United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 11

SEQ ID NO: 309 - DNA, 56785 bp, Homo sapiens
tgggattacaggcatgtgccaccaagcctgactaattttgtatttttagtagagacaggtttctccgtgttggtcaggctggtctccaactcccgacctcaggtgatctgcccgcctcagcctcccaaagtgctgggatcataggtgtgagcctctgtgcctggcctgataatggttttcattggtggggagagctggaggggtaaaaagaggtccatagataataaaggtgacttgtcatatattaggccattgtgttgttcattgtatgcattgtatcgtattatattcgttatattattccccatgagtttttatatgatttaaatatttcatttaaaaactgtgcaccatctggcctggcatgatggctcaagcttataatctcagcactttgggagcccgaggcaggaggatcactcaaggccagtagttccagactagcctgggcagcattgagagaccccatctcttgaaacaaaattagccaagtgggatggctggcacttgtagtcccagctacttgaaaggcagaggtgagaggatcacttgagcccaggagcttggatctgcagtgagccatgattgtgcccgtgcactccagcctgggtgacagagtgaggccatgtctccaaaaagcaaaacaaaacataactgtgcatcagtcaaggagcctgctctaccctccacaccagggcagacccaccaccaggctccatctccattttctatggactgtcttccctcctggcctggagccatgacccggcctgccgcttcagggaacaacaggtagttcaggatgactgagcccagaagtggcacgagaccagggatgtggctgaacagatgagtggtggccaaggcacagagggccttgtgtgccatgttggagaacttgggctgtgtatgaagagaggagtcactgggacagatcagtggcttggtgacagggagacagggtggcattggaggcatacaagagacagtgaggtgggctctgcaacaaagggagggatgtgcaaaaggagttggtcaagagaaatggggacagatctagccccatggccgatctgctgtaggatggcagccagttccagctggaggtggagttttcctgggtaaaaatggaagcagccggcaattgctatttataaaaataactacaaagacttgacaacccagagagaatgctgaaaaagtaaattgagggctgttgggaaaatgctcagtgtttctcatcttcaaagcatttccgagacatgagctcatgaatcctttctccgtggccctgagaaaaatatagaaaaagaaggtgggacaaagcatgggtgccttccccaaagcagcagaatctggctgctggagatgttatcatgggatgcccctcaaatgaccactccttcgatctgccccaactctgttcctcagacccagcctggttaagggcttggctatgaagcagcaaagggtgaggcaggcagagttggcaggctatgacagcagctgtgctgggggtcactgcaagccccagggggctgcttagatcctagtgatgaaggcaagaaaatggccagggggcagcctgggctactgatcaggggtcacactgaccccacagccctggctgaggcacatgggacttaatcgtgaaattggtacaggcaacagctgcaatgcaagcttgggcaaggaagagggtttgaacccagacaaggcaatagggagggaatgaagggcagagagcagacaggaagtgtatgccaccttgtcacctggaataagaactacctgctacaagtgctaggaaccaggcacttgagctcccattgtcatgacccccaaaagcccaaagcatggaggctcttatcactctttcacagagaaagaaactgggaaggccaggtgtggtggctcacacctgtaatcccaacactttgggaggccaaggcaggaggatcacttgaggccaggtgttcaagaccagtctgggcaacaaagtgagaccctacatctacaaaaaataaaaaataaaaattagacaggcatggtggcttgcacatgtagtcttagctcctctggagggtgaggtgggagaattgcttgcccaagaggtcaaggctgcaataagctatgttctcaccactgcactccagcctggacagcagagcaagaccctgcctcaaagacagagagaaaaagagagagagagacagagacagacggaagatttcttttagggagagtatctcgcacagcagcagtaacgggatttgcattcatctcctcacccccagcatgcccccactcattcttcaagtttcgactcaagatccccgcctctggaagccttcccaggctgccctcagagggaaagagcagtttgcttttctgtgcccagcagtccagagctggccctgtgagagcaccatggtgctgagctgtaagggctcattgcttctctcccactggacggtgccctgagaaggaccagcggaacttcggcttcccttgctgttgccccagtcctggcagcaatcagcttcctctgctttcttgtcgtttcagctccccaggacctggtgcaccccatgtctcctgcagggtgaccgctggctggcaaagcctgtccctgtgttgttaagtcggattccccagagggagaagcagacgggccagcagcttgggtcaggtaggcaaccccgcgtcagaggggagggtggcccaacccacaagtgcagtgacccatgggcccagaacaaagacacactttacccacacccaggcatgtgacagagtggactgggcatctaagtccactggggaaacagcaggaaacagaacagatggttcggcttgcattccggtggggagttggacaacacacgagcagatccataaagtgatatccgagagtgatctgtgccgccaagaaaggaagacaggtcctgcgacagggctgactgtggagcctccttagccaggctggacagggatgcctctcccaggagcccgcactggagactagtgtgtcccaccagacttccacgtggcctgcgagtgctcagcaatagtgacaacagggtctctactccatgaaaaaccatccccagacccgaaagcactgctttcatttcatggttctgcacattttctccagcctctgcagtgaaagattatttcattgccttcaacagaaggcgtatttgtgtgtgtacatatgcttgagagaaatttactgaaaagatgtgggtacgagaccagctggctgcacttgccacgccaggatcctctctcagcaatatgcccaagagctcgtgtttgcaatgctcgagtcccagccaggggagaaatgggtgtaagggacccacaggggaacaatttgtgttgacttggagctccacatgctccttcaaaggaagggagaaccttggaaggaggaaaggactgaagactttccagggaaattcaagagtctcaggcaattagtcagatccagaatatagatccaatattcagaagcagaagagggaaatgcaattatttgggggtctctctcttctagtctccttctgaaaagcccttttctaagacctcaattcctatgtctactcaatgggtatgattcctatcactttctcgtaagtacattttccttcaaagtttaaaaattttgtagatcttcaagtgcgtaaggcatagtagtgctaaacagaggtggaagtagtgaagggagttttgaacgtaaaaacataaatcgagagatgatgaacatgtttacttcttccttcacctctctccccccacccctttttctcttcttttttccgtcagtttctctttatggttaatacaaaagggacaggcttttgccaagatccgattcttcatgggacaccatgggcctcaggggtggggcagaggcaaaagacatctccccttgctggccattctagcattcaggaccagctacataatttggggagcccagtacaaaatgaaaatgcagggccccttgtgtaaactaattaagtgggaggatcgcttgaactcgggaggcagaggttacagtgagccaagattgcaccactgccctccagcctgggcaacagagtatgactccatctggaaaaaaaaaaaagaaaaagaaaaaaaagaaaaggaaaggaaagaaagtctgagacagtggcagggctcttgtgagtgtggggccccatatgcctgcactgggtgcacccccaggaagctggccctgcccatagttatgagtgtagatgtgggttacccaggagcttttctgtgggcccctgggtggtggatacaccttttgtctgattactaggccacagcttcttggaacctctctcagttcccccatggctgactttgccattgacttgagtctttttttttttttttttttttgagacagagtcttgctctgtcacccaggctggagtgcagtggcgcaatcttggctcactgcaacctccacctcccgggttcaagcaattctcctgcctcagcctcccgagtagctgagattacaggcgtgcgccaccatacccagctaattttgttgttgttgttgtatttttagtagagatggagttttgccatgttgcccagcctggtctcgaactcctgacctaaggtgatccacctgtctcggcctcccaaagtgctgggattataggcatgagccaccgcacctggccaacttgagtctttaaaaggaggatgtgcctgatacgtattagctgatacctcttcccggctcctgcttcccggtcccttctccgagctggttcgttctgctctccctagggggtcttcagcaccaagggagtgggggcacaaataggggtctgagtaagctgaaattgcaggcaggaatcagaagcagaatttttatcttaaatcagagcaaaaggaataaagcggacagttcctaaaatgcctgtgtttctagagtttagaatctcagtttatgttccttctggcaaaccatatacaaaggattcttgcagaaccactgttccttaccaagctgtgtcaggctgaaatcaccattacgctcatgtatattttaagtcatttcccccactaaggagcaccacacaccccacctccgtgaacatcccatcctcactgcccagggctgacctctttaaatggggactgggggtttgttttcaatctaatgtctccagctgaggtgggcgagtgcttggtttcaggcaatggagcaggtgaagggaggcctttggcattcactctttctcaatagaggtaagattttcttactattttcccaacgcctctggataattatttgctactttcaaaggaatgaggctcatatttcagaggaaatcgccatctcactcttacttcatgtggctgtccttaccacgtgactaggtccgcatccagtgtgttttgagcccccaggtgctgcctgagcccctgttttatgaaaaacaaattgttgaaaggagagaaagtgaagaacagttgaagagaggaagagcggcagaaacagctgccactgagtagggattggtgagtagctacttcataaaccctgtaacaggctttcgagtcagcactgttcctgctctacccaaacccagtctccccaccttcattgctgggaaagccccgatgtttcctatgaaagcagttttttaaaattgaagtatagtattgtgtttctcgaactttaacgtgtgagtgtattgcctggcaatgttgttaaagtgcagcttctgattcagtaggtgctgggacctcggttctgcatttctaacaagctcctgggtgatgttaatgctgctgggccgtggaccacactttgagcctcaaatatacctacagaaaagttcacgaatcatgcccacagcttaatggtcaacacacccaagtacccatgactcagattaagaaacagagaacattccttgtatcccagaagctgccctcctgcccctttccaatcactaccctcatccacctcccctaaggtgacaacactcctgagctctatgccatagactagtatggcttgtttttgcacttaatcttagccaaaaggctgagaagtgagatgtgtggcttctttctaaactttacatagtatgtgttctttggggtaaagtcttgaacttgatcagctgtccaacctccccaaggccaggggctcaaggaaagccacatcctccccaggctcagagtgtgattgctgtaagccaagcgtgggtgctgccccggcctcgtcagtgactggtttagacatggcatgaggtgcaattctggctagtgaggaaagtctgctgggagcttttgggaaagttttccttgttgatgaaaagatgcacagaacaaaacactctttggtttttgtttgaggttgttgttcccagaatagtggcagtcagcttacaatcatgaagggaaacagctgaggtctccagtcaacatctgaggatgggaaggtgaaatggagtgggaatgggcccaggtcagggaggcactcacctagggcacaaagtttgaggggtgcccaaaatctcaatctcagtagtcaagattttctatatatatattagagacagtatctcactctgtcacccaggctggtgtacagtggtgcaatcatagctcactgcagattcgaactccagggctccagaaatcttcccaccttggcctcccaaatagctgggactataggtgtgcactaccacacctggctaattttttatcttttttgtaaagatgggggtttccctatgatgcccaggccagtctcaaactcctgacctcaagcaatcctcccaccacagcctcccaaagtgctaggattataggtatgaaccaccgtgcccagcctagaattaacagttttaaaaataaaataatgcaaatatccaaaatttttaaaaatatcaaaattttaaataaacacagggttactaacagtgccatgctgagtgatactgaagcccagtgcaaaaaaagaaaatcagtaatgctgattgtctttacttaaaattttgatattttattcccaactttttttttttttgagacggagtttccctcttgttacccaggctggagtacaatggcgcaatctcggctcaccgcaacctctgcctcccaggttcaagtgattctcctgcctcagcctccctagtagctgggattacagacatgtgccaccacgcccagctaattttgtatttttgagacagggtttctccatgttggtcaggctggtcttgaactcctgacctcagatgatccgcccacctcggcctcccaaagtgctgggattacaggcatgagccaccatgcccagcctattcccagtcaactttttgcattaattttcatttttaaaatattgtcataaatattatttatcttgctgactgaatttttttggacgcctgaaatttcgtgccagccttgtcccaaccctgagtgaaaaagtgaaaactctggaactattttacctccagattttcattttgtgaaataatagttcttattgtttaagttattttttgttgggttttctgtttcttgcagttcaaagtataatagtcaatgtaagatcaattatctacaagtgcagaaacccaattcaaactggcttaaataatgaggaaagtactagctcatatttcagagaatgcagagtagtatgggctctggctttgtctcccttctgttctatcagtattttctccataaccttcaggtttgtctgaaggtcagggttgtataataaagaatttgtctggtcctgtctcaggttcctggcccagagcttcttaaaatctttagaatttcccaggggataggagtgtttttgttattcatgagctccatggattacacctgagtttatgctgagatggctcaggattaagactggtcaccagaaagaccaaccacgtaattagagggttggggttttgaaccagccctgcctccaaggagggaaggacagctggagattgagttccaccacatggccaatgttcagtcatgccaatggaatggcactctgataaaaactctggatgttgaagctcagtggatctcctggttaatgaacacactgatgcactgggagagtgatatggcccaattccatggggagagagcccagaagctctgcattctagaagctcttaggtcttgtcctatgctcttgattgatattctttattataaaactataatcataatgtaggctttcctgagttctgtgagtcattctagtaaattattgaacctgagagggattgtgggaacacccagatttgtagccagctggtcagaaatgctggtggtctgagaccccaccttgtggttggcatttgaagtgaaacagtcttgtaggggaccgtgccctttaacgtgtggagtctccactaacgccgggtatttgtatttgcatctggggaatcatattacagtacaccagttggtgtcagaacagttggtatcagaagagtcagcctcgtccagagtcacagaagggctgccagcagcaacatacctactagtctatttccagcaagagagatagaagagcctttccccaaaatatggaattgatgaccattccttcagtcttattgtgcccgcttatgtcatcctagacctaagacaatcaccaggagaatgtcacataatgattggtttaagcccagattcttaaaccaagcacaggggattattgtgattggctaatcaatcttcccatcctgcccacaagaacctagaaatggggtcattgacccttggcccatgttagctattttgaggagtggtaaataattaaacaaagctgacgttctgttagaaagggaactgggggccagctgtggtggctcaagcctgtaatcccaacactttgggaggccacgttgggaggattgtttcaggccaggaattgagaccagcctgggcgacatagcaagaccccatttctacaaaaagttagaaaaaataagccagtatagtggcacacaccagtagtcccagttacctaggaggggatacgtggacatatcacttgaaaacaggaggtaaaggctgtagtgagctatgatcgtaccacagcactccagcctgggcaacagagcaagatcctgtttctaaaaaaaaaaaaggaaaaggaaaagaagaaaagaaagggaagggaaaataaataatggaagttagaaagaccaccaacagtctagcaccatatataagagagaatggccttgatttgaatcctaagttcaatacttaccagctgcgggaagagactctgttttctcatctgtaaaaaagaggtaacagtgtctacttgatgtaagtgcttatgagggttaaatgaaaatgcatggtgtctgatatacagcaggtaaataattaaatgcatagtgtctaacatacagtaactgcataactaaatgcatagtatttgacacatcataggcacacaaatatagttctttcacccagtctcctttagacactgagttcctggggggtgagtgcagtgcttgccgggcatggtgcttggcacatggtgggcctttaacagatacttattaaaggaataaggcaagagaacatccctctgaataactggaaccttttccttctccctaatactaaggattatgcaactgtgtggcccattcttcctttgacactaggaacattttagctaactgaatttgaatttcagctataacaattagttggccttcctagactacacatctatgctcctctgtatctaatcgtgactctctactcctagttttctcaggcctaattctctacttctttgtttttgttttcccagcatcattttgttgtaagtatccctgctataagccatctttgtggaaagagatggcgcaaaaacagacgagtagacaaaccaaatgctttataaaaaagccatcgaagacacgtcaaggaagccactttccaccatttattaaataaattctttcccaggccggtctgagtcgcacccagactttacatcaggctttgttccaggtgggtgggggtgccaaagggaatactgcggcctgaaagacatccaaggaaaaaggcttcttttagaggcaagtccacattacacagttggcaatgctaagctgaacgtcctcccagcttccagggggaaatgaaagacattccccccatagctttgctttcaagctcttacagctggcagggcaggagagccaagttccgccttttcaatgcaggttgtcacttgggtgccaggatctgctgatcaattagccaaacatccaacgtgagaaaaaggcccagcacacatctttttgcttaactgtcattaaatgctccatttaaccccaaagaacctgactttctctttttttcatctgctatagcccaagaacaccattactaaagaatttttcttgaaaaattacaaagggaagcaaaagaaagaaacatgatttctgagcagacctctccttcgcagttctgcacctgaggctctttgttcttcatgggatctgaggtctgggagggaacttggggattctcgagagtcacctcattgtacagattgagaagcagatgccctgagaggtacagtgactcacccaaagtcacacagctggttaagggcaaggggagggctagacccacatctcctgacttttaattcactcactaaaccacatgcttctccagtaccgtacacttagccacaaactctttgaagagattgaataattcaaacagatgacgcccttgtagaaggacaaagtgcggggcagcctcacttctatgtaaaccaacaacccaaatagcataatgaaagagcccagtttatttttcttgtcactcaaattaaaatcatttacaggcagacattccctaactcacaaataagctgtgtcctaacagtgtgtttggaatttgctatttagaacccaggatgtgttttcttcctgggaaatcacatgatcgagtgtggtcagaaccccaggccaggtcacaaagggcgacttaaccaataagtaaccaccgtggagtcgaaggaacccttcatcatattgtctccatgaaaaaacacattccaggtttcaagtaggaatagtggaaacgcagctatcccaccaaggtcccagtgcaaagatgtccctcccaggcgcctggtggggagctgggaggttaggctaggtaagagctaggaagccgtgcagaattgtgaactggacatgcgctttgggtggagacagaacaggtttccactccactacttaatagctgggcaagttccttaacctctctgatcctctgaaaaatgaggatggcaacaatacctcactggtaaattataaggacaaaagaagacaatgtctgttaagaacctatttccgtgtctcgcatgtgtcaacaggctatcatttattattgtggttgcttgggaggagaaggacgggctctggtggtttggagagctgggatgctccatttgaggaggcagcatctggggtgaggaaaggctcttgccatagcctgatgggcagggggcagtgaggggaccctgggttcttaccccccatccctgcgccttaggcagtagaagtggcagcagctgtggttccacccctgtctgggaggaggcggcaaggccctggtggggcccacagtggccactccaagcagcctggttgttgagagggtcgcccttggcagtgctggctcataagcagcttcagccttcccctgccctctgtcatcattcctccccatccccgggggacgtccctggcagctcccacagtgcttctcggccctttcaagtctcatttcagtgacttaaaatgtccaagacagtgtaacatcaaactttaaattttgttaagttcagtctcctcccacaatctgaggcttgctccaggcttagaagcggcctgaggaggagtcgggggtctgtgttgctagtctcttctctctcctggctctacttccagcccccattctcactagctgggtttcagaccatctgaggctaggcccagagggagaagggagggagttgagcacagcagtgtgatctggcatgggtcctctgggtgtctgatgcatgggtgttagctctgtccccaggcccatggctccagagcccctcaaagcccctcacacctgtcttgaggtaggaaggaagtgccagaatcttcccccagaaatatggtgctcacctgacccagtttgcctgggactaaggggtttcccgggatgcaagacttccattgctaaagccgggagagtcccaggcaaaccagcaggaaacagtcacctgacccaagggcggcgggcacatcatgacactcagctctctcccaaataacccttttctcatgactcttcggcccaagtgaccagtgggctagagctggcaggccaggtttacaccttcctggcaggtcctgcacaggcagcctacctcatgctagtaggcagattctcggaatcttctaaatggttgtctctggggcccctgcctaaagtaagactcatcctcgaatatggactagagggatttgcagtgccgtggagaatcctgagctgaaaggttcactgcatgcttaggaacatctcagcagggactgagatgctgtacagtatggtgtaggctgtggcctgggttgaaatcttagttcagcccctcattaccttggactttgttacctttaacacccctgcgtctcatttcctcacatatgaaatggatggatgatggcccctacctcacagagttatctgcagcactatgagaattaactcatgtcacacattgcctgggacatggtaactccgcaatagatgttaactcctagcaacgtttttatagcaagccaggattgtgtaataaagacttgaatatatttaataagtttcaaatctactgcaggcatattttcttaagttattttcttcgttttaaagcacattgaagagccagtgttggcaaaggcaccagagacaggccatgcactcatgctgatggtgggagcgtaaatttatagtctctctggaaggtcatttagcgataggtttcaaaagccctaaaaatgcttttgacccagcaattccacttctaggaatttatcctgaggaaataattggaaaactggctaaagattaatgtgcaagatggttcattgcagtatacttaaaacagaaaaacatttgaagctgtctgaatgtcttagacgatcagaaaaatttttgttcatgcgtatagtgaaatactatgcaactattaaaaattatgtcacgatctatatttgtcgacatgggagggtgtttatgatatatatagtatacttatatagagagtgtacattttaaaatcatgtatattccaggattttttctgagcatgcgatttagtatttagctgagatcaaaatgtatatacaatactgtattttgcttttgttttgcttaatgttatgtaagagtcattttgtaccatatatcaaaccttctataaacttcaatagtaataatatccatcaagttgatgttcccaatttaaataaccaatcatttattgttggagcaacttattccaaaaatgttttaagaggtcgggtgcggtggctcacccgtaatcctagcactttgggaggccaacatgagcagatcacttgaggtcaggagttcgaaaccagcctggccaacatggtgaaactccgtctctactaaaaatacaaaaaaattagccgggcatggtggtgcctataatcccagctactcgggaggctgaggcaggagaattgcttgaaccttggaggtggaggttgcagtgagctgagatcgcatcactgcactccagcctgggcgacagagcaagactgtctcaaaaaaaaaacaaactaaaaatgttttaaggaatatattgttaacaccatctttgtgcctaatacctttttcattttcaggagcattttcttaaaattaatatatgtaaattaaattactcaaactataggaatatgcatgtatttgagggggacataaatatttttagggcttgcaatacatattgacaaactgctttccaacaagttataccaatttatcccaagaattgatttggaaattggatgcttgtccacttttctctgcaaagaaagaagattccactgtacatatgatgtcttccacagatttattgtgcaaactgaacggatcacccttagagtatctatctgatcctcttgcccttatgaagtctcacacttcctgatgaaactgttcaccaaattgccacagaaatggaaagaaaggggaaaaaaagcaaagaaaaaggactccagggtaatgaaacccctacacatactcaccaatagatcagtctatgtggcaaaaaagtaatttgattatgcaatatgcaactcaatacatttcagcaattttcaagtgcatttgaactgctcttgagaatgcctttatttcaaaattattaactatacaaaaatcaagcgtgttgagaagaaaacatcctagtagaagtctcagacaaaaactgaaagataaaagactggaagaagttacaaaatgtcaaaaactcttttgttctatcacaacagaagctaaaaagcctgatagacaaaagcatgaaattgagaagaagaatcataatagctaagaaaatataaataataaagatgagaagagagaataattataaaaatcagatcatgccaaagtagtacttgattaagaggaagagataaatttggagcataattgtttgaataacccaatttaatgaaggggagtgaatcatatgaatatgttgaaagaaggatttgcagtcttggtgatttgatcacaaaatacagacatcgacaacaataacatgaaccctactactaggattagttactactagggttagtgcctactaacatgtagccactactacaaggacatcaaccaaaaagaataggaaaaaaatatagcccaaaatgtagaaaaaaagcatactatagtgatatgtccaagttaaccaatacaaatattgttatgcttctagattctgcgatgtatgcagtatttgttagcttttcaggatgtgcgatttgttgtgatttctcctaaattaatattcacattgatgcctaattttgtcttcataatttgatattctttttcttacaatgaactccagttcctataagcctcaggttcccagaaacctacatctgccctgctgttaacactgagtgcctgtaaatgttcttagagaagattctaagtccagctcagctgatctccatcatcatacctggcatgttttataacaagaagggttaccacagctaaagtactcttgggaaggattatgcaatgccagaaagattctctcttcataagtcccataggtgaaagaggggtcaattcactgaagctgtcaacattcaacattcagacatggccaggcacagtggctcacacctataatcccaacactttggaaggacaagctgggaggatcacttgaggccaggagttggagaccagcctgggcaacataacaagacccaattttcttcttttttgtctgtacaaagaaaaaaataaaaattagccaggtgtggtggtatgcacctgtagtcccagctacttgggaggctgaggcaggagggatcacatgacctcaagagtttgaggctgcagtgggctatgatcacaccactgcactccagcctgggcacctgagaccctgtctcaaaaaaacaacacagtcagatatttactgagcatctactatatatgccatgaactggggacacaaacaaatgctaagatgctagtgagaaagacagctctgcaaagaagccatcagtttgggaaccactgctactcagctgagcacactcttgaagcaactctcctttcacccactgtcttttccacctagctccaggacctgcttccttccccatctaagacatgccgtcttaggcagacatcataggtctctttaagtcacaagaagagtagttgtatgtctgtgtctgatccaagtaataatcaaaatgttcaatttcatttaaagttaaagcgtctcgtctctggctcggaagcctgaagtgatggagatggtcatctcctcctcctgtcccctcccttcttccacctcccactccctatcctgatgaggcattgaggtgggggaccaggatgacagagcagaaatgatcttacttgactgcttcagttgtgagctgccattggggtttctagggctgacttttctttggggtgcttttgtgggtttcttggagaagccacttgaatttctgctataaagctcccaacttagggttgccagataaaaatacagaatgtccaattaaatttgaagtttagatagataaaaataaaaaaagatctagtgtatgtcccaaatatttcatttaacatatactaaaaacatacatgttgtttacctgacattcaaatttaaacgagtatcttgtatatttatttgtaaaatctggcaaccctatctcaactacacttttcattatgaggttgggatgtgtgtagttgtggggcagggtctcagcagcccttgggtctctggttttccagtggcccacatctctgttgggtccctttgcccttccaggcagcccacttgggtggagtcctattcaaaagggcccccatctggtccctgggagccacacaccttcaccccactgccctctggggcagggcaccactggccacggcagccctgacttctcagaccagtcctcacgtttccccaaacactgaaaggtgtggggagagctctccgtgcaacccttgtcacttccttgaggtgaggggaagcacttgctgccccaccccatggaagggcaacaggggtggtgggaacacacagccctcagcccaccctcttcaaggaaaccctccctgatgcctcgatctgaggctggaagtgcgcgaagggctgacaaaggaagttttccactcaccaagcttgtcctgggcagggtctcagcactgtgcggatgtgcggctccttgcactattttgttctgcctttgaggcctctgctgaaatgtctagataacaggaaaagtcccttttaccatccagttatactcccttgttacgagtgaagtccaaatggggcacaagggagcaggaagaagagtttatttggctgggcctaggggtaatcaggaaggggtgcagcgaagaggagccgcccctcactccgtgctgcacagacaacatgcttatgaatctccagggatcacgttaaacagcagatttggcttcagtaggtttggggtggggcctgagatcctgcatctcctacagctctcaggtgatgtcctcagatgcactttgagcacagaggggctagagggctgtgtaggaggggctgctaggccctcgggggaggtgggaaggaaggggcattgcaggccagggaacagcaaatgaaatgcagaggaagacctcaggtctggtaacactgcctccgcaggttccagtatgcggtcagaggctaagagggccacccacactcgtgggaggggaatgggggagctggcagtagatgaagttccaggggggtcctgactgtgcgtgaaaaagctggaacaggaaaagcaagctgagtgggttccactggcgtcagctcttgtaaaaacacttgacgagctagcctacatagttgtatttcacaaagccatgtgaacattaattactcagggcatctgatggctcgaccacagagtgcatgtgatggacacattcaagtcctgctttgcacaatgcccagctggcactggcaacagctgtagttcacatgactgtctcctgatgtgcacaggtggtatgagtcacctggaaaaggtttactgcctcagtgtaacatctgcagagggtcagcaaatcacatggcctaatctgcctgtgggtggcaagctagcggcctcctaaagatgtccactttctaatgcccagaactagtgaataggtgaccttacatggcaaacaaaagggcctttccagatgtgactcagttaaagactttgagatggggggactactcggggttgttcaggtgggtccaatctaatcacacgagtccttaaaagtagagaaccagccaggcgcgtggctcatgcctgtaatcccagcactttgggaggccaaggcgggtggcttgcttgctggtcatgtagaccagcctggccaacatggtgaaaccccatctctactaaaatacacaaattagctgggcgtggtggcgggtgcctgtagtcccagctactagggaggctgaggcaggagaactgcttgaacccaggaggcggaggttgcagtgagcccagatgacgtgactgcactccagcctgggcgacagagcaagactccgttccaaaacaaacaaaaaaaagtagagaaccttccccactcatggtctgagagagagagagaggtgaaaactgaggaaaggtagagaggtggcagcatgaggaggagccctgctgctggttctgggatatcagggttcatagacaaggataagagagaggcctccaggggggagctaagggatcccccccagtgacagccaacaaggaaatggggacttcagtcccacaaccttgtcgaactgaattctgccaactgacaagaaaatgcattctcccctagaatctccagaaaagaatgcattcttgtgtccaagtgaggctcatgtctgacctgcagaactgtataatgataaattatgttgtttgaaaccgctacatttgcggtaatttgttacagcagcaatagaaaacgaatcccctgcccagaatgacttcctcctttcctgtcggacgaaggctcaggccttctgctgaaagctcgctcccctaagtagtcacacccaatgccgaatactccccagaagcagctgctattttctgaggacaatgagttgcttgtaagcctgagaacaggacgaaaacccactttgcaagcagccctgcgtgtgacgggcatgccctcggagggcaggttggttttgctatctgctttctgtcctgcctttttccccccatgggtcctgtctggctcttttgctttctcactttgtgcagaaagccatctcaactcttctcacaggagaatagctgtatggacgtagcagggggagttaccacatgcctacctccatggttttcgagaggggcccctgcccaaatgtctcagtggccaccttcatcagaccatggagcagtcagagcgggaagggattctagagttggtccagtccaaccatctcatcttacatgtgaaggaggaaaggaagaaagggagaaaaataagaaagctgaggtcaaccctcctacagggatgggcctggccaacaggatcccaagggatgacataacattgaaattaagaaaccaaggaaagttgagaactaaagaaaacagaacccagtcagccaagaggcatccttgagggccaaccaagccgtcaaacctggatgcccccgacaagtcagaaagtcgggtgcctcaagagccaagcagccaagaaatggggtctggaactggcactttggtccgcctctgtgcactcacccagaaagggtggaagggaccctgggaccaagtgccaaggtcacacaacggatgaatagagctgctggacttcaaactgaaccatgccattttgccaaagcagtcatcaccttccgtgaatcataaatgtttgttcaaagccacaaatgtatatactctttgtatgtatacagattttttctaaaggttaacatctaaacagatcaattaaggtcagccttaatttgtctgagctttttggttaaagtttcctgagtaattgagcgaattcaagtttctggctttctcctttttctttctccatttaaaacatgatctcatgaaatttttgtcccaagaaaggcaggattacattttcttttaacagtttgagttggtgtagtgtattcttggttatcagaatactcatatagctttaggattttgaattggtaaatattcatgatgtgtgaaaaatcatgatacatactgtacaatctcagtgccataaaattggatgttgtgcctacacacgcacaggacctagaagagcatgtcaaactataaactgcctgtgattgtgaatgactttgttctttgcttcttgcgtttttcagtttcctataatgcacatcttaacttttaaaaaataaaggttattttaaaagccaaaaagaaaaaaaaagatctctaacctgttggctggttaaaatttgagaaaattagacaaatgcttacttttccctttttggctgacaaacaaaagcccagtgaggtatcctcatctgtagagatttatgtcctttgtggggggcctgcttctccctcaagatagagtaaaaaaaaaatcagtggtgtcacttgggctcaaaaggacagaagacttgacactggagtttgagggtcccagaggggctcagccacatagaccttcctgccccacccttcctaccacagccctttttaggagctgcccctacccccacaagactgtcctttgttgctgaactattaattacttaaatagtcattgatcacctaccctttgctaggcccaggagtcctgtgagatgggctcttcccttagtcctcattcccactggctattgacaccatcccccgctacacccccaattctactatccccttccagcccgacacaggacttgcctctctgagcctctgacctctgctttctcccagcatctattttggttcttcctccttggctcagtaagtacatggacaatcccagaccagccttaaaggcagccaccccccatgttggcctcagcctcaggggcaggggaggatcctggcctacaaatcatgcactcagagctacagtccagtctctgcaaggactggcagcagacggcgctcaccctgggagaccgagtccagacacctgttccctggcacagcagaagccctccacccaggccctggaatgacagccctgactgatctcctgaaagtgagctctcctgaaagtgagctcaggctgtccatcttccctgaagtccagtccatcccttgcaaagccagtttccgctatcccatcatgattaatgctgaagctctctttccaacctttgaaatgccttttcatgccatgcatttagagaaagggctctgccatctgcagaggacctgtgcggaaatgtggggaaatgaccgtgtgtttatttatgtcatccattgttagctaagaatatccaggtgttctaataatggaggtaccaagaaaggaaacagtgttggatggtgggaaggacgctgggctcggggcaggaaaacaagtcccacagcccaagctgagtgaccttcagcaagtttttgttctttagcctcagtttcttcctctgcagaaaaaaaaaaaaatgagtctacagtacttgctatgctgacctcaaagggatataacaagaatccaatgaaaggatgtatgtgcatcccaaatttgctcaggcccagcaccagagggacaaatgaatccacattaacagatgtcactggggcctcccacctgctgacacaggcctccagcacttccccatagaagtttcactgaaatatttttcagagtgcctaggtgtgtctcaggaggaccccatgcaaccttctttctcggttcactgcctgagaagactctccctatagccactatgtcccaagcaggggctgaatctcagggctctcaaagctgcaaaagacaagaggtgtcaaaatggtctgtcccctctcggaatgcacccccacctcctgacagagggacacctggaggctgggtcatgctcgggaatgtccacgctgcaggttagttcaggagaacatccctacgcagagggcagggcccaggctgaggggtttattcaggttgccactggatccacccagctgcctggagacagggattgtcctcatttgaccaagtcacacagctagtagtagtaggtggtggaaccctgtggtggacattggtcattctggctgcttagcatctaggtatacttattctatgctttcttgcagaagttgtgcagttttcaatcttatatttaggtctatggtccaacctgagttaatctttgtatatgatgtcaggttagcatcaaggttctttttctttgtattggatgtccacttgtggatatacagtacttcttatttgggaggaacatcagggtaagtgttccatttgcccgctacagaagattccattgcccagtacagaaaccaagctgaaggggaagctttccgctctctagttgcttaaaggtttcaccctttaggcagacaagccaaagcacatggtcatttagggattagatgaggtggctgtgaacagcagtgacaagtgcccctcccaagtcggtggctctcaaggtggcctctggactgtgcctgtcctcctctacgtcttgcccccgccaaggcctcccagcggccccatgatgccatgcgcttcccactgctcctcacgtaaattccttctctgctaaagttaaccagaaacagtttgtgtttgcaaccaaatttgcagctgctacaaggcagaattcaaactctgacaatgtcttgctaaaaaacccatgtgctttctaaaataccgttcttggtgcactgttaaagcttatgtacatataagacataattattattacaatgcattaaattggatgatatcctagtgagataggtggcagggtggtggtaatcacggaaaaaagaaagctcaaaccatcaaggctagatgctgtcaagctacaggctcacagaaagctttgggaggaaaagagctacacgagtcaggaaaacagcagattaaataggaagcacccagctgggtaatgcgattccaccgcctcttttccaaagaactaaattcagctgtggcttaaaaaaaaaattcctgtatggtttgtgggtggtcatagtcatgaaacctagaattttaaagccaggaaggaccttaaaaatcatctgaccttcagacccgcctgggttttataaaagaaaatcatctattgtactggcctcatttcctagataaggagactggttcccagttaggttgcaagacttaggaaacatcacatgcaaggcagtgacagagccagactacagggaggctttctctttaccttcacccttcggaaaagggtggtgaacacagtccaaaaagtcagaggggaaccgctcttacacagtgggaaactagacattagtttaagtaagaaatcaaattgcatgttatgccagtcttgtcatctctgtgaagtcactgattcattctcaaaaccatcaccctgagatatacccactctttcctgtgtttctactggggaactatccaggtaaacctctcctcccaaggtcctctagagtgttcctgaggcccatacttaaataaagcatttgagggccaggatgtacttgaagttcttcttcaaagtatgtgtttttctgcagtttacacaggctgtcgtacatgtatcacctgggaggagtgataggctgtggcgttatctcagtgctatggttttagcttatagacagtcattcccattagcccctagggaaaagggatgctgaagaaattcaacagaagacctaaagtttctatcgaggcattttcacacaatcagcctacactctgagtacaatttagggaaaagctttccttctccaaaatgcattttcttaagaggctctggaagttaggggagatgttagagacagctgaccaccttcccctgtgaaggggcctcctctccagccgatcctccccagcagcctgagcttcctagtcaatcagagagctgtggccccccacagcagcaaagtgatgtaagcctcagggagaatgagatcgctcagtttgtagtgatgtggaaagttctccaaggttcattggggatgcaaaagtgtgataatttgatcacataggtgtaaaaaataaacatatatgatttagcaaaatacatagacaacttccaaaaggagacacatgaaaccattaacagtgtttgctcctgaagagcaggactggaatatcaaggagggaggggatatttttgctttttgcttaaaacatttctgtaatgtttaccttaatggcaataacaagaacgatgaatacaggttacctttataattaaaagtagaaactattttttttaatccggtttccagtttccagagcattagccctcagacctgggtgggtggggctcaaacatccatatctcagtaagttcttctgatgattctagtgtgcggccagagttgaaaaccaccgggtcaaggcattgagggtccctggtaatgtaggaagtgggaaaggaggtaatgtatgaagtgttatggtgttatcttaatatgaatctctctgtcaggttagcttctggggagaaagaggtgctggcaaaattcagcagaagagctaagcagtgtgtttcctgggatagaagtgggttcctcaggtaggcatctcagggggcagccagagggcacttgggttgatgcccaggaagcggagaagagaaagcaagagaaggcagttcaggcccacggagcaggcctccgaggccccctatgtccccagaaccattggctccatagcctctgttctccccaccacaaagcaaggacttgtaatgtaggaacccacaggcagtttgaatatttgttgtatttggaagcctccaaattctgtttaaaaataattctgggtttctttcaaaaggcaggttggggagaaacatctggaataaaataaacccgcagaccacttgcacagaccaaaagggaaagaaaaaacatcccactccaaattacgttattcccaaaagagccaggaaagacatgaatgggggaaggaagagtaaaaaacaaacctctaaatgatgttaagagagggtggggaaaaccagggtggaggtcggtctgacagtactttgctctcacattttggaaagaaagaagttccattttagtaattttgagtctttctcaaaaaagtaatttttctgtacagttctaaatgatacacttgagtcaattctgaggagcttcacacacaactggtatctacattcccctcatccccatagacctggctaaagagtcagtgtcctggcagggcacggtggctcacacctgtaatcccagcactttgggaggcccaggcgggcggatcacgaggtcaggagatcgagaccatcctggctaacactgtgaaaccccgtctctattaagaaatacaaaaaattagccgggcatggtggtgggcgcctgtagtcccagctactcgggaggctaaggcagcagaatggtgtgaacccgggaggcggagcttgcagtgagctgagatggcgccactgcactccagcctgggcaacagagcaagactctgtctcaaaaaagagtctgtgtcctaccccactaataatggttgtcctctcagggaaagcatgtttctgacagacattgttctcagcagcagggctggtgtctgcatgttccatgtactgagttgaaaaggagctggcatccgcaagatctctttcagaagggctgatgaaggccttccagatcatcagctgcaattcccattgcaaatcagttcatcttaggaaatgtctgccgtggggacaaatctttactgagagccaacatctcaatggctcatgttgactcctttaggatagctaggggagccgagcattgctcccctagcattgctaagcatctagtagggaccctgtagaagtgatgtctcttattcttgctcagtcctgtgaagtcatttttactgtccacatttcacagatgaggaagttgagtcctctatgatagctaggggagccgggcattgctcccctagcattgctgagcatctagtagggaccctgtagaagtgatgtctcttattcttgctcagtcctgtgaagtcatttttaatgtccacatttcacagatgaggaagttgagtcccagggagtctgggctccagaatcaggcaaatctagctcctctactcagcagtagtgacttcaggcaagttacttaactctctgtgtctcgggtccctcctctttaaagtggagagaacaatgaaacctctctcatagtaacagagaagattgagagaatgcctctcaaagcatttagcagacaaatatgcaaccaataaatattaggtgctattgttattgatgttgtaatgatttaaagggttaaatagctcacttgaattaagtaattcagcactgtaataaagtgctgaagctgggatttttgttgttgtcttagccccagcacaaactctcattactcagcactgtgtctctaagctgaggatgaaagacagagacacagacgtcagacagaggcacctgtcctcttccctcaagggacagcaaagtagctaagggtatagattaggtagatgttgccttctggacacaaggtttattttgtggcttattagagagtgggactgactgtctgtcacctgctgtaacacaggtctaggatgaggcccaggagaattctgctgaccatgcagcaggcagggccagaagctgggaacaggctggcaagggctggagaaactgggcaccacaggcactggtgcagggaggggacacaaggtctgggcaccgtgtctgtgggctcaaaaggctgacagtttggaaccatctgggggatgtggtcagccaagcaggctgttgggggaagtgcccaagtcagcaggctgcagctgaactcaaaggaacctgacatggatctggcagccaacgggtgacctgcaggtgtggaaagtgggatcctgggttctagggtcccttggggaggtcactggctatcagtaatttactggtagccctggccattcctagtctttcctagtgagggtgtgtgtaaagaacccacaggaaggccgggcgcggtggctcatgcctataatcccagcactttgggaggccgatgtgggtggatcacctgaggtcaggagttcaagactagcctggccaatatggtgaaaccctgtctctactaaaaatacaaaaaaattagccaggcatggtggtgcatgcctgtaatcccagctacttgggaggctgaggcaggagaattacttgaacccaggaggtggaggttgcagtgagctgagattgcgccactgcactctagcctggcaacagagtgagactccatctcaaaggaaaaaaaagaactcacaggaaaataggagtcaagcactatcattgctatgctaggcactttgcacgtcccatctcagttcccacaacaggcccatgtggtagctattctcattccccaggttatcaaggaggaaactgaggctcatacaagttaagaaatttgctcaaggtcagcgttagagtgtctaataagctaaataaatgtctgcttaggatacctgcaaagcaagagcacctaaaaatttgcttctgaaataattttaaaattgatttttctaagactgcatcaagggaatcattgctggaaaaagaactttgttgaatttccttacaattatttttatgccctaaacagaatggaaagggataggtggaaaaaagctttctcctcacttttctctctttttatagtgagggaatgaggtgattgggaggaagagggaggattcttttcaagaagtcctcagaaaatgtcctccaacatcccattggctaggactgggtcgcacacacccctagaccagtcactggcaaagagaaaccacattgtgttgattgtcttacaacaagcacagtgtgtactgtggtgctgggcaaatggccacatcaacaacactgggttctgttagcaagaagaaagggccaacataatggtggttgagtaggctatggatggagctatcgcaacccttcaggtgctcccaaatcccagagaagctaggaaagcacagacgtttcatttaccaaatggttaccttgggtttgggatttatttactacaggttttcaagaagagaatatcaattgacccttatggagacttgaatcccatgacacagtattattattattattattgttttgaggtagggtctcactcctgtcacccaggctggagtgcagtggtgtgatcatggctcactgcagcctcaaccccccaggctcaggtgatcacctcaggtgatcagcttcttaagtagctgggactacaggcatgtgccactatgcttggataattttttgtatttttaacgaaaatacattggttttgccatgttgcccaggctggtctcgaactcctcagctcaagcagtctgcccgcctcagcctcccaaagtgctgggattacaggcatgagccactgcacctggccagacacagtattattagaactatgtatgttctaaccaaagcttccccccaattctgtcccctctttctatttctctcaccttctttaatcagctaagtgccttgtcacctgtcttcatttaaagtccccacttcccactccctcctcgactccctgacatctggcttccacctcagtttctcccttgaaactgtctggcaaaggtcatgaatgaatattaagttccccactcccttgcacacttttacactcaccgcttactcagctttgtgacacatggcactgtcaaccccttcacagtcttccaagactctcccccttggtgcctggggccctactctctcctcaccttcttctgagctctctggctgctcagtctccaggctggtttaccacaggggcctattcccaaatgttggggcttattcccagggttcttccctttacttcctttcttctctctccagacactatccttacgacatgcactaccatctcagatctctaattccagtgcaggctggagacctgagctgcagatctgtatgtttaattgacttttggatagaatttcacaggcttctcaagttcaattacttgtatttatttatttagaaacagggtcttgctctgttgccaggctggagtgtagtggcaccatcatagcccactgcagcctcaaatcctcaggcagtcctctaacttctgcctcccaagtagctaggactggaagcacatactaccatgcctggttatttttttttttttttgtagagatggtttttatatgtttcccagactggtttcatattcctgatcctcctgtctcggactcccaaaatgctgggattgctggtgttagtcactacgcccggctcaacttctgctaaatggactaatcatactctcttacttgccttttctcttgtgcctcctcatcttggtgactggcactaccagctaaccagccacttggccaagccagaaacctgggttccgccatgcaatagatagatcaagtcatattgtttctatttacctggtgtctcaggtatctctgttctcttgtatatccacaacttccacccagactcaaacatatatcataactctctgggtcattacaagggtctgaaactgatcctccacctttatgttcaccctagcccccagcctatgtgtcaccatcatgatggtggtctttataaaatatggagatgatcatttctccactctttagaagccttctatggctcttctctgatgccaacacataattcatgacatagaaatgcaaaggcagcccgtcttttcagccatattggcttaggctctctccactctagctggagacagaaagacattacattgcattttaataggtaaaatgttttacctttaataacttgggttgcttgcatttttataactctctttgatttgtccagctccattttgggagaccattatgtaatgatgtgactaagcttcagtctgaaacactgtgtgtctgatttgaattgttgaaacctctaaattcaagtttccttatatgctaaatggggatactaatacttgctcagaggggagttgggaggtgtaaattcagtgatatatataacaggcatggcatatggtaagtgtccaatcaatgataacagctactacttatagagcagatcttactctgtgccaggatggttctaggtgctttttgttgttagttcctttgatcttcataaaaatcttatgaggtagataccgttattcttattctatggatggagaaacaagcacgggggtttgcatagcccatccaaaatcgcacagatagtaagtggcaaagggagatttgaatccttgcagagtagggccagaaactatactcttttggttttgttttgtattttgagacagagtcttgctctgtcacccaggctggagtgcagtggtgcggtctcggctcactgcaaactctgcctcccaagttcaagcgattctcctgcctcagcttcccaagtacctgggattacaggagcgtgccaccatgcctggataatttttgtatttttagtagagatggagattcaccatgttggccaggctggtcttgaactcctgacctcaagtgatccacctgcctggggcttctaaagtgctgggattataggcgtgagccaccacgcctggcccagaaactatactcttacccactaagggaccctgcctcttcataactgttgatcatttaaattagtgcatttattttaactgtatgtaccagaaagtacacttggagtttttaataaatatgttacaaatgatttggaggaaacataaaatataaggactaatttctagaatgttagtataaaagcaatagaatgtcctctaccacacacaaaaaaaccaacctcttgatacattgaagatgctttttcttcactgaattgatccagggacaaattgctttgacatcattgataccaaaataattcagaccaaaattaaatctatcattctgtaaattaaggagtttagaaattacttcaaagagattgacatttttgcctttttcaaaattcccatttcacaatgccttcattttggaagagcttcaagccagaggcacttgtggctgcccttcaggtaaacttgacttttagctggagcaaagtgctccacagtcacagcatttacctagttcttcttggtttggatttttgccaatctggcaacaaccataggtgccccaggatgactgtagtggtgccccaggatgactcagggactggagtgtgtgctttatgtcaatacagacagttctctcactgcttggtctcaactccatgaacacttggaaattttacccctcgcaaagagagggagaataagtgtacaggcttttagatcatcccttctctggtctccaaaatcctttagggcagggactgtgttatatttacctctgcaaacccagatcctggcatgatgcctggcacagagaaggcacttaactaagccaagtgctggtgggtttagaagtcctagtttatcttcttcttcaaccagaattggttaagaatacgggttgggatgacagagtacctacaagggacagatattggtaccctctcatacaggaacctggatggtagtgataaaatgagatatcagttgataatatttgagaaattgtcaagttgttggaaacacatataacttccccaaataactaagttggaagactgtactagtttgaatgtgtagattctggaattcttataacaacaacaacaaaaaaggcacaccataatgatcacactttatagtggcacatgcttcctcttccctataaaccaaatgaagatatagttccaattctctcctcttttggttgatatttctcttgctcttttcccattaagactacatctgtgattctgtaaaatctttccttccctttcttattacctaagcatataaaacattcatatgtggaaagattctgatatgcacgataattccaaatgctgcaagcccaaacagacttagaaaaattctcgatctcctaccaaagcatgcttaaatcagaaatgtcttaaagcactaaaagaaaaagggaaaaattttagggcaaagacccaattgtagtagcaaggaaaaccagtggttgaagagagagtacatggaagggtatttcctccccaccccaggcactctgcagtgacttgatggagcattgggcaggatcttaaaataatccactctcccatcagacactattgaattacttattatcttcataaacaagtactgccattaattaataacactatgtaccaggcgctaggctaagtgctttgtatgccatctcttttaatgttcctcacactttgcaggtgtcaataatccatttttagaggttgagtaatttgcctaagaacctacagcaaataaatctgttgtactccacagtccaacttccttccacagaaccagtatttccaagacaggcccagagcctggcattgttagcaaagctgtgcttattagctgtgtgggtgagaggagcaaaggagttaagaccttcaaagtgcagacagcagtgcctggtagggggcaagcactcaataacggttgccagtgtgcagatgctgtccttgatgaggagggcaacccagtttgtccaggtcgaaagggaggctcagagcacaggttaagatggggccagggcatgtgttatcctgacagttgcctggtaaaagacctgatccaagaaggagaaatgaaaattaaggggagagcctgcttcaaccagagcaactggcccagatctccaagctcgtggggccacgtgaggattcaatgaagaccaggagggttgagagaaggcagcaaggaacaggtagggggatgttgtctggtggtttaagtaactgtctttggatgctaggcacagggtgtagagccccttctgtggagacctcagacctctccccaatgctagcagcagctcttcaaggtgtgcctgatagaaagagcctgggaagaacacatgccaacctgaccacagcagtcaactcatggccaatgaggagggcccaagcttgggagcagttgccaatggacatgcttgccttgtatgtaatcaattttaatatgttaataaaatcaaaatgcagtacctttaaaatgggtctcatacatgacagctctctgtcaactgtgacacacagtggaaatgctgtgtgtgagagggagatagagatgtgctggaacggggaggggccagaggtctggattgctggcgattcgtccttctccactgtggcagatgctgctacggatcttccagtttccagtctcccctctccctcagtattagaagtgcagaagcctcacatttcagctgggaacactgcagccctgcagtggaggccacacttctcaggctcccttgcatcaaggtgtggccacatgactgagccctggccagtgatgaagtgacatgtgccagcttcaggaaactctcctttgagctgcaggcacctgcctttgcccccatttctttgtctcttcctccagtggccgcctagaatatggatgcattggagacctaatcaccaacttagaccataaagatgggagccacaccctagggatcgcagagcaggagctggaaagagcctgggtccctgaggacatcacagagcagggccactatgccagcccaggagcgcctccctcaattattcacaggacagggacacgaacctctccttgtatgagtcactgtagtttaggttttctgccaaatgcggaagggactatctcagtctcttggattcttttgttaatttttgcttcttctctgcctatgtgcaggtctcttaggagcccccctgctgaactgaggaggctgaggctgacccgtgtgtctcagccgttcccctttgtgagcccctaagtgccttacagaccatgtatttattagtggtctattgttaataatcatagtaagctatccaagctgactttttactgagcttcggagtttcatggttataagagaatgaaaacctcagaataaaatattaggctctttgatctgtgtgaatagtcactcttgagctgttctgggtgtgtttttctgtgatttcccagctatcgtgctaagcgtcgcactcagtctcagctgcctgttaacggcaataggaggactgatgcattagcataacaagggatctgcagctagcctaggcgctctgagtactccatgcacagatggggtggacggtgggcagggaccagagctgggtggggagggtggaagggcatctgagaacaggcaggcatagaaggcaagcgcaggagaggtagagtcagaggggtggacagagatggctcactgccacttaataggtatacaatgagcatctcttgaagaaagaaagggaggaggatgagagggaaagaaggaaggaaagaaagaaagaggctgctaagaccaagtgctaggcagccaaaaaagctttgggggttgcttcaatagaatacacaggacaagaatgtacatgcaggtgcactgggataatgcttcagcagggtgacaaatacacacacacacatggacacaggcatatacagacacattgacttatacagatatacacataggtacatgtatggtagccagcctccacgatggtcctaatccttgcctcctggtatttacacccttatgtcattctctcctacaatgtatatgtctgacttgtgtaacaaatagaatattgtaggcatgatggtgagttccaaggctagggcgtaaaaacttatggaggcttccaccttgccctctccgggatcaccttctctgcaggaagccagccctcatgttgtgagaacactcaaacagcactatggagaatttcaccttccaactggccagccatgcggtgagccatctcaaaaacagatcctccagccccattctggccttcagctccagatgatagcagccctggccacaactttacagcagaccttaagccagaaccgcccagctaagctactctcgctttcccaacccacagaagctgtgaggtaacagtttactggggttttatgccaaaggaacttgctaagcagcaatagacaactaatataaactatatacacacataactttccatatatataatttataatacaatgcatatatagtttttcataattatcaaaataatgtggatttcctggagaaatttatgagataagtactatcatgattcccattttaattgacagggaaactgaaacacagacagttcaagtacttaatctaagcagtaagtagaggagacagaatttgatctcaggaaatctgagcttatcactatcttataggatggcacactctggctgacattttgttgtatttcccttcagtcttttaaaaatacagtttaaaaaaattactagactttattttctagagcacttttaggtttgcagaaaaattgagcagaaagtacaaagagttcccatacattccctctcccctcccctttcacctggtttcccctgttgttaacatcaggcattagtgtggtgtgtttgttacaactgaggagctgatattgatgcattaagtttgagctggcattaggtttcactgtgttgtacattcaatgggttttaacaaatgcatacggatgtgtatccactattattgtatcatacagaataatttcctgccttcaaaatcccgtgctgcacctgttcatccctccctatgcatgccattcttaagcagagctaatactacatatactaattttgcagtttttaaattaatattgcataagtattttttcatgtcagtaaaacttataagcattatttgtaatacttgaataccattctatgtgtgcatggctaaaccatagctcaatttatttattcccttttgttgggcatcagaattgttctcccaggactcttttttttaagtcctgggatggaggacccttgacaattcaactcagcatccttaatgtaagtgtgcatttgtctaaggatgtatgtgtcagctttagcaagtaggtacaactgctgcaattccaacatccttaacctggctctgtcagaaacttggaaactattgattctgtaagttatttctagcctgccagagcacttgtacttattctctctccccccaaccccaacttggcttttagaataagttttcatcagttcccaagaaatgaatcattgtgaatacaaaatgactaagagcatttctttggaccctacaccccacaacagacacaggctgacccccttgatgcgcttccaggattaacaaggatctgagaacaagcagtatagaagtaggggcaataaaggaaattgatgttctctgagattgatttgtcaaatattatgtatatcttttgcctgttcccaaattccttcacttaattctaaatttgattttaacagcctacaaattcctgttggattaaatctttatgactcatctgtactttcaagttcctgtaattgaaaattccatttatatgtgattttcttattattatagtatcttcttttgcacaccagaggacacctgggtgtgtatttcaggaaggtatatagacctgtttggactggcctaatagtcagattgtcatcaataagaaggaatgaggcacacaaaatttaagcctcacatttaagccttgccctgccctccacctacaactctctctctgtctctctttctctctctctctctctgaaacctgatgctcagatagaaagttgggttctaggccagacgcggtggctcacgcctgtaatcccagcactttgggaggccaagatgtgcagatcacgaggtcaggagatcgagaccatcctggctaacatggtgaaacctcatctctactaaaaatacaaaaaaattagccaggcgtggtggcgggtgcctgtagtcccagctacttgggaggctgaggcaggagaatcgcttgaacctgggaggcagagcttgcagtgagccgagatcgcgccactgcactccagcctggcagcagagtgcgactctgtctcaaaaaaaaaaaaaagttgggttcgaaactgtgtgacttcgataatccttagtgctagtattgacaggagaagaacctaaagtagttagaaactagaagtggtaaacttgaaccagcaactgcaagactttgtaagtcactgattttgatgaaagagacatttgtctcactcataatgggcagtttgtcttttaattctgagaaagttaacctaaaaagagtgaagcacaaccttaatttttgttttaatgtgttcccggaaattcagattgaagaataaaaatgtatataacttgctgaatgcctacaatataatttagataacttagttggtttttccagtgaaaattattaggccacagtaaaatgctgggttaacctgtcaacattcagtagaaaattcaggaactataataaatagggggcccaacagcctttactgaaaattaatacaaattttagtcaagtgactagcaataagcttttaagatcaccatttgttataatctattataagttttgctttacctccagcaaaagttctcatataaaattggaaacattatttaaactgtttaaatatatgatgataacacatcaaatctctagtatctcacatctacaagattacaacagacttttgaatttccttcccctacacctcaggcatagaacagactcccctcagtgcaaaggttcccacggcagtgattactaactagggatgggacctagaagggtgtgggtgacacatcgaaactgggtggggaaaggaagggtattgatgtagcatctcaggtgattctgagatgcccctcatggggagatactaccactgttttaaccagtgtgccaggttcaatccttgcccaaatgtaatctctccttcctcaataccatgacattaatttttcttaaatcattcactttatcatcctactccctttcttacacaccttcatcatctatcagttaatgttcatactcttcagcttgactttcaagaaacactgcacctctccctcctaccgtcatcacaaagcttcataagattagaagttggctgtatctcctgtactaccccttgccattacattaccctttgagaatggtgcaggaaaaatcagtttatttcaacaatttttttttttttttaattttaggctctaacatgtatggctacgggggacccaagagtaaacaaaagccaggatcactgttctaaggagcacaaaagtcaactggagagaagagaggaaactggccattgcagcctcacaggctgtgtgctttacttgggcacagggaattgagccttgagtgatgggaggtcaaggtggcttctgggaggatccaatctgagagctgaaatccaaaaggtgagaaggaatttggcaaagaaagggaaggcaggacattaaaggcagaaggaaaagactgcatataaaaggtgagaaggagtgaccagctcaggatggatgagtcatctgtggaccaaatctgtgcgggagatagttgacatatctattgctgaaaataatctggggatcactgaagtccaatcacggtaatgtgggatatacttagaagtgctaaaaccagagaaattgttgactcaaaccagtacattgaacatgcctgcttggtggcaatggacagaagggaacatcctagaagtgtgacaggctgtcagagtctgtctgtgcttattaagcactgtccaagggacagacacatgcatcagttgggcatgagtattgtcatcactagagggagatgctccatggtggggctgggagagatctctattctatgttccctaaataaccttctcatgcctggagacctccatattggaaagaggctgtcattatagcaaacatcagtatctggtcccttccaaaggcatatttgctttaaaaaagagagtgattttactttataaccagtttcttaaaaacagtttagcatatggacagtgccaagtacctgattaatgtgtgtgttctgagaagatcaaaatttgggctctgtaaagccaaggactaggctctgggccctggtggctccatggggctctgccacatggaaggcactaactaagaggtcagcaggcctcctctttaaatgcaataagaatgatttgtgtgtcctgctactacggttacttgtgtgttttgcatctcctctgtcttctccttgcccccatctccatctagaatgtaacatggagcagtgtgactcaaagtgccatgctgtaaatggtttgtcactggtccaaaacaagataaatccagaaactgagagtaagagttagaacattttagagaaatttgacagagtaattaatttctgttgaatctgataaaatattggagtttgctttttattatgctgtatgtctttgttttttcatttcattttatagtaattcatttctacaaaaatattggtccatggtgaattggtctttcaccccagatagtttgagaagtaccaatatagagggtagggatccctgttttacattgatggtgtatgacattcagtgcctttccaaatgttaacctggctgcacagtagaatcaccttgagagctgaaaaaaataaatctttatatccctctatagagagaagcttcagctccaccctcaccaattaaatgagaagtgaggtgggattagggtgtgtcaagggcatctgcatttactaaaaacttccttggtgtttctaacttccagccaggaatgaaatccttaatgtgggtggtatccaatcaatgaccacaggttgaatgaatgactaaaacatgtcagccagccaacaacaggtgtttattacacagctgacggtgctgtaccaggtgctgagtaacacattataaagtcatgaagcttaatcaagattttccaatctgatgataaagctcctattacaaaaccaatacaaaacaaagggcacagattaataaacctacaatattcacccacaaataaagtaacatttatgcactatggatggatgaagcccaactctctctctgtctctcaaaagcaaacagcatattcaataacatgtcacctaatgggaaagagatttccttaggctggtgtctccccgttggtcaaagaatccactagatgtcactcaaggtccctcaaggttccctttcacagactgcgtggtctttaattttacatcagatcattttcctcaccaaactttgtccccacagtccaaggctcctaatggaaaccatgcaaaatgtaaggcacagaacatgctggttgtttgatctccttccatggctttccgtagtactctagggccacaccattcatgcatctattcaagaacagtaactgagggctgatgttctacgacacattagtttaagctgcggtggaatcatgatgagtgaaaatagccttggttctgtcctcacggagtttacagtttaatctatgaaagcactcttcattctaatttgtgttgtttatttatttattagttctcccttcagaccagaagctctcaaacttttttggccgccacatccaagtaagaaagagattttatattgcaatttatattcacacaaatgctcaaacacataaccaaagttaaagtttcacagtacaatgcttatcttcatgttgtgtgatacactctgatattttctagtctattccagttccttttttttttcaaaatgctagtcatgatccaccaaattgatttcacaatccactaataagtcacaatcctaagaataaaaaatacttgactagagggcaatggtaacctcttgtgcctagcaaatagtaaatgagcaatatatttttttaaatgaatgaaaattatgaggactaatttgcattaatgtttacattaagaagaaatagatacagattaagtggtttataatatgtataatcagtgtcctaagaacacatttctatatacacattacattctatatacgcaattataatggataatttttttcagataatctataccagctatactaggtacactatatatgctgtcaatgtaatttattatttcagtcacaatcaaggactcacatattttaaattcacataattaaaaatatgttcatcttggaaaaagaagtcataagcagcaatgaactctttcagatattaaaactcattataaattccaatagtaaaagagcctgggattagagaccacagcaacagaataatggcctccaaagatccctaatccatagaacctgtgaatgttagcttgcatggtaaaagggattttgcagatgtggttaagttaaagattttgagatgtggatattatcctggattatatgagtagacacaatgcaatcacaaagatccttataaaagggaggcaagagggagaaaaaaaggcagaaaagatgatgagagagagacttgatgccatgctactaggtttgaagatggtggaaggagccatgagccaaagaatgcaggtggcttccaggagctggaaaaggcatggaaacagattctcccctagagcctgcctcctcaaggaacacagcttggcaacctgttttggacttttgatgtccagaactgtaagataataaatttgtgctcttttaagccactaaagttatggtaattttcttgttttttgggagtttgttttttttttttttttttgagacggagtctcactctgtcacccaggcggagtccagtggtgtgatctcagctcacagcaacctctgcctcccaggtttaagtgaatctcctgtctcagcatcccgagtagctgggactacaggtgtgtgtcaccacgtctggctaattttttgtatttttttagtatagatggaaccccacctatactataactggccaccatgttggccaggctggtctcgaactcctgacctcaagtgatccacccgcctcggcctcctaaagtgctgggattacaggcatgagccaccacgtgtggccaaatttatggtaatttgttacagcagcaacaagaaatgaaaatagagatggagtaaataaatagttcaatggcataaagtaaaaaaaacagtctagatccaacaaaaacttcgagaatttcatatctgatgaaagcaatttggtgtgtgtgtgtgtgtgcgtgtatgtgtgtgggtgtgtgtttattccataaggtggtattaggacaactggatagttatttaaaaaaaaaaaaaaagctacatctctatccccttacaccaaaattatttcccagatagcagcagaagacccattagcaatcctgagatcaggatcatggatttttaagtattttaaaaacacaactaaaagtactagaagaaaatgtgggatttttttaatgtgaaaaatacaaaacccagaatgataaggaagaggtggattatagcagtaataactctcacacagtgaggcaatcagtagtcaatttggcagcatttatcaaagttaaacatggccatacacttcaacccagcaattgcatttccacgaatttgtcttaaagaaatgcttcattatgtgtacaaagctttatgatgaaaatgttctttagagcattatttgtaacagcaaagtactagaaacagcctgatgcccattaattagagaaagttaaatatattatggctcagcccttagatgacatgtatctacatgttttgttaaggaatgatttccacacacatttgtaagtgaaatatggtatgatcccttgtgtgtggggaaaagagatgtaggtttagcttatatattcagagaaaattctggaagtgtacacaagaactgtcaatagtgcctatcttttgggagtgggactgacagtaggaagaagtcttagatttttaaaattttacacttttttgtagagttcctgatatcaggattgctaatgggtcttctgctgctattcagcaagaaaggaaaaaaaggaaagaattgctgaaaatgaagagggagagccatgctcacatggtgacaaatctgggccagctgcctcagaggtatatggtataggattttgaatttttttaagtatatttaacacagctctgtgattaaaggaagcccaagtcacagaatcctgaacttattggaaacatgtgtgacacctctttaaaggtttaaattatttaaatttgcttgcttttgcttttaagttatgcatgaagattccaggcaggtaaaaagatgaaattctcccttaactgactagctaaggcagacaggtacctaaccaaggtctcctgttggggaccaggttagataggactcacatttcactgaaagcctgtatacctttgtatgtcccacctcaccagcgtaggcaacaaaatcaagtcagtttaagtcatgtgcttttttgaagttaaaattcataccactctgagctctacctagcgagtagagtccaaccttctgttgaggttcttctccctaggtatccccagtgatcctacggttactcatttcttccaaagaagtcctctccagttactgatagtgggtggctggtgagtcagccacagtgcctagtcaaagtttcttcttcacggctgctgcctggggtcactgccaaggcccatacaggcaagaacaaatgcttgttcccttctggctgtagctacccagggttaagagaggtcctaccattgaccacacagtgcaaaacggccagtcctcgcctgccaacatcctccaagtgtggatacaacctttgctcttactctcccaaagcacagtcaagggcagactgcagacaaggaaaaaaaaacagtcaatagcagtgtctgccaatatccagtaatgtttgaggccacttttgaatgaaaaaaaaaattcttgctaacttccaactgttaagtcattttaattatgtctcttaattatacataaactttaggtaataatttcttattcttatagctcacgtctataaaactaaaacaattttagaaattaaattcacaaatttaaaaaattcaattaatatgatgtatgtaatgtgtggtgaattatatttgttgttttgctgaaattaaattgtcctttgatatgagaatatggaactcactgctatggtatgtacttttttgtttggcatgcttataattgacttaattatctcaacattcttctctatttgaatttctgttaaacttctgtgcagtgtgccgtaaaggacgtatgaccttcacttagccagaatgctgtcctttccacaagaagtattctattcttttcccattagccccagaaaattaaatttgtggttggtgccaaatacaaaatcaagtgcagggtttcgttacaaggtggtcatcaaatgatccaatatagtgactagaatatattaacttttaaaagaacataatttaagtaagagcaaaatatttacatattttatagataatttgcatatattttttcttagactccagtttaaggaacagtagtctacacccctgctactccagggtggtccaaaagccagggagcttgttagaaagagtctctaggccaggtgcagtggctcactcctgtgatcctagcactttgggaggccaaggcaggaagattgcttgaggtcaggagggttcaagatcagcctgggcaacacagtgagagcctgtctctattgaaaaaaaaaaaaaaagaaagaaatgcagaatttcagggcccactctagacctaatggattagaccatgccatttaataagaactccaggtgatcagcatgtatattaaagtgtgagatatactaatttattatttcccaattcaattttcagtgggcccatgtgagcctggggcacagtctaaagctctctctctcttttttttaaggacaataattgcttcttctctttccagggttgcaggcaggtagatttaaggtgaactcagatttttcaaggaataatggtgagtattggtaacttcaaagggtccatcctggtgacttgcaggggaagttccactcaggaacttttgtgtcttgcttaacaccagacacaagactacatgtaagccatgtggctcacatgtgtaatcccagctactccgaaggttaaggtaagatgatctcttgagcccaggagttggagaccagcctgacaacatagcgagaccttgcctctaaacaaaaattacatattgtatgattctatttatatgaaacattcaatttctggtggaagtctcatatgatctttggttggaggatgactggatgttgacagatgacaatgaggtgaagagcattttagcagagggaatggcatgatcaaagacaaaatggagagtcagaggcaggaatgcatatttagggaggaatgaatgagcactggctacaacagagatctgggaagaaaagcaagtgaaggaagtaaagctggaaacatggattgacaagttgcctttttcaaatggaaaaactaacaggtgtgagggagaagagagtcaatagaaatttctgtcttttccagatttgttcacattcccctgatttgtagtcattttgtcggcttgggaaagtggtttttgaaagatcgtctttataaaggtaggctctgataggatgctcaagctaagagcaaggaaggacaaagaaggcgcctggcgacagaaaagggcactaacaaaaattgggcaaaaaggaagtgtggcggtccccaaatcccttcttcctccatttcagctgagatcattcgccagtaggcaactgtggtattaccaataagtttgtatcaccaataaaatattataatgcacctggctaaaaaccctggcgtgataacaccaaattcatgttattagaaggaattaaattttaaaaagcacaccgttccaggcacacagaaggagcccccgaacgtttgttttataaacgcaggttggttgctgaggctttgttttggagcctacgtttaggagaggaaatgattcaaaactgccccccaaaacctatatcctccaggagcactgaggttggggcgacctgctgccaactggtctggttttcccttttaacacacgcttcttgcccactatccggtccctgcggtcagtgggtgcagcaggggtcgcagtccaaacaaccaatcgcgacgcggctgcggggcgggggccacagcgctccgcctcccccctccaatccgccctcccaatcctcctaggccgctctctctcgcacctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaaggtaagaggttctccggtccccgccggcctctcggccctgcacgttgaacgggaggctcttacctgcatgtgtggctcctgggaggtgagccaggtggggcaagccggaggtacgaggatgatttgaaaggaaggaaaaaaggacaaaaacaaacaaacaaacaaacaaaaaaacgctttctttcctttcttcctgggacctctgcttttgcgggggttatagttggaatctctgttatgggtcagcgaagggccaagggatggaataggtgcggagatggaatgttcccagtacctaaactctaggtaaagctttggaatcttgagttttccattgctggtagaattccttttttttttttttttttttttggctcatatgagcgcttcttgcacgctgcatgagccaactattcctaccattgaagttttaagcctgttatgattctaccagtatatacctgtatttgggaatctgtagttgagccaaaaaaaaaaaaaaaaaaaaagttgagatgtgggtaaacagtgatgcatttcgcagggtttccataaaatggaacagcttacagttgcacaggtgatgtgtggatgtttctgcaaaacttagggtggaagattttatgtctgggcttgcatcatgtagtgacatcagtatgtacaaggacgatttgtaggatttttcaaaacgcctgttctaggataacttgttatgcatctgcaatatgccagctgcttttcgaataagaggtttcagtaatactaagtttctgtgtccagatcttgggcccagttgaaacagtacagctgattggtcacatttaaaacatatttatggagaaagataaaaggccaatgtgtccgacttgcaaaagacaattagagtagaaagaagactggaacagtaaaagccagggcatttttaaatcttggttttctgaactttaacgtgccagaggaaaaaaattttttttcaattttaagggggaaggagatggccttaaaataaaggattgttcagagcctaaactgtgcttaatggaatagagctaggtatatcatctaaatcttgaatttgactaatataaattcagctttcttttaaagaaaaaactcgtaagcagaagtttgtgtattctacagaacctcttcactagctcgtaagtgtgatcattttgtggacatcactgtttttttgttagaataaatttatgctccaattaccacaaaagcaatttttatgtctcttcgcattttttatggtacacatatctttgttacattttgcattgaaacacgcacggtcccatagtatcataatcttcagtgatttataagagaaacagtctattttgtacatgggaatgtttgtcatgttgccagtctgttttaaaaatttggcaagaggtttttaaaatccaaggaggcaccactattttgtagtttttaaaaatattaattgagtaggtccatgtttattaagttagaaaatcacgagttcctcaaaagtagtaatagacgaggatgtgatttttcttactgcccattttctaacatcttagcttcagagctgtaggtattgaattgagtcaaacttgtgtttttttcttatgttctaattaaatatcttttaaaatgtccctagtaacattgttactttaaatttataacacccaatttctaatttaggctaggcataaaaccagcattgattgaacgtacttgctaaaaatactttctgggtcggatgtacttagaatgcagcctcaggaaatttcatttgaactattctgtgaccagtgtacacttcattattgttgaaggacttttaaaaaaagtatagatctctcatactcgatttaatcagtttgagcatagatgcctaactttaaaaaaaaagtataataaagtgggatagtaatacaatttacgtgagatggtaataaaaacttttcagcttttttttttaacttgtatgacttcgttaggttgttattaaactgtgatttgtatttttaaaatagttttgtctgttaaacataattgaggtgtacagtacagtatccattgttatctgtttagtatttatttatgacttacaaactctaaaagcgggatcagtgatcatggtttttagtaagttgtctttaaggagcaaagtaagagactagcagaaaattgcaaggaggtttgttattgagagtacttctgccccccgcttgagagttaatatggccacttttaaacaagaaaagttttccagaaacgtggaaatcttgtttggtgtatgtttaggggcaaatgttttaaagttttgcctaaattcttagttagaatgcaaaattgatcaactccctaggaatggttattgtggctaaatatgaattgttgctcctatgtaaaatttagttattggtagaagtttactaactgagttgaattttgttgttttcctgggttattgcatgttatgaagttttttatgtactataatccagatttgttaaatttgccagtttactagaataagctgtgaagccttgaagtttggcttagcattctgaaaatcctttttattgtttgccaggaaagcactgtaggaaggaggtgttatctcttcatttaatatttaatgagtagtatagatgatgagataggatataatgtagaaataccgtagaatcttctttattgatatgaaagtaccattgtctaggaacagcataatttcttatcttttgcatgaatggggaaaaagaggaggggaaatttattagactctttcatttcattagagatatcttccctcacattcattcttcatttcattattcttaagtagaaactttggaagagagatgcaagtatttgaattaattagtaagaacaaaatgaaaattacatcgtatagactatcatgaggaaaatatcaatttgggttggttattgtgtttgtattttttaacaaggaggttatatagagtagtagaaagaaaaaaggacccagaggggaagagtgttaatatttattgtctgttaagtgtcagatcctgtataaggggcttttcatgttgtcccactcaccaagtatgctttatgaggtaggtattattaatcccctgtcctctccctgccaaatagaagctaagggaaatgaaataacttgtctaggctcatacttctagtaagtggaattctctaaaacttattctttagatcggttctgtccaattaaactttctgcaatgatggaaatattcttttttccttcaactttattgaagtataattgacaaatatcatagaaatattttttgcactgttagttatggtagccattaatcatgtgtggctatggagcacttaaaatgtgacgagtgtgtctgagaaactcaatttaaaattgtatttaatttaaatcaatttaaatttatagccagatgtggctagtagctatagtattggagagcatagctttaggtctgactgcttagaaaatctgagttgtagtatttaatcttccactggtttatgcatggcattgggcaagttgtttagttctgggcttcagtctaatctggtgtgaaaatgaaggggtcgccactaagagattatctccaaggttccttcttgcctgaagttctgtgactgttattaaaacatacagtagcattcaatattcacaagcattatgtctgaaaggatcccctccccaatatgctcacccattacctaaagatttctgtttagtcagtttctctttttgagaagcgtatgtataaagcacacataaaggatagtggattattccccacctccccaactgttcggcaaaaacattgtgtaactcaaggcagtactttatgatggaacaaagtttgaatctttaaaggccatattttaacatgccaccttcccgtttaaaaatatataggagttccccggtgcttatcaaattaatcccaaatttacctgcttgaccttgaagactttctaccaacttcatctcattaaccttgtttctcattcgtgcttaaaaagaaaatagtcttgttttttcctttgtcctcgtttccataatttaaacatctctgtctccaattcatgtgcctcctctttaaacctttttcaaaattcacctgtttctggaagaatgctgcttaatccactcacaaggatcagttaatgaatcctggtaataagtaccctaaggttaatatatgcttgtttagatatagtttaatatcttcttaagctttttttttttcttaagtttttatgttacctactctgtttccttaattttcttaggttaaaaaaattaaaataggaatagcgtcttttgtattgtcttatgaatttagttcatttttcaacaatgctacttttaaaagttgctaatttttaaaaaggataaatactgtaacaacgtttacccttgatcaccaccataatagctattttttgtttctttccaggtaattgttcatatttaaaaaataaagttgtgtggtagagagaattttgagaggaatataatgggaacattgtatggtggaggctgtgcaatgtaggggaaagatcacagactttggagtcaaatctggtgtggaatctagcgtcaaaaacctcgggcaaactgtctgatttctgagtcaggagtcaaatctggtgtggaatctagcgtcaaaagccttgggcaaagtgtctcatttctgagtcaggtggtcttgaattgtggggattaagatactatatgtaaggcatctagcgctgtgctttaaatacaagagatgatcagtcagtgatagttggtattattttttcatttttctattcccatcttcatgaatattatttatttattttagctacccaaagccaccaaggtcaatgaatataatttaagtgattagttaaacattcaggtgatataccataactgatttagacatttacattttgttaagcggttttttgtttatttcctcagtttaaaaccctaggactgggataatggtcaagtgtcatgaatatttctgtgccagatctctctcttacagaagtacctacagtggttgttcttgttttgggaagaaaaaaatgctaattttataattgtatttcattgttttaattaatgtaatttgaaaatttatttggtgatgatgtaatgaacattcctttatatgttaagcaaacatttgaaatgcccattgtagtgggagcagtggtataaaggtaaataagacatgattcttgtccttgagctcaaattctagggtggtaacacatgtcaacaaacaattaacaattcatagtgacagtgtaataagatctggggaaaagaagtggcatttgaatatggtcttggaggatcatttggaattgatctgggtagagagaacagcatatagaaaaagtcaaagtatgaaagaatgtgtggtgtgtttggagaaatgtaagttgtcttgttggatatgtctgtctctgtctgggtgggtgtggttgtctgttcctgtgtgtgaatctgtgtgtgtgtgtgtgtgtgcgcgcgcgcatgtgcgttgattgcagtgggaaatgaagtcttgtgagggtccttgtgtttgggcaatgagtgggatcattttaagacctttaaaatagagcttcccaactggtgtgccatgaatggtttaccagtgtttcggagagcaagatacccttgtttaatgggacctgggcatatcagatccccctccccaccctgccccaggatggtttcttttggctttgaatagcatttgtggcttatcccaacgtgctaagaaattattattttctttgttgccaagttgggaaaaggattgggaaaaccactgttttagagactgtaagtattagaaagtttatggttcctactcacccttggcatccactatggaatcagaaataaatatcaaatcctaaagtaagcttaaggtaaacttaagaattcttaagtcaccttcctctttctctctctttttccctccctttacccgctgcctcccccatttcactggtgtatgcgcatgtgcgcgcgtgtgtgtgtgtgtgtgtgtgtgtgtgtgtgtgtctgtgtgtgtgtgtgtgtgtgtgtgtgaaatatctctttggtgcccttgcgttactggtgccctaaacatgcatttagtctgcctcttgggaaatcagcattaacattcaggaacaatttagaggtatttaaataagggatgataagattagatgcaggttttgaaaggtaactcctgacttctagataatgatgcaaagttacaaggataatgcaaggatgaggttagaaatggagcagagagaccagatgctgttgcagtggtccaggggagggatgataggaaccagaaatagggcaatatagatatgagattagaactgaaaactgagtagtttcactagacctgagagtccatttggacatggggggaaagagttgaagatgatgctaggatttcttctttggcagcttcccttctttagcaagggaaggccagattatttttattgagcacttccagtgagccaggtattttgctagacagcgaagttgtcacgagttctcatttaacattttgaaataatttcaaacctaatgagaaatctcaagaaaagtacaacaaagagctcctgaatcgccttaaactaatttttaacattgtactagctatgtaccgtgtgtatacacagctcaagatgagcctggaacacctcgtgcttggctcagtaaggccttttccagatgccccaagtggtcaccttggaattgtgtttagccctttccctttttctactgtatctaattggatcctcaaatttcagtgaaacaacctcatcatctctcatttctggtcctacattttaatccttatttctccatttcaggggaatgcaccatttctaatttcatttggcttttttcctgaattatttgagagcaagttgcagacatgatccctatcactactaaatattttagtgtgtatttagcaaaacaggacaatctcctacataaccgccaaatcaggaaatcaacgttgatataacactaccttcaggtcgaacctagatgccattcaaatttttccaactatcccagtagtatctctcttttctttttggtccagcatccaattcaggttcacacattgcatttaattgtcacatcttttagtttccatcagtttggaatgattcctcaatatttccctgtcctttatgaccttgacagttttaatgagcagagtcctttttttctgttacatgttttcctcaacttaagttcatccagtggttcctcatgtgcagaccgagtgcattgttggcaggaatgccatagaaataatgtcgtgatattcttagtacatcactaagagacgtgctgtatagtcctgctactagcgatgtttaactttgaacacctgttaaattcaagtctgctgggtttctctactgtgaagttatcgtttttttccttttgtaattgggaattcttatgtgagaagatatctgggagtgtgtcaatagagctgaaggctgtaaccacgagccttcaggtctgatgattgctacctgaatcagccacaactgtgaaagttgtcacctacatttattagttcatattctactgaaagaagattttctccttcttctccatacatttatttattcattcatttatatcaatatatactcctggatttgtttctgtttagtggtttatattagttactgtcattttaaaatttcattttgttggtcaaattgtcccaaatttggcctttaagttggctcctctatctccttgacctgtccccctccttggtgtatttccttactttctggcctaacaagatgttccagatgatcttaatactctcctatcccagctctgaaatcatttatttttccaaggaatcctgattttattttacttttttaagtagagatgctatttaggaactgagatccgagtgttcagtgtgttcatttctgctggcatgtcatcacttttagggggatagagctaggaaatacatatatgtatacacacatctgaatctgtttctatgcctatgtacaggtattttataagttcacactgatacaaccaattccaatctaacatctcaggattcgtctagccttttccctttctgtatttgtaaatctcttctccagcagtgataaattggttcctattatctcctcagtgtatttacttatttgctcaatccccttgtatgtgccagtcttccgaccccgcattagttgtctcctttctccttgcttgccgcctctgaggcctgtggcatggggtcctcagagcttgctgtcaggtccatgtaggaaagagaacttctcatttaatctttttcccctcatttaatcaggacagaaatttgttagaaaggtgctattcccagttttaaaaggagaacagagctgaaattcaaaaaggtctgtgtctttaggcatgttactgtgtaaatagctgagtaaatattttgcattcagattcgtctgatactgaagcatcttttctctcctgtactgcatagcctctgagtatctgtggaatccaaagtggcaggatttaaggttgtatagatggtagctgaagcaatgggtgggactgtcactgcttatgaagtatatataaagttaggaagaggcacactgacagagctcctaactaccatcactgaaagattaagggctctccgaaatcaagaagccagtgaagaagactgaaagaaaggttgtgagagaggagtgtggttgtgtgttagatgatggtgaagtaaggaatttcatgaagctgccatgttgctgagagaaaaagagaagaccaagaggctttgaatttgactgttggaaagttattgataatctcagctagttggttttccagtgtgttcaggcgagctgcctgtatcagaattatggagatactaatgaaaaatatgaactccccaggtctcatctcagaccttatagattcttaaaagggggagtggggagccaggaagtggtagcctgggaaaatctgctgaaatgctaaggttcttctgaggtgtactagtttgaggtttgttgctttagcagaagagttatagtggaagagtgtaataaactaaattgaggaaaccaagtgtacaatgaatatagatgagacagctcttcgagaagtttgccatagaggtaaaagatctcaggtcatggaagaataggggacagcatcaagaaaaatacctttgcgtttcaagggttacatacaccttaacatttgttgggattaagagaaggaaactgtaatggttattttaaagttgggtaagcaaaactaattagcaacacctactatcaaaaaaatgccctgagtgaactttgatatgtatctgggatagctgcctgctcccattttaaatgccatcttttggtaggtctttggagtaatccaagggtcattgtttattttgtttttagttaaatttgtatcttgtgtttttgttatacagttgtgtaaagagcttctctttgctcatttttatacaaaca

SEQ ID NO: 310 - DNA, 46225 bp, Homo sapiens
ttcatcctgagtgcctctagctgggacactgacacattggtggttttctgcctttggactcaaactgaaacgttggctcttctgggtctcaagactgacagccttcagacaagaactgcaccattcactctccttggtctccagctggctgactgcaggtcttgggacttctcagcctacataaacatatgagccaattccttctctctctctctctctgtctctctctctctagctctcactctgtcttctgtgctctgtgtgtgtgtgtgcgcgcgcgcacgtgggttggttctgtttctatggagagccatctgtaatacacttgctggggagaacatagtgtggtcatggacaacaggctcaggcctgccctcctgcctttatgcaccctcctgagggtaccaccaccccactgccaccagagtcagtgctagagcacagacacatgcatacctttgcacacacatacttgtccccagcccttccccctcaactcaaatttctttcttcctctgaaagagataccttcccaacaatacccaacaatatcactggatgaggggaattttaaggacttttggtttttctcctttatattgttctattttgttaaaatatttttctttttttatgatgtttgtttgtttgtttgtttctttgagacagaatctcactctgtcacccaggctggagtgcagtgatgcaatttcgactcacggcaacctctgcctcctgggttcaagcaattcttgtgcctcaggctcacgagtatctgggactacaggcatgtgacactatgcccagctaatgtttgtatttttggtagagacaggggtttctccatattggccaggctggtctcaaactcctggcctcaagtgattcctccacctcggcctcccaaagtgttgggattacaggcatgagccactgtgcccagccaaaaatatttttcaaatcaccataaagaacatttacctgacaggatcattataaagattaaatgagataatgcttgtaaaaggctttgcacagcatttctcaataaaaataggctcttattttagaaatctaattaaaaataataatacagttatgcactgcacaataacatttcagtcaatgacagaccacatacacgacagtggtcccatgagattataatggagttgaaacattcccagcacctagtgatgtcatagccatcataaagtcatagcataactcattactcacatgtttgtagtaacgctggtgtaagccaatctgctgtgctgccagtcatataaaagtatagcacatgcaattatgaacagtacataatacttgataataaattactctgtttctggtttatgtatttactatactaacttttaatccttattttagagtgtactccttatactcatgaaaaaaaaatgttagccgggcatagtggcccatgcctatagtcccagctagtcatgaggcaggaagatcacttgagcccaggaaatggaggccagtttgggcaatctggacaagacgctgtctctacaaaaagaaaaagtttttaaaacttttttaaagactgtaaaacagcctttgttaggtccttgaggaggtatccagaggaaggaagtgttgtgataggaggtgacagctccatgcatgttatggcccctgaagaccttccagtgggaccagaagtggaggtggaagacagtgatattgattatcctgatcttgtgttggccgaggctaattgcaggtgtttatatcttagtttttaacaaaaaaatttaaagagtaaaaaaaaaattttaaatagaaaaaagcgtatagaataaggacataaagaaagaaaatatgtttgcacagctctacaatgtatttgtgttttaaactaagtgttattgcaaaagagtcaaaagtaaaacaaaatttaagtttatatagtcaaaaaattacaggaagctaaggttaatttattattgaagatagaaaaatattttctaaatgtagtgtagcctatgggtacagtgtttataaagtctacagtagtgtacagtaatgtcttaggccatcacattcattcaccactcactcactgactcacccagagtaacttccagccctgcaagctccatgcatggtaagtgccctatacaggtgcgccattttaaagtcttttatactgtatttttactatgccttttctatgtttagatttgttgaggtacacaactacttcccgttaggttacaattgtgtacagcattcggtatagtagcatgctattcaggtttgtagcctaggagcaataggctataccatctagcctgggtgtagagtaggctctaacatctaggtttgtgtaagtgcactttgtgaagtttgcacaatgatgaaattgcctaacagtgcatttctcagaacctatccttgttgttaaagtgatgcatgatagtatatgtttaaagaacttcaggatttacaaagtactttcatattcattatttgacttaaacacaaacttgaggcacacttattatttctggtttacagattaggaaactgaggcccaaagacattaaaatgactgggcccaggcaattcagcacggagcaatgtggcagggtcgggattaagttgtgggacatgatggggatcctgctcactgacttgacttgcggggccccagagcaaaccccctgctcacagggccttaggtcctgccgccttagtggcactgcagctcacacctgcgtctctctgaaaaagaagcccagcattctctggcatttatccatgaccctgggctcccagttaactcctgagtttagaaaccaggcattagtcctctaatccccacaagcccctcccattgtgtggaatctggataaaccccaggcctgagagatgcaggagggaggcaccttccccagtgtgattggcaggacgcagagccccaaggctagcgtgggacaggaggctgcctctggcaggcaggcaggcaagcatctcacagctgccccacctggctgctgggccagtcgccttgagcttgggataaggaaccacgagtccccactttaccatgaatccacccagggcaaagcttcctaagtctttattttttcttatttatataatggttcaatatctgctgttttcttatctcatagggaaaaaggttttgagtaaaaactaagatctatgtgatactgtaaactccttggcatggagagtgggatgacaaagtgtctgttaaaaaggctactgtccctttctttgattgattcattcatttgttcaataactatgtattaaccaccttccatatgccagactctattctcagaattgggaacagagctatgaacaagaaaaatctccccctatcctcatggagtagaatgtccggaaaattcaaaccctaagccaccaacagtcagtacagtcagagctccattattattctgagtattttctataacattttttcaatggaaagttcccaaatgaaagcagctctgccctgcttctaggatgacaagcccagtgtatcggaaaatacaaactaatctcaatacacattgaaacaaacaataggtaccaagggtaattcactgtctagtctgtgatatgcaaagtgaatttttgtaaaggatatctcatcctgcattttaacaggcataaataaaaacctgtttgctgtgcttaaaactggtaaacaagcttttccaccaaaaacattcctttgcttataaacatgtttttctcaaaagtagttaaaattataaacatgtttaccccattcccaataaacataaggctacctccttcaaaagtaataaacagctctaccccaaagtcataaacatattttagactgtacagaaaatttatggcataaattggtaagttgtgatataatttggaaaccacatatacagccaatgatgtaatggcttagataattttggagtacaaccaatatggtagatccaaccacaaaccattaaactatgaggcaagtccagagttcccaggctctgcagttaacacagagacccgctgccagactgtgtgagtgttgatgaccccctacatcttcccggtgtgtcctgagctggctgcagttcaccacatgccacccataagggactctgccctggggaagatggagaccaagatctctgccagtggagaccactggatgcatcaaccgagagtgagtggcagccaaagccaagggggagatgggccagtccctgacaggtggcacgtgccttccccactcggccccctcttgctggctcacaggtgccccttagcttgttgaaggaaataaataactgaaccctgtttaaactaggtggtgtttttgtgtctgatggttcccactcattgacattctttttaaaatcctttttattttttatttttagagatggggtcttgttctgtggcagactggagtgcagtggcacaatcatagcccactgcagtagcgagctcctgggctcaggtgatcctcccgcctaggcctcctgagtagttgtaactacaggtgtgcataccactccttggcatgctaaatccaggctctagctttgactaaaggtgtaattcttcagaataaaaaacccatttatactactatgtgcattgccaatcccaacaaagaggttccgggaagtccactgttcttgaaattttccattttttataaacaatcagctttgggctctgttggagtgcagctgctccaaggtgtgatgcagtgggccctgaaggtgggacattttgcccaaggtaagaaccctgggagagcccctgacttgtccaccaagacctccatccctcatacccttgtctaagaggtgagcaggaccaacagtcttcatcacccgaaagggcaatccaccagcctcccagggaggcttcactgcctcactgccttccgtcagcaacctaattctgacaccttgcttcccagttggcttgctgggttcagagcactgggcaccaagtctgtgtcttggtgtcattgctattcacacagacattgtgtccaggttcctgcatccagaaacattccagaacagtgccagcctttgtggtttctctgtgctgcctctcccacagcactcacttccctccaaccaaaccacatcaccgtcactcttgtgacaaaaatagaaataacgaagtttagaaatcttgatctcacagcctcccacctcctcccacctctgatctcctctggggcatgttcgcagaatgtgtgcaattctgcctctgcttttttaattatcttccttaccttgtcccttaggccctgctgcactgttccaggaacagcctggaaaatggaggtgcagcttccctggtaccccaagggcagagcacattacacatcacagtgccaggggcccactttcatttgcaaaatgctttaaacccaactgttgctctctccacctcctccttatcttcttatttccctcctttgctaactaaaaaaaaaaaaaaaaaaaaaaaagtggtcatcttgctttatcttcagcttgaactagaatggattgtgttgatgtatcaacatggcatcctgttcccaggctctttcctgaagtctgcagggtctgccagagaccacgtgcccctttcccccagccctaatctctccctcaagcagaatttgtttaaagccactattgaaagactcacggaattcccccagccttgctgtcctcactcccactcatgaactcctgtgcagcttcatagtggctcgtgatttgttttctgagattgtggcctcaatatgaccaggaacaaatgtttctgatgtgtttgactcaggccatagtgtgtgggaaatgaaaaggatatacaggaataacagccaatgcagtggctgaccacagcccatggcatcacctgggagctccctctctgggcttcagagcttcagggccacctgggcatgcttgtgacccgtcagtttctccactgtgtaataactccaccaggcggcttgcccacatgctgcccagcgtgtcatccagtagccagtggagtcctgtactttgtgggttcacaggaggtcatggagtttctcagagctgagccaaagggtccttatgaaacagttcaggctacttcagggatggcaaatgtgtttcttctcacacaccaactttgacttattggaagtggctccaggtgctactgagaagaactgcaggtcatggccaagctcactgggaaggactgttgtaacaaatcagggatgccctcactccttggagaagaaggaaagacacatgccctgtgcctacagcccctgggatggtttttcctactaactatgcttgccaattcctgaagagcgaggctggcttagcgaggaccagcctcacctgtctgtcttgttatccagcctaggtgctagggagaaaaataggggataaccccaactctcctttttttttcttcacttttaaaatctaactctataaaaggggtcaaagtgcaaattatacagaaatatatgaaaaaaatgggatggaaagcaagacttaaagaaacagaatatacaaacacagtttgatgcattttttccattttcaaccttagttactttctgctgaattttctctgtttttaggattactttccaagctaaataaaattgctttgaactcataccaaggccttatttggagccagaaagtgtttgaggcagaagtgctattcacactgtttcacacaaattcatcaataccatgatgagccctgagcatgtgtccccagcatttgtgatgtccccaaaacacttctgctatagtcctccaaattcatatgttgaaactttacaggaggtgattaagaatcgagggcagaaccctcatgaatgggattagtgcccttatgaaagggctcaaaggaactagctagccttttgtatctcttcggctatgtggaaacacctggacacaatcatctatgaggaatgggccctcaccagacaccaaattggccaatatcttgatcttggtcttgatcttagacttcccagcctccagaactgtgagcaatacattcatttctttataaattacccagttagtttgttatagcagcaggagcaaagacaccttccatctctttggcttattacttagtctcttacttctggttcatagtacatggcttctcacaccacatctaaactttaaacttcttacaaccacaaatccactctttctaatcagaaccaaaatatgagaatttaaaaaatcaccatgcatgcatctaacatctgcccaacactttctctgatttagtgacatccacccttcaagactgtcaacaaaccacctgttgatcttatcacctaaatttctttgacacttggcagacatttaccactttacattctataaatggtaatagaaaagagtaactcattaagagctgaaaagactagccacaactggggaaaaaaattttaaaaaccacctacctgaaaaaggatttacatccaaaatatacaaagaatgcctaaaactcaacaataagaaaacaactcaattaaaaactggacaaaagatgtgaacaaacatctaaccaaagaagatatacagatggtaaatatgcatatgcaaagatgttgcccctcatgtcatctgggaattgcaagttgaaacaacaatgagacaccactacacacatattaaaatggctaaaatacaaaatattgacaacaccaaatggtagcaaggatggggaacaacagaaactcccattcattgctggtgggaatgcaaaaaggcacagccactttggaagacagaggggccatttattacaaagctaaacatagtcttaccacaaagtcaagcaattgactcctaagtatttatccaattgaattgaaaacacaaaaatctgcacacaaagtttatagtagttttcttcatgattgccaaaacttggaagcaaccaaaatgtcattcaataggtgaatgaataaatgaactatagtacatttacataatagactattactcagtgataaaaagaaatgaggtatcaagcctcaaaaacacatggaagaagcttaaatgcattttgctaagtgaaagaggccagtctgaaaaggcaacatactgtatgattccaactaaatgacattctggaacaggcaaaactatagagacagtaaaaaggtcagtggttcccagggttgagggaaagggaggagggaagaattaatgtatggagcacagagcaattttaggacaatgaaaccattctgcatgttactatcatggtggacacatgacattatgtatttgacaaaagtcataggactgcacaacagagtaagccctaaagtaaactgttgactctacttgacaatgtatcaattataacaaatataccaaaatgcaatatgttaataattggggaaactggggacagggaagaggaggtttatgggaactccatactttctgctcaatttttctggaaatctaaaactgctcttaaaacagtctattaataataaaaatggcaataagagcacaaagcatggaaatttagtcaagaatacacacaagatcttaaatttttaaaactttaaaattttattaaaataatctatgataggagatgattttaataaatggaaagacattccacagtcttggatgggataacttattaagttgttaaaattttccagattaatcaatagattaagtgtcatgataatcccattttagttggatttttttgaggcgcttaataaacttactttaaaatttatttcgagaattaataaacgtttttgaaagctaaatcaacttttaaaaagaatagtaaagagcagaacttgtctattatataataagacatcttttggccaggcatggtggctcacgcctgtaatcccagcactttgggaggccgaggcaggtggatcacctgaggtcaggagttcaagaccagcctggccaacatggtgaaaccccgtctctactaaaaatacaaaaaattagctgggcatggtggcaggcacctgtaatcccagctatttgggaggctgaggcaggagaattgcttgaacccaggaggcagaggttgcagtgagctgagatcatgccactaaactccagcctgggtgacagagcaagactccgtctcaaaaaaaaaaaaaaaaaaaaagacatattttaaagccgtagttatgaaagcaatttggtaaagaggaattgacaatggaatggagaagagagctcagaacatacccatgtgtatccagtgatctaacacatgagagaagggtcactacacatcagtggcaaagaacaatataaatataaatacatgaaaattaaggatttctcttcaacaaaagacatcatgaagagagtaaatagataatggccaaaaggggagaaaatatttgcaatatctaaaattggcaagggatgtatactctatgtggactacaaatcaagaagaaaacaacaaccacaatatagaaaaatggatagagggtataaatgggtaatttcagaagaggaaacagaaaagtaacaagcatattatgagacgctcaaaatcattggtaacccatcaaatccaaattaacagaatgagatacgactttgcatctattaaacttgaaaaataaaagtgatgggaaatacttggcagagatgtggggtgttggcggggtgtagaaggatgtagatgttccagagcgtagtgtggagctacgtagtaaattaaatatatgcatagtgtataaccttcaaattctctggtaaacatcctagggaaattcccgcacagtccacaagagctgtccaagggctgtttgcgctggcgaggagttaaaggcgacctggatgttcatcactgggagagcagataaagaaaatgtggcagttgcacactgtcgagtatcgcccagaagctggaagccaggatcagatgcatgcatagcaccacacagctacatcttaaaaaacgtagtgtttactcaaaaacattagggaataacgaaatacataacataaaagcaggtatgtaaatttaaaatgcatgcacataaaacaacaatgtatctttttcaaagcatattcctaagaggaaacaaaatgacaatcaagagaggggtgcttgcatgaaacagtgtgactatgtggcatgaactgaggaggaggattaactcaaccctctgcacctgaggcagcaacaacttatgttaacataataacataatagttaacataataacaaagtaagttattaacttagtttctacaagttagattaaaaactagctctaaattcaagtctagagatctttgttaaagtttccaacctatttcttgcaagacatttaaaaacatacttccagttggatgcggtggctcacgcttgtaatcccagcactttgggagactgaggcaggcagatcacttgaggccaggagttcgagaccaacctggccaacatggcgaaaccccatctctactaaaaatacaaaattagccaggcatggtggcagccctctgtaatcccagctactcgcgaggctgaggcaggagaattgcttgaacccgggaggcagaggttgcagtgagccgaggtcgtgccaccgcactccagcctcggtgacagagcaaaaccctgtctcaaaaaaaaattaattaaaaaaataaaaacatatttctggatacaacagcatagattcatagtccagccggttacatgacgattccaaagccccttcttatgtgagcatgaaaggacctcgatggtcctttcttaagtaagatgagatgagagatggggacatagtccaaagaagttgatgctttcagcctttcctgcttatcaggcaccatgataaggctgtttgctgtcatcttcacagtgagaggtaggtatcatacacccactttgcagaagaggcaactaaagctcagagcaattcagtgacttgcccaaaatctgccagcccactgtgctctctccagcacaccattctgaaaggtatcaaaaagtagaggggcccaggttcattttgagtctatgcactgcatagctgtgaagtaccagagggccgtgttgcagctatcagccgggacagcaggaagcccagcggcagcgctttgccgttgccttcctggaaggacaggtggaggctcacctgcaccatttcccatgaagtacttgctaatttcatctggctgtgcagcaccatgtgctgggctaccttgcattgccctctggcttgctctagctgttccctcagacttcttttaacagtgcccatgtcttcctcagtgggtgtgctctctcttcatggcaaaatcctcaaggtcagggctacaaatgggactcctcctgtacaaccccagacaggcagcccatacaagcacaaaggagatgcctacctattaattatgtccttactgaattgaaatgcaatgcttctatccatcacattagtttggtagacctttggatttgaaagtgatttgtttataagaatcggctagtgaaaaatgttaaaccataatttttaaaagtgctgggcctcatagcagtctacctacaggtgattcaccacagcattcctggtaaatgtgggcaaagtgaacacgcattacgagcaaaacagtctgggctggccatcgaaaggcttagaatcctacagccaagagggattttaagagacctcatcccttggctcctgacagcaccaagactgtgatgaagggcatgtgccttagtgtcaaggtggccctaggttcaaaccccagcttggcctggtgggaccttaggcaagatcttaagctcttcagacttagtttcttcatctgcaaaatgggaatgataatacattcctcataggattgctgtgaggattcattgcaattgtgaatggacagggtctaatagagtagctggaacacagtaagtgctcagtaatgctctctatatatgttgttaaaattacaaataaatatctccaagaatggagcctcacttagcagtataatgaacatccatcccagcaagatagaaataaacatgataatctctgcttaaatggtcagagaccacagtgacttacccaggttcaaggctgagtacacagaagaaaaatcacttgcagttcatctttcattcattcacactttgaaatgtttagcctatatagaaaatatatcctgtatgttaaatttccctagcatttttcccgaaggatgcttcttaaaagcaagttagaatggcatattcatagagttagaaagaaatgtttgtagaagttacacaaacaacctttttttaatttgggaaatctttttataagcttctctccactgctaccactggcaaatagtgaatcagctgtttcccctggaattcctgctacaggcagctcacaatgtgacaaggcagtcctcacaagttactgccgctccatcaccatcaacatctaaaatacgcaggcagtgagcaagactctaagtcccatagaagctgagcccaggttactggttcactgccatatgcccagaacctagcagcacagtgatttgtgaccaagcaggtgatcaagagatatttgttggatggatggataggtggatggatggatggatggatggatggatggatggatggatgcacggacagacggatggatggacagatgaatggacagatggattgatggatgcatggatggatggacagatggacagatggatgaatgatatgccctctctgggtgctatagaataagttaaacctgtttattctcctttcatactatggcttagagaataccctgtccattcacaattgcattgaatctaaagtaaagatttggggatattttatgtgatgcaattatagaactgtaactatcctaagacctgtaaacaatcccaggtttgggtgtcagcaataaaactctttaaagtgaattacccactgattacaggggtagttgtcaagtgaaaacagtccattgattttcaaatattaacacttacagatgcctgagagataattattaagaattgcattcagttcttctttaatctgtaaccacatataagctaccatctattttgaacttaatacaaggcctaagtccttaataaaaatgtatgtaattctgaattgatcacaaggacagacttttgacagaacctgctcatatttttcaaaaatatgtgtctactcgttgacaacatggtctctttctcaaattagtcattggacttacgaactgttgtatctgagaagaaccagattattaataactcaagttacatatataaattagtgcattcactttgataaataataaatgaggcaagtcaccctgctccgaactgatcgtgccatatcttgcgttgttttctcttttgcagaatttcttttcatttgctgaaagttttaagtcatgcccaatgactgatttattgttttcttcacaggaggaggggggaagcattaggtacctggtacccagcaaaagcccaacaagcaaagttatcagtggaattcctcaatgtgacaaagggctggatgaggggttccttgctggtacaaccaggtcacaagcctaagaaggcttgacgggtgtggctggctctccccccacggccctgctctgttcccgatctgggctttgctgccctgggctgggctgcttctcctggctctctgcaggacctccaggctccaggaatttggaccgagtggtagagacatcgccggcagagacggcaatcgccagcttcctctctgtgctgtcttgtgattcaaagcagattctgctccacttttttaaaaggggagcacatgaatgctggagacccacaagaacagagtcgagcaaggaaacgtgcaacagtgatacaaaagtctgtgagtacgtggctcattcgaggtgagccatgacagggatttgttcatggggagcccaggggcatcaaggtctgattgctgagagtgttcttgtgggagatgggaggttataagagctgtgagaaccctggggcttaagagttttgcaaatgaccctgggctgggacacacacacacacacatagaaagaaagagagagagagagagccctatgtaccaaggtcatccaagcactgcatttgtacttggctgtagggaggaagggttggaaaaaagagaagatgttttctatcttggacctttacctaaaataggcaccatcgtgctcagtggccttgcttgtaaacttctacaggagggtgagttggagagagtgagtgtgagcgtgagtagcagggtgagctgctcactggtgagtccaggaagtgactctggacctcttcttacatcagtttggtatgataccacagtcagacaacttaacaaaaactgctgctggctggatgtgtggcatggtcgttgaaaacatttttttactttgcctttctcttcttgcattattttctagttaatgatctctcttccttggaagagtacatttctggggtaggaactatctttgtgaaaatattcttttttagagactaatttgcatcacaagaattctgatattcgaggtacaattagttcatgtatcaatattttaattcacataggtattctcaaaattttatataccactcatagaagaccaggatttgagtcacagcactgtttctttccccatacaaatgagtcactgggcctcaaaggttcaatcatcctctttatagatgaaatataataacagatactagtgagattgttgggatgattaactgcaaatgtacaaagtcctttttaacatagtagataattatttattattattcctgatagacacagcacagctataagctgactatataccaagaacaatgagtaggattacctcttacatttcttttcccaacataatgctttgcttctgatctgaccagggctttgctaaagtcacacatccagtaagtggccgaagcagatcttcagacccacagtttggctgccaaaggaccacagtgagtatttctaatgctgaaacaagagggtgcagctctgcagcccagacggctgggcctcagggtaggtaaccaagacagctcaatgcatctctccctcagccgtccctagcccctaaaaacagagctgggggtcccagtcctctgtgggacatggccctctttcatcaccagcttccagcctaccctgcatctcttccctctgaattgcaggaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatggtaagaggcctgcccacgtgcacactcacttaccctcctgttcacactcacactctctccagctcaccctcctgctcacactcacactcactctctccagcttaccctgctgctcatactcacactcactctctccagctcaccctgctgctcaggctacctgggagatagggagctcagctccctatggtgtgcacatggggaagagtgatcactggacaggtctgtgacagaaggcattcagactttgggatggtggtgacccttgaattttaaggttcccttctaacctaataggtttcatggcaatgtttcagtttcatttgacacaccctagcatagtgccttcctaggtgccaggcagtgctggaggcacttacaaacattaattgaattaattgtcacaacagctctgttgaggatgataattttattatcatcccaatttcagagatgagcaaataggcatggagagttgaagcaacttgctcaagttcacagagccaataagtgacagagttgggactcaagcccaggctgcctggtttaagagcccatgcttttgaccaacctgcttttataaatctgtgacttctagccagtgccagatctgccagcttatttctatggattatgtattttagagcggctttgccggcagcagcatgagtctttcgaatgccaggtcagcttcccctctgcttacgctcagtgcctcagctcaatgcctggcctcagaaccaatctaccaactccagctaaaacagatactcacacacattaacatttttcttcctagactaggatctaggaattcagcaaagacagaacaaaaaaaaaaaaaaaaaaaaaagaggctatgagctctgcggcctcacgttcattcaaagtggaatgaagctgtcctaggcagggtcatcccggcctacccattcttcaccctgtgggtgagcagggcagtaaagccccaccacctatacctgggtgacactgagcacctttgttaatctgtctgggcctctgctcgctcatatataaaatggggataataatagccctcaattcacaggactgtcaaaagcattcagtgtgatcaggagtgttgagtgtttagcacaatgtctatgaacacagtcaacctccggcattttttaccctgtcattgcatattctggcaggtctaaaaatgttcttcctgtgtgcaaatgtgcatggacaaactaggctagggcagagaaaagatttcacacaaaaattcacttcaagccaacttactctactattttaatgtttctgactaaaagaatgtgggtcccctggcccagagagggtggaaagatggagaggagagttctgtgaccattcctcaggtcacaccacactatggacaagggaagtgtttcaattcttctctgcagacagtcaacattcctaggaatgtgatctcagaaatacatgtgaccttcctcgatagagtaaaatctgattataagtatgtttttatccatttttttcttactacactcaaatgcaagcacttaagttaggctgattcatgagatcaagattctgagtcagtcttttgcaattgtggattctcaggagcagcttcggtagtgaacatattgtggacaagtgatgtctgcctactattgtcctctgcagcctcgtttggctggggaccctggccagggtggactctgggttcccgtgcctccagagaacattagccaggaaactcaggggtctgctgctgcctcctggcttggcttctgcaacatgaagggtgtcagaggggacagaccccaagtgagtgagagtttcatcccagtgaaaaccagccggagccaggtagtggaggaaaagatacccagcattttgtcttacagggagggtttgtagataactgcagggctgtgcctaaaagggagtagaagcagcctaagcaagggggcttcacttctggaaacactcagcttgcatgtgtcaggaatgagaagcttggggtacgccactgtgtctggactcaccagtgggcaagagccctcgttccagctatgggatgcctgggggaggacagaagctgcagcttgtgaataataacatgaaaacaaaatccactattgatcatggaaagaaggaagcaatctcctgtataaacagtaaataaatagaagtccagctgccatccacgaaggtggaagctatcgactccctcaaatgcttattatttccttgacattcttgcagcctttcactgacattaataacacaagctgtctgctgggtcttagggaaacgggggatgggaggagttcttacttttcctctgtatttctcaaattgaaagcatagttctacacaaggctgaatccaaatgttactcaggctcatgacacgcagttgtgggaatggatttaaagccccgtacaagacatattgacagcacaacatcctggccacctcccatcattgtcactgtaacattgcacataaatctcctgatgtgtttgaaaccccatcaccctgcaccctggacctgctgttttcccagccctagaatctctactccaacacacatcaaccttcctaaagcagaaaattaaggaagaatatcctctattcatctactggatgttggtagtgtttttctatttgacttcattgcagcttgatttctttcatatctagcatggtttcttcccaacttttaattggtggatccaggctgatttctgagcacattagctatgactttttcaaactggctttgtatggtagatgaaccttatgagcaagagtggagttgctggcgttccatctcaatgcaatgtgtgctggaggttgtgctaactccttactcacactcaccattgtcaacttatcccaacttgtttttcacagacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtaaaagaaaactgtacatttcaacaaggctaaggcagagggctgcagagacagagtctcacccatcacttgtcagaggccatggtgctcaggccaccttcaattacagcagaagtctgtcctcttaggagatcctacccttgaatgacaaggggacactaagtccctttctgcctctcttcctgctctgaccctctcccacacaaatatacacatgggcacacacacacacacacgagccacaagagcacacaagaacacagaattgtgctcttcagagcctcccacctcggaggaccccacaggctttctcccatgcaactgtcccccgactgagctctgctctcatttataataaaccacctgtgatggcaaagtgcaacaggagccaaaaaaagtggtttcctgggaatttaggttaaggaaataatttaagaaaaagttacacacaataagatgtttagctcagtgttattgaagaaagagacttacaaacagcctcgctgcccagcaatgaggtgtgaatcagtgtagcacagcacctgcatgttatacagttgtaattattatgaaagataattaaaatcatgaacgtttactgagtgtttagtttatttagttagcactgctcccagttgattgtctcagttcaccctcacaataatcctaaggggtaggcgctattactctccccattctataaatggagaaactgaggcacagaaggctcagcctcctgcccagggtccacaggccaggattctaacccaggtggtccggctccagcatccttgatcatttcaaaagtttcatagcaatgtggagaacattcaagacccagtgttggttaaaaagcaaaataggattgggatgccaaggcgggcagatcacgaggtcaggagtttgagactagcctggccaacatggtgaaaccccgtctctactaaaaatacaaaaaattagccaggcatggtggcatgtgcctgtaatcccagctactcggggaggctgaggcaggagaatcgcttgaacccaggaggcagaggttgcagtgagctgagactgcgtcactgcactccagcttgggcaacagtgagatttcatctcaaaaaaaaaaaaaaaaaaaaaaaagcagaataggaagtgatatgtatactacgactgaatggaaaacagtaagtgtgtggacaaggatggcagaattaaatgcaaaaattaacatcttttgtgataaagttctctctcatgctcttttattttaccatgtcttttcaatttacttaaatatgtttaattccctgctcacatccttgtgctgccagggcgtaaggccagagaagcagctcccagtgcaggctgattgtcctctaagaaaaaggggcagttggctcagttgctcagagcacagagtccagagccaggctgcttgggttcaaatccaagctttccatggagctgctagggttctatttcaatgcaatccacattgcattgggtaactgggtggatggtggcttcacccctcataagtatgtgaccttgcccaacttctctgagcctcagttccctcacctgtgaaatagggaataataatagaactgttaggaggagtcggtgaggatttgctaaagcacttagaacagagcctatcacaaagtgtgtgcatattaaacaaataaacagctgggacaaaaactatccccttaagggtggtctgccagctcctctttctgacactgcatgaaattttaactgcagccctacaaagaccataccttgaatattgttttctaagcaaaggctcagtgagagattcagctcagcagcggggcagggtggggactgggggcgacaatgtgcaggatctcccatcacagcacatactccttccaagggtctgcctggggagggaatgtctaataattcctaggaaatggccccaaacagaaccaggagcagcatcccaacctgttcagaaaagaataaaaagcagggtcttcagcaacagctggttataaacacatatcaatttgcaatgaacatattttaataaatactctaccaacccaactccagagatgactcactgcccccacctcccctgactggtcacccaggtgtcaggacttctgagttctcactttccatttccctctccacaccctcatcccccagcaggggttgtcattgtcgcccccatacccagccctacagagcctctgactctggccctgtgaggttatcttaaagactctaggtctaggatttttataaaatgaccatatcgctcaacagtccccaaaagttgagagcagctcctggtgccttgggtccctgacagcacaaggagctgagacagggaattaaatattcttaagtagactaaaaagatattgtaagatgaagagagagaccaccttaagcaaaaagacctgcattttcgcattttaactctgcactccttgtccgcacacacactgggttcggttcagtttcaatgcacatttaacccatggccaccttgctttcctgcttgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtgagctctgcccctgctggtttgtctaaagggagaggaagcctgggcctgagggcaggagagaggaggccaggtccctgctcctaagggatcgggatgtgtttccgcagggtccatctgctggactgggcatgcatggcggaaggaaagactaaggtgcccggagactttagagaggagtgtgggacagtgtgctctgacaggacagtgaggacacagatgtggaagagaaactcagtttcatgcctgacatttccttctgcactagtagagtttggaccaaactgccaccctggcaggcacaataggccgggattgaatggctgctcctttaagatcgggtacagtagtaccctgtacccttatccatgattttgcttttttgaggtttcagttatccgcatcagaaaatattaaatggaaaatttcacaaataattctcaagttttaaactgcacgcccttctgaatagtgtggtgaaatttcctgacgtccttctctgttccacctgagatatgaaccatccctttgtccagcatccccaggctgtctacagtatgcccgttggtcacttagtagccatctcagtcatcagatcgagaaaacatagtatatgcagggctcgttaccatccacaggttcaggcctctactggggttcttggagcatatctgccaaggataagggggcactactctatgtggttctgcatgtgccatcgtccccccccccatacccagtcctagagaacctctaactctggtcctgtgagggtatcttaaagactctaggtctaggatttttataaaatgaccatatcgcccaacagtctttggcctgaaaccgcctcctgagggtgaggtggatgctcggttttattgtttccagtcctctgagccagcctctctcagggtccgacactggttcattctcctggctcctgggacagagctgacctctgatccactgtaccctcaggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtgagcagctgagtccccctcacaggtgctgtgcagccagcagtcagaagagcgtggatttgcacacaggtggtctgcctccagggtctgtgcttagccactgggatgacttgtttaatatgtatccccagaagttagaccaagaggaagtgaccctagagtttgagttcatttcagagccactgctggctagctcacagcacagactgaaatgaactaacttcccagagtctttccaagacaagatattctgccttcactgggctggaatggagccccccaggaccccctgatccagccctaggctggaccagtttttggaaaggaaatgctcgtggttcccttgtaggaacgttgcccaaatcttatcccatcctaagagtatacaactgtcatttttccaaaaccaaagagataagatgacttacgtaattgagcaagtacagataaaattctgatcagacgccaaattaaggcataaaattttgacactttaagtctctgtgcagaaggttctcattctttctaaatggaggtgaactctcctttaagaagacccaataggtacaaatacaaatcaaaaagtgaagtggtggcattctatgttgctttttcaaaacaaaatctattagcaaaactcataactttacaaaaagactcctcttagggcttctttaaatgatgagcttctgtgatgtatttgaaatcagagtaaatttataaccattttttgaccagcattaagcaaggaatgttgtccagtagccactagatgccttggcctctctccactgcctgggcttccagtaggcaaaggcaaagtccttggcagtactcccttgaggagttaaaagtaaatctatgcactagaaggaaaaaatacaaagagagacccagtaagttaagggccaaggtctaaagtgagatctggcataacccagggcaaaaggtgcacttaactctaaggtaaagtgtatctctcaaaactaaatatttggaccccaaaccaaaacccaaatactggatatttcaacagatctctcagggagggagcagaagcaaccctaatcttcctattatatttgagagaaactcagcaagggaaggaagagcagcgttccgtgtcaaaagtagagagaaaaaggaggctggtgcgagaattcgccacaacctttttgggtttaagagacagatggtgggactcatcctcgagcagttcttccctggaagagaccccggggaaattcccagctccactgagaactctccaccgtcctgattctgcttttaggagtctcaaaccctcaagcagtttgaaaactgaaaaacactggcaggcagggaaggcaaggcaaggcagaaatcttagtaacacaactattagttagcacttaacctcattctgataattttttttaaatctccttaagactaccaagactgctgtccaaggaggatagaggtttttaggaaaatgaagttatttcacaagtaaaactaaccaagttttttttgtttgtttttaagctagctttaaatcctttggggaacaaaacaaaaaaagtaaaaactctcttaggtctagatttaggtataaactttggatcacggtagacacaaagtcagcttttaggcagggatttacctctcattctctcaaatcactcattcttcttttagtatgacttgctctgcagtcagcaggcatttttcgtttaacaagagcaaaaaaattttgcacactgtgggtagcaatgcaaaattgtgtgactatgagatgtgctttcaggttagacatcaccaagcagtgcactagtagattctggacgaattatggtgtctagcttccaaagtaaccttttatttataaataaataaaaaaagtgcatagggactgttaatcttcatgagggacgcttagcatactaaaggaataatcaagaaaaccaagaatgtgttaagggttgtttataaccacaatcatatgatgtcccacaagaaagactaataatgccaaatatgtatgtaatgaataaaacatttgattattaggtcaacatagaaggctgagcatgagcatgttttgatattagatataatatatatcttcttaaaatccaccagatcccacatattcaaaatgagttttgcccttcctcccaggagctgctgattatcatggtgtgtggtttatgcttttctaggagtgtttcttttttaaaaaatcaagatataattcacatattataaaattcaccattttaaagtacacaattcagaggttttcagtatgttcacaaagttgtgcaaccatcactactaattccagaaccttttcatcacctcaaaaagaaaccccatatccattagcagtcactcccagctcccctccccacctcccagcaacctctgatctatttgctctcaatagatttgcctattcgagaatttcatgtaagtgaaattatacaattacatattgtacaattatacaatatgtggccttttgtgtctggcttctttgcataatattttcaaggttcatagtagcatgaatcaatactatcttcctttttatgactgaataatattccattgtattgatatagtacattttgtttacctattcatcaatttatagatatttgagtgcctagacacattttggcttgttttaacttcttggccaccagaaacaatcaagtgcacatttttttgtgtatatatattttcaattatcttggatatacacctaagaatgcaattactaggtcatgtggtaaccctacattttacattttgaagaactatcaaactgttttccaagtcactgcaccattttacattcctaccagtaatgtgtgtggaatccagtttctccacatccttgtcaacacttgttaatgaccatctttttattttagccattctagttggtgtgaagtagtatctcattgtggacttcatttgcatttccctaatgactaatgaggtagagcatcttttcatgtacttggagaaatgtcttttttgtagaaatgtctatttcagaggtttttcccatatttaaattggttgtctttttattattgagttgtaatagttctttattctggatactagtaccttaacagatatatgatttgtaaatactttgtcattctgtggtttttcttttcacttctcaatggtgtcctttgaagcacaaaagttgttaatttggatgaagctcaattaatctatgttttcttttgtttcttgcgctttcgatgccatattatattgaatagacaccactgtctagttagggtcacaaaaatttaggtgtatgttttttttccaagaactttataggcttagctcttacatttaggtctttaatccattttgaattaattattgtatatagtatgaggtagggattcaacttcattcttttgtgtgtatctatccctttgtcccaatatcatttgttaaaatgatttttctttcctccactgaattttcttggcatctttgtcaaaatcaattgcccataaatgtctaagtttatttctggactttcaattctatcctataggcatagatatttgtatatttgccagtaccacacagtcttcattactgtagtttgagtccttcaactttcttctttttcaagattgttttagctattctgggccccttgcattttcatataaattttagaatcagcttgtcaatttttgccaaaaatgcaggagggatttagacagggattgtgttgaatctgcagatcaatttggtgagtattactttctaacaatattaaatgttctgggccatgaactcagaatatctttccttccatttaggtctttctttgtttctttcaacaatgttttgtggttttcattatgcaagtcttgcacttctttcattaaatttattctaagtattttactccttttaatttttactcattttcagattgttctatagcgtatacaaacacaattgatttttgtatcttaatcttgtatgctgtaccttactgaactcatttattagctctgataggtttttttttgtgtgtgtggattctttagggttttctatgtataagaccaagtcatctgtgaatagagatagatttacttctttctttctaacctggatgccttctatttctttttctcatttaattgtcctactcgccctccagtaccatgtgaaatagaaggggtcagagtggacattcttgtcttgttcctgatcttagggggaaagttttcagtcttttactgtaatgtgtgatattagctgtggggtttttgtagctgcccttcatcaatttaaggaagttaccttctatccaaagtttgttgtatgtttgatgtttgtttgtttttagtcatgaaagggtgttggactttgtcaaatgctttttctgcatctattgagatggtgatgtggcctttgtcctttattctattaatatggtatattatattaattggttttcatatgttgaacccactttgcattcctgggataaatcccactttgtcatggtgagatttatatggtattggatttaatttgctagtattttgttgaagattttgcatctatattcataaggtatattggtctgtaatttgtctttcttgtaatatccttgtctggtattggtaaagggtatttttttactcaagttatttttgtagcatttctgctggatctgccttcatagccatacaagacaatcactctaatcttttatagtcatatctcacttttactgatgtttttagtttatgaaaaatgatattatccagttttattacccaccataatcatatttagtttcaaatagcccttaattaactctttctcaacataattgaaaaataatttaaaaatcacaatggtaacaataagtgcatgggctgtgctggggattgttccaagcactttacaaggattcattcatttaatctttacaaccctacaaacacgcattacaattatggtcatttcacaagtgaggactgtgacaaagagaagcaaagtaacttcccacggaggtaaagtaactagtttgcaggtagttacttgatccaggattcaaactcaggcattggattcccaagtccatgctcataaccactgtttcagcatttagagttttcaaaaaggatgtgttttcagtacttaagaaaatttcgtaagagatagtccaaaagttttttggagaaatgtcagcatacttggagaaagtatatttcttttttggaaactattctgaagattcaaaacatacctttatgagaaagtatgatacttttgtttaaagtatgagtcatactgtcttgtatagcaatgaagacctttgatattaaatggtcttgttcaatatttttactctcctgcaagttctgtattatttatagaaaaagaccatctaatttccattttgatcttttttattttcaaagaaaaataatatcagcagcccttttaaagtatccttcaacagtaaatttttaaatgccttgtccctggggaaatataaaattggtgtagtgattctttgtgctcaaagggtttactaggaaaaccaaggctttaagttccattcttttcccactgtgctccaaaggcataaagtgcacacagcaaatatgaaaatatattttatccagtataaacactctattaaataaaatactctattaattgtcaataaggcaattagtcaacagcctcttttctgcacctactatatgtgagatgccacacgagatgggaggtagcaaaatgtaggtgactagagcatgggctctgcacacacacaggcttgatttgaatcgaggtccatcacatactcattatgtcatcttgggcaagtttcttaaactctttaagtcttgattttcccatctgtaaaatgaggataataataacatagttatatgaagatgaaatgtctgataatccacataaagctcttatagtatctagcataatgtaagcactcattaaatattaatttttattaagaaatacaaatgaattggagcctggcacagtggggcacacctgcagtcccagctactcgggaagctaaggcaggtggatcacttgaggccagaagtttgagtccagcccgggcaacatagggagaccccatctcagaaaaaaaaaaaaaagtgtttaaaaaatgaattgggatagccacttttctcaggtagtttacaataacataaatgacactaataggaagcagaatgttctatatatcgtaagagcagaacaaggtattaatggggctttaagaaccaaaggtcacaaaatagctgaagaaaagaggaggaggtaacaactgaaaaatggataataactaaaagacaatcaaagtcaatgggaagacttagaatgaacagcaggaacaagagtacagaggtggggaagagccctgtgtggtcagattagggcttatgggaaggcgccatggaagatgaagctggaaataaatctggtggagccagcctgacttccaagttagggattttggacttcatgtggtgtgtatgaaagtatattgagtgagaattttgaaagttgatggtttgtttttgccttttaggtttaggatccaaaatcaattcaacttaaaaagcattttaaattcttggggagtcaccgatctttttgatccactcaaagctaacttgaaaggaatttcaggtaaaaacggttcttcttccaaacgttctagccgtgtatttggggcagttttatcatactttgattaagggattctcatttcagagtcaacattatgtaaaagaataagaaaggtgctctgttttatataagaatgtgttgcttctaataacagtcaaatttgggttagatcttgtgaggaagggatgtttcttcaggccttaatcatggttttcagagacgaccttcaccatggggtcaatgtccacagcacacagtaaacagaccctccctctaaccgtcatgactaggagtgtacccaaggcattgctgcagcaatagattcttcattatgacctcctgctgtcccatcagcttcagtcaccctttgtttctacacccttttcctccctccttcccaataccttctctgtcctcttctaataagctagtcttgaaaccttccctcatctgtccaatttccttttttcaaattacccatactcttacaaccttgccttaaaatgttctcctttccaccaaccacattgaatttctttgcacaaagttgaattgctactaccaatcaataggtgctgtttgcttatggtattataggaaatttatatcaaatataaacagggagtgaatgccagaacctatgttctacaatcctctcaagacaccattggctaaactattgccaactcaaaggctcaggtttgtttctactctggatagtaaattatctgtgcaaagatgatactgtagctggtatttccattggccttgacatttcccttacctgaagggcttgaaaatcactattttgaattctagaacatcataatgtggacttttctaaatcttggctcagaatcttccttcttaaggaatcacaggaaaattgagattttgatccacaagagaagtcttggtttgggctttagatgtgaccagattgacagttacttatcaaataaaacacaggagtgagaatctattctacagagtttaaaatctaccagctctgtactcattgcctgaacacgcaaagagatagcaaagcaatagtcaagtttgggcattgtgtccacaacgatgcttggcacacagttggataccaagtaaatactgttgacttggtcaaatgactcaaacagaaactttccttactgacacaggcataatctgacatttcaagcaaaggaggaatactgaagtgaaaagattggagggcaaggaaagagcaagggatgaagaacttaagagaattctatgtttgataatgtgcaaaatctaaccagtgtcttcttgcaactccagagctcagccatggcatccctgttgttgctggtgattttgatgatcagagttaaaaactgtattttcttctacatcgctgtattttcttctacatcactgtattccgtgaatcactagggcttactgactgtcccttcataactcctaaagctctcccttttatgtcctaaaagtacatcctaatgtgccatcaaccctctgtcctcaaacaggactgatcttaacacacatcatgtagctcccctattggtaaaggcttccaaggtccacaaactcctctggcaagatctaataaataacctagttttaaaagtaccttttttgatacgaaaccttttttttttttttaacgctattcaaatctacttatatttgctcaaaccagcagaaaggtaggcaggcagatctggcttatttaataattatgaagcaattatcatgtgccaagtatgaagcttgcattcacatttcctactgacaaaacatgccagtctgttaattttctctcatgaagttttgttcctctaaagcaggggtcagcaaacaatggcctaccacctgcttttgtgaagtttaattaaaacatagccactctcattcattcataaatcatctatggctgctttcctgctacagcagcaaaactgagtagttgagacagacaccatatggcttgcagtggctaaaatatttaatatccggccctttatagaaaaagattgccaaccaaattattgcttcttaatgtccttctttaaacataatcaagagactaaccacttctctgcccaaatgggctttcaacttaatattctagagacagggccaccaaatctctccaacaaatagtttcctcattcctaaaatggggtaactaccactcaccacacatcttaattgtagaaacaaaatcatttacttatagtatgacatcagcagagaccttgccagagagtaagtgatcagaaaatactggcctctcctctcttcttccagtttacgagggattaccaagcagttttgtactactgatggaactccaaccaccacagcaaacatttggcctttcggtcccaaagcccagaatcattttactcaaattctctttccccatttacaagtcacttatctcttccttcttggcatcaaatattttttttgctgccttaaggactcattcaatattatctcaaggcccagctgaaaccagagtgtagttcccccccagtctccttgatactagatgttatgcagcttttaagagtaattccagtttcactcacactgaagatgccagctaaagatactcttcttaagcaatcccactggctttaggatcagcaggctttgatatagacccatgcctcctagtccacaaaatactccttgtgcacaaacttgaaactctgaagaaactgtcttgttcttggcttttataagtaggtagtttccaatctctgctcggtaagaagtacaagttctctgttactatgacttaaatgaacaaaccagagttgtttggttgagtatggaagttatgtaagttaacttatgccacaccagatgtctggtcagaattgcaatagaaagaggtgcagagtgggctagaggagacaaatggagaaagcaactaaccatagcctaatttcaaaggccatttcagattcttcttagcactctctctccctctcctgggccgggtgctatgtgtttctctctctagccccctctccctaacacttagtgttagcaactaagtgacaagatgaaaaagataaactagaagcaagttctggcaataacattttaaaagccactaacactggctacagcaaataattgtaaagacaaaagaaacagcaaatgatatgtttatcctgatttatgagaagctgaggatgaaatgttgggacacaatgtttatacaacgtcatgttttgaagacttttaaccttttgagtatgaccagccatacacaaagaataacggtgtccaccaacaaagcactgaaacaatcatttggctgagacttgcagatgacccattctatgccacgcctttatggttctacaaacaccaatcagcatttccttacaagtttaacaaggttaaagaacattaaggccattcgtatagtggtaaggggtgtctattattaattcatccagcatttactaaacacattaatgtaccaagtatttttaatgtaagttgggcaaagaaatatttaaaatgattaagacatcatttatgcttctaggagctaatagtctaaaaaggaaggtaaaaacccatagaagatgttatggaagaagagtggagagtatgccaggagggagggtaggaagagtatcacccctttgctttgtatatagaatgttgtattgtaggagcaagcgagtttatggtgggctacagtttcccaaagtatgttcccaaaatgctaatcctgtaaatctgggacagagaatggtgtgggtggttctatggttaaacgctatgtattataattgtcctgtagagattcactataaaagttagcagattagcagctctaagaagtcccctactgaaaacaaaagtgcaaaactgtttagcatctcccacatataattaatcatggaacccttttacagaatgccacctataaacaatcttgagaacaacttttgggaaaatagggcgtatgtccctcaatggcactaagcagctgtcaacacttcaggggagtagaaaaagaccaggagaatccctttgtgcttgacttctaggttcatttcattagttctgtaatatttcaatagctactcaataaaaaataataggaatctgtaatacaagatcaagtgggaggaaaaatgcaaaaccatagatgactcccatattctcatttttatcgcatatgttggtcttttgaaatgtcaactcttaccagagataaaatttaaaagatgctgatgctggggcatgacataggctatggaccttggtttatggctgtgcaaacatataaatgtcaattattggaccactcctatagtctgatggagagaaactgtttaaatgaaactcttcagttgcagtttcaaaatactgaaatagcctggcccatctaaccagactcatccacatcaactggtctcatttctcacactgccaaggtgcccagactaatacagacacatttactgtattttagctgataaggggtttcatagtgaatctctgcttatttcaccaacattcatttaaaatgttcagacaccatcctatatagtcatgaagtctcggagattagtaaaagcctctcatgactgtcaaataaccattctttaaccctaaagctctttgtaactttggcactgcatttcagtttgcttaattagctagtaagaggggctaattattgatagtgaaatttgtttcttaaagaccctagagaaaaagaccaactgctaaaataaatcaaattctttgctgattttaggacaagtgacactagtgaatgtttctattgatttttacttcctctggcccttcctgtccccttcactgatgctggaaaataactgttccttacagtgaatatagccaactcccaacatcctgtgcacatcttacaagatggatggaatgccgcatattctttattttggtctggttttattctctcatggcattcatgggctatctcctgtgtgtgcgtgacaaacacaaaccaatttaagcgttagtctaagatgaaacaaagctccctcacacaatatgtgttcatcaaactgatcattttaacattcatgccacagatacctcccagtggcatgttggagctgactagcatacactttctgaaaggcggcagtgtttgaatggaggagaggggtgggatgggagtgggctttcaatcagaatattctcaactctgcttttcaaatgtgtgatctcaggtgagttcacagctcactctaaaatgaaaggattggactgaatgatttcctaagtttcttctggttctaaatctttcattttttactgtgtcatcaagtatcctttcatctttggagctgtttaaaaatggttaatgattagcttacaaaaatcagccaattcctctaaattatcacttagtcctatttgctaaacttataatctgtgaaactgttagcacatagaacatttatactaacctctcatttgctttgtagattctagcccatgaggcaaattaattgcataactgatacacctaagtatacagaatacagtcatgcaacactagacacattcatattactctgaattgtgcctcaataaagcctgtaataaaaacctgtgactttgtcatttaaaagtggctcttaaagtgcagtccaaaaaggcattcaagggaaatgatctctgaagcttggtgaaaatgattcccgggctacagaatctgcattttaacacataccctatgatcactgaagtttaggaaatactggctgaaggagggattgtagttttaactagaatcatttctgaaaatgaaccactgaaaaaatggggcagtgctctgaatattattttgggagcgattacatattttaacaaattaaatatatataacaaattaaagtttggtaacatattgagtcttaagaattttccaaacagctacctgagcctccagtaaaaacaaaaacagaattttccactctttccctagctacacagtaagcagcattggatactataaattttgtaagtacatttttaaagaatgtgttctaaatgtgttagaaaaatgttaatgagcaactcacatttttatcattttctgtggttaggccaagatggcttttatgtttctgaagcaatccacaaggccaagattgaagttttggaggaaggcaccaaggcatctggagccacaggtatgttcagagaatacccagtcacactgcttacccatatctacctttctgaaatttacctagttgaatcttcacacttctgaatctttccataacccccaagttcaggtgtggtgtagtattttttaaaaaggaacactaaagaaaacaaaaagtttttgaaaaatgacggggaagaagagatatccatcccataaaaataattctgaaagttaccttcaataaggaatttattccatggaatgtgttgaaaacaggagacaggattggctaaatggcatcttttctctttaattttcccatctgcacccccatcacaacagtaaacaatcaaatgccattaggatgctttgatttcttaaaaaattaacttacttcataaccaatagttattttcttaaaaatgcacagaaaatgcaatggaatttttctttctttcctgcagctctgttgttattgaaaaggtctcggattcctatttttaaagcagatcggccattcatctatttcctgagagaacctaacacaggtattacagtattttttgacaggattcagataatttatcagtgtctctctagcaacaagggctcatttgtccactatcccctcaaaaataagcattctttctagctgtttttatggtgcttcagaagctacccagttgctatcttctatcctaagaaaggggactatttcgtaagtacaaaggaaacttatcctccatgttttttaccttctcattctctcagctcatatatagttaatgtagatttttttttttaatgctataggtttctacttctgaagacacttggaaaaatcatgaaagtaaaataaattataaatcttgcccttttttccctttgtcccctagctttcttatcattttagagttttttcaggtcactagagtacaccagagtagtcctcttgtgatcctagtattctaatgaatgcacctggatttctatactgttctgttgatctttctcaaaaatcaaatgtttgccctagtacttttaagtcctactacataaccttatggtaatccaaagatggtgtggtaccggcaaagcctcagtacatcagaaggacacacaaatattcttaggcttcgacaatattgaacaaagtctttagattatttctcttaatgttcttcctcccccactcacaattacttagcctaggaaggaaaagagattctcagttaagagttgttggcaagtctaaacagtgtattaaaaagaaataggatagaacaagactaataaaatcaagcaaaggtggatctactttaactaaacatcaggcattacttttatttatggagaaaaatgtcaaaagttagaatgaaaattatgcatagttttacataaattgttaaggaaatactgtcaacatcattttatctgagaatcatttgcatcctgctgtaccttgtgctagaaatcaaaggaacatttttgtgacgagaaagatataaaccattcactagaaaataatctatttgggattatttggagagaaaaagtccatcaacagagtatgtcttcctagtatttcaccatgatcatcccaaccacataacgattagatgaaaatatcacttatcacccagaacaggcggcagagagccttctcttagaaaggacacgtcaaaaaaatgaaagatgagaaaaaggacaggttctactccctaaggaaacaaagagacaggactacatttgaacagaaaggtcattgccaaaagccaatagccaataaaggttgataggtaaaagagagattctgattttggaattcaagtgcataaaaatgatgtaaaatccttaaacaaggaaaagacacaccactatttcaatggtaggagttttcagaactgcctcagtaatcagaatgaaaatataaggataatccaaaaccagttccacaatccactggaattctaatagtccttgtgactttacctctatctgggaggcattagcctacatcacacaacacagtggctgctcttctggtgatggttatggaagagtttagaaatgagtctcagccttcattatttccaactgacaaatcttactaagagcaactaatgaatcaatcagcaaatgagaaacatgggagacattaaaaaaaaagatttgaaaacctcaagattaaactttccaagaatatcatttgtcgagccttaagtcattcagtgacataaagggcctaaaagacatgatgtttcccctagatgtatttcccttcccctttgacaataattctacaacaagtattctaatttaactaatatacccattttttttttaaatgaaaaaagcctgagggagatgagatattaacctttagttctgataggtttcaaaccctcctgaccaggttttaggatgaggtgagaacagtggcagagagataaaggacaaaaagaagagatgaacaaaactgctacttctcacctccctccagggttcattcagaaaaatgtattaaaggtcatgagcaatctgtgaaacagaaaataaaactttctgataaggaaagctgctcaatattgggatgggctgaatctctttcctagatactcttgttaagtatgaatttttatctgaatgacttctaattcctcctagtaattccagaatctaaatatatataatttaggaacagacaatatattctggattttgtgtaactctcaatgaatttagcaatgtgactacaggcaattaccttaacaattccatctattaaatgttatcttgcattacttaaaagtatttgtatagaagtaaacaaagcttaaagaactgcatatgaaaatactatataatattaaattcttctttttcttgacagggtttgtcttcagtattgggagagtttcaaatcccctagactaaatgcatgttctccactttcatcaatgcttttcttcataaagttataatttcattttgctatacccttgaaatttaaaaaaatgtctgataaagtgtaaaaagctaagggtatgtgattttcaatattataaacctaaaaatacttcagtttttaaatgttataagtttattttgcctactcttaatccaaatctattttgaccttcttttctactgcttaccccccaaaccactaaaaggcacagcagtgatcatgaatggtgagtgagtcaggccataagattgcttcctcagtacggatactctaggccatgttgaattgagggtggagaatgaatagcgtggttttccttatcctgtgaaactcaggggggatgcaaaatgagcaaagtcatcttaaaggtgtttcctttccatttagcttataaataaaacagagtttaagtgtgagaacagcagagcagaacaaggaggcctccaatttgttgtgggcttttgcaagcatggcatgaagctgctaaaggctagatatttcagagcatgtactgtactccaaacctaccactccctaacagcttcagcttcgtgccatccacaatcctagtgataaaggaaaaggtgttgaagtaaggaaaccaataatatccaaagttgtttgctttttaaatagcttttaaagtatctgtctatctgccccatacaaagtcattcccataatctaggcagaaatgggagtatgttggcatggccaacaaaaactacgaacatatagtaaaaaggcaatgcagattatgtaacatgtaattacagttaggcttaacaaacatgaacttcaagtggtgtatttttccaatgctaaaaagcaaggcctttaaaattccattatcttaggatgtttttaaatgattactttaaatgtgattatttcctaaaccacacaagagtaaaatagagcatttattgatggaataacaaaagtgcttttcttaaatattcttcaaaatacatttgtacaacttacaataatatatccaaaataactgtatatacaaaacattacctagttttaatgtatgtgcttttttccccaaaaattacaaagtaacttcttttttttttggcaaagttcaaccttaacagaggtgacaattttaaaggttggtttaagaaaatagaacctgagggaaattgacacgcaagagtcaatgacaagcaagagatttggaggaatatttttagtttgttaaattaaaaatgttttttagagtgatacttttcacattacaaaaataaaccaaaatgaagaaaaggtcactgtaaaatgatggaaaaaggatctgtagatttgcttttagtatttcaaatagccaacaatgcatgtcagaaaatgaatgcaagatcacaacagtcttgtatttactttgtatttgaagaagatagtgaaataagtggccacattctattttcttttaattgctattaatatggttgatctgattggctcttcgatgaatttcatccaagaagttctccagttgttctattagcattcgttttttaaacctgtatgaaaaaataaatagtactctcaattactttttaatgaatagtatatatcagtataatttttttaagaaaggagagaaaattttgggaagatttttcaaagtgaaatgaaaatagaaaaatcaatactacgacaatataaaatatgttgaaagattagcaaattattatcctagtacagtattatagtttgtccctaaaacactctagggctaaacaatgggaaagaggttgttccttccacaaccgaaaagaaaaaggaaaaaacaaacaaaaaaacaaaaaactaatatattcaaaatatattcaagggctgcaaacactctagtgaaatttgggctccccaagcaaatacttcaatagcttcttctcatgctctttgtaagctgaatattgaaaggaatgtgaacaaagtatgaatataatctcccacaaaatggaagaagaaatgaaaattggtcagcagcatttaaaaaccatggtattctattacaatttgagagctagcaaatcaaggatagacatctataatacagagtatagcaagcagttaaagttcaagtaacaacttttaaagattttcagtaacaaatatggacagactaaaattgcatctgtatacgtaactgctgacggttttaagaatatcccaagacactggacattttattcctacttccttgctacttagaagctaatataaatagccaccataatactacacaactctctaaaaggtggcagaagtgaagtacagataccggggatataaattcctaatgaggttttagctgacagaatgttaccataaagagcataataggttaaatactcaaaattacatgaaaagttatagccttatcttgatcctgcaaactggcctatgctctagccactccaaaagtacaaaaagaaaagaaaaccagaaacaaaaccaactttatctaaaatcttcatgtgtagcatagaagagacagggggacaaagtataagtgtgtttacatttagaaggtgggatgtgataagccccaagttttcttataatactaaaatccccaaaatcttgaagggaaaataaaaaatgtttttaaactcatacaactatgttttccagttaattgcacttcttaattaccatttataacctttatccaccttctttacacagtgatccctcggtatggatgggggatttattctaggcctccctatgaacactaaaatccacgaatgctcaagtcccttgtataaaatggcccaatatttgcatgtaacctatgtacattctcccatatgctctaaataatctctacattatttataatactaatacagtgtaaatacgatatgaattagactgaattatttagaaaatgacaagaaaaaaaaagcctgtacatattcaatacagatacaaccatccatttccccgcctccaaatactttcaatctgtggttgcttgaatccaatgaatgtggaacccagggatacagagggccaatgtactaatgatcctgggctactgaaacaatcagaataaggcccatttgtccaattcttgtctccttaattacgttttcccatgtaaaaataaatgacactcaagtacgttatttttagtcaccaatattaatgtataaaggagaaaaattaaaggttataaaatattaatgtaaagatatcaaaaagctacagagaagaataacaagaattctccaagtatccagtaatttgtagggagaaaaggtccataattcctgaagaatgtatgtgtggctgttttctaagtgaatttctttcaataaactaaaaaagaataagaatttatttatatgttggtatgccatatacatttataaacaatacaagtgcaaaacggatactattaaaatactgcctatataaactgtggactcatttcatcaccatttcattatatgcaatagtttatttaccttgatgcttctttaatgacattttgtaaaaatattagtcttgtttgtaaactgccttgcacatgcttcagtaaagtgaagattctttcatattcttaaagcaaaagaaacaaaaagaaaaattaagtgcctttcatttgtattcttattcaatattcttcttttgcagtttatgatattaagatatactgagataaaaacattctacataaaaatttcaccactcattagagattttatattttaacatatatgtaaaagtaagtacacagcaacaaagataaaacaactaatcaaaccctgctttgtaagtaaaagttcctattaaggtatcaaacataaagcttaaaaggatgagtaaatagctttatggtagtatcactaaaaaataagaacaagtggcctttacaaaactccatccttacagtttaaaattctaacagctaacatgggggtaactgggaagtgggggtaaaaaccagacaggttaagagtgttatttcagtttaaagttttcatatgaaactctgcaagggctataaacgtctgaactccaaggactgatttgttcccatttctggaccacccaggtcattctactaccccagggcaagtgatctgttaacatcctctaaatgaatgccaataatactgaactttttcccacgaagttcttttgtgttcatataccagagagctttcataactttagttttttggcctaaacatatcctataatatcacagtttaactactaaacatagtggtaggcactatgacaagaactttacagacatgaagtcatttaattttcactatatctcttgtgagctagctgctatattaaaattccatcgttggtcagaatattcaagactatgggttcctgtcaatttatctgtacagtgttgctctgctctcagtccctgctgcctaccaccatacctagtaccttggaaatagaagatatttggtgttggtcagatgaataaaggatcttaactgagatgttgttcaagacagatctagaatcatatgtattcttttactacagttacttgactttttttttcttttttgctttttgagcacatacagaaatcagatctgaggttcgtctcttattatacatacttcttcctggctttcggatctctttcattatttgtgcttttagttcagtattgacctcttcatggcttctgcaatgcatcaatttctttcctttgttgagtgaagatgctggtatgttctcttcagcacattgttctttatctcttggctcctcatgattttctaaaaatccaccaacagtgaggtcattggttcctaaatggtcatgaccaagagcctccatatgattggttggccgttccagtaaactggctggagaagatgctgaaaattccgtatccatagcatttggtgtaatgtctgatgaaagttggtctgcaacatgattttcaaccacatcatgtattatcgaatcattagtggtttctgaaactaaaaacaaagatacggggaaaaaattatgggatccagtctcaaagcatacagtaaataaagctacaaaagaacattactacagcaagtcaactgttttccttgactaatgcaagttaacaaataatgtgatatagtttttaagcattgccaaagatacggtagatttcaatgtgacacatacacagtatttacaaaatatttacaatttttacccttggaggaaaaaataaagccaatttcaagtagtttttagttttctggtttattctatagcaattttattgaaacaagtaggttcttgatacttcaatgaaatatctatgatcaaaattatcacggtcatctatctctaccttagagagccctaactcacacatatgccttatacatctggtatcatttagaggcaaaagtaaacactgggtagtttttactttccacttatatttctgcctttaactgttccaaattctgcagggaacataccaccaaacaggtaatgttttacagtataccttctaactagagaatctagtcatcatttatttaccagtgcagagcaacctggtgcccacttcagcttattagactactaaaactgaaagctcgcaagccttcctcttaacaccagattattagacttgccccacagaaagcagctgaattttaagttctctgattgctcaccaacctccaggatcccagctgaattcatctctactgtcctcatttcctgtccaaactataaacttagtttacccatattcccctatacactcatcacaaatcccccaaattcctgactctctcctaaattcgattccatgatttgcaaactcctctttactgaatattctctacaacaacttatgctttaactgaaacccagctctcctgtatggagactgctctcctttccagaccaaaagtagaaattgctttctcttgcacaatctccataggcataaaaggacatggagtcactgattccttcacttcctagtgctattgcaaaattactcccttgcactcttgtgagactcaaccatgccattcacgctgtctctccttatcactatcttaggccaatctccagggtacaagcctgtaagccactgttgtctctggcacccagttcatagccttccttctgttgtgctgagcccctatcaactccagtggggatggcaccaagttcaagaagccaaagaagagacccagagccagcaaacaagacaaggcgttttgttgggggctacataaaggggagcaagcccagtggtggcaagctaggcaggagaagcaccttacatacagtccaatggtggtgggctggacaggataactgcacggcccagtggcagcaggctgggcagaaaaatggcaactgcttgcaaaaagtatacagtttatatcgtattttcacttagcactcttccccctaacaacctccacctggcaaccttcatttaacccaaaacaaagggcctcaatcccctgtctggcctgcattcacttcacaatgggttaggggcacagatgttccttatagatagggaatggatctttgggttagccaccctattccctagctcagaactcccaaccgcatgcaggtgttgtctgcaagcagggtcattctcaaggtatgcttcagttattgctatcaagcacatctgccatgcacattccacccccaaagcccttctgacttcattcttggttcttactactactcgaagtctggtgtgtggacaagcagcagtaccaccaacagagagcttgctagaaatgctcatctgcctcagactgaataaatgagaatctgtagtttaactagacctcccaggtgattcacatgcatattcaagtctgagaagtgctgtggtgacttcagtgtttaagcagatcacctgttaagaacctggcctccccattccccagcttctctctaaagaacttacacttacaccttcgcctttcacatccagacaaattcagagatggaggagtatcatcttcacagtactcccgctactgctccttaactcagccagactttgactctagcaattcctctactttcttcctcctattaaccatatcccttctaagtagccaattctgtatcaggcttatatccctgtaagtaaaagtgatatatcacttttactaatgtctgaatttctcttattctactgtcttcccataacatctgccaagcaaaatcccatctcttgactcactatctgcttgccccagacttgcatttggaatcatgagcgctgctggagaaatagggcccagctctacagagtggtcacaatcaccatctctacttggatcccaggcactgtctagcaaccttatcacaatcttttctctctctctcccacagagattgttaaactccctcactctcttcaaacctctgactttcccaatatccccttccgtctcagcagtatacttcaccttctacctcacagagctcggaagaaaagcaaagccatgattaagggacttcctttaccttcctctaactaaattgcacacaccctcgccccacttcccccacattcagtgtcaatggagggagcattctttcatctatgctctagaccattccctcttgcgttctcagtaattttgtgctgagtatgccttttctcatttttattttc

SEQ ID NO: 311 - DNA, 81032 bp, Homo sapiens
gggcacccccacaggagacagagaaggaagctgggtgttctccccctggctcctgccacagggtggcatgcatcaaggggggctgggtagggaagctcctgacaatgggactctttcctggtggtggcaccaccaggacagggggaggccccagcttccctgtggacccttcaggctagcagtggtaggggcttcccaccacctgagctagtgaactctataccctgtccatacctatgcaaatagctcccttatgaaactctcctaacattaccccatccacatgtgccaatgattcgctgatttgcacaggaatcaatggcttggaagaagattctgaaatcaatcatggaaggcttaggaaatgctgccctgcccatgctcctgatggcacagaggccgacatcatgctgcccgtgctcctgatggcacagaggccgacatcatgctgcccatgctcctggtggcacagaggccgacatcatgctgcccatgctcctggtggcacagaggccgacatcatgctgcccgtgctcctggtggcacagaggccgacatcatgctgcccgtgctcctgatggcacagaggccgacatcatgctgcccgtgctcctgatggcacagaggccgacatcatgctgcccgtgctcctggtggcacagaggccgacatcatgctgcccgtgctcctggtggcacagaggccgacatcatgctgcccgtgctcctgatggcacagaggccgacatcatgctgcccgtgctcctggtggcacagaggctgacatcatgcagaaaattatggacattaatgaatttgagttaacaatagattcaaatgaactgtcactggagaatttctggaagccataaaccaatgtgttttactgatatattcctcttcatgaatgtacaatagtgatacatcattttttaaaatctttgtcttaataagtctacctatctcagtaagtataaagtaaaaatcctgggtgataaagcactttatcacaatttagctgaccacctacattgttttaatgaaacaaagtaatgataaatcatacaatcaatggtattttagattcaataaaaaatgacagtggcttttggcatgagttctgcctaggctggtggtaatactgtgttccctgctttccttctgcagagccatgcatagccttagctatcttttcattttcaacatttctgaattactttattttagaagtctctcttttacatagctcagggttttgctttatgagtgacatttgtttgtcttatttctaccaagaatatatttaatgattttcacaaatccttttgtcatagttccctttgtcgtctcttggttggctgaaatttattctccaatagtttcctaaaggaagagcccatgagaacagtattttctatcttaatgcatgtttaatggtttaatggtgttttactgactttttttttttttttttttttttgagacggagtttcactcttattgcccaggctggaatgcaatggcgcaatctcagctcactgcaacctccgtctcccaggttcaagcgattctcctgcctcagccttcctagtagctgggattacaggcacctgccaccacgcccaactaattttttttgtatttttagtagagacggggtttcaccatgttggtcaggctggtcttaaactcctgacctcaggtgatctagccgcctcaaccttccaaagtgctgggattacaggtgtgagccaccgtgcccagtgttttactgacatttttacacaaaaggacagtttgccttcaactttcctcttttcagtattttgctggtgttgctttgctaccttttagttaaattttgccaagaggaaactagaggctaatcttttacctgccttgcaagtaattttcttttctttttttttcatttttttatgttgttgttgctttggtcgtgctgacttcgaaattctttatcttcaaagcacaatgattttactagaatccatttcagcgtttacgattctagttctattttcctagggcatagtatgcctttcagtatgttgcttgtttttaatttcaggaacattttttgaattaacatgtaaataatcattgttatttttttctgtaggattttaattttttgtgtatcacaactctcatctgatttctgatcatcttttctccctagtccttttaatttttcctttgttcccatttcattgaatttacttttctcatctggcgtctctatccatttgtgcgtcttcaatttctgttcttcctagtgctccttttgatttcattttcttttccttttttcttaaataataattctgagttctctaagctcatgttttctctactgttatttagtcatcatttccttaagttctcaaatatctgatttgtgattctcctgcatagaggttatttattaagtttttttttatcatagagaaacagtcactttaaaaatctgtgctgtggcaacgtgtttctggtgagtgttattcctctattgaaattttgttgcttttcttcaaaatttgtcatgtagtatcttatatcagtgatgccccagctccttcctacctgctattgctttttttccccatcattgaatgacttagaatttgtggaaatttcgtatataaaggaggggtcaagggaaccctcagatttttactgtaaaagattctgccctctgctgccatagaaacagttagattcctgcaagtgtggccagttattgtatttccctctctctccttcttttttgatatctcatttcctctaacactttgagctaagccaagttcaagaagccttctcccttatactctgtttctccatccattgttactaacaaggaatttagctgtatgtttcagttcagctgtatgtttccatcattttcgggaaatgtgtttttctgaacttttccaaagatctgctacaatttagctcaccttcagctcttcattattttactcttcaatcttgcttgcatgcttctgcaggatcttagctgtttctagtatcctgtgcatgcattttgtactagagggaatacatctatctcctagttttgctcaaaatggaggttttccttttacgatttccaagaggagaaagggagagatgatgatttatgcagcaatgctcatagtgtaaatccacttcgaaatgttttaatttgacttattggaaatattttctgtgggaatcagcttttggttaatatactatacagagatgctcctcgacttacaatggggttacatcccaagaaatccattgtaggttgaaaatacgataagttgaaaatgcctttaaaggataagatggtcaagatggtgaaatgcagaagtcctgactcatgtgcaatggccattactgtttgcagcttcatgccgggaagttatcttgagtttcatctcaagaataattgtcttcttctcatcagaagcaggaaacacagaggagtgtctgtagaaatgaagagatgggaaaacacgatatccaaaaaactgcaggcaatacagtccactgtgcagtattggctgttaccccgatggtcatggggctgcctggaagctgcggctcgctgcccctgcccagcagcaggagggagtattggacagcacgtccccagccccggaaaagatcaaaagtcaaaagtggaagtatggtttctactgaatgtgtatcactttggcagcaccgtaaagtcaaaaaattaagtcaaaccacggtaagtcagggaacatctgtctagctgtaggacaattcttgaagaactaattgcagtgctcccagcatggtgcaaatatgagggtaacattcagtttaattaaatgtcaaatcataggatggaaaatgacagtatctttgtccaaaaagcagatgcagaagcagcataatccacagaaattttcaatttcatttgctacccagcggctcaaatccattatatgttaagtattgttccagggcttcagcctccccggcagatttctcctgtttttgctgttgctgcagggactggccccgtcttctgaggaccaggcctccacggtggctgcacacctctgctttaaatacttttaaagttgcagaaaaggaccttcttgaagcaaaaaagacaccgtcctcttctgcatgggccaatgctcaacatacacatgcatggaaaaaaatttccaggaagtgataaactaagcatggggcaaataaaacaacacatgacctgatttcatctccaagtttgctcttgtgtaggaaaagataagcatttctttcaatgttaagttggggtggtatctaataaatcagaatgaaaactcaggtttcataaaagcagtgatttctcttccagagagggctctgaatacattgttacttacttgaacatgctgtccttcaaggtaggagctgaggcagggcctacacctgtaatcccagcactttgggaggccaaggtgggaggattgcttgagcccaggagtttgaggccagcctgggcaacatagtgagacccagcctctaccaaaaaaaaaaaaaaaaaagaaaaagaaaaattagccagacatggtgatgcttgcctgtagtcccagctaccggagaagctgaggtgggaggatcactggagtccagaaggcagagattgcagtgagccgggatcacgccactgcactctagcctgggcaacagagcgagaccctgtctcaaacaaataaaacaaagtagaagatgatatccaagccatttgtgatttgttctgaccttccaatctatgatttaggtattgatttagaatgcattttattcatcctataaaaatctctgccaattattcttttttttttttttttttttttgagatggagtctggctttgtcatccaggctggagggcagtgatgtgatcttggctcactgcaacctccgcctcctgggttcaagtgattctcctgcctcagcctcccgcgtagctagctgggattacaggtgcccaccactacgcctggctattttgtgtattttagtagagacacagtttcgccatgttggctaggctggtcttgaactcctgacctcaagtgatcctcctgccttggcctcccaaagtgctgggattacaggtgtgagccaccacgccctcacagaacaatgtattccttaactttttatatgctttttttagattgaaaaatttcaaaattataagcaaatttaatgcttgaaattggacatcagcattgagctggagaaaaatcaatggttccttctgatgtgaaaggaagcaacaatatataaatacaggtctatgtcttcatttctccttgtaacaaaaatggggtattcagtgttgaaaatttccttaggcaattccccaaacaactacttaaaaatacccagagttggccacttgttctgtgcctacatcagactccaaaaaaggaacaaacactttcagcaatggtgattgaccctcctataagtttctctcattttaaaacatgggaaaatcatcacttctcactcaatagaagaggttaggtttagggccgtgctatgtttattttattgctactatgtaagccaactttgattctggccagaacgatcagcttatgtttatatcagctttaacaagatccataactgttttccctcttcactagcctggctatatgtgggatacaaacttctgtgcttctcacaaggaaaaaaaaatccaatttcaaagactcaggtctaaccactcaggtgactttaaaatcaaattattctatagaattttacagggtgacagcatatttgttgaatgatatgatattgatgtgtacatgaatttttagttggagactaaaatctgttttagaaatagatccagtgctttttagaaaatacttaaatttttcccattgatcatatagttccctaaagttttagctttttaaaaaatctaaatggcattatgcttttaaagaaaggaaagtggaacgtttgattatgaaatgtagggaatgctaatgttttatagtttatgtcttcaagaatcagtttttaagttttttttttgtttttgtttttttttttaagacacagtctcgttctgtcgcccaggctggagtgcagtggcgcaatctcggctcactgcaagctccgcctcccgggttcaagcgattctcctgcctcagcctcctgagtagctgggactacaggtgtccaccactacgtccggctaatttttgtatttttagtagagacagggtttcaccatgttggccaggatggtcttgaactcctgatctcgtgatctgcccacctaggcctcccaaagtgttgagattacaggcgtgagccaccgtgcctgccccagtttctaacattttttataaccatcatacaattgaaacaaggtgcaactggactcacgaggtcatgggtcaatttcctgtgagtgtgggcttagaccgtccagcttgttctcctgccacccactcttagcatggaaggacgaagcgggtgacaatcagccaacatgtgctcaaatagctagatgttcgatactgagtagaaaaatccttacacatcagctgagtttttccatgtttacccatatattttggcatagaatgaactaaatctgtgatttttcagcatgttatggttgtagagttcatgaactattattccatcttgggaatactttgagaagtaaaagtaaattttattattgcaaaagatgcagtaatatttagtattttgttttaaaagtcaaaacttactcagcaaatgcacggcatacagatggtgaagaggtgattcagtaaagttttggtttcaagaaatcctggcccacctaagtaatctccagcatagcaaggtttatcttaaagataaaaaaggatcaaaaggcccttgagaattaggcagctaccccctctgtctccctctccctcgtgcaagattatctgctccccacctatgactgctctctccctttcctcagagtggattcttccccacagccacttgtactggcctcacatggtcacctgtgccccactttatcatggctcactggcccctcttatcattttctccctcccagattattgacagatgaatgggattttcacagtttaccttttcaatgtggctctgtatccttagcaaacctatggattctctgccagtggcagaatagagacagttgcaaactcttttcttctcccatcaaaagatgaagtctgatttccctctccttaacactggctttgcctttgagatttgcttgatgcatagaatacaagagaagtaactcagaagaagaacttccaaggttaggtcagaaggagcctcgcaacttctatctgggtctctggtagaaccacactcttgcccttggaaccatgagctgccactttgctagaaagactttgtgaaaaggctcttggacaacacagataggagaggagtccagctgagtcttgccttcctatgcccccgccaaggtgccagctacaggagtgaagctatcttggacccttcagaccagatcagctatcagctgaataccatccaccatcctgagtcaatgccacgtgcaacagcatcacccacaggagcactacccaaatctctgacccacagaatgatgaaatttaatacaatggttgttttaagccactaagttttagggtagtttgcgatgcagcagcagatgcaacgcctctgttcacagcggctaagactcaaagggacgcaaaccaagcaacctacgtctaccccagcaaggacagtgggtagaaatttccttacagaaaagactgcatgtcatcaggaatcataactgaaatctctcagttaattcctatcctaaatttccctcgaggatataacaaggagaaacagtattaagttacagctagactctggtgggatttagattaaaaatataaaagtacatctagatgctagatgagactagtgacgtcacgaaccagactgaaacttaatcacattaagaagcaggtaatcatattcaaacgagatttgtacttggtaacttaaggataattacatctcaaagccaaggactatctttgtcaatctcatgttttcatgatcagctgaagcagagaaattaatacattttaatgatgaaacttagcctacatgtattttgtagatattcacttagaagtgaaaaatatgatgtaaaatcagttatgtgtagatatttttggagaaaaaaccttaaaacttagaaaccagttacatagtcattattaacttaaaacagatcatactgatatatttctcatatttcatgcccttccttaaagacaatgattttttctcaaacatcaaacatttcagcctttacatatttctccagaaaccaccacaagcatccatatagtgtgtttactgtcaggtttattctgacttgccttcacaacagttgactctcagtttagcttgttgattcacagaaaaaaaaacctgaatgccaccaagaaatttccaagaattgttaaaaaaaattaaatgtgaaaagaagaacctctgatccttactcaatgtgttctctatttttccctcggactaattaagaaaagcatgttaattataatggattccaaatgtgctaacctccagttagtattttttaaagtattgactattttggccagtccaagattgcctattagattataagctcctctgagacccagaggccatgcctttgttgtcattgaccagaaagggagaaagagtaaatctctgttcattttggggggtgtgataactcccatttcaggtgtgctgaaggtggcagtgatggacatttgctgtttttaccatctagcatctgtttattgcttttttctctcttttttttttttttttttttgagacacagtctcactctgtcactcaggctggagtgcagtggcctgatctcggctcactgcaagctctgcttcctgggttcacgccattctcctgcctcagcctcctgagaggctgggactataggcacctgccaccaagcctggctaatttttttgtatttttttagtagagacggggtttcactgtgttagccaggacggtctcgacctcctgacctcgtgatctgcctgcctcggccccacaaagtgctgggattataggcgtgagccactgtgcctagcctgcttattgcttttttcaaactagcttctccttgaggagaacagccttccctatttcatccatctgatttgggtggacagaagacctacctccaactgcaaggatgagacgtcacgggcttcagttgatcaacacagctcagcacctttgcagacagatttgcttagaaatgtccaaatagtctatagccaaggtggtatgttttagggcttctgaataaataagagcttttattctccggcttgcaggagctcctgaaaagcaatctccttcttctcctgagtgtgatgttgaagatctgtaactacagtcgccagtttgccgccaggtgggaacaccagttgggaacaacacgggcctgcgagggatgccgctgaaagcaggaaagattagtgacacagacagaagctggacgaagtctcacctcaggtgcacatctgggcttcgcaattttatgaacctgtaagttctctgattccaaaggtgagttgtattttggcttatgttttgcagctgaaagatttctaacttcttttccaccacagaatctttgaatgatttagatataaacttcaagctccatttaggtcagtgatttttgtctgtattgttcactgatgaatcccactgccttgagcacagcctggcaatattaggtgctcagtgaatatctgttgataaaacgcgcaaagttggttcagcctttaagaagatgaatgttgttaataacacatgcctaatgaaagaatctgagtacatattcctagaatacacacataaaatttaaaacacctaaaaatgcttaaatacatttaaaaaaacaaaaaacaaaactataacgattggtgagattcagccagtagtgtgttggagctggcttgtcctggctttggagactgagctgtatacatctcctcctgattccgcatccagtgtcttcatgttggcagcctgaaattgaccagagggggcatttataccatggtaatcggcaaacactgcaaatgaggggtttatttcctctcctctgccctaccctcccagagagccagttcagcattatttttcctagaaaaaccttttagtgaggtgaacactttcttttaaaaaaataaaatcttcccatttcagagctggaaggaaactctgaagttttcgacttcggtatcctaagttgacaggcgaggaatctctccatgagctaagttacggaggtgacagcacaccccggaccctcaatttgcaagatccaaatcacacagccactccgcaagaaaaagcgtgggaaataatccaaacacatgcgtctctagcgagatgccaggcatttgttggggaaaatatgtccctccaattatatgatgtcagggatcactctagatggggtttgtgtgggtcaaatgtggtaccaggacccctagatctggccaggcctatcccaggctcactgtcctgcagggactaaatacccagccgcagcctagtgtgctatctctgtaggttgtgtgaaatgactcaacatttcctgctctttctcaaaggtaaactcacaccagcccttgcgcggcaggccaattctccctgacgatcacacagacaggcctgcatgacggtcacacagacaggcctcctgacgatcacacagacaggcctcctgacggtcacacagacaggcctcctgatggtcacatagacaggcctgcatgacggtcacacagacaggcctcctgacggtcacacagacaggcctgcatgacggtcacacagacaggcctcctgacggtcacacagacaggcctcctgatggtcacacagacaggcctgcatgacggtcacacagacaggcctcctgatggtcgaacagacaggcctcctgacagtcacacagacaggcctgcatgacggtcacacagacaggcctgcatgacggtcacacagacaggcctcctgacggtcacacagacaggcctcctgacgatcacacagacaggcctcctgacgatcacacagacaggcctcctgacggtcgcacagacaggcctgcatgacggtcacacagacaggcctcctgatggtcgaacagacaggcctcctgacggtcacacagacaggcctcctgacggtcacacagacaggcctcctgatggtcgaacagacaggcctcctgacggtcacacagacaggcctcctgacggtcacacagacaggcctgcatgacggtcacacagacaggcctcctgatggtcacacagacaggcctgcatgacggtcacacagacaggcctcctgacgatcacacagacaggcctcctgacgatcacacagacaggcctcctgacggtcgcacagacaggcctgcatgacggtcacacagacaggcctcctgatggtcacacagacaggcctgcagagcgctccagttacacagatagatttccacagcacggccgtcacatggaacgaatagttaaacctagggaaatcagtgcccagacgtcaaagctagaaatgaaacataagacggtcagtaggagccttacatggccttctccctaacctggagcaagctgaaataatagacagttttacattcctagtgccaggacccgtctcgggtcgacaaaatctgagacgagtcaaggtaacagaggcagctgtttgaatagattcattggagggtctaaggtagctctctgggccaagctgtaaaggagatgaagtagaaatgatcactccggtgccacagtagacgggccttgaaggtactggggcctcacagctcaatcgaacttaggaagcatttctttgcctctgaccttctagttgaaacaaaattcgttaccaatagacttaggcaatgctatactgcacgcaggcgcataacctcaacctatattagcactaagaaaattgtaacactttgagttggtctggtggaattctctctggccttctccctgcatccggttacagcaataaattcccttctttcctagtttgtctgcttcttattattgggccccaagaaaacgcagcgagacccagcttggttctgcgaacacttgtgcaccagaatcgaaggtaaggcaataaaagaccttgatctttattatatcctgcgagccaagaataatgactgtctttttctgggaaataaaataaataaataaacacacataagaagagatggagaaaattatctcaaatttccaaaaaaaaaaaaaaaaaatctcgttttccctcacctgaagatgataaaacaaggcattaaagtagcacagactgatgatcctggtgtaatgcaggctgtgtatcttggttttccctgtaaggtaccctgccagctcccagctaggactctaggcatcctccacactcctccctgccccaggcacgtttccttgatgctgcgaggagcacgtggaaggaataagggcattgcggttcactgccgtcccagaaaagctgctgtccctgtcgctgatgtctaagagtagtctggcactggctgggagtggtggctcactcctgtaatcctagcactttgggaggccgaggcgtgtggattgcctgagctcaggagttcaataccagcctaggtaaaacggtgaaaccccatctctattaaaatacaaaaaaaaaaaatagctgggtgtggcggcgtgtgcctgtaatcccagttacttgggaggctgaggcaggagaattgcttgaacctgggaggcaaatattgcagtgagtcgagatcaagccattgcacattgcactctagcagcctgggcaacagagtgagactccatctcaaaaaaaaaaaaaaaaaaaaaaaaagagtagtctggcacaactgtaaaagcagtgtaaccctgattatgtcaactttgtgtggataaatcaggtgttattttctttatgggattttttttttttgaggcggagtctcgctctgttgcccaggctggagtgcagtgacacgatctcagctcactgcaagctccgcctcctgggttcatgccattctcctgccttagcctcctgagtggctgggactacaggtgcccaccacaatgcccagctaatttttttatattttagtagagacggggtttcaccgtgttagccaggatggtcttgatctcctgacctcatgatccgcccttttacccatacttagtttttgttttccttccagtggaaagaagaaacaaatgccaatctaaaaacatatggagtttctatagtcagtctattttttcttggccgatcgtttgatcagtaataactttgcacttagcatgacctaggtaatgacattatttctatcattattgcattttccctatttggataatcaattaagtcaacagtatttagaattttgctgctcagactgagtcactggaaaaaaaaaaataagccagtgaaaatatagaccccagattagaggcccagtcgggatcaggccgtggctgacgaagtggagtggaagccgcaagaacagggagaggctcctgcgctgacccagggaagtgtgctccggcaggcgctgcatctctcctttgctcagacacccaatgcttgaatgcttggaacaactgtcttcttctttttcttttcttttttttttttttttttagaaggaatttcactcctgttacccaggctggagtgcaatggcgcgatcttagctcactgcaacctccgcctcccgggtacaagtgattctctagcctcactctccccagtagctgggattacaggcatgcgccaccatgctcggctaattttgaatctttttttttttcaatggagatgcggtttctccatgttggtcaggctggtctcgaacacctgacctcaggtgatccacccatctcggcctcccaaagtgctgggattacaggtgtgagccaccacgcacggcttttttttttttttttttagatggagttttgctcttgtcacccaggatggagtgcagtgacacaatctctgctcaccgcaacctccacctcccaggttcaagtgattctcctgcctcagcctcctgagtagctgggattacaggtgccaccatgcccagctaatttatttacttaattattgtatttttagtagagatggggtttcaccatgttggcaaggcttgaactcctgtccacaggttatccacctgccttgatatttaaaaaatatctactgtaaaaatgtgcttagtgaggaacacgtatgcacgctggctagagagaatcaaaataggctctgcatcaattactcaaattagtccagaaactgttctacaaacgagcactggacttggagaagcccacgccagcccttgacatctgggttactacaggaaaactgcctgcctcccagggctcttgttttctaatcttgaaatgaggaattggagtaagaaactctagtacccattcgtattttaacatttattggttctgaatgttcttacctccttgtagtgctgagccagtttctgcagataatctaatatgcatatttccatcagccccaaaaggcaggtctgctggaagagtggaggaaggacaggcgctcatcgagtaatcgccaaggagaggcatttagatattccggctacttaacttagaaaattaatattaagtatcattagcattggcatgattgttcaaatgacattatcaatttctaataaatagatcaaaaactcatgcatggattcagcagttattcagtaggtgtcaaatggtctgtgttcaaatatttgaagtctagcggtgggggtactatttaagacatcacaagacagtactgtatcaacagcaaataagctggttagttcagggaagaggagagttcatctggatgtgtgtatttcataaggtcccgatggggacagcggcactcatacgtggtcttagagaatgtatgtggcttgaataagtgggggagcgttcacaggacattccctgggggctgagatagcgaagggggacaaaccttctcgaggaagagtgcctgcccatctgaacacaacagaagcttcctctgggccagtggaatggcagtgggaagggagcctcggcacccacttctggagacaggacatgtcaagctcaactgtcagtaatgacccacgcataactatcatacttcccaacgctgtgcacacacggcattacccacccgtaaccatcatacttcctaacacggcacacacgacattacccacccataaccatcatacttcctaacaccgcacacacgacattacccacccataaccatcatacttcctaacgccccacacacgacattacccacccataaccatcatacttcctaacgccccacacacgacattacccactcgtaaccatcatacttcctaacaccgcacacacgacattacccacccataaccatcatacttcctaacgccccacacacgacattacccactcgtaaccatcatacttcccacccataaccatcatacttcctaacgccccacacacgacattacccactcgtaaccatcatacttcctaacaccgcacacacgacattacccacccataaccatcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacaccacacacacgacattacccacccataaccatcatacttcctaacgccccacacacaacattacccacccataaccatcatacttcctaacgccccacacacggcattacccactcataaccatcatacttcctaacgccccacacacggcattacccactcataaccatcatacttcctaacgccgcacacacggcattacccacccgtaaccatcatacttcctaacaccgcacacacgacattacccactcgtaaccatcatacttcctaacgccccacacacgacattacccacccataaccatcatacttcctaacgccccacacacggcattacccactcataaccatcatacttcctaacgccccacacacggcattacccactcataaccatcatacttcctaacgccgcacacacggcattacccacccgtaaccatcatacttcctaacaccccacacacgacattacccacccataaccatcatacttcctaacgccccacacacggcattacccacccataaccatcatacttcctaacgccccacacacggcattacccacccataaccatcatacttcctaacgccccacacacgacattacccacccataaccatcatacttcctaacgccgcacacacggcattacccacccgtaaccatcatacttcctaacaccacacacacgacattacccactcgtaaccatcatacttcctaacgccccacacatgacattacccacccataaccatcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacgccccacacacgacattacccactcgtaaccatcatacttcctaaggccccacacacgacattacccacccataaccatcatacttcctaacgccccacacacaacattacccacccgtaaccatcatacttcctaacgccgcacacacggcattacccacccataaccatcatacttcctaacgccgcacacacattacccacccataaccatcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacgccccacacacgacattaaccactcgtaaccatcatacttcctaaggccccacacacgacattacccacccataaccatcatacttcctaacgccccacacacaacattacccacccgtagccatcatacttcctaacgccgcacacacgacattacccacccataaccatcatacttcctaacgccccacacacaacattacccacccgtaaccatcatacttcctaacgccgcacacacggcattacccagctcataacccatcatactgtcctaacgccgcacacacattacccacccataaccatgcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacgccccacacacgacattaaccactcgtaaccatcatacttcctaaggccccacacacgacattacccacccataaccatcatacttcctaacgccccacacacaacattacccacccgtagccatcatacttcctaacgccgcacacacggcattacccacccataaccatcatacttcctaacgccccacacacaacattacccacccgtaaccatcatacttcctaatgccccacacacaacattacccactcataaccatcatacttcctaacgccccacacacgacattacccactcgtaaccatcatacttcctaacaccccacacatgacattacccacccataaccatcatacttcctaacgccgcacacacggcattacccacccataaccatcatacttcctaacgccccacacacgacattacccacccataaccatcatacttcctaacgccgcacacacgacattacccacccgtaaccatcatacttcctaacgccgcacacacggcattacccacccgtaaccatcatacttcctaacaccgcacacacgacattacccactcgtaaccatcatacttcctaacgccgcacacacggcattacccacccataaccatcatacttcctaacgcaccaaacacgacattacccacccataaccatcatacttcctaacgccccacacacaacattacccactcataaccatcatacttcctaacgccccacacacgacattacccactcgtaaccatcatacttcctaaggccgcacacacggcattacccacccataaccatcatacttcctaatgcaccaaacacgacattacccactcgtaaccatcatacttcctaacgccccacacacgacattacccactcataaccatcatacttcctaacgccccacacacgacattacccacccataaccatcatacttcctaacgccccacacacggcattacccactcataaccatcatacttcctaacgccccacacacgacattacccacccgtaaccatcatacttcctaacgccgcacacacggcattacccacccataaccatcatacttcctaacgccccacacacggcattacccactcgtaaccatcatacttcctaacgccccacacacggcattacccactcataaccatcatacttcctaacgccgcacacacggcattacccactcataaccatcatacttcctaacgccgcacacacggcattacccacccgtaaccatcatacttcctaacactgcacacagggcattacccacccataagtatcatacttcctaacgccccacacacggcattacccacccttaaccatcatacttcttaacgccccacacacgacattgcccactcataaccatcatacttcctaacgccccacacacgacattacccactcataaccatcatacttcctaacgccccacacacgacattacccacccataaccatcatacttcctaacaccgcacacacgacattacccacccataaccatcatacttcctaacaccccacacacgacattacccacccataaccatcatacttcctaacgccccacacacgacattacccacccataaccatcatacttcctaacgccccacacatgacattacccacccataaccatcatacttcctaatgccccacacacgacattagccacccataaccatcatacttcctaacgccgtgcacacatggcattacccacccataaccaccgtacttcttaacgatgtgaacacatggcattacccacccataaccaccatacttcctaacgatgtgaacacatggcattacccacccataatcatcatacttcccaatgaactgcacacacggcacaactgcaagtgttcctacctagtttcagtatcattttaaacattttctagttcgacttggtcataaaaataaagtttagaaattactttgtgccctttttgtagaaaagaaataaagcattttgaaatgttaacacagtgggctgggtccaatatattaaacacagaaactttaatgaatagtagatacacagcaatcttcccagctgtgattcctggagattttttggactgtattcatacctggcattctagacaaaggaggggaaagaaagtatgaatggacaaaaggccaagctaagaaggcagtaaagcttttttaattcaaattgtaagaaatagtttgtttcaacagaatgaaggataaaaaccatatgatcatttcaattgatgctgaaaaaacgtttgataaaattcaacatcacaacaagataaaaaccctcaaagaactgagtatagaaggaacataactcaacataataaaggccatatacaacagacccacattagtatcatactgaatggggaaaaactgaaagcctttcctctaagatctggaacatgacaaggatgaccactttcaccactgttattcaacatagtactagaagtcctagctagcgcaatcagagtagaggaagatgtaaaggacatccaaattggaaaggaagaagtcaaattatccttgtttgctgatactgtaattttatatttagaaaaacctaaagacccacaagactattagaactgataaattcagtaaagttgcaggatacaaaatcaacatataaaaatcagtagcatttctatatgccaacagtgaataatgtgaaaaagaaatgtagaaagtgatcccatttacaatagccacacatacaattaaatacttaggaattaaccaaagaagcgaaagatctctgtaatgaaaacagtaaaacactgatgaaggaaattgaagaggacaccaaaaaatagaaaaatattccatgtacatggattggaagaattaaaattgttaaaaatgttcatactatccaaaggaatctacagattcaatgcaatccctatcaaaataccagtgatgttcttcacagaaatagaaaaaacaatcctaaaatttatatggaaacacaaaaggtctagaatagccaaagctatcctaagcaaaaagaacaaaactagagaaaatcacattacctcacttcaaattatactacagagctatagtaaccaaaacagcatggtactgacataaaaatggacacatagaccaatggaacagaagagagaacccagaaacaaatccacacacctacagtgaactcattttttacaaaggtgccaagaacatacactggggaaaagacagtctcttcaataaatggtgccaggaaaactggatgtcaatatgtgaaagaatgaaactagacccatatctctcaccaaacacaaaaatcaaataaaaagaaattaaataattaaatataagacctcaaactatgaaactattacaagaaacactgggggaaaatctccaggacattgaatctccaggtctgagcaaagacttcttgggtaataccccacaaacacagtcaaccaaagcaaaaatggacaaatggaatcacatgaagttaaaagacttctgcacagcaaaggatataatcaacaaagtaaagagacgatccacagaatgggagaaaatattagcaaacaacccctctgacaagtgattaatgaccagaatatataaagagctcaaaaaactctacaggaaaaaaatctaataatccaatcaaaaactgggcaaaagatttgaatagacatttctgaaaagaagacatacaagtggcaaacaagcatatgaaaaggtgctcaacatcattgatcattagagaagagcaaatcaaaactacaatgagatgtcatcaaatcccagttaaaatggcttatatccgaaagacaggtaataataaatgctgataaggttgtggagaaaagggaacccttgtacactgttggtgggaaagtaaattaatacaatcactatgcagaacagtttggaggttcctcaaaaaactaaaagttgagctatcatatgagcctgcaatcccactgctgggaatgtgcccaaaacaaaggaaatcagtattgtagagatatctgtactcctatgttcgttgcagcacagtttgcaatagctaagatttggaagcaacctatgtgtccatcaacagatgaatggataaagaaaatgtggtacgtatacacaatggggtactattcagccataaaaaaggaatgagatccagtcatttgcaacaccatagatgtaactggagatcattgtgttaagtgaaataagccaggaatagaaagacagacatcacatgttctcacttatttgtgggatctaaaaatcaaatcaattcaccttatggacctagagaatagaaggatggttaccagacactgggaaaggtaatggaggattgagcagacatagggatggttaacgggtacaaaaaaatagaaagaatgaataagacctactatttgatagcataatagggtgactatagttaataataacaattatatattttaaaataacttaaagaatgtaattagattgcttgtaaatcaaaggataaatgcttaagaagataaataccccttctccatgatatgctgatttcacattgcatggctgtatcacaagatctcatgcaccccataaatatatacacctactatgtatccacaaatttaaaaaaatagtttgtggattaaaaacaaaatggaaccctagaaatgtgtaacagtagttgttttacagacaggaatactaaagtagaatacctctgcagtaggtagaatacccaaaaatgttgaagttaatgagaaaagcaatggggaaacagcagacactacctcttccccagctcctgggctagaagtagaattctccattgcttttatgatcgtgaactacgtttgtagagtgctttgtagcctaaaacttacctataatgtgaattaattcttgcaacaagaatatgtggtctgattctcactttataagtgaaaaaacttaatctggtcagaaagtggtagcggaagcaagacttgaaccaagctttccggaagggatggaacatgcagcacagagcattgctgtttccctctcatttcgcaagctcttgtgggctattctgctctgtggaattccactgtgggacacagggagggtgaatctgacgttctggagtagtgtggctctcaactggttttggtgtaaggacacctaaaaccaaatgatttcgaagaccttctagttaaagatagtgcagaaagaggctgtttcctttttaaaaatctttgtatccccaaccattaaagaaagaatggatgaaaggcaaactcatcaatgaaaacggactaatgcaatcctgaacccaccttttgaaggctacccttcataggctcagaaatctgaatgcagggggatgctgagagtcaacataatttcttcagagctcagtaaacacatttccccaaagcccattgctgaaagtgatctccaagggggaagcagggtgaaataatgagggaatcagtgatcttcagatctcagcattaaggaggtgtggctaagagctattatagcaaagcacatacacctcctgagtgttgaaagggagaggaaggctggacacagtggctcatgacagtaatctcagcactttgggaggctgaggcaggaggatcacttgagcccaggaagttgaggctgcagtgagctgagattacaccactgtactccaacctgggcaacaaagtaagaccctgtctctaaaaacaaaaacataaatgaaaacaaacaacaaccagaaaaaagaaagaaagaaaaggagaaataagttaccaatggaaaaaaaatgacagatttactaaaagtattttggagatggcaaatccaaacagaactgcttcacatcacttcctctccctaactcccctcccctctgtccctgcctttgttattcccatttttgtttacttactaatttatccaatacctgcatgataaataattaaaatgaataatgaaaatgaaccaacatggaatctactgcagaggttttaattggaaaaagaataaaagcaaaaggctgatgaaaaaaaataccatgcaagataaattaaccaaggaaacggaagaattctaacagccctttcctttcagagacaactcttcccctccaaccctatgaattcacaaagccaagggcttaaatatatattaaaatatagtagaagattatctagcagggcctttggaaacaaagataatagaagattttaaaaaataatagaagattaaatgaactgaaagaactccaataacaaaggaaagcaaaatataaaaactttataaagataaaaagcaacataaaaaacagaatttaaaaactaaaatacgaggaaacagttaacagctgtaatgaagtcatacagaataaaatgtaaaagaaaaactataaaaataattagtaataaatatgaaacaaagagttcaaatacattttaagtgacgttcctgaaaaataaagctttttttttttttcaaaaatagagtaaaaacaaggattacataagcttccagatacagaaaacgagtcaggttcttgagggaaaagatctgggtagcctcaaaaacgtgcacagtaagactaagtgccagaaggcaggtcagcaatgtctagagtttataaccatgaattttatagtcagtttagcttccttacagttacaaagagatcaggcatttttaaacattaaaagctgaaggaagataatgatagttattgctgtataactaaacatcctaaatgtagtgtccttagaaaccccaacttttatcttgctcatgaatcagacctggctggctgggataactcattctgctttactcagcatcagctgaagaagcctggagctaggggctgggtcatcggggggttcccttactcatgtgtccgatgtctgggcaggaaagtttcaaacatctgtgagctggaactgctggggctcatctattctctctccatggttgctccaatatggtggcttcagaatagcctgacttcctacatgtcaacccagggcttcaagttgcaggccacgaaggagaacatctggaggaagctgcgtcagcccttgttgtctaccacgccatccttccatcagtcacagaagaccaccctgactcaagggaataggaaatagattctgctggatagggaatgccaaggttctgaaagaacatgtagggcttcaaatatggatgcaacttaccagaataatattgaaaattctcaactgtacagtgaaattcaaccaagaatcaaactgagtaaaaaatccacagtataaaaaatgctaatgttaatttttaatgcattagagattggatcgatggtccaacatctggctcttctaccatcctacttcgtctgagtcttctgtccttgattcatctttcatccagtcgggactccagggtcaaccactccatgaatctcttaaaatatcctcaattccttttttcccttcttttccagatgtcacacaaaatctcgaccctgggtcaatttaactttcccattctccactcctccccccaggatattaagaactgttggtaaaaatcatgtattttgggccaggcatggtggatcactcctgtaatcccagaactttgggaggctgaggcggacggatcacttgaggccaggagttcaagaccaccctgggcaacatggcgaaaccccatctctactaaaaatacaaaaattagctgggcatggtggcacgtgcctgtaattccaggtgctcgggaagctgaggtggaagaattgcttaaatctgggaggcagaggttgcagtgagccgagatcgcaccactgcactccagcctgggcaacagagcgagactctgtctcaaaaaaaaaaaataaataaaataatgaattttatagccagtttagtttccttacattgttttatgtttaccataaaacaatgcagaatatagtcactataaattcatagtcttcgaccttgaataagacttcaaagctgcctacaattcctatttattctctttctccatgacaattatatcaatgctttttttttttttttttttgagacggagtttcactcttgctgcccaggctggagtgcaatggtgcgatctcggctcactgcaacctatgcttcctgggttcaaatgattctcccacctcagcctcccaagtagctgggatttacaggtgcacaccaccacgcccagctaattttgtatttttagtagagatggggtttctccatgttggtcgggctggtcttgaactcctgacctcaggtgatccacccacctcggcctcccaaagtgctgggattacaggcataagccaccgcacctggcctatcaagccttttatactatacttacaccttctagcccacacccactctcagtggacatcacactcaaatgcacagagaaaatagagaccctcaaatagatgcaccctcaacgctcctccattatatttacaatcttggctgaaagtggcaatgatgagggtgaggaacaaaggtccatgcctcctccagaccatgctgtaaaccacctctgctgcttctcagagtgggtgctattggcattttggatacagcgattttcttgttagattttcccacatattgtaatacttttagcatctctatccctagaacaacataaaccattagcaagtcaagtcactgaaataggcaatacatatcctgagatattcataaaagcccctcaaggattgggacttggttgagattttcagaccggtaaaccctttgtgttacagatgaagaaaccgaggtccagagcacccaaatcagtttcccaagagcatggtttaatagcactgggaccggcagccaggtgtactggcgttatgccccaggctccttctactaggcgacaggttctgctcaactccacagctgaaactgtttatgttaaaaataacacttaagctgtaatggatgtcaaaataatacctgatccaatgaaaatgagcaaacctttataataataagcaaataaataaatatgtctgcaaggagaggtgtgcatgaattaaatattaatttcaaacaaatattaattctaaaaatgtctatattaatgttttctcaaatagaaaaacttataccagttaataagcacactatatccactctgatgcttttaagtgttaaaaaatatcatattcagtaaaaaatgttttctttaaagaattccttattctctttctgcaccacttatcaaatatcttatttttttgtatttcattttaagatatagtcgagttatttatttgactatataaagtaatattgaatcttctactctcattagtaacctaattcttcaatttctctgatttttcttgaacggtatgtcatcaaagtgactatcattttagctaaatacattgtcatatatgagcaaaattgcatattgatagaatttctgaaatttcttttactttatttgacatattttacactaaaaaaaatcaatgtaactgataggacttcttaaattgcctattttaaaaaaatgtattacccctacaattgtaagtaatttggaagccctggtacaacctatacagtgtttttgaatttgattctgagtggacagctgtaggagggagaattactgagtcacaaaatgaaacagatcacagcactgattgggccctacttcttatcaaaagaggctcttcatacacttaactcagcaagtcactgttgagcactggaaatcgtggagctaggtccatcctcactcccctccctgtccaaatgagaggaggaaatgcccaaactattatctttccaaacctgagccgtctttttgtcgcctccatcacatgatcagattttttgtgtgctcactgtactcattcttccccctttttctatcatggatacatcccagccttttacatcagaaatgtgctcagtttttttccctccccaatcttctaccaccctttgctttcatttattccttaaacgactatcccttttcttttccctcgttcatcaacaacgttttgagaaagtccaacgtgaacttcaaagcccaactgattataaatgcttccctctctcaatgcttccctggccaccattcagaatcggtgcgccacctaggaaactatcttttagacagtcgttactgagggattgtttttgaagttagtaaaataaaatacactccctggttctcctgataatcacggaaatcgtttgctataaagctatttcaataaagcaataatagaaaaacaaacatcaggaaggaacaatgagctctgagaggacctaggaacattaggggtaggaagatgaatttaaactatgcctcgaggacaaataaggatgttgctgacggtgccaaaggtggggagaaaaggacaataagacaaacagcatgagcaaaggcattaaaatacgacatccatgactcactcagtgtatttaaagataaaatgtttaaatgtattttccaggtgttacatggtccttaatgatttttcaaatccttcagtatataacatgcaggctcatttggttttcatttacacactgtctctgtaattctgtcatacttgcctcaagtgactttaccgtggaagaggacctgcagggaagcacatagcacaggttgcaggacagcttcgtggctcttggctaattcgagaatgtatgagtggcagaattccatatagttattctcatcctaacatactacatggaagcaagattgtaaagaaggaacacttgcctacctttaaatacaaaaggtgaccaatatttaccaaaaagaatcttgcagttgttgtgaacaaccaaattcatgtagaacagtttgcaataacagctattaagaaaacaaatggtctgttattcagaccagaactcctgttgctctttagatgacaaatgcatgacgctttaaatgtatgtacgaaaaataaatcttttagaagactttcaaaaatacttctaatttagagtttctgactcagcctctcaactttcattccttcataattcactcatccataataatatttattagaatctacctctgtataaggccctttctaggagtcagggatgaagtggggaataaggtagaccaggtccctgccctcatagcaaccatattctagggaagcaaaaaagatttgcttttcaagcactccaaggttgctaattattttcctggtttcccacatggttgttgagaaaccaaacaaaacttgtctttggcgtatattctttctattctttgaaaattttgtacattagcaaaacacattcactaaagcaaataatttttcttggttaagtaatttggttattcttaccaaagatatagagaccttccttcaataaactataaacattttcagcaaataactaatcagagtttatgtgagttttttccaaatatgcacaacttatagtagcaaaatatttgcaaactcagtaatcataagttaaaccataatgatgatgacatattttgaaacatttctttgtttagtaccttgaatatgccacacactatcctaaaagaaaaaaagtgaagattcaaaagcagtgagagaaaatttccctgtacagtacacaaagttgtatgtacttcagtggggttggtgtttttctccaggagcgtctaccagcacagctttgatcccttcatcaacaatatcctaaaattcaacgcttttatggttacaatactgcctttccaaaggcatgtcagctagatctagcatacagtttttggcacaatttatttccttccttccttccttccttccttccttccttccttccttccttccttccttccgcctgccctccctccctccctctctctccctttctttcttttcttttcttttctttctttctctttctctctctctctttctttctttcttttctaggatggagttttgctcttgttggccaggctggagtgcaatagtgtgatcttggctcaccgaaacctccacctcccaggttcaagcgattctcctgcctcagcctcccgagtagctgggattacaggcatgcatcaccacgcccagctaattttgtatttttagtaaagacggggtttctccacgttggccaggctggtctcgaacttccgacctcaggtgatctgcccaccttggcctcccaaagtgctgggattacaggtgtgagctaccgcacctggcctctctatttttaactgtgcaacaaaagatattccacaagaaggtaacttcagttccaattgtttgttctgtgagaacttggtttagagatagggttggtaaattgttaaaggtgtgtggtatttttagtcatttcccaatttgctaaattacaaaggactagctttttgatagattactgggtggccaatctgattgataggaagctcaaagacaagtctgatcctcaattacacatttttaatcctcgaagccagagggttagtcttttctttaacttcctttttaattaattttattaatctgttgcagatgttcttctgatatatccatgttcgtcaaggaagatggacatgaaagctaatgtcttggcacaagattacgtctaaagcccacaacttaaaatgagatgggctaaacttcacataaactgcatacaccttggtatcactcctcctcaaactaccgtctcactacttacagacattccagcttcagaatccacgccttatataaggtgactgccacctcctgctctctcaaaatacttccctacttttaggtgtcaaaggagcagtaaagggtctaatcctataaaaattcatttctgccaatatgctagcccctcaggaaacagtcttaaatcattatacaatttgcatttcttaacattttaggtgccatttaggtcagtggggggaaatctctttgggccagcctttcgattttggtgtcacagattgtttaacaaagatgacagcagttccaaccaccagcgccaaggggctacttccctcaacacgtcagaatgcacaggattaaaagaagagtttcccaaaaacattgtatctggtgaacttagattaggtcgaatcttctaacccaagcaaaaaggcattatcttgcttccatccttattaaaatcttggtgtttgttttacagttttggtctttaagctcacaaaacccaaaggatttttgaataattcccagtagttttaccatgtataaaaactgccttcaattttataagcttctttgatctctgctaggccaacatgctggggggataaatatcaaaatttaaaaagaaattctcagccagtaagaaaagataaagattaattcactatgttactgtacattcaacaattcacacagctctattatcactttaagataccatccgctgaccatcattcttccttctagagaggctttagtggtaagaaattaactaaaagagaaaaggaacttttaacctgtcctcacagagatgatgggtgggaaagaagataaagaaatttattactgaaaaatataaattggatcaacattagtcacactaaacagattaatgcttgttttcccaaagtattttttggtatttagagttgcatccctgttctctgctcaccctgaggtaggcccagcctctggggttgtggtttgagcaggatcagcgctccactagccacctagtttctttgagtcttgagcatcctgtttttcccaggcagccagagtcccctgatttcttttctgcttttttttgttgttgttgttttctaatttagaaacagggttgcactgtgtcacccaggctggagcacagtggcacaatcatggctcactgcagcctggacttcctgtgctcaaacagtcctcctgcctcagccttctgaggagctaggactacaggtgcacaccaccatgcctggctaatttactaactttttgtggagatggggtcttgctttgttgcccaggctggtctcaagctcctggcacaagtgatccacctgcctcagcctcccaaagctctaggattacaggtgtgagccaccacaccgggcccagagtccctgatttctggggcttcttttcaagtcgcaataacagatgactgtgacaagatggatatgtaatcacctgatttatcccttaaccctgctccctggagcagagtcagctggagaattcagagccgcagcgcccaggtttcttaggtaggcaggctcagcttccccctttgtatgtggttgttcttttccctcatggcatgattccttgcttgtggtaagctcctaaactaatataaggttttagaaatcatttcaccaaagtggttgctttggtagaggagagagagggatatatctggaagagacacgagagtgctgaaaatgtgctatttcttagccttcttaggccaagagttacactgtaacatcgtagttacaatgatgtgcctactttgtgacagattcatagaaatgtgcagttatgatttgtgtgcttctgtgtcttatttccattttaaaatcttaacagtaaaagagtggcatgcccctgtaatcccagctactagggaggctgaggcaggagaatcacttgaacctgggaggcggaggttgcaatgagccgagatcatgccgctacactccagcctgggcaacagagcgagacttcacctcaaaaataaataaataaataaaaataaataagagaaagctacagaatggtatctctgtgttatcctctgtgatttgcaaaatgttttctctgtatacttttaaacatacagaatatttctggaaaaacaaacaagaacttagtattaatggtcatcaatagtgggaggtcagggaataatcatgggatcttagtagaaacctaacattttttgtgtaaacttttatgtactctttaaatttctcaacatttgtatgtgtatattttcaaataaatcaacatttacaaaataaataaactagaaccgaactgaactgaaaaaagtgggcactgtattaagggacagtttgtttggtgtggacgaaatattcagaaatgtagtgatggacgtatgcagcaaagcaaggagcagattgcaggaggtccagcacgcccaacaaaggactagactgtatatttcccaaactgacactgagcctgtctttccccgccagactccttctccagtcttccccttctcagtatttttcatcacaaaccacccagttgtatagactgcacatggattacgcaaccacaacctctccttcttccccgccatcatagtcgtcactaaatcctttgcagtctaactcgaatgtctatttttaatactaatttttctattttttttttactaatttactaccttccttgatgtccacagatcctaccctcggccaaatcaccacctcctctccctgacatattatagtattcttctgacttgctttctacttgccccgttctgtgcctaaagaaagcacttcagtgggtttacactgcgtgttgataccccctgaacctaaaataaaagttgaaaaaaaaatgaagctgtgattgtcgtggtcaacaacaccccaggggatgtagtcctgcctccctctcagcctcacttggaagcagtccttcgctcttccgtgttccagccgctctgctcttctcagtaccttgaacttaactcactctttcctgacttggaacctttgagatgttccgtctgcctggaactcaattccaaaccatccttgtgtggttggctccttctgtttctttaagtcttgatttaaaagttccttccaaaaaagagacttgctctgattacattcagtgttcctgcctcccaatcgtctgtaccacggctccatggtcacggcattcctcttccttctgtctcacatattacaggctgctgcgggggtgcaggggggaagctactgcaaaatccatgggatcagctgggcgtggtggcggtggctcatgcctgtaatcccagcactttgggaggccgaggagggtggatcacgaggtcagggtggatcaagaggtcaggagatcgagaccatcctggccaacacagtgaaaccccgtctctactaaaaatacaaaaaattagccaggcgtggtggtgggcacctgtagtcccagctacttgggagggctgaggcaggagaatggcacgaactcgggcggcagtacttctagttaaatctggtaaatttaacacatatcttcctctgcattctctgctcactaaaataatgaaaaaacaatttttaaaggcatagtgaaagacatcaacaacatttttgaagttggaaagtgaatggacttattaaggcagagacatgactctgcaagaaggaaagtaacaagaagtaagccaacatgtgacagaaccctaaaaagttaaaacatttggggcacaatgaatttctggaggatggtgtgtggagtggggctgggacaaagtttataaactaagtgcaggcaccttatatcccaaacacaagccaaaaaagagtggcttaatttctgaagaggctcaaccatagtaggtctggccttggagggataccagtctccgctgagggtctgttaaaatgatgtcctgaaaacagggatgttaggtagacatctgcataccaaatggagaggtcttccacccccagctcacttctcctacttggctcttagaatactggtcttaggcttctaacatacctccacccaccccacctctgcaacagcaacaggaaactgggagactcctcttgagaaaactgaggagctcaagaaaaaaagacatttagatgctcccaatggaaaagtcagcatgccagatttccagtgttcccctaaattcattctctcttctgcaccctcttctctgccctaggaatctgagctgtaaaggctacataagtgatcctcattgccctctggctttttacttggttcaactactagggagcccagcaatagatgtaagggtagaaggagaatatgtcatgagcacttatgcactggttcccctacatacaggattgctttctgctgactgagctgttgatcaggcatcttggtttctcttccaagactctcattttctaagctctggtaatcacttcttccctccatccctttgagcccaggagtggcaataaactcagagtaattcccaattccttgcgtgttttcaacactctataaatgcccaacaggttctttttgcctgctgcacagaaaaagccaactcactgagacaacagtattgcagtagagaaagagcttaatgctcacagggctagacaagtggtatgatgggagttaactacccaagtcagcctccctgagaactcagagactaggatttttatggatactttggcaggcagggagctagggaatgggtgctgctgattggttggggaggaaaccataggggtgtagaaaatgctcctcgtgggcagagtcagcctccaggtgggggtcacaggaccagctgagtcatgagtcatgggtctggttggggtcagtctgttaccagaatgcaaaagtctaaaaaacatctcaaaacaccaattgtaggttctacaatagtgatgttatttacaggagtaactggagaagtcacaaatcttgtgacctctggccacatgactactgagcagcaagatatcataggaaagaaatctaggggacaatggctggatatcatttaactacacctacatcttagaagagttcaggcccctcccatcatcctaatcttgtggccattcctttatcttacaatggtggcttcagttctcagacagtggcctttcattagtcttacaaaggcagtttcagtccccaaataaggagggagtcagttttaggggggaactgttatcatccttgctttaaagttaaaccagaaactaaattcctcccatagttattgtattagtccatttgcatgctgctgataaagacatacccaagactgggcaatttacaaaagaaagaggtttaattggactcacagttccacagggctggggaggcctcacaatcatggcagaaggtaaggagggacaagtcacatcttatgtggatggcggcaggcaaagagagcttgtgcagggaaactctcccttaaaatactgtcagatctcgtgagattttatttgctatcacaagaacagcaggggaaagatctgcccccgtgattcaatcatctcacatcagaccctcccacaacacgtgggaatcatgggagctacaagatgagatttgagtagggacacagagctaaaccatatcagttatcttggcccatgcctaggaataagtgaggacagccagcctgtggggctagaagcaagatggaatcagccatgctagacttaccttgctgtcataatccttgcaaaggtagtttcaattctgtctacatcattgtaagttgtcatttcactcaattttcctaaaaattgtcctaatttaaacactgcctttttttcccccaggactctgacactaccagttcactatattgtggccttctcaatgaaatcctcaagccctcaaattcagctcttacctacagagcatccaaccagctttttagtggttcattttcaaccatgaatggacagccaaggatcaatcaccagacacgtgaaaaatcttccagcatgaaagatagaccaaaacgaagaggaaaaagatacaatgagatcacatgagaagaaaagaagaagacagccaatatctctccaataggaaatttaaagataagaaaagggaagaaaaaataatcaaagaaaaagttcaagaaaaagttcccaaagtgaaggacctcattgtaaaaacgtaaaaatagagagatgctgctaaaaacttccataaagaaaaacaagtcacatcacaaatcaggaggatggccaccttctcaacaactttggagaaattccttacatttatgaagaaaaatgacttgcaacctagaattttataattaacccaactattaatccaatgtgagaatgggattataacattcatagacaggtaaatactcaaaaatctactgcagtagacagcttctaagatgaccccaaatgtcccgacctcctagcattgatgcccttataggatctcctcccactgagtatgagttggacttagtgacttacgtctaatgaatggagtattggaggagttatgggacactgctctaatgttaggctataagaagactgtggcctccatcgcgggcactctctgatgttctcttttggtctccttcctgtgggggaggtcggcagccacgccatgaggcagtttctctgaagagacccacagagaaagggctcgatgcttgccaacaaccgtgtgagtatgcttggaggagtcctagtatatatgtttaacatgacatagtttctcagtttattataacacttgtaaccataataggtctgttgcccaactcacacagcaagtcaacatactgagatatggggctgcagcagagaaaggggtttcatcatagggctgctgaatgaggagatgagaggaaaccccaaattcatctccctggggagtaggagggtggggtttttaaagaattttggagtaggctgaagtgtgaagatcatggattggtcaaagagtgcagggtgaaatactgggacaagaagatgaagaaacagcattcccacgttgatttggctcctctgtggggtcttcaaactggtggcatcaactattctcctggaattcagaatctgcttaagcacttcttaaacacaagccttatgattctaaggtcagaaatcctccctataggaacagtgcggacgtgagtgctcagtgccgggtgcaacagccctttcagttacaaggaagtgggtcaaagcgcagcctgattattgcttaattacaacaacatttctgtccagaattcttgttaacactgtcaggacagccttattgtattaagtataataatcacattgaaaattatttaggctttcctcaaaaagacaaaccacagatcagcagaccatttgcaaagcatctaattaatagagggataatgttcaggatttgtaagagtttgaaaaatatattaaaaagataactgaacagaaaaattctcaaagaaaacaaataggcaaatcacagaaaaaaaacacaagtggccagtgaagagataccaaaacttcactaataacccgggaaataaaaagttaaactaaagctgacaccattttcacccatccattttgtacacattatgaaacctgttttcaccaacctgatgctaaaaaagaaaaaaattataaagtctaacattatcaagtattgtgaaaattttgaaaaatggaaatactcatccgtcattagtgtgggtataaacttgaaaaaccatcctgaaagtattttgattatgtctatgaaagctaccccccaaaagtacaagttctacaaaagagcaattttacttgttacgtgcattatattaataccttacacatctgcagtgagacatgtaaaataatattttaaggacaaataaagattaaaagtgggcctggcacagtggttcacgcctgtaatcccagcactttgggaggccgaggcgggcagatcatgaggtcagcagttcgagaccagcctggccaacatggtgaaactctgtctctactaaaaatacaaaaattagccaggcgtggtggtgggtgcctgtaattccagctacttgggaggctgaggcaggagaattgcttgaacctggcaggcggaggttgcagtgagctgagaccacgccattgcactccagcctgggtgacagagcaagattccatctcaaaaaaaataaaataaaataaaataaaataaaaaataaaaataaaaataaaaaagattaaaaatgatagccgaattcttccgtttgaaaataaggtaagaaacttctccctctctcttttcttagaacatttactttagaagatttgtaattgtaagttccttttctgtctctaaatctttttccaagcccaataagcctcttgccagctttacgacccaggaatggctttctcaagcacctggaaatcacctctttgtaaacatcgagtgagacagtgcctctgtggcccagtttctgggggagagtaagagcctgtctttgggggatgccttgctcctagttgcaaaactacctcttgtcataaaaataaatgtttatttttccctcatttaaaagtgattaccaggtgaatttaggatgaactgtgtgtaataaatggtgctatcacattctctcacttgaggactagttattatataccttgagagcatgtatgtaatgaattgtatctgcttggttatacgaaggggtgagatttctttctgtctttgcaatctctttgtgggttgtctgtgatatatagcacattctgatttaatgcctattcaatttttaaaaactgttttctttctctgctacctttgtgaagaggttttctaggttgggagaagattttggtttaaattaaatttccccagcaatgttcattatagcattgtttgtaatagtgaaaaatataagtactttaaatatccatttgtagaagaatgaattatcataaaataatacaatgcactaatatacagcagttaaataaataaattagcacactatgtgtcaaaatgagtaatctcaaaaacataatattcaatgaaaacatagttgcagataatagaagtatgattttgttttcataaaattgaagatactaaatatattatgtatggttatatgtaaaaatagtaaatatataaaaataacaatagggccagcatgatggctcatgtctgtaatcccagtgctttaggacactaaggtgggaggatcacttgagtccaggagttcgagaccagcctgagaaatgcacggagaccttgtccctaaaaaaaaaaaaaaaaaaaaaaatagctgattgtgtgtgcctgatgtctcagctactcaggaagctgaggtgggaagatcccaggagttcaagactgcagtgagctgtgattgccccactgaactctagctggagcaacagagtgacactccatctctaaaaaaaaaaaaataaaaataaaaacaaataacaataggaagcatatccaccagtgtgcaattaccattacctgtggtgcagaagggaaggtaatcattttgggaataagaaaaaggagagtttgactgtatctgtaatattttatttatatgaagcaacatatagctagattgcaacatataggtagtaatctggcttttagatacagaaaataatatgacttagattggtgggtgttcatcatattattctctctacgttttaaagttttcatgacaataatattctcataaacaaaaacagagttcctggatcaaagaaaaaccattttagaagacgttttcttccaaaagtttgaccagtgagtggaaagtatttcaaacatattctctacacacaaaatctgcagacctaactctctttaccgaggaggaaagctatctctcattctcagtttggcagggcaatctcgtgatgggaaacatttcctgtgggttttcaggggccagtgaagaagtagaacaaagtacttgctacctgggttacctgttaagaccacagatcccgccagagcatatcctggtccctgtgacgccatggaacccagtagtcagcctggggcaccattcctgttaccggaagggggtcccgagccagactccaagagagggttcttagaccttgcccaggaaagaattgggagtgagtccatagaggaaagtgaatgtaagtttgttaggaaagtaaaggaataaagagaccaaggtgggcagatcatcgggtcaggagttcgagaccagcctgaccaacatagcgaaaccccatctctactaaaaatacaaaaattagctgggcgtggcagcgcacgcctgtaatcccagctactcgagaggctgaggcacgagaatggcttgaacctgggaggcagaggttgtagtgagccgagattgtaccactgcactccagcctgggagacagagtgagactccgtctcaaaaaaaaaaaaaaaaaaaaagaatgaagaacgtctccttcataggcagagcagcagcatgcgcagctccactgggtatacttacagttatttcttgaccatatgctaaacaagaggtggattattcatgagttttcctggaaataggtggggatttgccccagaactgagggtccctcccctctttgaccttataaggtaacttccagacattgccatggcatttgtaaacagtctggcgccggtggcaatgtcttttagcatgctaactcattacaattagcatatactgaggatgactgagatgactttcttggtttttagttttcattgtaggtttgggggtacatgtgaaggtttgttacacagataagcacgtgacatgggggtctgttgtgcataatattacatcactcaggtattaagctgagtgcccagtagttaccttttccgctccgctccctcgtccctccctccccccacaagtagatcctggtgtctgctgtttccttctgtgtgttcataagttcttttttttattattattacataagttcttatcacttagctccatttacaagtgacaacatgcagtgtttggtttctgttcctgtgttagtttgctaagaatgatagcctccagttccaaagacatcatctcaatccggaggtcactttcattgccatcttggttttggtgggttgtggctggcttctttactgtgtcctgttttatcagctggatctttgtaacctgtatcttgtgtcgacctcccctctcatcctgtgactattcctcctgggaatgcagcccagaagatctcagccttattttacccagctcctgttcaagatggagtcgctctggttccaatgcttctgacattcccatctttgttattactgtgaatacttttttcaaagtataatatatttatgatatcagttattaaggagccctgacactgagataaaccttgttagcatctgctgctcactctggatgcctgccctagtgggagagcccttatgactcccatcctactctgcttttctattgttctgcaacacattgaggaatccaaagagatcctagagataacccatcctcagtcaacacattttcctctctccttttcttctcttctcttctttctttctctctctctctctctctctctctctctctctctttctttctgacagggtctcactccgtcaccctggctaaagtgcagtggtacaatctcagctcactgcagcctcaacctcttgggctcaagtgctcctcccacctctgcctcccaggtagctgggactacaggtgtgcaccaccacgtctggctaatttttttgtatttgcagagacaaggttttgccatgttgcccaggctggtcttgaactcctgggctcaagcgatccacatacctcagattcccaaagtgctgggactacaggcatgagccactacagccagactcctcttttcaaaggttgtcctgaaatgttctcgaaaataaaatagctatcaacagctgcagtcttaacccctatttcttgcagctggaaggtatcagaatatgccatcccaaaatatgcctcattggcatgtggatgatattgagccaaaggcaactgagaaccaacagaggaaggaaaggccctttaccttctcccaactgcctgaaaacagagtatacatttcccccttttgtaacagaaatttccatttataaaggacatttttgtctctaaaagtgtcgctgtatcaggaagagagtttcttcctattacctggaaacaacacttatctgcacagcaagaccgcactaatttaccatgaatttcctctctttaccttccagaattcctcctcccacccctccaaagccccatattctttttttaagcctaaaatggtatagaaacctcagtcatctgaccacttccttaagtgtcaattttttgtgaaactcccgtgcccacatatataattaaaccttttttctcttgttgatatgtcatttttcagtttaatttcctgggccccagccagagtacctaggagagcagagggaaatggtttgctcctcccctacactgccccaagatattaacaggacgtaaaagcatattctcaagccctcatgatataggatttttcttctcggtcactttgccagccgaggatccccagcaggcaacgctccagctcacctgtgttatagcttgtacctgcgtttggcagttcccgagctcttgtattgtgctcgagaaaaatgaggatatgctggacactgaagtgcaaggagggcggagaagaattttattgagtgatggagcagctctcagcagagaggggacgcgggagtcgtccccgacccccacagtcgggtagttcttctgtggctgggtccagagctttgtatggactcagaataggggagtgcatgctgattggtttgtgagtatgcaaaaaaggttaaagcaaagacatcactcaaaggtgggcgtgacagtgcagagaaccaattaggaaagggtaggtatatgtaaaataggtaaagggtggggattaatcagaggaaagtatgccaaatgggaagacaagttctcagtccggtttgaagattgaacttgtgcttggcttttaggctttaaactgtcttcagcttggaggtgaggtttcaccgggacctgcccctattggctaggcatgtgactgcctcctgctgctatcactcatatggaactattttcttcaatgtttaaatgtttttcatttctacttggcagcttttcctttatctggtgtttattgttttagtagttctttcaaaacaaattgattgtgaccaacttttagaaacattaggggaagagtggggcatatctttgtctatggtccttaatataatactgtttgtgtaagggcttcatggaaactgaaaaacgaagatatttatcatgaatttagatataaaagttcatcaaaactttgtcctaatgagtacagtacttctgaaaaacattctccattcttcaagcaagcttgtactgggcatgcactgttctcagggctgccagtataaagtgtaggggagaaaaacattctctgactttctacccatcttagtttcatgggttagggactgccaattagacagacaaaagatagattagcaagagataaacaaacagaaattcattaacgagtgcattgcccatacacacaggagtactcggtaacgaataggtcaaacaggtggctagaacctgggtttatattttaccatcttaacaaaagaacaagaattttgtagagaagtagcaacacaagggaaaggggccttcagttctaaggccagcaaattgtggaaaggtaaatcgatgaaggaaaacaagggaagacaagggctattagtatggttcattctgtagattcctctcttacacagattctctgggctgggaagggtctctagagagttacctctggccattgagagttatcctgcccttcccggtagagagggggaggtcagagagtttttcttgcatctgttctttttaattgctttcagctcaaaataatcctatttcaaagtggcatattttggggtggcacattctgaactccttcaaagcaagggagaaaaacataatccctgactccgggtgtaaagtacaatgaaataattcatattcaaaaggaatttgatccctttgataatcagacttgggtttccaccagaaactgatacagctatttgtcaagaactggttgcctggacttataggaaatgactcttgaatactcaggcaagaaatttcagattctctgaaaaggtgactaccacaatgttccatttagagttcaaccatttggagatgtacatgactgacttctgtgcactctcaatttttgcaaatatatgaagaaccaccccccactgagtttttcctctgtagagtgtgaaggtaaaccctcaccccaaaatatggctccctgatatcacaagtattttgaattaaaggccctcagagatcaacagacattggaagaggcttttctcccatctatatcaagaccagatgaacctaccaacaagagcatttttttttaacctctcctcctgctatctcattatctatcgcagaaaagattaagaatgaaaccacacctgaactgactccataagctattatctgtctcttgggtttattcagcttccaaagggaaccatttacaggttaatctccattgcccaatccattcattcttccaggtaatcatttattgcccctcaacagtcacgtatattccctatccacccgtcccctgaaatgaggccatacaggtatctggactccagtgggatattgggcagtcatcctgtgaatctcccctgtgcacatgttaataaactggtatgccatttttccagttaatcttccctttgtcaattgattttccagggaaccttaagaggacaaaggggaaattttgtcttatcccctgcaagtgggaagggtgaatattcacagccagctaacttaatgaaaaatctcacagaaaacatgactggctgaagcctaaagcaaaataaaatcttcaaggggtctcagagctacagaaagtagtaggaacatggtgatctctctcctgacaagcgtacggcctcatcatttttctatgaggatgtcacaagaggctccctgaggatttgatcagcactgttgtcgggcaccaagttcaactgagtgttcctgatgaattaacatgttaataaagttaatataagggtggcattaataaaagggtgcttgccgggcgcggtggctcacgcccataatcccaggcgggtggatcatctgaggtcagaagttggagaccagcctggccaatgtggtgaaaccctgtctctactaaaaatacaaaaattagccaagcatggtggtgggcacctgtaatcccagcttgggaggctgaggtaggataattgcttgaacccaggaggcggaggttgcagtgagctgagattgtgccattgcactccagcctgggcgacaagagtgaaactctgtctcaaaaaataaataaaaaaaattaaaaaaaagttaaaagggtgctcttacctaaaggcaactctcattagcatagacagacaccaaaaatagttctatatggtcaagagatgtttatatttgcctgttatctatataattgttggtctacttagacataaatttccccttcatttaggtgcattaaaattataaagaaaaatttatcttggagatttccattgaaagggagaaaaaaacctttattcctctactcccctaaattctctggctggacctgcaaatcaaactgacagattaataaaagaaaaacaaagttttagttacacacatatgtatggatgtttcacaaagaaatgaactcaaggaggtggtcagataattgaggcttacgtacactttaggccaaacaaagcaaaagaggtttggggcttctgagtgagggaaggcaagttatggaaaagagaatgaggaaatgcaggtaaatgcggcctgtcttgctatgcaggtgagagtctgaggtggaaagagttgtctctgtggccaggtgcagtggctatgccagtaatccagcctttgggaggccaaggcgggaggactgcttgagcctaggagtgcaagaccagcctggataacagtgacaaactgtcgctacaagaaagaaaaaaattagccagatgtggtggtgtgtgcctgtagtcccagctactcaggaggctaaggcaggaagaccaccagagaccaggaattggaggttacagtgagctaggagggtgccactcctctccactctttagtaacagaggaagatcttctcactaaaaataaaaatataaataaataaaaattatttgtaattccagcactttaggaggctgaagcaggaagattacttgagcctaggaatttgagaccagcctgggcaacataaacagattctgtctctacaaaaattaaaattaaaaaattagccaggcgtggtgacgtgctcctgtagtctcagctactccagaggctgaggtgggaggatcacttgatcccaggaggccaaagctgcagtgagctgagattgcaccactacactccagactgggcaacagagcaagaccctgtctttaagaaaaaggaggggggttttctccaggagtagctgtcttccaggtacagaggcccctctcccaatggaagttaccttcgtaagtgtaaatttcctttataaaaggggaggttgatttttcacgcagacagggaaggtaaagagcttttccttcatctgctggctctcaattacttagtcaaaagaatccctatgcctaagaagtgtattttggggtggcatattctggtacctttctccaccctccctttcagagccccatatccctttgggcaacagctcttgaccattaggatctgctcttggttccttacttgagaccagtcagtcattcgctattatgaatgtttcatggggaaccttttctctaatgatggaatgaaagacaagttatagaattctaaatgttaacaggcagctttgtcttggtaccacggagatgctacacaatccagtgtgtggcttactgatatccaattcattcatttggtaaaaatcaattatcttaattaacactccataagtattgccagtatctactaaatctaacttaggttttatttatgagtttgaatggaagtaattcacctcaacatgtcccagaatttcaatttttctgcatgacatcagagagagtatgatagaatttattctttattgcattaagtctggcagaacatcattggaaagtcattcctccagaaatatttattgaagattctcgatatgccaaaatttttatgcatggaagataggagaaaagctgcatgagggtctataaaatcttttgaaagttagttatttcactgggaaatgaaccatgggaccatgttaattagctcagatgacattctttaatggtagagtcagtgctgataaaaagcaaaagactggaaaatgtaaacacagcatttaaaatctaattccatgtcagtgctttgggactccttttcgttaggctctctctctaggggaagtctttaataagtctttatcaagtgcattctgaggggccacattttctacatttgcattaggagattgaaagcaggtttataacttttaaagatcaaattacttctatgcattttatgtgccccaatttcaagtgtaaagggcacatacaaaactatgaagagggacagatggcaactggactttacataatgcttgaaatagacacactgatgatcctaaacacatttttagatatctaaagacaaaaatcatcattgaaatagaatttaagtgaaacaagaaaattttaaattaaatatatattatatatatttagtacacatatatttaaaatcatcttgtttcacttaaattctatttcaatgatgatttttgtctttagatatctaaaaatgtgtttaggatcatcggtgtgtctatttcaagcattatgtaaagtccagttgccatctgtccctcttcatagttttgtatgtgccctttacacttgaaattggggcacataaaatgcatagaagtaatttgatctttaaaagttataaacctactttcagtctcctaatgcaaatgtagaaaatgtggcccctcagaatgtacttgataaagacttattaaagacttcccctagagagagaggaatatatatatgtaggtgttttggtagagacagggccttgttttgttgcccaggctggtcttgaactcctgggctcaggcgatcctcttgcctcagcctccgaaagtgctgggattataggtatgagccactgtgcctagccagacagtttttttaaaagaaattcatcttcacattgtgactatcaatgtatcatactaatatctgaaaagctcatacagattcagagttcaaccacctcactcccctaaccgcacccccctccccccacccgccaaaaaaaagaataaaaaaagaacagtggtctcttctgttaaagaaaagaaaaacaaacctaggagaaaccaagtttggagacaacagatgatctgttgctactggaggccatctcttcataaggaaagagagcatcgccactgcctcgggctccagtcatgcaggtggccctatgtataagtcactcagtctacctgaagcaaactgctcctcccagaacagtgagaagagggcctggtaaccaaattacaccttgctgctttttctgctctcactcttttcttctggttcacatgagaagaggggattctgaatcataaactagatctagaagacatactggctatagtttttggttagtgaaacataaacagaaatctattttgatttgtattctcattcttaaatcaactttctcagacatatcaacaccttttttttggccaaagtacaatatggcaaatataatttactatttcttatcaaattaagattgtgatctatctcaaggtcacaattaaacatgacgtgtgctttttaaagaataattttagttacaaatatataaataaggccacctgtaatcccagaactttgggaggccaaggctggcagatcacttgaggtcaggagttcgagactagcctgggcaacatggcaaaaccccatctctattaaaaatacaaaaattagccaggcacggtggcacgtgcctgtaattccagctactcaggaggctgaggcaggaggatcacttgaacctgggaggtggaagttgcagtgaaccaagatggtgccactgcactccagcctgagtgacagagtaagcctccatctcaaaaacaaacaaacaaaaaaagaaattacaaatatataaataaaagaaacagaactagtgaagctcagctcgtttcctaaaaagtaacagtgaaactggaaaagggaatcccagattcaccccaagcactcattcccacagctgctgggagggtcaacgggttcagttctgcttcctccagcctctctcaggtgcaagagaggaaaaatatcttccatctacccttgtaagttctcagctgggaaccccttcacaaaagacagattaataagagaaaaagcatagaaatttaattaatataagttttacatggcatggagatgtccatgagaaaatgaagacacaaagaaagggttaaactggggtgtgtttctgctgtttgatgaagagtggaaagtcctggggaaatgtgacaggacagaatatgggctaagagcacgggctaagagtatgggctaagaggggtaaacggggggacacttggcagggctcatttgttctaattactctcaatacccctctgtctttggagataagaatgttgtcctccaggtctaggaaggcacctctcacatgagggtcttatcgcctgcttcaggaaagaaggacagaggcaggttggagagaccttcttgccatttctcgaattccttcagcttaacatattcactatgccaaggtgccatattttggggttgccctgaaccccatcaaaggcattgatttctagcgcactctcccataaactttctgtacccaaatctcagtctccaagactgctttctaagaaaactgttttgtgtctgtgtacatgtaagtcagtaaatataaacatcagtgaagggcaacgcatcacaatgctgaaacatctttcaaagaagtaagattaaggcgatgaacttgaaaatgattttgtaattgtcttacaaaatacacatccatgttatccttgcaattttgttttccatgtaaaacatgtcacatgactgaaaaggttctcattaacctattaagaactaaaaaccaccattgagctcaaccaggtgttcttattctcatggtctgacatgtcttcctctccttccccactctccttcttccccaatagtcttcagacattcagttaactatggtatgtgctctttttctcaaggccaagtatttccaagtctcctcttatatgatgtcttatataaataaatgtttaaagtatatcaatataaaattgagataatggaaatatttactgttcctatcacttcatcttttcaaagccaactttaacagcaaacactattggcctcgcaaggcaggagatctgaagacggatatattaaataaataattttgatatgtaccttgagccaagataataatataagattgtgaacactcgctgggaaaaataacgatctggtgtagaaaatgacaggatatttgagaaaatataggtatttttctggacaaaagtaaacattaatgtatttatgagatgtttctcactgagaagtaaactctgaccttttttctctcttgcccatattcctatctaaggggcctgcggagtcacgactacaaaccacgactacaaaccaaaacatctcatcaggtgggctttatttcaccctatataatgtggctcactttccaacccaacactggcataacatcacatgaaagataaagaaagaaatcaaaatattttaccccaaaaaatatgtagggcttttcgccatattttaaaatggccctgcagagtcttttgtgggggaaatttttgtccgtgaagaatctctgttaacacaactaaatcttccccttccaggccctcccaatcctgaagagattaattgagaatctatttctatttctattttttatttttatttttatgtttgtgttttttgagacaggatctcactctgtcactccacaggctggagtccagtggagggatctcagctcactgcaacctgtgcatcctgggctcaagcaatcaagagtccagcaccttttaaaggtttgaagaggagacattcaccatctattgtatctaagggcagccacctataagatttcataagaacctcagtgtccacagccccttatgttaacccagacactcctttctattgcctctattattctatttagataataactcttttaaccaattgccaatcagaaaatccttgactccatctacaacctggaagctccctcttggagttgttctgccttttcggactaaacctcatgtgtattgtatatgtctccccaaaacatataaaaccaagctgcagcccaaccaccttggacacacgttctcaggatctcttgaggccacgcctccggccatggtcactcatatttggctcaaaataaaactcttcaaatacagagtttggctgtttttgttgacactgtagggataaaaaagctattacataatatttgactgtactgactgagttataatttacaaaggacagaattcaaataaataagaaggaaattctagagaggcagccttgttgactgaccatcttgctatctgaaatgttcaattgtgggaagtggaaatggactcttttcctacaccatagacgaggctaagagtaggcaacaaccggccatgtactacacgcagatggatggcagagacagccaggacctggataaccttgataccctagaaagagacacactacctgtgaagtatatgtacccaaaagacaaaaattatctgaatctaatcaaggacttggatctaataactggtttcaaaaaataccaatgagagctgggtgcagtagcccatgtctgtagtctcagctactctggaagctgaggtgggaagatggctacaatcacgcctgtgtacagtcactgcactccagcctgggcaacacagtgagagctcgtctggtaaaaaatacacatgtaggtgatgaaggaaaatgatgccatggggacataatcaacaaaatctagaattggaaatttctagatgtaaattattaggtttcttcaacaaatagcaaggaaaaaagaagacggagggaaatcacagattaaagaaaggtgatacatatgaagccaatgtgatatgtggtccttgtttagatcccaatgcaaacaaaccaaatataaaacaaacatttctgagaattgagaaaatctgcacactcaccagatactggattatattaacattattgtcgattttagggctattaataatattgtgtttatgttaaagaaagaatccttatgttttagaaatatatgttggagtgtttctggatgaaatgatatgatgtctggaatttcctttaaataatttgggaggtgggagggtgggtggaaaagaaacagatgaaataacagcagacaaacggcagtgattgttgaaggtgggtgatggctgtgcagggtgggtgaactgaagaaaatgatggaggtgattttttttttcttttttttttttttgagacggagtctctctctgttgcccaggctggagtatagtggcctgatcttggcttactgcaacctctgcctctgggttcaagtgattctcctgccttggcctcctgagtagttgggactacaggcgtgtgccaccacgtccagctaatttttgtatttttagtagagacagggtttcaccatgttggccaagatgaatctcttgacctcatgatctgcccacctcagcctctcaaagtgctgggattacaggcgtgagccaccgcgcctggcctgacggaggtgattttaatccatttagaggtttattttgccaaggttgaggaagcacctggcaaacagagacacaagccactgtaggatctgtggcaccccctttttctgaagaggattttgagggctacaatatgaaaaggggaaaaggaggcaggaggggaaaagaaggaaaaggagagggagggctggtcacgttctttagaatccacatgaaaaggagcgggtagatgaaccgtcaattctgcattcatctcctgctcagtacatctgtactctacataagataaggtgaacttcagtagaggaagcaactgaatatgcattcgtctcagggtgcgcagcgggacaatttctaggctcctctcgtcccgtactcttgaagataaactgttaatttacatggtcagagtgagggaggcccctgtggaaacatgtggccttctatctgtagctattagtttaggagcaaaaggaaaggcagggttttttggttttttcatgactcagttttcaagcttaacttttccattttggcatagcgaatttgggctcccaagattttgtcttcctttcataggagaaaaaataatttcttttctcaatccttgtaagttcattagtgggacagattcctgttagcagaagacagattaacaagagagagaaaaaaaagcatttttatttacgtgtgtgtctatcccatggggagaaagctgagttcaaaagtaaggtggcttagggccctggcttacatagcacatctagcaaagaacaatatattcagaagtgacaggacaaaggaccaagcagctccaggctcccaaaagtgggacaactatggaaaggtaataaagcctgctcccagattcctctggccctgctggcgccagcccctgcactgataagtgaaccactacttacatctctgtcttcaggcagataggggaggcagaagcttctccgcattttttcacagcaatttttatggcctgccttaggtaagaaagggcagctcagacagccctttcctgtaactttactttccacttgccaaagaagcatatttcggggtgaaatattctggtgttcttcagatgtatggggattcataagattattttctctcctgctgtctaaaattccacaatgaagaagttaaaaaatctctactgtaattaaaagtaaactgaaaaatattacagttatagtgaattaaataattgaagttttcatataaaaatgcaagtttttagaatctatgcatctgaaggatttttttaatctaaaaattgaatataaaatatgtaaattatgttcttttctaacctaggatgctacttattaaaaacctaaattattgctataaagaaaataatagagatattttagttcatcttaattatatattttatagtttggttttttgttttggggtgttttggtttttattcattttatttatttatttatttatttattttgagacagggtcttgctctgtctagagtgcagtggtgcaatcatggctctctgcagcctcaacctcctgggctcaagtgatcctcccacctcggccctcaagtagctagaactacaggtgctcgccaccacacctggctagtttttgtgtgtttgttttttttgtttttttggtagagatgtggttttgccatgttgcccaggctttaattatatattacatagggactatcaaagacactgtcagtgtaaacatgctagaagccaatataagccactccaaacaagcagtgtacctacatgacagcttttcaatctaagtcgtgaggcttggtcagagttgtgcctgaaattattgaattttatttcatttcttatgcactgttatagcattagtaaatgtattatgcactattacagcattataattcttatgaaataaaacatactctgtatgataaaacagatgctgagttctacagaaactcttcaatttatattaccccagcaaaatatcagcaataatggctaacaagtatggagtactttccgtagtgtctaatatattactgcattacatcagtggagtggtattattagtgcttctctttcttctcaggctgaggaaccagcagatgagagggttcatgaaggaaccactagttccagaagtgctggatcctgccttaatcatcattccaaagactctccttatgatgataacaattagttgaactcactttctagaatccaaaattgcaatggttctccaaattaatacattgtatcatgaagtaaattcaccttatttattactgttttgctttcatccaccagtagagggagtacaaattcacctataactgagtccaaatcccaaaaacagatttagggaatgacaggatcaggcaggagtttaactcctgtatttttatgcgttaaggaatccgaggtgacagaggttgggtgagttaatgcagttacatggttggccaatggtggggccagatgaacaattcgcaccccctggcttccagaacaggctggttttaccaccggtgaggctggtcctttcagtggatatcaggtttccttcctagcccactgggtggtcatgtggaatatttcagaaagccaagctcagtttccctcaagaaacgttagtgaccactagtttaagataaatttttatttggctatggtgaaacagctgatcatataattcccccaaatgaacattaatttagcaaattaatatactgcacaaataagtatacaaaagcaaaattgagagctaaatgaagacaaaattcctctctgggtctttcaaaaacacaatttatcagttgagaactaattgactgtttacaactggaggtgagaagggtgtattcacagatgtctgcctgagaccattggataaaggggatgagttccagttaaattttgaaaaaaaaaaaaggggaaatagcagggcacggtggctcacatctgtaatcccagccctctgggaggccgggacaggcagatcgcttgaggtcaggagtttgagaccagcctggccaacatggcaaaaccccttctctactaaaaatacaaaaattagccaggcatgggcagctgtagtcccagctactcgggaggctgaggcaggagaattgcttgaacctgggaggcggagtttgcagtgagcggagatcgtgccactgcactccagcctgggcgacagagtgagaccccgtctcaaaaaaaaaaaaaggtgtgtgtgggggaggaggggaacaaaacaaaaagctgaccctgaaagtctccttactactcagtttgagagacaaaaactccagctcgcctgttgtttatgctcatgcctggctctccttccactgcctgccgtacactttgctggggcggggctgactctgtctccttaggggcaggactgtctataacactgtcttaagttccacctcttctatgcctgggaggacacacctgtttcgtgttcatttgcattcccaacttatctttcttcttctcctggtggccacaggaggtgctttgtcggctggcaggtccattttgggtattctaatccaggcttctgactaggtttggtagctattctcattctcattttacttcttattcattctaactctcattctactattttttacttagacgtagttttcttggtaagaaaggccatggtaagcagacgtagtgtgcacagaaatatgcagcccttctgggtgcctggaccccagtagcaccatagtcacccgtaatagccacataatagccacgcctagttctaagagtgagtagagttggaccaagttgtgaaacttcaagtttgcttttgtttttagtcgaggcctaacctaggcttggctgggcacttttttcagggtgctagtgttgtagaacctctgagagcagcgaaaggtttataagatttggccaaggccagagggcgggagacaaaatctcgcaattctgacctgcctttggacataattgaggctttatgaggaaggtggggatgcgggagtggcgatcccatgaccaaagctgcttgcctccctcggtcccttggccagatgaaacttctggatgccttcaaggatgtctatctgaccaaaggatcttgttctttaaagataaacaaagccgggcgtggtggcttatgcctgtaatcccaacatttcgggaggccaaggcaggcagatcacttgaagtcaggagattgagaccagcctggctaacatagagaaaccccatctctactaaaaatacaaaaattagccaggtgcggtggcatgcgcctgtaatttcagctacttgggaggctgcggcaggagaatcgcttgaacccgggaggcagaggttgcagtgagctgggattgcgccactgcactccagccttggccacagagtgagactccaaaaaaaagaaagaaagaaagaaggaaggaaggaaggaaggaaggaaggaaggaaggaaggaaggaaggaaggaaggaaaagagagagaaaagaaaggaagaaagaaagaaggaaggaaggaaggaaaagaaagagagagagaaagaaagcaagcaagcaagcaagaaagaaagaaaggaaaaagaaagaaagaaaaagaaagaaagaaagaaagaaaggaaggaaggaaggaaggaaggaaggaaggaaaacaagttcatcaatctcgcaggcagaccctggagggttaggatatgaaggtaatcaattattagcaactcccctccaccagaatgacttcatgccagcaagtgtgcacagggagaggagaggacaaagagagaggaaaataagcaaaacagagagaggaaaataagcaaagcaaacaccttagggtttttgtttgtttgtttgtttttgtttttttgagacggagcttcactcttgttgcccaggctggagtgcaatggtgcgatcttggctcactgcaacctccgcccgcgccctccccaccccacccccaggttcaagtgattctcctgtctcagcctcctgagtagctgggattacaggcatgcaccaccacgcccagctaattttgtatttttggtagagacagggtttctacatgttggtcaggctggtcttgaactcccaacctcaggtgatccgtccaccttggcctcccaaagtgctgggattacaggcttgagccaccgcgcccggcctagggtttttatactataggctcagtcgcactagcctggtctccttttgcctccaggaagccgtgtgcaccacctacatgctgtaaagatcaaagaatgcacttatctaggccactgctgtcatgtctccatttcttttttgttttttgctttttctttttttttttttttgagatggagtctcgctggagtgcagtggtgcaatctcggctcacggcaacctctgcctcctgggtttaagcaattctcttgtctcagcctctggagtagctgggactacaggcgcatgccaccacacccagctaattttttgtatttttagtaaagaaggggttttacttcattagccaggaaggtctcaatctcctgacctcgtgatctgcctgcctcggcctcccaaagtgctgggattacaggcatgagccacagcgccctgtgccatgtcttcatttctgcaaccaacacctccatgctcaggtcttccagtcttccagctgtgatctttctcaaaactgacactgggagtgaagcaagccttggaaggagtgacaaatacacccatcccctgcagcccccgcagaccccattcatcgatcacagctctccttccaccactcattgatcacagctctccttccaccactcatcgatcacagctctccttccaccattcatcgatcacagctctccttccaccattcagtgatcacagctctccttccaccattcagtgatcacagctctccttccaccattcagtgatcacagctctccttccaccattcagtgatcacagctctccttccaccattcagtgatcacagctctccttcccccattcagtgatcacagctctccttcttccattcattgatcacagctctccttctcccattcatcgatcacagctctccttccaccattcatcgatcacagctctccttcccccattcatcgatcaaagctctccttccaccattcattgatcacagctctccttccaccatgcagtgatcacagctctccttcccccatgcagtgatcacagctctccttcccccattcatcgatcacagctctccttccaccactcattgatcacagctctccttccaccactcattgatcacagctctccttccaccattcagtgatcacagctctccttcccccactcattgatcacagctctccttccaccattcagtgatcacagctctccttccaccattcagtgatcacagctctccttccaccattcagtgatcacagctctccttcccccattcattgatcacagctctccttccaccattcagtgatcacagctctccttcccccattcattgatcacagctctccttccaccactcagtgatcacagctctccttccaccattcagtgatcacagctctccttcccccattcagtgatcacagctctccttccaccattcagtgatcacagctctccttcccccattcattgatcacagctctccttccaccattcattgatcacagctctccttccaccattcattgatcacagctctccttcccccattcattgatcacagctctccttccaccattcagtgatcacagctctccttcccccattcatcgatcacagctctccttccaccattcagtgatcacagctctccttccaccattcagtgatcacagctctccttccaccatgcagtgatcacagctctccttccaccattcagtgatcacagctctccttcccccattcattgatcacagctctccttcccccattcatcgatcacagctctccttccaccattcagtgatcacagctctccttcccccattcatcgatcacagctctccttccaccattcagtgatcacagctctccttccaccattcagtgatcacagctctccttccaccattcagtgatcacagctctccttccaccattcagtgatcacagctctccttcccccattcattgatcacagctctccttcttccattcattgatcacagctctccttctcccattcattgatcacagctctccttcccccattcatcgatcacagctgtccttcccccattcatcgatcacagctctccttccaccattcattgatcacagctctccttccaccatgcagtgatcacagctctccttcccccattcattgatcacagctctccttccaccattcatcgatcacagctgtccttcccccattcattgatcacagctctccttccaccattcatcgatcacagctctccttccaccattcatcgatcacagctgtccttcccccattcattgatcacagctctccttccaccattcagtgatcacagctctccttcccccattcatcgatcacagctctccttccaccattcagtgatcacagctctccttccaccattcagtgatcacagctctccttcccccattcatcgatcacagctctccttccaccattcagtgatcacagctctccttccaccattcattgatcacagctctccttccaccattcattgatcacagctctccttccaccattcagtgatcacagctctccttccaccattcagtgatcacagctctcattccaccattcatcgatcacagctctccttccaccattcagtgatcacagctctccttccaccattcagtgatcacagctctccttcccccattcagtgatcacagctctccttctcccattcattgatcacagctctccttccaccattcattgatcacagctctccttcccccattcattgatcacagctctccttccaccattcagtgatcacagctctccttccaccgttcatcgattacagttctccttccaccattcattgatcacagctctccttccaccattcattgatcacagctctccttcctgctgagcttgggtgtagtctcagagtccttctcaacatagcattccagacaaccaccaccaaatgtggcttgacactcaagtaacacacatttaccattactgcctgtcaatgagaattagaactggacaccagttaaagtggtggagctgaattttagggagaaactaaactgctgtaataggggaaaagagacttcagcacagaactgagctcaatttgaatacaaggataagtgggaatttatcactaaacagcaggatgggggcatcagtgggtggacagtcactaagaggaaacatcaagggtagtaggttcttgagaaactgactcaacagggtccttgctgagagcaggccggcaggatgggatatcaagagttgggaattcttttgtaggggaggaaaaatatcttttctcctacccttcagagtttgtggctggggaccccgtaataaaagacagattaacaagagaaaagcatagaaatgtatttaatataagtttcacaagacacaggagccttcataagaaaacaaagatccaaagaaacggttaaaccttagtgtttttatgctagaatggatgaagagtggagagttctgaaaaaatgtctgaggacagagcgggagctccatatagtcaactggggaaaatttagcaagtctcattcactcagattcctctcagcatccctccatctttttttttgagatggagtttcactcatgttgcccaggctggagtgcaatggcatgatcttggctcactgcaacctccaactactgggttcaagcgattctcctgcctcagcctcccaagtagctgggattacaggcatgcaccaccacgcccggctaattttgtatttttagtagagacggggtttttccatgttggtcaggctggtctcgaactcctgacctcaggtggtctacccgcctcggcctcccaaagtgttgggattgcaagtgcgaggtactgcacctgaccccctccatctttaaagtcaaggacactccttccctctgggtataaagagatcaccccttacataagggttggataatccgcttcaggggaaggtcagaaaatcatttcaccaattccttcagctaaaatattcaatataccaagtcagtgtgtcctgaactccaccactctaaactgacatagcagaatttgtgataaaactgaactcagcaaagatgaacacggaagaccacggaggacacctgatgaagaagagggctcagaggagcatggccacagtccagttaaggagaaagtctttgtcacgccccagagttagagtacacagccctccctagctaagaaactgtaaataactctacagcaatccatctgcagctccaggtagacaacgtcacctgcaccatcagccgcttttgacaccaggcaattctaggcacctcggcatgctgagtgttttgagcagaaggaggttgagagggtcacagaagcaggttgagagggtcacagaagcaagaaggtctctccaatcttctcctgccctcctttctcctaatcccctttgccctctaaagcaggttgtagaatctagaattcacctcccctgaagcaagccatcaaactcaggaacatcactctctgagctcctcactactccactgaagaccctcatgtggcaggtattgtgtcctacacctggggcgggggaatgaattcatagacacaaaaagaatcggaacaaacaggcctaaaggagttcccccaagtttattatcattagatcacactccctttcatccagtcatgattctctacaactatctactttttttcatcagacttagcataaaaatacacagttttccctggttcttgggccttcattcctgaaggctcttgtgacatgtgaagctttcattaaatatatttgttcaggttttctcctgttaatctgtcccatgttacggaagtgtcagccacgaactgaatgggtgaaaaaaagagattactttttctcctctacagggctcaaggctcagaaaggtatttttcaaaaaagaacttgagtcgtatagctctatttcattttttcctcagagactatatacacaaaattgaacaagcattttataacttgttcaagaaggcaaaaatataggtcactgaaaacatagtcttcttgaattacttttttttccaaactttaatttaatccttgtaatagtcacatcaagaaaagctttttctatccattttcttaccagttgaacactcttttgaaagtggactttcagtcacacagctctgtgtttcagctaataacctactttgcagctgacatacaggaatacaacggctatacaagaaagaaatgttatttttcttttctatggaattgggtccagaaaaatgcctgtgagaaaggctttttgcatggacatttgtcctggcactttttccttattaaaaatttaatggcgtgggccacatattcatattcagatcaactctgggtacttatcccagtagctatgataattaagattttacttttatgacagtctagcagagcacaggttttatattcaatattctgccacttgacaattctttagccagcttttcccaacttcccttctcataagaccccactccagatactgattcaacacggctgacatgcaggctggagtcctggtatttacaaagaaccaaagaaccgcaagtgatgtttataaccagaaaggtttggaaagcaccactccaggcaaatagtcagttttaggggttttaaaagattttcaaaacaaagctaaagattttagttcatttttatttttattttttcaagacagggtccggccctgtcacccaggctggagggtggtagcatgatcatagctcactgcaacctcaaactcctgggcttaagccatcctctctcctcagcctcccaagtagatgggactataggcgcataccactacgcccagctagttttgttttcaaattttttgtagagatggggtcttgctgtgttgcccagcctggtcttgaactcctgctctcaaaggatcttcctgcctcagcctcccaaagtactgggattgcaggtgtgagcctctgtgcctcaccaaaactcaagacttttcaatacagcacacacaccacaaaggacagccatgacagtcaccctggtgaagaggtgaaagcacctgccagctgccgctgcctcagcctgccccaaccccgtgcagccctgctccttctctcattagaagtggcaagggaaggcacggcggggagaggggtagggacgctgtgagcatcctcagaaaccatcgcagtgcctcctgcccagctgcagtggaactgctgcactccaccaaggcagccgagggctctgaggaccagaacagaatacacttccatatgcatttcttccacaattctttgagtgaagcaccaccctctgtacagaatcattataattattcttggatcactcttttgtctctctacagtggctttggtaacagcagggattccagaaacaaggacaaaagcatctggcttgagcaaggaggctgctggcaagactgagggtggcagagctaggaggatgaatgtgtgaggagtggacaggcgacaggaagagaagggaagagagaaggaacagaccggggagagcccctcagtggccagtagtgaactttccccaaatctgtcctcctggcagaaccctctctcccagctcctggaggcggagccaaccccaggcaggaggctacagcaagcagatgtcctggtcactgcctgcacctcccatggtggctttcacagcttcctgccagctccaagccgaccctaaacctccgaaaagcatctgaggaggcagcttacatttgggattaaaacaccagtgttacccctgtcagaaaaatttgcattattcgtgtggcgaacgaaaaataaaatcttaaggcccccactgatcagaccccctcttggccaagggaactccagagaaagcctaaaactgagttccaggccatcactggaagggaggtcaggcacgtctcctcatacccgctttcttttggagcttagacacgacaactgaccagcattcctgtaaaaacaaagatcaggaggctaacaaaacagactctctgtcgtaacaggaagccaaattctaggccgggagcggtggctcatgcctgtaatcccagcactttgggaagctgaggtgggtggatcacaaagtcaggagatcgagaccatcctggccaacatggtgaaaccccatctctactaaaaatacaaaaaattagctgggcgtggtggtgggtgcttgtagtcccagctacttgggaagctgaggcaggaggattgcttgaacccgggaggcggaggctgcagtgagccgagatcacaccattgcactccagcctgggcaacagcgcgagactccatctcaaaaaaaaaaaaaaaaaaaaaaagacagatcttaaacaggatgtaaagccggcagtcttgctgaacaggtcatattgtggctgactctgacacagcatccttatctttttttcctttttttatgctccacagggcaagtcctaagcatccctatcttaacttcaacagtccattctgctaactccaaatttttagacaaagttttgttcctttcaccaactacacattaaagaatctcggaatccacctgtgacctgtaagcccccatttcaagatgtcctgcgcttcctggccgggccaatgcataccttccaggtacggatttgtgttttgccttctcaaaatgtgtaagaccacactgtgacccagccacctcagcagcactaagaccacactgtgacccggccacgtcaggagcactaagaccaccccgtaacgcggccacctcaggagcactaggaccaccccgtaaccgagtcacctcagcagcactaagaacaccacgtaacgcggccacctcaggagcactaggaccaccccgtaacgcggccacctcaggagcactaggaccacccagtaacgcggccacctcaggagcactaggaccacaacgtaatccagccacctgaggagcacttgctcaggaccccttgagactgtttccctgggctgtggtcactcatattggctcagaataaactctttaaaatattttacagagtttggtttttcccactagcaatgtcaacctaaaaggaagaagctgaaacaaaattaatgtagtagagagtttatttgggctaagcttgaggactgcaatctgggagcatagattcaagttgccctgaatatacatcccaattagcagatgttgtaagtggattttttttttttttgacagaatctcgctctgttgccagggtggagtgcaatggcacaatctcagctcactgcaacctccgcctcccgggttcaagcaattctcctgcctcagcctcccaagtagctgggattacaggcatgcgccaccacagttggctaatttttgtaattttagtagagatggggtttcaccatgttggccaggatggtctagatctcctgacctcatgatccacctgccttggcctcccaaagtgcaaggattacagatgtgagccaccgcgcccagttgattttttcttttttttttacagggtctggctctgtcccccaggctggagtgcagcctcaaactcctaagcttaagtgatcctcctgcctcagcctcacgggtagctaggaccacagacacatgccaccgtgcctagctgattttttgtatttttttatgtttttgtagagacagggtatcactattttgcccagggtggtctcaaacgcctggccttaagtgatactcctcagcctcccaaagtgtcgggattataagcatgagccactgtgccctgcataggtggatttttttttttcgaagtctcgttctgctgccaggctggagtgtagtggtgccatcttggctcactgcaacctccgacttcctggttcaagtgattctcctgcctcagcctcccaagtagctgggattataggcacacaccaccacgcccagctaatttttgtatttttagtagagacggggtttcaccatgttggccaggatggtctcgatctcctgactttgtgatccacccacctcagcttcccaaagtgctgggattacaggcgtgagccaccgcgcccggccgggtggatttttaaaggtgataaagggggacggagagcgtgctgacagggggacggagagcgtgctgacacgaagtggctcctcaggaatcctcactggtctacagaaataacattgattatggtgggtcatagtgtccgggcatggcatccttaggtacatgtatagcttctgtggcaacagcaagcagtttcgagagatgaattgcgagatcaaaaggggcagcaggctgcagttgccatctcattttaccatctctctgagtctgacaattcaaaggacttgcattcctcagacaaaagttcccctcccctcccctcccttccccccgttccctccccctcccctcttttcttttctcccttcccctccattcccctcccctcccatctgtcttctcccctcccctcccctcctctcccttctccttcccttccgcttcctttcctttcttcccctttcccctttcccctttcctttcttttcttttcttgaggagactccgggaaagcgaaagacagaattgtggcaactttctggagcagaaagttctgaggcaaggaaaagcccttatgtgcgatgcgagggaggctgcacagacctgggtggctgcccacagcttctggagcctggccgcagcgcctctgaaggcaatgtcacatagggaacgagtcacgaggaagccagacaggcacaagcacatggacgctttccaccttgaagatccagggccaccttcctgccccctgggggcacagcggtctccagtccctggagaagctccagctggggatactgtcaacccggtaaccagcacggcgctcctgggcagcccgggaccagctgtaaagtggtgatggcaggagaaaccctacagggactggctcacacacacacagggactggctcacacacacacacacacacacacacacacagggactggctcacacacacacacacacacacacacacacagggactggctcacacacacacacacacacacacagggactggctcacaggttttaagtgaaaggaagaaatcaggagttctttccttttttagcaatttgaaactctaagaaaaaggctacagtgttgtattaatgtctcaccactcccacccccttttcaagtgaaataaagaatacaagggaagccagaaaaatgctgaagattttggcaatgaagggtctgaccacaaagaaagccaatgtgccacttgtgtggatttttgcagaaagagtaaacagccttcctgcaagacacaggctgcagagggttccgttttcatggctggctgccacagaattggcttaggctggatggactgagcagagcatggggtctgagccgagtggcgtgagccaggggtccagagcagacacggggggcgtgcacgccatctccagagtcgcacagggctgtgcgtaggcggccactagggtaggtcacgcataaaagttgctttgtatctgcagcacgaacaagacttaaagaaagatctgttttataaagacgaagcagtgctcagtatgtcatttaggatgaagaagaaggcagggaaagcgttcattttagaagtgctgtgaggatggtgcaggacgcagtggggcggggggagggtgcattccgcccggatcttccctcccctcacttctgtgctgccctgcctgcatgccctcacgcccaggctagtttccactctgccacaggcagtgaagattggatccgctgatggcagcatcttggaaacaggaaactgacaggcctctgaatatgccatcctaaaatatgactgtctgagaccagactataccaccccaaaatatgactgtctgagaccacactataccaccccaaaatacgactcagagatcagactatatcaccccaaaatgcgactgtcagagaccagattataccaccccaaaatatgactgtcagagaccagactatactaccccaaaatacgactcagagaccagactatatcaccccaaaatatgactgtcagagactagactataacaccccaaaatatgactcagagaccagactatatcaccccaaaatatgactgtcagagaccagattataccaccccaaaatatgactgtcagagaccagactataacaccccaaaatacgactcagagaccagactatatcaccccaaaatacgactgtcagagaccagattataccaccccaaaatatgactgccagagaccagactatatcaccccaaaatatgactgtcagagaccagactataccaccccaaaatacgactgtcagagaccagactataccaccccaaaatatgactcagagaccagactatatcaccccaaaatatgactgtcagagactaaccagaccatgcctcccacacatgcctctttgtcttaaggatcatttggagctggttattttgagaaactgcagatgcaggagaacctttaaaaacagaaacttaccattttgtaaaggaaatgtccgtcaataaaggaactgtccatttgtaagggtgccttcctctctgcaccagagagagaagaacgactagatctctagactcctgaaccatggagaaggtttctaagcctgaagtttaaactacctgtttgagatcaactccagagacatactcagttctctgggtgcctcccaagtgcacacgagctacacatactaataaacttctgtttgtttttctcttcttactcggtctttgttacagggagtctcagctaagaaggttggagggcagagagaaaactcgtgttctgcccctaccggagcaagtgtgtgttcctctgcactgatgaatgtgcctgtctccagaaagggcagcccgtaggtactgagagcagaggtggagcttctaagagagcagtgacagcctcactcctcctccctggcccaccctcaccccgtcccctgcacctggagccactggaagacggaggagccatcctttaagaatctcctggaggactcatcgaccccacggggacatggtacaaggctggagagcagctctgtgttgaaggggaggagagaagataatctcatttcctcccagtctaaagaatgagcattcccagtggaaggagaaagcagatccttggccacacacaatcctcggagaagagtcaacaggattgtgactagaagtggcttctacatcagcccaaagttgactttcagcaaaaggtaggtttttgcaatttaaagcagtgacaattgatttagacaaggttagccttaagtgatttaaaaaatgcttttatgtaagatctcatttaatcttcattgcggttcttgtagaaaggaatcagaatttaaggcaccagcgcgaggttggagagctattatattatggagctaggattctgacctagttggcttaacaaggaggggcttaataaagacaagtgatctccaagcccaaatacaagcaaagccagctcataaaagatctgctttcagattttaatccttgatgaagggaaatgtttaaaaatttcctaaaagcaaaattgacaagacaaatccaaagaaaaccctgtcttatccagtgtggcctcaaggcccaaccgcatcccctgaacagaaaaccctgtcttacccagtgtggccttgaggtccaaccgcatcccctgaacctggtacattcgcctttgggtacgttcagtaaagaagccagggtctcagaatatatggagtggtatttttgttgggagcaggggtggagaagttgccttgaaatatatacagattaaaaatgtatatatttcaaatgtatttaacaaaatttatagctaagcaaatattccctacgatctaccaaaaaaatgtagaaattatccacaaagaatttagggcttcatctatttttagaggaagaagctgttagcatgctgtgttcagaataaatacattcaattaagttaataaattaatcatgtaatctttgattaagattatcaccaatgaaatatagctacacaaacagtaatgattcaactatagctttgcttattgcaatgaaaaggatgatctggacatctagataccctcccgaaaaccttgtgaaacctgtgactacctcttcatgtaagtccctctccccacccccgactggggaagtcaatgatttaccaaacacagcacacagctggtccatggcaaaggcagcaggaacccagcactatctgcctaaagatggtgacctgcttatgggtggccgtggtccgcaagtcattagtagctttggcacacgggtctatcttctggaatgaccaggcctccctacgtaggccagagtcttcctgcacaggccctgggccctaaggctgcacaggtgcccgaggtccagtcagcagatatgttgggatcaaggcatcgcgtgtccttctgctaaggcagtgtttcccataccactggcaggcatcaagatcacttagagagcttgtaattcctcaggaaatgaccttcaggcctctcacaaaaagtgtcaaagaactgaaactagatcaccacaccagatgcctgacccctcattcaccatgatcgcttccttgccccaggctggagtgcagtggtgcgatctcagctcactgcgacctctgcctcccgggttcaagtgatgcttctgtctcagcctcgtgagtagctgggactacaggtgcacgccaccacgcccagctaatttttgtatttttagtagagacgggatttcttagccagactggtctcaaactcctgaccttgttatctgcccacctctgcctcccaaaatgctgagattacaggtgtaagccaccgcaaccagcctgagccaccgcgcctggccctgttttcttatacattgttatatttcttgcctgctatataaactcctggttttgatcagtcagggagatggatttgagactcagctgcagcaccctattaaagccttcttccttggcaatactcatcatctcagcgattggctttctgtgcggtgagcagcaggactgagatcaaacccctggtgtttcagtaaccattttcctactgtttttcttttctttttttttttctgtagagccaatgtcgtgccatgttgcccaggctggtttcaaactcctgggatcaggtgatccccctacctcagcctcccaaagtgctgggattacaggtatgaaccaccacgcctggccccctagtgaaatctaaaattgcaacgctcttttttctcacagttttctcatgtcattaattctctcttctacttctctaaaaactttaatctactccactgtccctgacattttagtttttgtctgactacactgtcttgcctaccccatatttgaaccactttttcactactgcccccagcccctattgccctaacaggcctcccaggcttctcagacccgcgcaatggagatgaagcctggagttactgactgtgctgcgcaaagcaggccaggagcccacagctgtcctgaaagcccttctgtttgtggtgttcaccttggacaggccttcgcccccgacttcgttcatctgttcttgctcagcttatatcttctcttaacccaccgcaacattcatggctgagaccccctaacaaaagactgattagcaaaagaaaatcatgcaaatttatctaacgaaagttttacatgacccaggagccttcagacatgaaggcccaaagaaacagggaacactgtatttttatgcttaggatggataaagagtggacagtcctgtaggatggttggacaaagggaagatgagctaatgagaataacctggggagaacttagcaaggccaatttgttcagattccgcttggcatcgctgggtcttcattcctcttctctaggtacagggaggaggaacctctggaatgagcgtctaatgacctactttagagggaggccaaataattattttaggacctgctttggaggagaacactgggagaaggtcagagagatcttcccgctgctgccctgcgttctccttcccctcctttgtctccacggtccccgcccttgtttaccctcccgtgctcttaccaccctccaggatcatactcaatgcattaaccctttccctcgtctcttctggcttgttcgccccaggcctccccataaacctttcttaataaatccttctttctccatcctgtgtctacgtctacttccaaccattttttctccttaaatatttaattcaccatctttacctacatgcttattttatgcattatcacaaaattatattttcagcccccatattttcctgaagctcttttgcaactgttgtaaataatcttctggcagccaaacccctttttcgttccctcattaaggagggtttatacttaggaagcagccaccacttccaccactgagctggcattggcgatacgacaatgaacaagatacaaatggcctttacccttatggagcacgcagtccgtggtaaagaaagcaagaagataatcaattacagaccaacctggataacacagggagatctcatcgctgcaaaataaaaaaaattagccaggcgtggtggcgcatgcctgtggtccagctatttgggaggcttaaacaggaggatcatttgagctggggagtttgaggttgcagtgagccatgatcacgctactgcactccagcctgggcgacagagtgagacctgcagtgagccatgatcacgctactgcactccagcctgggcgacagagtgagaccttgtctataaaatgataataataagaataaccaattgaattacagcataacaaatgccaggatggagaaataatgggaaactgggtgcagaggagggaggtctttaaggcagatcaactctccttggcatttagttctaaatactgtcctcccatgtggcttgtaggacccacactcccctgagactcctcctgccactcctacttggttttattctttgtcactcctccatttccccaactatctttgaaatattcgtgttccacaggactttgtcatttacacactcttcccttctctttctagaggcttccttgagcatgctcactgcttgaaaacctgatgaaactgacatccgtctctagcctggagacgttctcttgcacactcagctctatgacgggctcctcaaactcaaaaggctcgggaactgagctcattatgtttcctcccagtccttctcctattatctgtcctactctagttaatgaaattttcacctccctatttggagcaagtccaaaaactgagagtcaacctatatttctccattttacttattctctgccttcactggaggctgtaccacttacaagcacatactctaaagccagatggtgtggactgaatcacaattctactatttgctagaagagtgccttaggtaaattactgcatagctctgtgactccatttcctcatctgggaagtgtattattaagaatgtggctggcctttgtccccaggttttgggaagtaacctctaaacccctgccatttcccgtgctctaggggtatctttgttattcacagggggctccttggaccacacttggtagtctatgtgaacatatgacttggaatggaggctggtcaagacggaaagacccaccatgtgattagggagtcgagggctttgaaccatattttagtggcctgactctgaggaggagaggggccaaagactgagacacatgggcaatgattcgatgaatcatgcctatgtaatgaaaccccaataaaactcacaaggactcaggggagcttccctggttggcaatttcctctgtgcgttgccatacactgaagtgccggaagggtagcacgtcctgaggacaagggcagcttcgcagctagaaccctcatagatccccttctgtgcatctctccctttcactgcttctgaattacatccttttactgcaataaaactgccatcataagtatagtgccttcctgagttctgtgagctgttctagaaaattgttgaacctcagggagtctgtagggacccctgaattggtagccagctggttagaagttagggtggctccggaggcctccaaacttgcagctggtgtctgccgtgaaggaagtcttgtaaagaactgtgcccttaacctgcggtttggcctaaatccagacagggaattgaagacaataacgcctaatccatatggttactgtgagaattaaatgagctaatacagataaagcctttgaatagtaactatcataagtacaaaatgaatatcacctatttttatttgtattgatttatttttatagacagggtcttgctctgttgcccaggctggaatgcagtggcaccatcgatcattgctcattgcagcctcaacctcctgggctcaagtgatcctcccacttcagcctcccaagtagctaggactacaggtgcacaccatcatgcccaactaacctgtttaattttgtagagacgaggtctcactctgttgcaggctggcctcaagctcctgacgtcaaacaatcctcttcagcttcccaaagtgctggggttgatgttacccacctttagaattgttgccttgcattagtgtgaacagagcccatatacatgaggagtctgcattcccagggtcttcccaatgggcctccactggatgcccatagagaagaatggtacacagcagaaaagcagagagagagagcttcatgtggcagcacacagacatagatccccacctcctttctgggcctttccttcacacaacacaaaagcatgaggccactgtggatgggcaggtaatccttttgtcccccaaggcttgtggaaagatcttctgttgtttgtttgtttgttagtggtagggtggttaaaagcaaaagccatctgcccctggatcatgccccatataaaaccgaggtctgctaccagtgagccaggagcaggaagctttctccaaagaaccccacagatacaagcagagtttgactatgagacaaaggcagaaatactgagaaaaccccatacatgaggtccaggctaacagggatagcctaagattgaggctggaccaggagaattaaaaaatgccccttccacaccttaagtctttcatgggaaaataagcaacaacagttgtttactcttgggagggaggaatcaaatgaaaagagagacatcttttgtgtacaggcattcagggtctaccaaaagatgaaggtgaaacagtaacattgacaaaaactctccagcacaccaggtccttcactaatacaaggtatcagagcccacgactggaagaacttaaagtttgaactaactgtgattatagcagcaacaaaacccaaacccaactcaaaccagacttccacacaagtggcctggcagaagaagtatgcccatttctggacataaaatattttaaaagtccctttattactattgttcttctacacacaatgtctgatggtcaatttttagaaatacatatacgtatgatgtgtaaagcaagaaaacatccaacttactatcaagggataaagcaatcaacagaataaggcccagagatgaacaagatgctaaaacaatcaaacaggaattttaaaataaccatgattagcacaggacaaaaagatcaactctcatcacttctatgtaaaatgtatttaaaatcttaaacagtgaaataaggcaagagccagaaaaaaaaaggcacacagacttaaaaaaacaaaactacattcattacctgactgcataaaaattccaaataatcttttttaaatgctattggagtaagtgaatctaacaaggttgtggaagttaaggccaatatataaaaatcaaatgtctttttatatactagcaatgaacaattggaaattcaaattttaggaaacatcatttaccctagtatcaaaagcatgaaatatttggagataaatctaacaaaaatgtgtaagaaatactgtgaaaattacagaatattgatgatggaaattaaagcacacataaaaaataaagcaaactaccatgtcatgaataggaagactcagtatggttaaacttttaattcttcccaaagtgagctataggttcaatggaaatccaatgaaaatccaagtaaggctttttttggtagaaaatagcaaaggtgattccaaagtctacacggactttacctgcactatatccaaaatttagttcaaaatagacgccaggcataatatcacacctaaaactataaaatcttctagaatgaaaaaagaaaaatctttgttaagcaaaacgaggtgtaaaatgatgtaataatttgggggagcaaaataagcagtttattattaggttaaaaatactcttaccacacaagccagatagatactccttttctaagtatttcccccccccaacccaaaatgaaaacatatccataaaactaaactgcaaatgaatgacacaagatttacctgcacagtgtcatggcactatggggctggcaaggtagtagcatagccatggtgccaaggcaaacttctcaaatctctctgtgcttcagtccctagaaggaactcagctacaggcgatgcccgatcaggttgaggtttggaatgggccctggatactggcatttttaaaactcttcccaggtggccgggcatggtggctcttgtaatcccagcactttgggaggctgaaatgggaggatggctggaggccaggagtttgagaacagcctgagcaacatagcaagatctcgtctcaataaataaataaatattcttccaaggcaattttgctgtgctgctgggtttaaagcactagcaggacaagacagtcattgtttctagtatatatgtgaacacattgcaggagggaataacatatacaaattagcgcttaaaaacattcaggaaggaacatacaaaggagcaaagaattatatattcaacacatgttttgtgctctagaagaaattaaacagaacatggaatcaaacaaaaattaaagataaaataggtcaaaagagaaattggagagaaaataaagcaaaggaaggacaaaacaccattagaaacacccaggaacagaatgatcagctgccagcaagtcagtgtcagcaagggaagatctgaaatgctagcaaagaggaagaagaaaaagattaaagacattgaaaggaaaagatatggaggacagacaagatacaaaataaagcaaaacataacattgctctcaaatttgaaacacgtgacaggaaagtgttaatttagagaggtaaaattcaacagaaaattaaaaggcatgaaaatggctaattaatatgtggaaggattctgtgtaaatttagaaaaatgaaaacaatgtattcagttggtgcaaaagtaattgtggtttttgccgttaaaacctctttgcagatcacatcatcgaaaactgaaaagattgatgtgtgggcaaaggtgtaaaactagaaacttgaatataatgttgaataaaactatcattttcaattcaaataccactttacttcagcacatttatcttacatatacactcgcaactaggaaaggaatatggacaagcaaagtcactgtgtcatttttagtcattgtaaaaaccagaaaaaatctaaagttttgtttgtaaaggattggtttaaaatcatggaatatccatacaatgaaaaaggtaggtgttcactgggaaatacagtagctgtctatgttgatagggaaagaccttcaagattgctcaagtgacacaacggatatctaacaatacgtatgaatgcataccctcctgttagggaaacaggagcctaggagagtcagggtgacaccactttaaaatcaactccatcttaaacctaatgaggcacattccttgccagttaccacctgtattagcctcttctcatgctgttaataaagacatattctagactggataattcataaaagaaagaggtttaattgactcccagttccgcagggatggggagggctcagaaaatgtagaatcatggcagaaggggaagcaaacacgtccttctgcacatggtggcagcaaggagaagtacagcaaggagaagtgtgaagtgggggaaaaccccttataaagccatcagatctcgtgagaactcacgcattatcacaaggatagcatggaggttaccgcccccacgattcgattacctcccactgggtctctcccatgacacgtggtgattatgggaactacagttcaagatgagatttgggtgggggatacatgggtgggacacagccaaaccatgtcaccacccatggtcatagaatgttaatagctgagaaaaacgcctaatgcctgcaaggacaaactcttatgacagcaaaatgtcccaatgtcccaatatcacatagcaatatatgcttttaaagataattatagtcatgctgtggtgtgtttgtgcactaaagtgccaaggacagctttctttaaaccaacgaggaataaattttgtcacaccgtcagcccactggcgtgtagacataatgtagcttagcttttacatagataagacccctatataagaaaaacttaagacaaagatgaggggttcctcctcttgctttctgaggatgccctactttgtatctgggtaggtttcagtaaactctctctcctcactgcactctgcaactcaccttgaattctttcctgcacaagatccaagaactcttacttggggtctggattggaacaccttttcctggcaacactcctattacacttgaaatttcaatcgtatgcctgtatttcttctgtttcaaatgttaaaaatttatatgtt

SEQ ID NO: 312 - DNA, 108018 bp, Homo sapiens
ctctcacccacttccccttaggttaaattattttgaagcagatcctagacattgtggtatttctttcatcagtgtttctatgtggatatacaaaagataagattcctttaaaaaagccataatcaccacatcatcatcacacctacaattatcagtaattccttaatattatcaattatgatctcttcagatttacccatttttaaaaacatttcttttattaaataaagatctaaataaatccaaatattggaattggttgatataattttaacttttaatctaaagatggctcttctctctcttttttaaaaaatgtatttgtgacagaaattgagtttttcatcttgtgagtctcccttcgtctttattttgcttattgcatccctgcagtgtcatttaacatgttcctacctcccctgtctttcctgtaaattggtagttggatctggaggaggtttaatctacttcttagatggtggtgtgtgcttctattaggtgacgcctaatgtctaattttctttcttttgttatagcatgcattttaacacttgatcatacaacttattttttatttatttcattaatgaatattcagtctggcaaaggagattttaagtgcctttagggtgagattggtttctttgatatcctgtgtagtgcttttctaaggttagactcacagaatgtgggctacattctgtttactgacttgctgcatgccttccaaacaagaatggggcatacctgttggcaaacatggcagataagtggacttaatttcactcattattaagaggcttaagcaggaagacagatgaattcaacaactgctgttcactaaagaggaacaaagtgaatgctaccaaaccttgcactcttttaaagaacaactcttctgcaagcattcaatgggcaattgagaccttatttgtttctttgcatctgtatgtggtgactgtatgatgctctaactccattttaaatttaattatcagtgccaatgaagaagagacttgttatttgtgtatttggagaaattccaaattccacggactgaagacttgttgtgatgaattgaccagcactttttgttctgacaaataagatttctgctgcttcatctcttttagccctacaattggatgcacttagggtctggtatcaaagtgattggtattgatggataaaaattttgtttggagtaaaataaatagaaaagacagatgcttttagtttttctctttttctttttctttttctttttttttttttgagatggagtcttgctctgtcaaccaggctggagtgtagtggcactatctcggctcactgcaagctctgcctcccaggttcactccattctcctgcctcagcctcccaagtagctgggactgcaggcgcccaccaccacgcccagctaattttttgtacttttagtagagacggggtttcaccttgttagccaggatggtcttgatctcctgacctcgtgatccgcccgcctcagcctcccaaagtgctgggattacaggcgtgagccaccgcgcccggccagtttttcttaaatagtagtaagaaatatgttaataattaacatatatggatatgaatggtttggaagcacagaaaatatcaaataaatatttgctgatttaggagaaggaaaaatagtaagtgactaatttgtattgccagtctctatgtctgagggtctttgccacatgtgttatgtatgttaatgtacaaagtgctgtgatgggtagatttttttttttttttcttgagacggagtctcgctctgtcgcccaggctggagtgcagtggcgcgatctcggctgactgcaagctccgcctcctgggttcacgccattctcctggatggccagattcttactcctattttacagatagggaaactacagttcagagattaaataatatgccaaagtcttcccagctactacctggtagagacttagctgaaatccgaagctatctgattcccaagcctatgcactttccaccctaccagcttttccaaagtgtctagagaaggccagtgctgagaaatgctccctgagtaaaggattatgtcaccttatgaattgagaagactctgaatagcaaacccatttcttagcaaattcccaatgcatataataaagtttctgagaagtcttatagaaattaaactaaattaagtttgttaaatccagcattggattatgaaaacttttctcttttccttataattctttgggaaatacatactttactgggctggactgagaatcagtggtcctggacgctttaccagctaagtaggtaaaactgtttacctggggataagttacattacctctctgggcctagaattcgacatttataaaataaaactctggctagatattttctaagatccttcttgagtataaatgcttgatgactccaacccatttccatatgaacaaaacccattatgctttgtttagattaccaacaagatacctgaaatctccactcaatttcctacagacatctcaaattcattatgtaccaatgtgttcttatccattccacctccccatcctcctgcatttctttatctctgtcacattaccagtcacttaagttgtttaatccagaaacctagtagtgatcctggactcctttttcctttgtcaccatcacatccaatcagtatagcttagcaattaaatgtgtgggcttcagtactggagactacaaatcctggctctacttgcaggaaaattagagagcagcttgaattctctgtgtctcagattctttataaataaaatgcatacaataattccaagatataaatttattgtgaaaattacacaagagataatcacatgcataatggaaattcaataaatggttccttcctattattctatctttaaatctcttatgctcttcccctcttctccatccagagtaataccttcctaacccggacctcattatcttttactgatattgcaatagtcacctaattgggctgtctaactcttgtctagtccctcccactttatcctttgcatttttgactgggtgatctttttgaaacaaattctgtcatattactctgcccttgagtcttgtggtccagtgacagcaaatgacttgaagttccaagaagaagctgtgctacttcatgctttggtattttgctttgttacttcctaaggtgacccggagtgctcttaccactgccctttgtttggctagcagacatctattcatctttcaacttaaataatgttgctggtcccagatgaatttctagaatcttgctactcctctgaagagatggaacctattttctctccctttaaatctagatagagctttcagcttgcctcaggaaatgaaatgcagtggtagtgatactgtttagcccctgaggctaggacattagaggcaatgggatttcagcctggctttctttctttattgggatgcttgcccttgcataccaaccaccaagcttggaagaagctcaaagtagcccatctagggagacagtatgaagaggccatctgggatgcaactcccatgtggagagtcttctagatgacagctagcatcaactgctggctgggacttcatatttttacacgtgtgtgtatctgtatttgtgtatatatatggatatatgtatatacacgtgtgtgtgtgtgtgtgtgtgtgtgtgtgtgtgtgtatcttcataaaaatctctgccttcatggaccccatattctttgtagccttgtggccatgtattggaaaggtagtgaaagacacatctctgatgaggcaagaggacatacctcaggaaactgttctgttaggtagacttactcactaatgtgaaaaaccacttactacttagcatgaattagaagagaaagcttgaacgagagggtccctttgaattgttccgcctgcttatctagccagtgaacttcacggccagttctacattcaagcttcttggtaatttaaacgttctcttgtgtgttgcatatggcaatctgggctagccgtctgggatgtgactcctgcttcaagagcaatgaaaaagtttctagcactcactgtcgatgtgggaagcagactgttgttgaagtgttattattaatgagaattactgctggacagcttgaactagaggataatttattctccgtgaacttctaattgcagtaaaatggtttattcactgccatgcttgtccatcttgtttgttcttgtctttcaggcacagttgactgcaatgaaataaggcagaagtgaacaagttgcactagaaacaaaaatctgtatttctggagacacagtggaaactggtcaggcagggttagcttgtggaagagatgcttgggaaaatggtaaaaagcagtatggcatgctcaaggtggagccagtcatagtcaactcagatgaagcaagacacctactatgtgttatgccttatgccaaaatgggaaatcaatatttccagatggctactcgctgctcttacttttgaagttctcacttcccctctggcatttctgacagagagctctttcacttattttaaaatttggcatgtcttctccactatcctcattttgcttctattgattgctttgggaaaataaaaactcaccatgatgaggagatgtaggttttcctggtaatatctttaatgttctggtgtcttccccccgatttttgccaaatctctgcctcccattgatctcattcttctccattttgtttccctggtagaaccactgcctttctctttgcataaatgtcattaaatgtgctcctgatttgctgctaccatggtaataggtgcttgtcataggctattgactcattactgtatttatatgagatttggtcacttgtggtttagcaagcttaagaaacaaactgactctcagccaggaaatggattcgaacctgtctgtgatgaacgatagattagggtttgggtgctattattatttaatagttagtaaagcctctgagtggactagggacagtgcgttgcctggggaaatggtcctggctgtcacatagcatctattctactgtagacagccttagtggagcacacagccagagagaaggagagagagagggaaagagagaaagtcttatcactatctttgaatatccctggagaacagggtgggaggacaggtctggaagaatccaggaaatgtcaggaatgtctgcatagatgttatggaaacagagaacctagttgacctcttgatctaactgtgactgtttcagatgagaaacagagggcttacattacgatttgaggaacactagaaaagtatgcctacaacaattcttaaatagatgtgcccacttgctgccacagaacctgatgttttgccccaagggccatgcctttggatcccttctttaacttcctcactgtacacaccatttaacaaactcttttccttgccttacaataacaattcccacctcagatcacccaaccatgcatcttctctcatcttactgaatgttgctggtaaaatgtttcttctcagaatatctgtctactttcacatgtaagcaggagatagtaattatttttgacaggggaggaagggggacaatataggaatgttgagaatcaatgttgtttcaacctggtaattaccaatggaagaggtcatattcttatgtgttgagacagaaaaagactgagatccattaagcttaggcactgtcttccctggaattcagttcccctgggagtatagaaaaacatcctatagataacagctgtactgaaagacagttatgtagagaggaatggcccccagattttgtagacaaatgtcctgggtccaaaccttgactctgcccatactgtccgcataacccttggaaagttattagctcctgtatctttcatatttcttatctataaaataaaattaaccattgtattaactcatggggttactgtgattaaatgagcatatgccttgaaaacacttagaacaatggcttcaacttaacaagtactacagaagtcttcataatttttaatactacttttcagggtacatttgtttttctcaaattgacttttcttttcttttctttctttttttttttttgctctgtctcccagggtggagtgcagtgacgcgatcttggctcattgcaacctccgcctcccgggttcaagcgattcttctgcctcagcctccagagtagctgggactacaggcgtgcgccaccgtgcccgactaagttttgtatttttagtagaaatggggtttcaccatattggccaggctggtcttgaactcttgaccttgtgatccgcccacctcagcctcccaaagtgctgggattacaggcatgagccaccgtgcctggccctcaaattgccttttctaaggcagtttgcaactgactgtagcacagccaagtcagtttgatgaaaagagaaataaaggatggtcttgacattgataacacctcccttgccgttgtgttcaatctgggtaggtcttttctgggaccgtttctgccatcctgaggtccatgtcaggaaactgtttggctccacagggagagctgagtgagggagaagagatgctaaaaagatgtttgctttttgttacccattttgtcagagtctgtaaccttgacataatctttcctcccattcttgttcccttgtgaatgatgtagagagtgtttcacctaagtggctggggaatgatccagtgttggcgactttatgagtattgttgtagaaggagctagcactttagcgacacacagaccaaggttcaagtcctgtgtgtgccacctactgtctctgtgcctcttgataaatcaatgaaggtgtcaagagttgcaatttctcatttacaaaatgggcatgctaaaatgtgcctacctcccagagtggtggtgctaatcaaatgtgataatatgtgcgacagcaacttgtaaactataaaaggtgacatagatgtgagttgttactgttagtggttcttttaatttccctgctctctacaagcagacctgaattctagcagcacctgtgtgctgtcatcacttggctgctgattttatgtgaaggctttactcgtaagtctgggaccaataattgtacactggcttctcttgtagtgagagaatggtagatggtggatgcctatcacccgactggctaagagtaccagtgtggaagctttgttttcatagaacaagggatcctgacagttttcagaaaggattattttctctctttcaatgtgtaaatcgtgcaatattataataggaaactttttggaattacgagctgttatttggtgatattgttactctgatagttgataaaacactttcagaaaccaagagaattaaaggttggctagggtggaatgaatgctataaatcaagattacctgaaggggatatgtatgagagagaagggattaaactgaataaagaagaaataaggagaaatatccacggagcttgggaacatttacctactttcaggagcagatctctgaatgttattttgtgctattaaagaagtcactctgatgaaaatcatcttcacttataaatttatgtaatgagagtatagttttcttaattttgtatatagggtcaatgtagtgacttctggctacaatggattgaagtgttacaagaaaaaaaaggaagagaaacgagatgttactgtcagttgtgaacagaatcagatggggtgagacctgggctctgcgggtcacagaaaacattttgaaataccttgtgtttcaggccttgatcatggacagaaatagagcacagaaggtgcttcttagggaagtcttcacttttccaaccttgtgccacaagtaaaaaatggagcaaatgagtggctgggtacagacccttggcaccaagtggctggagtaaatggaacactgcagggacacagaacttcgcccgccactgagcatattactggagaaatacagtacgaaacccagcaggcttctgcaaacaacacatccctttaagttaattggtgttatatagaagctgaaatgctccgcttatttacaaagctacagatttatgtaaagcaaaaccaattacacttaatgcctaaactattccaggtgctcaatgataatgttgctaggcagtagagaagaaactgctgtgtgaatgcatcctgttccgaatggaagcctgtgtagttactgcaatttagctaatcacgagtgtcaacgccaacgtgaggattctaagctcttttggtgtttgctttgggtcaactttataattctgtagatctttcagctctaaggacaagtgaaaccacaatgagcacctttttctattatgatgtagaaattaaggagatgaaggcaaatttgtggggagggggagaacaaaataaagcaggctccttttctatcagtaagagggactagagcttctcacttgtactgaggtgaagtgtttaaagatttcttgctcttgtgagtgttcattaaacccaaattgcaaacttggcatttaaccttttgcagcaaggaaagcttctaaggaatattaggggtctgcctcactgttttgccaggaaacaattgctaaacagaaaggatttgaaaaagttgcaggaaacgaatttatgcctgtaccagcaagtcttttcatttgtcctcaaacaaaaaatagtttgagtaacagaaacacctggtgctttacagctcctcttttgcaattaaaaatgcgtagcatacctaatcaagttgagtaaatcttttattctacagacctaaaatattttatgtatacacaagggaggtgcataattgcagaataatttgcagtcagctgataaactcacctgtcctatccaacatgaattgtcctggaaagcaatggcttttaaaccttagggaacatgagaatgatttgggtgtgcttattaaaaccaccaattgctggaccccaatctcaaaaaaagatttgagttaaggcagtctgtataggggccagaaagattcacctgtagcaagttgtcctcaaccaaatgttgacaaatactgctactgagaaacagactttaattttatttgattttttaaaaaatgagtttccacatatttttgcttatgaaagaagaaactcttagaagataattttctgaatgcatctgaattggcagtggagaccgaaagatgttattcatataattcctttaagcatctctatttggtttggtcacttaccctcctctcagccccctcattttatcttccctaatttccttctttcttttaattccaataattccataacttacatttatttttcaacttttttagtatgcggacattctctttgttaaggacatctattttagtaatactgcttttaaattcagagaaaatgtccttaatgaagtcatattttgatagcataatattaacagcaaatatagaaaatcatgtatatgtttattatttactcagttatatacagtatatggtcacaatgtaataaggtcacgtgtaataagggatcactaagtgtattgaaagagagtatattaaaatactgtcattttgcttctaatgactcattaaaactccaaaaaaaaggtcatacgctttcaatggctgaaccattgtagaaagctgtaaggtattattggtgtatagaaaactgtcattttttttgtcatagagtaatcactgagactttgaaattattttattaattctaatgctataacatgttaatgcaaaagcatgacagtttactagaaaattcataattagtctttgtaaataaagtatacagatgatatttgtaaaatcacctctgtatatattggcttttacactaaaacacataaaatgctcaactgaagaagaaaacaatgaatactgttctcataagacaggtagactcaaacacagtttcatagggctgtctcccaaagatcaatacttgaagaaaattcctgtatactgccataaaatttcagagatttttcgtggaggagaagtgtttcttcaagattacttccacggatgttctgggcattaaaatgatttagattacaatatctaaaaaagaaagaaagaaagcttttcttaggaccagatgtagatgaattgataaatcatttgcttccctcctgcgcttgtctaccttttatgatgggctcatagatactggcacaacagtgacgattatttaagagcactgctcaccaaaacagcctttttaaaaggacaaaaggagtttttgtgacttagtaaagtgtctcataaggacctttaggtggcgctttttaacaacctgctacgctgtcttcagtgctgacagagagatggtgagaaggctgaaagcctattgacttgacagatttcatggcggtcaggatgcataagaggtttactgggaatttgtaaattcagtgctgagattatgtggaaagcaccattgtcaaagaaggagtctatgaatatatttctagaatgtgcactctccatccccaacctccagaaaaacctgcctttccagtgtcttctaagtaccagccccatgcaagggtgggatagaatcatcccatttcacagattaagaaactgaagtttccaagagattaaataacttgcttaaggttcatagaaatagtagttggcagagtttggatttggaaccagaacttgattattctgaatcctggcgcttttcctccatggcatactgcctctaaagacaaattactttcttaaacactttcgggtaagttccagcaaaataggaacttcaaattgctttattcactgctttattcccagtgattgatacatagtagatgttcaataaatatttgtcaaatgaacaaatgaatatcggctataagtttaattttatcacatacacataagtttcaaaaatagatggggtcagtcatctatttttgatttgtgaaggtttcaaaagttaattttaccttcttttccttctcagtacattactaaaaataactgtaactgtaactctaagagaatgaatactgcctgaacaactctggtcatttgtctctgatttatgtcactttcaataattcttacagcatagacacaaaagattactagaatatttgacaaaacaagtgcaatatcaactttataacatgtgtttcacaacactggaaggacagtggtgttagttataaaaacaaacactctctgcccactccctctcaaaacacctgaaatttctttttattttagcaccaaatgtgggatagaatacatatttatataaagcactgtagacatatttactttcatctacctacttccttcacccctaaactggaaagcctcgagtatgacatgtcactaatgcagtatttcaaatttgattgtggaggggttgttttcagtttctttgatgtggtacatgtgacaggtaagtctggccttatatttatggataattcctagctttatgcagctggggatttgagataatgtcccagtaaccctcacaagattggtttggttctaggacttaacaataagattgtatcagactaatatgaacttggctgtgggggtgtctagggtgctaaaacagacctcatcctacctgtattttggtgaggatgttgtttcataattaatacactgtcctcaagatcttgaggacaagaataagttgggactgccttgttcttgatagatttgccactattacctggctgtgaacagatacacctttgggtttgataaaaaatgggattgtgattgcatatgtgctgagattaaatatgatttgacttgtaagtaatgtgtttcaataatgctgtccctgggacatcggtacttttccccatttctttgcatgcttattgttcattagtgtttgacaaaaataatcagtatagaaaaaaatcggaatcatgcgctcctcactgcagacactggtctttctctctcaggtttcatactgtgtcttgcttaactcttctgacttggcctgtccaatcccaatggccaataggtccccaaggcagcatgtgctttggcattgatgtcattggttctagctgcttaatctctggaggcaaattttccagaatctccttacttctgacatgtgacatccattcttttcctgtggggtgctcgtcaacaggtggtagtgggtagagttattttaactgaaggaaatagttttctcccaaaccaagttaggaattgtcagagagcaagaaggcagctcttctatggcacctggaggcagcatagtatagaagtgtagaagcatgggcttcagagacaaatttggggttgaatcctagttgtgtgaacttggtcagtttatttaactagctttgcactttagttttttgatttataatgtagaatgagaagatctatatgccaagaaggtggtggggagtaagtgcagttgtttgtgtgtgtatagcatgccacccaagaaacacaggctgctcaacacatagaaaattaatttctttccttcttgctttgtttcttcctctctctctatctttattccctccctaagaaagtatgcaggagaagagaaagtagataggagatggagaagatttggtaagaatcagattcatttctgaatgaactttacatttttacttagtcacttctcatctttggttcctccaatctctggtgtgttgtatatttttattcttacctcctcctctgcactccacgccactatttctcacttctttacaggaactcactagttccacaatcagagagaaggaatcacacttgaatattttaatttgggccctagatgttagctccatgtagactacaagtttgcctgttcaactctatttctctattgcctggaacaatgcttagcatgttggttgagtgtatatattaatgagtaaatccctgggctaatagattctgggtccagtgccatttctacctgaactctgtgcatgactgcggtcatcttggccacacctcaatgtaagtctaggagaagaataaaaaggaggaagaagagagcatatggctaggcataagaccattataattacaattgctaacacttcagagcatttactcatcctcacaaaagccttatgatacagttactatttttatcatttccatttttcaaatgaagtaactgaggtttagcaaggttaaacagcttgctgaagtttgtatagcatgtaaattgtgaaactggactcaacttgggtgactaaattattttatgaaagacaaggatcaaaccttaccataggatacaaaataaaaattgagagatggtgcaggtttttgagaattgctgggtgagcaccacttatgtgtctggaggcagtagatggaggggaatgaggccatgtgaaatctgttttgctacaatgctgagaacattcctgttggacctttctgcaaaactttctggttctctaatttgattttcaatctaagaatgagatcagcatttaggaaaagtatatactgtgaaggatcagtttgataatttatacactttggagtgtaagaaatgtaaaaattcagggagctattaaggcttttaattttgttttcaattctgccttgcatgaggtttgattctttcttatgctggaccataagcccaatgagagcagaacactggtgaaaataaacctttattgacatactgactttgacatctttctggtttatgacaccacctatcacatggctgatgttcaaaaagagatttgttaggttaataaaataatgacctaggcaaaggtgaagtgacaatggatgagataatatatgactaaatgactaaagagataaatggatggaaggaagtgaggaaaatgaaaatctgcttagtttctgcttcgtgacagacattgtgattagcactttatcaatattcgtccccgtaaaacccacaagaggttttttattttacatgtgtaaaaacagaggcccagagaggttagagaattttctcaaaagtacacagctgtccaagaatatgtcaaggggagagagagagagagagagagagagagagagagagagagagagagagagagagagagagagagaggctggcaatggatgggtggatggatggtagctggtacatattaagccactctcaggtgacaagctaagggattttgtagttttttttaaattgaccttgaaatggtcactgctgatttaaaagcctgaataggatccaaatctcaagcatcattagatttctagctatttgtttaatggtatttgcttttagtggtaatgattcactcgttcttattatcgataagcttatttctaattctaaagtgatgctacatagtggggaaaaaaatcttgtgttaggatatgttttagaatttgtaaagtactattttattataaggattgatggaaaaagtgaagttccaaattgaaatttcttaccctgaataatctgttgaattgctctaatattctaatttgtccagtcatggtgtacagaattccctggctcagtgatggttcccagaccaatatttcatggactcagaaatttttcatcttaccacacacttacttacctttgtgaaacactgcagaatcccaggacgttcaacaatgttaatgatgccaggaagaagaagaagctttctaaattgcctttgtttaatgtgtttggaaaccaattgcctgtttggaacaaatgtaattgttattcaactgcagagttgtaagtttctgtgaatattttatcattccacaattcatagagctttgttcgcttcagtaatatccacaaagcaaaaaagctcatctgaaacttgattgtcaaaatttatttaattctgtaattaatagtaaaatgataagcaaagcaccccaaatattttgaaggtcacaaaacactcttaatttgcatcgcacaaatataggtgtcagaagaactgggttgtaaaggtaatcctgactattccattaacttgcaggagccatgtgtgtatcttatttatccttatatttgtagtatttagaacagtgcctggcatgtggggattatttggcaaatatatagtgaatgaatgaaaagtattttctatgaccagagagtctgtttcatatgctaattgtaaggatagtgagatgatgtatataggtgatagatgttagattattttcacaactttgataaatccagggctaccttatgataatatcacagacctcattggtcaaattacttgcaatctctggctaacatggagattttcttttcacctaataagtaaattcttcaatttgataccaccaaataaaggatctgtacttcattatgatgtcatactgggtatatatgaaactattcaaggttcaaggtaattactttaatttgcttctaagttttgacttttgctttggagctgtgctataactctatctctatctctgtctctgcctctgtctctgtccctgcctctgcctctgtctctatctctatccacgtacatactttttatttcttcagtaaattttggggtattgtttaatatataaaatataatgcactattttatgaatattgtatatgtgatacttaattttaggcaatactttaaaaacagcaaggagaactagtattaccaaatgtatttacattgcactacagaatgcttaaaagggaaaaatctaacttaacagagagaatttaatttaactgtagctagctctgaatgagttgaatttttttactgttatgcattatgagaacatgaaattatcatctttgaagacaccaatgacaaggtttcatcatttccttgcctttttataggaacaactcctacaatggaaggtgaagagggtgtgggaccagagcaatcagtctgttgacccaataggactgggcttcagtaccatctttggcacatgggttgtagggttgtttcctgcagtagaaagtggttcttggcctctcccttgacaatgcatacttataaatgggatttaacttaaatattctgatcatagtcagcaagtgcataagtatgacaattgtgattaattgtgccacttcccatttaaagctgtttgtcttctgtcttttacctactcaatgactattactatggatcagcaatgaaaattagctgtgtctattatattcttggacctatatctgaaagctagcctaaataaattatagcacaaataaataaaacggtaaagtgcaacttacaaaataggtattattttgtcaaaagaactgggttgtaaaggtaatcctgattatgctattaatttgcagtagctgtgtgtgtcttatttatccttatattttcagtatttagatcagtgcctgacaaatagggattatttggcaaaataataccaaaataggtattatgataggtataaataagtattactatacctattttgtggttccactttaccattttatttgggttctattataatgaaaatttatggttttattgctacagttacatgatgcctgtatctggtgtttagatgagtaaatgaagttcactgaatgtttctctataagtcttgtctattggatattgtgtagcctttttgatgtgtatatgtgtgcttttgtgtgtgtgcatgtgtgtgtgtgtgcccgtgcatgtgtgcacacaggaactaaacatttgattgtacttgagtggggagagttgaggtggaggtcaagataaggtgcaataacatcctacttattttcaggaagaactaaaccatccttctaagcctattcaaacagtgctattttttcccctcttgaattaatatcccaattgtatttctgtccttttcatttcacatcagcactttgcatgtcatgcgattatacctttttatcaccatgtttctctgactagtgtaagaggagtttgcacagagtatgtgaagcttcagaattaacatgacattaattcttcttggagcatgaattctggtccataataagtaattgaaaagactatattataagagagtcagatgaggaagaagaatataaattcactaagatctttaaaggtaaaacataatattttaaagaaattgtttcattatggcaaataccagccttttgggagatactactagatccccctgggcacaccagagcactctcatcactggggatgctgtggaaaacagaaatgacaagtactatgacttggtatttgggagtttgtgggtgacaggagagaaggacatttgtactagaaaagttagagaaagatagtataaatctgtggatatggacaaaacattttgtgagtgggattatcttaaaaaaaaaaagaaaagaaaaccccaaaccgaagattgccatattacgtattcaaactttctataatgctcctgtattcattcttaaatatcatttttagcatgtggctttctttctaatgctcatcttcattctagtcccacattttttccatatttagattcatttaacattctctgtatagctgatttacatggtaaagagaagcatcgcctgaattgatagcatgggacaaacacttgtatcaagtcagacagaaagattcttcaggacacctaaagtttactttatttatatggagatgatctgtctatgtgaagagacagaattgggtataaaaagatatagaaagggcatgggctttagtcaggtagacttttaaagttgaatcttgccttaacagtgtagtcgttgggcaaataactggaccacttaagcctcagtttctcttctatgaaatgatgataacagaatctcccttactgagttgtcatgagaagttaaagagataatggttgtcaagggccggacacagaggaggcactccacaaaccttagattatcacctcctcctgccccctttccaggtagctcacacaccatcatgtagcctgagcttgatcttgggtctgtctcctataagatacttcttcatgttctgtatgccttttttttttttttatcattgtcccaggactggttgtaaaatgttccgtttaacattgtcagttgactccgctcttaggtactataactttattttagtagcttataaacttttattgtcgtaattcacatttgtgccatttttcatctgacatttccagtagctgattgaaatcaggagcatccttgcaaaggagacatagtgaagacttgaggtctagaatgaggctaactaaacttctccagatcgcaggatagctgaacaggagcatgagaaacagtgtgccacatagagtctgatgggtcattcattccctgccattcgtaatgcccacagtgcaccctagttaatactttcataatataaccagctagttagtaatagtgttcaactgctgaagtagtaaaggactcaaaatatttagcattgttcagaattcctccaaatatctcttgcttagctagatgtatttgttcatttgaaagtcattttttagaatttttttgtgtaccagaaaatgtgcattccatgctgcttaagaaaaggaattcataaattagtaggggacaggcaaagtgtaattattctggagcattaggccttgtagacactaaataaaatgtttctatttatccgaaattatcacagtcattttagagacaaaggattgtagaatcatctagactcactctttattttatatattaatgagtgaaggaacagagaggtcaagtgaaacatcactcagcagaaccctcatcttcctgctgttatatcaaatgcactgctgtagtccacctcttggtgtttaatgcaactaccacttttatgactttctttaacatcttctcaacagttttaaaatgtctggatttcagtctttgaaatcacttacctcaaattctttctaaaatacctaaggacgacatttctactctggtcctgagactggcattcaacctactgtgagattcttagagcaatttacactaaatttaaagcttttgaaactggattgagaaacatatatcgtgatacacacatgctataacactataaactacacaaatttgctaatatgaaagaaaaatacagtttatttctcttctatctaatgccctacgttgtaaggctcaaaatttcatttgctgccttgatgcctttgagcctcacaggccccaaaggtctaaccacatgttcccctgctttcattagataatgctcctcacccagagggaagagctccccacctggctagttcccctattagccaggccagctgcactccacccgggtctcaacctaagacgtttcacttccctgctagctctcaacattattcaaagcaaccaatcacatttagccgacaggaaccagcctgtcaccacagccctttgttactacaaagcctgccccccacagaccctgcttgttcactgtatgcctgagtgcaaccccaggtgaccctgcacatatcagggtattttcctttcccaggctgtgagtgtatgtgactaataaactgctgtcagtctcatgtgtagactgtctcaaaaaaaaaaaaaaaaaaaaaggatgcatgttttccataatctcatactatttagagtaagagacacccccaggtcaccaatgtggtgaataagagatgatcagaacagaccctcaccacagaaatcaaggtcagttctagagaaaatagtaatagcttttgctttaatgcataattactgtttatttttcttttggaaggaggagaaaagagaaaggaaccctcccattcatccttccgtatcactactcagaaccaagtacctctgcttctaaactacatcagggagtgcaactcccatggaatcacaggacaagaagaaatgggaacagatatttaaggtaatagatatacaaattaccttgatttgactatataaatttatcaaatgatcacacgtatcttgaaaacaagtacacctagtatgtatcaataaaaaattttttaaaataataaaagaagtaatgggaataagacatagtcatccaagaagtattggatgcagtgcaacctgcctgaccaaaaataaaacattataggtgagtatgagttctggggggtgccagatagccatgtatgcttgacactgtggtctataatcactctatctagtcagagtgttagaaaacctaaaaatgctgtaaagttctcattgtagcctagcagtcttgggcttaatgggtcactttaactgtagactttagcaaaaatatccacatacactctcagttagtaaacactactctcagcaaatctcttcttttgagcatgagtaaacagaaaaagggtcaatatgggtaaggaaaagtgactacgatacatgttataaatgttgcttacaggaaacaccctgaacacagaatgacaaagcttaaaataataataatattattaataataatataataatgaatgagaaactcataagacaaagacaaaaaatactggaaagtactaatctcagcaaagttgaattcaaaggaaaaactattttaaagggacattgaaaatttttttatattgataaaaaacacaattcaaattgaagatatgccagtggatttcccttaagtaatgaaatcataaaaaaatctgttgtcttttggaaaaaatgatatatacgtaattcttatcaatgactataacacactcttgccagtttttgatcaaattgtcaaagaagagatgtagagaattaaattaatgtgattgacaagtgtttaataaagatcacaacattgtttagtatgaagaaagaatatttcaccctcttacagaagtttcaataacattagaaataaaccaaacctccaagaaattgaagatatgcctcttggacatctaactggtcaatgaagaaatgaaacccacaatatcaaagtatttagaaaatgaagagaatgaggaaattgcatttatacatttagagatacagatataaactctacccagaagcacatttaaaggcacataggttttcatttttaaagtcagaattaaaataaatcaaataaacattcaagacaaaaaaattaggaaatgcataaaacaaatctaaggaaagtaggagtaaggaaatagagatgagaacaggaaatcaatatattaaacatttttagatttaatagttctaagagatgattcattggagaaaatatgacaaataaaactggcaaatccaatcagaatatgtaacaacagatacagaggagataacaatgtttagttacgcgtatgctattttacagtcaaaactcttacggaaatgagatgagtacttaggtaaacattaattgccaaagttgaaccaagaagaaatggaaatacttaaggaccaatagtagtaggaaaaagttacaaagaattactttttaaaaagagacattaagatccctaccaaaattccactgacacttttcacagaaatagaaaaagcaatcctaaaattcatatggaaccacaaaacactacaaatagacaaagtaatcttgagcaaaaaacaaagatggaggcatcacactacctgacttcaaaatatactacaaagctatagtatcaaaacagcatggcataaaaacagacacatagacaaatggaccagagtagagtccagaaataaatctgtgcatttacagacaactgatttttgacaaaggtgccaagaacaggctgatatgtttaggctttgtgtccccacccaaatctcatcttgaattgtaatccccataatccccatgtgtcaagggagagagcaggtggagatagttgaatcatgggggtggtttcccccatgctgttctcatgatagtgagtgagttatcaggagatctgatggttttataaggggctcttcccccttcactcagtattctccttcctgatgcctttgaagaaggtgccttgcttccccttcacctttcaccacaattgtaagcttcctgaggcctccccagccatgctgaactgtaagtcaattaaacctctttcctttataaattacccagtcttgggcagctgtttatagcaatatgaaaacggactaataccaacaaaggagaaagtacagtctcttcaataaatggtgctgggaaaactgtatatctacatgcagaagaatgaaattggacacttataccagatacgaacaaataaactccaaatagattaaaggcctcaatgcaagacatgaaactgtaaaactactagaacaggggaaaagcttcctgacattggtctaggtaatgatttcttgaatatgacaacagaagcattgacaataaaaggaaaaatagacaaatgagaatgtgtcagactaaaatgtttctgcacagcaaaggaaataacagagtgaagagataacccacagattgggaaaaatatttgcaaattatatatcaagtaagggcctaatatccaaaacatgtaaggaattcaagatactcagtaagaaaaaacccaaatagctaatcgaaaattgggcaaatgacctgaatagacatttcctagaagaagacatacaaatggccaacaggtatataaaaaacttttcaatatcaatgatcatcagggaaatgcaaattaaaaccacaatgagatatcacttcacaccagtgagaacgttatgaaaaagatgaaagataagtgttgatgaggatgtggagaaaatgaaaccttagtacactgttggtgagaatgcaaattagtacatctattatggaaagcagtatggcggtacctcagtaaactaaaaatagcattaccatagcattaccacatgatccagcaatgctactactggatatatatccgaaggagttgaaatcagtatatcaaagaaacttttgtaaattttaggatactctcagtttgttgcagtactgttcacaatagctaagatatgaacacaactaaagtgcgcatcaattgattaatacattttaaaaagtggtatatatacacaatggaatattcagccttaaaaaagaagaaaattctgtcatttgtgacaatatggatgaatctagagtacattatgctaattgacgtaagcaagacacagaaagacgaataccatatcatctcacttatatgtggaatgtaggaaagtcaaactcacagaagcagagagtagaatggtggtattaccaaaggctgaagtggggaaggggactgggtgggggaaggggaaatattggccaacaggtacaaagtttgagttagacaggaggaattagttctggtgatctattatacagcatggtgactctagtcaataataatgtattgtatatatcaaaattgctaaaacagtggattttaaatgttctcatcaccaagaaatgataattatgtgaggtggtggacatgctaattagactgatttgatcattccacaatgtatgcaggtattgaaacattacattgtaccccatagatatatacaattactatttgtcaattaaaaataacatgcaatttaagaaaaaagagagatattaggcatttttaaattttcacggaaaaagtagatcttttctctggatctttccagaacatagcaaaagaatcataattgccaacaagtattgtttattgcacatatataaagatgatttaatattgaaaaatttactaaatgcaccctaatgataggtccagtttcttatgattaagaaatatcataaggtgatcttaatagctacttaagaaacattcgatacaatttaaactgatttgtttacctcttagaaaacaagaataaagtttttgtatgataaggaatattctttaagatcacctttataatcctacaaatatacttaataaaaaaataagatatcctcattaagatcatgagcaagatatgatgtgactgtcttctggtattaccattgccccgtaagctctgggtcctgagaaagatgcaaagcataggagtaaatattggaaataaggataaaaattacatgtacctgaagattaattttgctgaaaaagtaaaagggtcaactgaaatactcttataaatttaccaagtttattaaattggatgcagatgaagacatacacattaataaacagtaataatctccctgtataacagtgatcacctcagtgagttgtaatgagggaaaatgaatcagttcaaatagcaaaaaggaaaaatgtataaaatgtctatgataatttcaacaagaaatgatcaggatttatatgaagaaaaaaccttactgaactcaattttgaaatattaaatttaaaaagtatgttatatacttggatggaccactacctgttgcaaaaacttcagtttttctaaaattaacttacaagttttactcattttattaaaataaaaataggattggggtctgggtgcagtagctcacacctgtaatcccagcactttgggaagccaaagtgggctgatcacttgaggtcaggagtttgagactagcctggctggcatggtgaaaccctgtctctactaaaaaatacaaaaattagcctggcatggtggcagaagcctgtaatcccagctagttgggaggctgagttgtgagaattgcttgaacccgggaggcagaggttgcagcactccaacctaggcaacagagcgagacactgtctcaaaaaaaaaaaaattggagaaaaaataataaaaatgtgaaattcatctagaagtataagccatggagaatatggttttcataaataaaagataaccaaaaagataagtatgagtaataactgatataaactatatatcataaaattattataataattaaaaggagagtgatactaagctaaaataaagaggcagctgaaaggaacaggacagaaagccctgaaactgtcccaagatcacctacaaatatgttaaaatatgtaaaactgattagtttcatttcacttactgtatggttgtgaaatatttaaagtttaaccaacttttcacaacctatattaaatactgttgtgaatgttggttatttgaagcaaataagtattttctttaataaaaccaaaatgaaatccacatgaatagtaaaattagtccaaaatgggaaaccattaaaattatacaaccatagataaatgcaatgaaattaatcataatgaaaaaggtggacagatttgattacatatagcagcaaaacttgtataaaataaatttatgaaataaaatgttgagttaaaactggaaaaatactagcaataaatatgacataaatcacaatattcttaaagtatcatgagcatatataaactgacaaaagaagaccaaaagaaaaataggccaagaatatgactaagcacatcataaaagagaaaagataaaaatgttctataaacattaaacatttcaattttacactctaaaaaatacaaattaaagtagcaatggaatgtaattttttccagtcaaatagacaaagatcaaaatattatgctaagggctgaaattaatatcttgaggcaagtattatcatttcacaatgacacataattgatgcagtcttttagaagtcaattttgctttaattctcgatagtctttaaaatatttatcctcactgaaggaataatcccatttccaggattctagtctaaggcgggaataagttatgtacttaatgatcatagaaaaggatgcttaccttagtaatatttatagcatgaaaaattagaaataacctaaatattccataagaagggaaaggtgcatatatatatatgtatatatatatattccataagaagggaaaggtgcatatatatatacatatacacacacacacacatatatatacacatatatatatacacatatatacacatgtatatgcacctttcctcacttcagcaatatgtcactccatctcccaccaaaatcagagctttatcagatacttcaagtgtatgtggcattaagtgcaatagcatattgcttttgattcaaggcagatttctgttatctctctttggagaaagatgcaatatttcccctctttacaaactactgttttattttgaatgtaatggaactatgaaaatcttaaaatgtgccttttggaatctcttcaaaagatagttggagacagtgaggaattatttccctcagacttcactaaatttttttaagttattttgtagtgctgatgttctagcaaaagtccaaaattgtcgagacaaaactgaaatggattttatactctgctttatctgaggcacgccttctacttcactatgtgctttttgcttgggagcgaaaaagggtgcaattaaaaagatgtaacagtctgtctccagggtggatgtgcttctgtaccacaggaaataaaactagtgtagtaaaaagagctttggaatctggaatccgccattgctgtgtgatttggacaacgtatgcaactctctgacctcattttcctcttacatatgatggggctacagaaatctacctccaaagaattgttgtgaagatgtaatgaaatagtatcttcttgaaatgcatatagcaaggtctgcatataactgacacttaataaatgttaatttctttccttcctcctttcagtaacctgatttaaatgcttcatttgagattcatagctctcctacctgagttaatttttaaaacacattaattttcatgatacctgaaggaaataatacctaaccactgtattctaactttgacttttctaccagtttttcatatttatctaataaggactcaaatttttattaccctcaatttataaacaagaaacaaaggcacagagcagctgaactgtttgcctaaagtcatggaaaggggacagaataaatatttgttgagtgactggatgagctgagattgggcctcagatctgcacatgcttgatactttgctctagataataatggctgcatcacgactttaatgtgcatttccagatcttgggaactgtggataaaaatgaagtcaggttgctgtttccaggaaggaacactgtgtctttcaaaattgtagggaaattgctaggcattgttcacctgagctgcagagagaacaggcatgggtgatatttggcataactagctttcttataagggtgagttcattctcttgaagagcattgggaagtaaaaacccatcaagatagtgtgttctcatgatgatttcaatgaattatcatggaaatgagttttagaagagaggtaatgctttgtgataatagcccgataatgccattagctatgaactgtaattgtaatagcattagtcaaatgaatatatctgatattaatttgagtgtcaaatatttctataaggttcttcttattaattaaacatcagacttgatattattaattcagcatctagcagtgcttgcacatagtaggaaaccaatatgtatttgcaactgaattaataaatcagtctataagtgggtttatttaaaatagtaaaatgttgaatttaaataattacatggatataacaacactgatttttgcccagaatctgcttatttgtacagtctgttcttcatttgcaactctactaatagcgtagatataatgatttcataattttagaagaaagcctttcttttgcatatttggaggaaaataaacttttaccccaaattactttaatttaagagtagagtttgtgcctttcatcctgtgtcttgtgctctttaggctatttaaaaatctatcagacatctttatgactgcattgagcttctgaatatcactgggcaaattcatgctttaggtagtttgggatcactcttcatgatcaccaacatcaactggggccttcaacaccaccagcgatatttttttttctttttttttttgagacggagttttgctcttgttacccaggctccaggctggagtgcagtggtgcaatcttggctcactgcaacctccgcctccagggttcaagcgattcttctgtctcatcctcccaagtagcagggattacaggtgcacgccaccactcccggctaatctttgtatttttagtagagacaggtttcaccatgttggccaggctggtctcgaactcctgacctcaggtgatctgcccacctcagcctcccaaaatgctgggattacaggcgtgagccactgtgcccggccagaaccagcgatcttaacacttgtcttctaaatcatcttttcataccttcataataagtttgtaatccttgctcttccaactccccattctcatcctattccctttgctctcacagatggctcactgcatacctcattaaaaaacatggggggtgccacaggaaggctccaggatctttccagtatcagaactatgcatctgtgtgcacctgtgcctatcttctcctttctctcttctgtttcagttcaggaaagaagtatccaccttccaataagaagtcacactctctgggttgtccctgaccgagtccaacattcctttcttcagggcattagctccataaattctctgttctttctcttgcatttttaacttctccatttacagcaggtattcttatcagaaaaatacactcaaatgtctctcagaaataaagtattaggtgtggtggcttttgctatattcccatctactggggagactgaggtgggaggatcttttgaggcaaggagtttgagaccagcttgggcaatatagtgagacccacatctctaaaacaatgcaaaaaaattagccacgcggtggtgtgtgcctacggtcctactccggagactgaggcaggaggatcctttgagcccaggagtttaaggctgcagtgagctatgatcatgccactgcactccagcctggatgacagggcaagatcccatctctaaaaaaccccccaaaataaataaaataataaaaaagtatcttgaacccacacctaaggttttaaatacaaggttcccacttaaattttaatttcagaatgaggaattattttttagtgtaagaaggtgtatgcatttttttagtataaggaggtatgtcctcaatattgcataggacattcttaaagaccaaaaagttatttgtttacctgaaattcaaatttaactatgtatcttgtatttttatttgctaagtctggcaactccacccacatccccttctagccatcatgctatctcttaaatcttcttcagtttcttgttcttcaaaagagttctttaaacatgatgcctttttttttttttttcatgtactggacttccatcaccttaatccaatctagttttcatttcaccactgaaatgactcttattaaaggtatcagtgatcatagtgttgctaaattttatgaataccttccattcttcatcctacttgattttatagtagcatttgacacaatttaccattatctgcttgaaaccatcttctttcttatcttcagtgaatatacatatgtgcatatacatatatacatacatatacacacatatatgtgtgtatatatacatatatagttccctccttccagctttctggctgctatgtattttctgtggcaaactagttcctttccatccaacctctaatgttggggctcctttttctcctcattcttaatactcacactatgtaatttcattcatttccatggtttcaaacgttatttttgtgccatagagtttcatagttatatatctaacaaagacctttttttctggcctccagatatttctatttggatgtctcacaggtatgtcaaacaatgtgttaaaaagcaaatggatggcaacttttaaagtctattcttcttccagctttttccatttagtaaatggaatctttgcccacccagtagctcatggcagaaactggaatgctttcctgacactacctcctccctcttgcatcctactgtctcctgactttctcaaaaccattgctaagacattgattctacatctaaaatatagcttatatccattcacttcgctccatctgcctacttcctctctagttcattactattccagactttcctggattacttcaattctacctccttgtttctcccaaattattctttcttccctcaaaaatcatactggatccataatgatcttccccaaacaccagtagatcattggtgttttgtatgttaccattcttatagcattcaagtaaaagtaaaatccctgtattcaaagatctcacgtgattttgcccctatctaactctccaatgtgacttcatgccatttcctccttttttgaatattttcagcttactggccttctctgggttcctcttatgcacctatcaattctttatttgtgggccttgatatatgtgctctctaccagaaaaacctcattcctaggcttaccaagctaaattgcactcatctttctagtttcagcttcaataccatttccaggtactcctagtatgcatgtgcatgtgtctctaactctacctcgacttataaatttgccatgcgtaggaggcttcattaattacatgggtccgtgaggccaagaagaatctcagagcactttctaatttcttcttctcccaatctccacctggaattgaacagtacaactgaactctgcaaatatggaatctattcttttctggagaattaagtgccataccaaaacatcatatctataatacatctagtccacctggaagatgttgaggtcccactcaaattaagataacaacaaaatcattattttttgtgcacctacatttagctggtgatttttatctatttcttctagtcctcataaaaagcttgaaaggtaagtcactagtgaagactagagagagaaacagcctccattttagagaaggataaactgggactcagtatggttaagtaatgagctcaagacctaggaactcattgagaactgagttgaattgaattcaggttcatctgactcaaatgtctgccttttctacctctcgtgagccaatagcaatggactgttgctttccatagtctaaagctggctctttcctgatgctattataaactcaaagtcctctgtgcagcatcaggggtttctgtggagtaaaaggttaatgatatagaataaattgtatctgaaatacataaaaccattgtatgaggggggctttgcatctaattctgactgaggaccatgagcagggtttgcctatgggagttattggggccctgctgacttagccacaggaaccaaggcactaaaccagttgacaagtagagtgtgggcctggctaagggtgaattatggcagtaggccacttattttcccctctgaatctgaaaatctctaaacccaaatcccatatgaagttggacccgaggcatagatctgaatttgaggaagcgtatctcttagataataggtatgagcccatgaaatgcagttggaatacttttccagatgcataaatattttcttcaagtttactgcaactgcaaattcctgtttcaagagtgactcagtcattcgtgccgacataactgtcagtggcctcaaaaatcatagatatttaaatgagccttttaggagatctcatttttaatttaagagaatcttgatggaaattaaacagctacattctttgcccctttcccgaattttgaggagaaggaacttgtagggacaagaagatataccacttgacctcttgattctgcccaattatccctttttttttcttaaatattttgcttcggatctttcaatcgcctgcatgtccataactaagatgtcattttttactgaattctgttttgctatttttatgaaaaggtttaagttcgaattcatgagtgtgaggaaattgatcttgttgctaatgggatagagtcgaaataagcagtctgactgacttcttcattcccttatattagcattgctacttttagataaactattcctgaaatgattagtgtaggaggatgagtttagtcttgtatcttctcctttaaagcactcagagttagagatcccagaaggatcagttttctcacttgtactgaaaatgtcactctaacagttatctgtctgcacagtcaagttttgagaaatcttttgaatttaccgcattcacaccattctccattatggtgctaaaaatgactaatgcagcttggagactggaagactgtgatagctgatcttcttttccaatcgggtatactaacactctcacacactcacatgcacacatgctcagctgacatgaatccttaaaggttgaaaatatcctatatactaaatgaaatgctgaaggatgtagggtgcctaaatgtataattatagtgttagtttcattatggtcacttctgtcaaaaaaatttgtctgattgtttgagtggcctgatcttgtttttggccaaatgaaccattataacgtatgacaatgttatatttaaaaataatctctggcatagaaaattttcaaatatcttatttagttttattctctcatcctgtctgagaaaagtgaagtacaatttcctttttttattaagaaaaaccagttttagagggatactgacctacccaaagccatgcttatggtcactctcttttagggcctttatttattataccagtataggattactataaccaaataatctaaatgaacctcatttctttcattgaggaatactattctgatggctaaagggattgtcacaaagagacttatcctatttccagaaaaacgtgaaaagtctcctgtgatgtcatttagtgaatgatggagaagtatgtgggctgaatgatagtaattaggtgaattgggaactgattatatccaaaaggagaggattaatgtgttgtcattaacttgcaatgaggtctaggaattttctgtaagactcttttttggtcctgtccaattcaaaaattttatcaattacctggaagaagtctaggaacttgcttaccaaatttgcagatgacacaaagcaagtaaagaagtaaagattagtaattccctggatgacacagaatcaattttcaaaaatgtctattacttaggatgatgggttgacatttattaaagataaaaataaagtgctgcatctaattagaaaaaagaactgtgaggagtagaactgagctgaaagcaactcctgaaaattaaaaaaagtttcaaattttaattgaccataagcaggatgcaactgtgagaaagtcagcaaaatctctgttggcattcagagagagagagagtccaggttgataaaagtaacatacttgtcctgattgtacccattttgtacccatattatgtttgattttggaagccatattttaagaaagatactgacgagttgctgtttgtttaatggatggaggcgctttgatagagaaaaatcaaggaatcatgcaatatgaaaagactgggatagtttgtctataaaatagaaggggtcatgactgccatctttactgaacacttactatgcatattaattgcttaatcttcagaacaacgtaatatattatttattatcattactgaaatagaaactgagaacacatagctagactacctagattcaaattcaggtggtctgactccagaacctattctcttaacccctataccatattatttctccaagtatttatcaaatgtttgaagagctgctatgtgaatggagaactggacttactctgtagaacatagtgatcaatagatgggcacactcaggttatatctcaaagtagagaatttttctgggcactagattatgctactacatcttctatttttggtactatgttagactagttgaggtctaaggcaacattcaactctatgattgtgatttattgggattataatttgatataacacaatattattataaaccagaaagaatacacttaaaataagatgtagcttaaattgatgagtggtaatttaaatggtgttctcttgagcacagtttagaaagtgccccaccccacaacccatcttgctaagatgtcctcaccatgtgtccttggtaaatttcctttcatgggcaccaaattgtgccagaattatataaacttttgtttctctacctttgtactgtatctagaatattatcaatattatacagacctctatccaaggaggttatattgcaaaagtaacaaatgtctttaaacacccttacatctgtggatttctacaagttgcttgtatattgaaatcaatgttggaactggtttcagaatgctgagaggattagatctctgtcagctaccagttgtgatgactagagaacttgactttattttttctgccctaatcgttacatttaaaaaattagaataataatgtaaggttgttgtaataaatgcaataatgcatgtaaaagctcctactatactatatagattcccaataaaaatttagattttcagtgaaatgcttttgtaggaatagttgtgtgattaaaaaatttgcctggactgattcctgggaggtaatctaaatcttttcaacttcttgagtggttggaatgtctgttatttagggtgggaccctcagtccccacctgatagtttatgctaatgaggcaactcagaatggagagggcccatagataatttatgctaatcagatgacccggaatggagagtgggcagccaggaagaccaaccacatgatcagacttggagctttgagccacatataccagcccaacttctggggagcagaaggagggtggagactgagctcacaatgattcaatcaatggtgcctatgtggtaaagtctcaacagaaacactgggcactgaagctcaggtgagctcacctggttggcattattcttatattgatgtggttagtgcatacctggggatgaaggaagctccacttttggaaccctcccagatcttgttccatgtgcctcttctgatttgtattcttctgccataataaacagtaattataaatattgtacttttctaagttctgtgaatttttctagcaaattatcatacctgagggagtctgtggggatccccacatttataggcagcttgtcagaggtgatgacagccctaggaatctccaaacttgtggctagtatctacagtgagggtagtcttggctgggtgcggtggctcacgcctgtaatcccagcactttgggaggccgaggcgggcggatcacgaggtcaagagattgagaccatcctggccaatatgatgaaatctcatctctactaaaaatacaaaaattagctgggtgtggtggtgtgcacctgtagtaccagctacgcgggaggctgaggcaggagaattgcttgaacttgggaggcggaggttgcagtgggccgagatcgtgccactgcactccagcctgggtgacagagtgagactctttctcaaaaaaaaaaaaaaaaaaaaaaaaaaaccaaagtgaggatagtcttggggagaacttagccaagattgtttggtctaactctgggtaggttgcttaagcctgcatatgaaacatttagatttacataaaagataaactggtagtaatatttgactttgcagttcttcatgtatatgtcaaatgtgatttgattctagaaattttgttttagtaaatttttggaaatatcttcactgagtaatgtaaagaaaggaaacatgttcaacactgaaaatgtttcaggtgtgaatataggtaagacttctcaaggttatcttacaaaaccttaatgccagtgctttgtctctagcttatgtatgaagaatctgagcactagagaagtcagcaacttgctgccgttcacacagttagctaacacagtttgaatttgagttctttgagaactggatcatatctcacacaattccaggtagcacacggcctggtacacagtaaatattcaacacacacttcagcttaattttctcagataagtaaggaaagggcagagtttgaccttgtcagtcgtcagtcaaggattagtaggtttcttcccaagaactctgctgctctatctatcattggctttttcacttttaatttcattgcttccttgtacccctggaaatttcctgagggcttgcaagtgtttattttgcttgccatggtatcaccagtgcccagtatggtgcctggaatagaatgggtccttgataaatatttttcgaatggaggtttagtgttaaaaggagtgtctcattcatagaagttgatttttttccatagtttgaaagcaggtaaattaaatttgtctgttacaagagaatagaaactaacactttctttacatcatttttagtgcacaacaataagtatttttgaaagtagagaatacacttgtgatcatttccataaaataagcaaaagtacattaaaattaaagatatatcgacattttagaacaaaatttcaaaagtccagatttaaaatacagccaaagtcatatcactgtgatgacttatcattattgtcatcctgtctggctgttgtttttaccaacacgtgcaaccaaagaatagttctttaaaatttgctttagtctaatatttgctttagtaggtactttaatatttcaaacaatatttgaatttttcagattagttgtttctcctgaccaaaatctctactgggaaaattttaaaatatcatttattattcaattcacaatttctcttggattgcatagacaagaattgtggcaaatcatgagaaaaaaagatcattcaggtaccctatcccctatatttacacaggtcttactttttctgaggactgtctatgccagctgtgaggcattattgcatatggtctcactgaaagatctaataagaatataatgaccagtttgttttaaaatacactaaggacagcatgacattctgtaattacctcctcctatcaaaagaaaaacaattcccagaaattaatgaatacagcaagagtgtatttcctatcttaattctatcttaattgcaaaagtggatcaattaaaaaaagactgcactgacaaagcccctttcttaagatttggtctccccattccctagtcatcaactcaatgtatataagcatgccacgaacctatttttaccatctgagatgagatataccaacttcaccagcagtgcccctgtgaaacagccaaatccattgaacagtgtcagaaaattcatggaggttcctctgacattgcttggaacaaatctgtatgatattacagagactgagagaaaaagagaggtcagaatttagaactttctcctgaaaatgctttcatagagactgttcaaattgatgttgatcatgtatcaaagaaaatttactgatacaataaaaatttgggttggactttgttaaggttactatagtaagatatactgtgttacaatttacagatgtcttcaaggaataaaatatgacaaaaatataccttgacccagctacaatgagaatttgattacttagtagttgagtgtcctgatgtattcaccctaatttcactccaaattgaatatttctgataaattttggatagaggtgtggcctctattagataatatcatgacaatctatcaattttgtgattctgtgtaattcattaagttccttatagaaaacttgtattatataaaatttgcatcaaggttaagagcatgggctctggagttagacaagatagtattaaaataccatgtcagccatctactatttctgtgattttaggtaggtgacttaaactttccagcctcaatgtcctcctctatgaaatgggaataatatcgttattcacttgcagaggtgctgggacacttacctgcaatactacatgtaaagtgcttagtacaatgctgactcgtaggtcctgggtcctgaataagggttaggtatttttgacagtattaatcttatcaaattgagtagttcctacttgtgcaggcactgtacaaagcccttaatatgcattatctcatttcaggagaggtgctgagagagagagagacaatagcttaagcattggttctccaaagtggttatctttccttcccaagtcattttttgggtgccggtaatgatagtaacaagaggttaaaaaaaccacgaaaaaaatttttttaaattttcaattaaaaataactttcttttggaatcagaaatagatgaaaataagtatatgagattttgtacgtgccatataaacataatattttaaaatgcatgacaatcttagcgatatgtgttaaaatatttgatgtttattataatatgatatttgggattgcttcaaaattatacaaccagaaggaaaaaagatgtgaatgagagtagaaatgaaacaagttttggctatgagttgaaaattattgatgctagaagatggatacaggggagtttattatactaatctctattatatatgtgtgccaaaaaaattgtaaggaaatacactaaataatattaacagtcttagctttgagtggttgaattactggatttctaatattcctcttactcttttgtgctttgcgaatctttccacaatgaaatcataagtaaatattacagctcattttaaaaagaaaagtgatgatagaaaacagatgtgcagtcatgcgtggcttaatgagggagatatgtccagagaaatgtgtcattaggtgattttgccattgtgcaaacatgatcgagtatacgtatacaaacctatatggtctagcctactacacacctaggctatatgggtagcccatcactcctaggcaacgaatctgtacagcgtgtgactgtactgaatactgttggcaattagagcacagtgctaagtatttgtgaagctgaacatatctaaacacagaaatagtatagtaaaatatgatactataatcttatgaaactgccgtcatatacgtgatccatcattgatcaaaatgttgttacgtgttgcatgactgtactgtaaacactaaacatttagtttccttctctatgagaagtaagagatcttattatctcttcctgctcctctcgggaatatttacccctggttttttgtttgcttgtttgtttgtttttaatactttgctgcagcaaaactctgcatttaccagaacttttccatgatcttactaacacatgatgtaaatgtattaatgctccttccttaatttaaaatttctgttttactttcggtgtgtcctgcacatgtcttgatttatttatcccataaagatttaaaggaatcccattttgcacttcaggaaagtgctcagtgctggaactgagaggtgggaaaaggcatcagtttatctttcctggactttaaactctggagcagaaacagcacattatttagtacaaagggcagtgctaaatgtgcacttttcccacaaacgctgattggagatgaagataataatggtgataggtaaaatactgtggagaagggcttcaaatattggtggcacggtagcacagctctttgtgtagtaccaatcaccagcaggaaccttggagtattttcagaaaggtccaaatgggaatatgagaggaagcctgaataggctttgggaataaatgattcacagttataaaaaggatttggcttataaactttcctttccataagtacaaggagacaagcaatgagcagaaagagtaagtaggcctatttctttcactaagaaaaagcagaacatacaagcccattattactctgctagttaattattaatcctatgcttttctcctgctagaacttctggtacggtatataattcatgaacacactttgccagctctctgcctgctggttaatctctctttggtgtcattttagtcgtttttgaaaacctccagttcccttttataggacttagcttttcaagtcctcgaatcttcatttttaggcatctacttgcatgttctgatcttttgaaactttagtgatcatcaatttgattttttttaggctccgagatatttcttttagcccattacaatgtagataatatcaataagtctgtcactattgtaaagttcccgtttttctatgaagacacaataaaaaatattcagtgtgtacgtgaaagctggtcttcttgccaatgagcgctaaaaatgtgcctccaggtagtagctggttagtgcttgtaaagatgccacatcacagcatatgaggaatcttcaaaatatagggccataaccaccttcctaaggcacctggtactggggacttattgctggaaatattttttactctcgttgttcttaaacagttaaaatgtgtgtattgtgtttggtgaaaagttattttgaacatgtggagaagaagtaccacagtcccagaaaatggaactttatcctgttgccatttttagaccattatatctcccttaaccctaaaaaagcttcagctttgaagctcatgttatcagactatatcatctacttccctttcatgctgtcatctgccaatctataggacattttcctctttttctcagagttgtcagttcctctctcattgtcacactctctggtactacttctgccttaatacttggcaattttactatacatgtagatcatccttcccaccttccatcctttcaatcttggttgtccagttccttgacctccaatgtctgatctccaatctacctcagcttccactccactcacacccaaggtcatggcctatgccttgtacctcagaccagtggttggccagctatggtcaggtaatattcagtttgccacctattttaataaagttttattggaacacagccacgctcatttattatatgttgtctatggctgcattcataccacaatgacatagttgagtaattgtaacagagactggcctgcaaaaccatgtgttggatcaataactgtacccactccataatcacaattttgtgcacccttctctgattagagccttctatcttcccaacttactctccactactcaaccacagagatgctataagctataatggcagaaatttttgtcttattttttttaactgatgtgtctaaaacttcgagagcagtattaggcacactgtagacacccacacagtattttttgaataaacaaacatagggtatgagacagctgaggtgtacgctgctacaattaaaacataatttgaaaagtttcctactgcttttttttttctagctcatctccaatgtataacatgtcttagtagggtaggctatgtctactgtcatttatggagtgattcactgtgtttccttgctcaatgccatcaatgtaggacactgtcaaaagtttgaataatacatttttattgtaccatatagaaatagccgtagacttcattcatttgtttcttcaatcaaaatgtatttattgatcacctattttgtatatgtacttttcggaaaggagaaacataccttgatgtcaggaatgtatattcttacagtgagaggcaggcaatacaaatataaataaagtaatttcagattctgacaagtgctatttaaaaaaccagggtaattaagtggaaagtgatggaatgctcaaggaagcccctccaaagagaagacctttgagaaagctcaataatgagaagccagtcatttgaaaacagaggaaagggaattctgaataaaggataaagcaagtacaaaggacttggggtagacagaaatctagcatcttagaaacacacacatttctggggatgtggtcaaggggcagattgtaaccaaatgtaggtggaacaacacgtggagaccaaatcatgtggaacattattcaccattgtgaataatttatctctaaaactctactgtggaatttcaatcaggggaatgatagaacttatgttttgagaagaacaccacaactgttttgaagagaatggactcatggggcaggagaggaagcagggagaaaagttcagaggctctggtcgaattggggctggagatgatggtgttgtacaccaggagaacaaaggggatagtgagatgtggccagatttaagttatatttcagagtaaaaatgaggacttgctgttggattggaggggagaggtgagaggaaagagatggatctaggatgaatcaagtgagagacagttctgcttatgcttccaggtctcccagctgttcaggtggtttatggcagaaagagctgggaacaggacacctgtgcttctgttctgagtctgacactattaattcatgtgaaacatgataataatattaggttggtgaaaaagtaattgtggtttttgccattacttttagtaatgataacaacacattataactgctaattattgaatgctgtctatatacggggcactgcggtttttgctttacataaaatcttccacttagtcctttgaacaactccctgttttatagatgatgagaaaagcccagaaatgaggaataattttcccaacgtcacagagttagtcagtgacagaactgggtttgaattcagatctgtctgactttaagaccatagagcctaacctctgtgctgtactgtctcccagaaaggtaatacttgattttatagtttgaaataccctttcatatgttatgtcatttgattttcaaggagtagtctctcattcccattgatgcttaccctatcaatgctgtgatataaagaagaatacaattatttctattttaaatatcagaaaagtgaggattggaggttaaatgagttcccaaatttatgtaggtagtaatggaaaagctagatatcagaccaaattctttcagtccctggtccattatcccaatagcagatgagtcaagtgacttagacctcagttaggcctgatttcctggagtaaatcagggagtggtggagtaagtgatgtgtagcacatgatctgcctttttcacagtcattggttttctgtacctctctggcttctgaatgttgaaccactattgctaagctggctagcaatttcctccacatattcactcattacttttactcattatttactctataccagcccagaaaattttggctgactacttccaacacatttttgggaataacatcagagaagatcacaaatatttgtgtagtagcattgctttacacttcttttgtcttccttgcagtgttaaacagtgaggtccccagtttaaaatctcataaagtaatttatgtatgcaaaatatatgggatgaaatgatatacaattataaaaaaagaagtctgagacacacatatatatgcatatactccaacttaattttattttcattatttaatgaattgccttggtatcataagtatgtgtgtgtataaatacatatttattaaatatttattttaaggagtttggaaacaacttttaagataatagaatcattgaagattgtagacacagatggaatggttagaattgttatttaggatgattactctaaaatccatgtgccagttgatagaatgggagagataatggaggtcggaagatagttagaagttataaaaatattatccataaaatataatgggagcttgagttacaatcaggactcctactacacgaaaatttaaggaggatagaaacataagatgtaatcaattacagagataaatagatgtacacacacattactgtattgcaagaagccactgaaatattgtgataaattgtaaagtggctagtttaattaatataagcaatctagataattcagaaacccttgatatttaataaacttattttgaacctgtcttatgaaacattagtgatctcatttaatctagtgtaatttaattcaaagacatcaagttatctggaaaattggcttaaattttcatttcatttgcatgtttatatactctcaaagaacattaagtgtcatttttggaggagtataaatgagctttttttttttttgagatggagtctcactctgtcaccaggctggagtgcagcggcacaatctcggctcactgcaacctccgcctcccgggttcaagtgattctcctgcctcagcctccttgagtagctgggactacaggcgcctgccaccacacctggctaattttttgtatttttagtagagacagggtttcaccatgttggccaggatggtcttgatctcttgacctcgtgatccacctgccttggcctcccaaagtgctgggattacaggcgtgagccaccgcacccggcctgtgagtttatctatgagtgagagtcggggaggtgagaggagggaagggagaagagaagaggctttacatcttagtgttctggagttgtcttctgggttttagcagaggttttcctcctgtggtgtgtctgacaaaatggttattgcctttaaccagattaaaaatcttttgttccatctgcatccaggcagaattgataattgttctgtgcatggcagaggaatgaggagaaatgaaatgtttgtaaaaaagtaataaataaatttgctggaagtattgtgggaactctctaggaggtgaatagatgacataccactttaattgttctggttgaggtgatgtgttctgtgtaaaggttcagtatgttctaacattagttgaaaaggtgtttactcacgggctgggtttaccagtgtttccgccactccaagtaaaacatactgaagaatcaggtagaaacagggcatggaggaaacagtgagaacttttcctgaaaggggctgctccactgcagggaaatgttttcggtgtatttcaaagaagccagctatcatcacagacaatgcagcaaaaagatttccagcaactgaaggaaaataatgcaaaagaaaaaaaagttaaacgaagagctagagattcatgtaataagccataacatttcttacccattgacattagatgtttcttttttgtttgtttgtttttatttttttttaatttttttattatactttaagttctagggtacatgtgtacaatgtgcaggtttgttacatatgtatacatgtgccatgttggtgttctgcacccattaactcgtcatttacaataggtatatctcctaatgctattcctcccccctccccccaccccacaacaggccctggtgtgtgatgttccccttcctgtgtccaagtattctcattgttcaattcccacctatgagtgagaacatgcggtgtttggttttttgtccttatgatagtttgctgagaatgatggtttccagcttcatccacgttcctacaaaggacatgaacccatgattttttatggctgcatagtattccatggtgtatatgtgccacattttcttaatccagtctatcattgttggacatttggtttggttccaagtctttgctattgtgagtagtgccgcaataaacatacatgtgcatgtgtatttatagcagcatgatttatattcctttgggtatatacccagtaatgggatggttgggtcaaatggtatttctagttctagatccctgaggaatggccacactgtcttccacaatggttgaactagtttacagtcccaccaacagtggaaaagtgttcctataggcaataccattcaggacataggcatgggcaaggacttcatgtctaaaacaccaaaagcaatggcaacaaaagccaaaattggcaaatgggatctaattaaactcaagagcttctgcacagcaaaagaaactatcatcagagtgaacaggcaacctacagaatgggagaaaatttttgcaatctactcatctgacaaagggctaatatccagaatctacaaagaattcaaacaaatttacaagaaaaaaacaaccccatcaaaaagtgagtgaaggatatgaacagacacttctcaaaagaagacatttatgcagccaacagacacatgaaaaaatgctcatcatcacgggccatcagagaaatgcaaatcaaaaccacaatgagatatcatctcacaccagttagaatggtgatcattaaaaagtcaggaaacaacaggtgctggacattagatgtttcctcaacatttgtttgccctcgggatatccagacgccagtgatctgtgctgtttggccatccagtgcttaggctgtggcctcacaaagggctgagttgacttcctcttccctgacttcctacatatagaacctcaggccagtaatgtaacctcattatcactttcctcagctccaaggtggagttaataacgcttactttatagggtgcttgtgacatttaaataagacaactgatatctgctggggattggttccaagaccccaaagacaccaaaattcctgctgctcaagtgtattatgtaaaacggctttgtatttatttgcacataacctatgctcctcttcctctattctttaaatcatttctaggttacttataatccctaatacaatgcaaatagtatgtaaacagttgttatactatattgtttagggaataatgacaagaaaaaaagtctgtacatgttcaatacagatgcaaccaactactttttattcaaggttggttgaatctgcagatgtggatcccttgaattagtagcaattattattgaagataaagcaatgttttaaaactttttttcccagaaaagagatatcatcctagataactttcataaaaaagatatatgagtcaaaaattatttggaggaagttcaaatataaaattatctttatatatagctttaattattattttaaacatgtttttgaaataaacttaaagtattattggtcctcagttgtctggcatttctctgattttcacagagaaggtaaaacagctattagagaaggactaaaactttcgtttagaaaaaaatttcttaaagagataaattagctaagtgaagagtgtaaatgccaacaattatagtggtcaaactcttctcttccttttacttttgaggaattatctagaagttttttgttgaaattgagtaggattttgttaccgagtctgtatctactctaactattccatttctccatttagcattcatattactggacttaatcctttcgttagagtggaggcaaactttagcttgatggaatttatttgaaattttcagatagtcacattttgctaacttgcatacaattttagataaggcaaagctttcaattcagaaaaatcaatctaatgtttaaatagcttagtgtttgttttggttgatagagaaactggtaggtaatttttttgattatatctcagaatttaaatatattcataaagactgctctttccagggtccccaagaaatcaaaggtgtaaaaaaggaggaaacctcaataaacctcagtttaaaaatttgaggaatttttaatttattactattttaaattaaggactataaaggcttattcatagtaaagtagagattttgcttccgtaaacggctcacataaaaaatacacatttcacatattatctgattttaagaccaaattcattatataatcacctttatcaagattattggacacattacagactcatcagaaagagtgctaatatgtcaattcaatttaatatttgctctgttcctgctatatgcaagatagtatgctcagcaccgtgggggataaaagatgaaaagagtctgttccattgcagactcatattctattggggagtatcaggagaagaacttattgctagttggagaggtgagagacatcattttatgcttttaagaaagaagggtttcagtacgaaaaggtgaaagcagcacacgtggcatgagcaaagggacagcgttgtgaaagcatcagacagattttcaggatgatgagacgttcaagttatttgggaatcaaggtagacgatagattggggtcagatcataagaagcatttaatacacttttaagaaatttgaaaattactctgaagataagagaatgaagataatagaatcattgaagattttagacacaagtgaaatgattacaatcgttatttaggatgattactctaaaggtcatgtgctggttggtagaataggaaagatattggaggtaggaagatagaagtgataaaaataatctggtaacgtataatgggggcttaagttacaatcagggcttccacttctggaaaatataaggaaggtagaaacataaaatgcattagagggcactgataaaaccatagcaactgatgcaaagagcaaggaggaagcagaagttagttatgaatatgaatccaggtgactggaaagatggcagtggtaatataagtaagaaccatagtagatatgggaataacatgaatttaattttgagttgagttggaggtacaaagccgtcatctaaagagaaacgatcagaagacaattgaaaatgtgttatagctcaggaaattgggtgaatcaagagagaaaaaataatgagtcatctgcttagagtcagagtttagggccagatgaaactgaaagaggattggggagggacagcagagaatatctaagcagtgccttcaagcatgtttgcatttggggcaagacaatgaagtaaaagtgctgaaagcaaggtcagaaagataggtcatgtgtaagaaaaggtttcaaggaggaggatatacaaagtagaacttttgatctttctctctaattcttctccttcactcttctgatctcttccacatctgtggtcccctctcttccccctacctccaaatacatcattaagtcctgtagattttgtttccaaaatacacttgacccttgaacaacatgggtttgaactgctcaggtacacttacatgcgggttttcctctacttctaccacctctgagacagcaaggccaacctctcctcctgctcctcctcagcctactcagtgtgaagacagtgaagttaaagacctctgtgatgatccacttccacttaatacagagtaaatatattttctcttctatatgattttcttaataacatttccttctctgtagctgactttattgtaagaatacactatgtaatacatataacataaaatgtatattgattgtttatgttattaatattgctttccatcaacagtaggctattagtagttaagtttgcagggggtgaaaagttacacgtagatttttgactgtgtggggcttgatgctcccaacccctgcgttgttcaagggtcaactgcgtattataaatcaatttgcttctatccatagccactgccatcattccaagccaagccattctcatttttaactcagatgatgtgcagtagcatattaactggtcttcttgtttccactcttgtccacctctaacctattaagcacccagcagccagattgagcttatgtaaatgtaaattgaatattactcttcagcttaattccttctatgggtgtccacacagttaagaagaaatccgtaacttttaacatggcctgtgtgatcttgcctatgcttgttacttcagtctaattgccttgctactttctactgtctgaccaggtttcagccacagtaatcttcatctttcttgaatatcttaaactctttcttttccatcttagggacttttatttgctcttcactctgtctgaaaccatcctgtctaatgcctctttgtcttttagatatgcactttataatctaaattagatcccataacatccatttttttcactatacttactacaatttgaaattaaatatttttagtgtgttcatttttaccatgtgtttcaattacttcattggaagattcacaagaattggatctaagtttgttttgtttattactctttactaccaagaaaagggcccaggttcaaagtaagcaacacacacacatacacacacacacacacacacacacacacacacacacaatcttaaataaataaatgaccacgtttaatatttttaatattttaagagatagaggataatgaaacatgtgacaagtctactgtattgaagaatggaatataagttactttttacactcagcaggactcccatgatgaaatcagaaagcaaggggttgaacaatgagtgggtggtatgtgtaagtagtgtcatctaatcttctaagaagtttggtgtgcagaaaaggagaaagctttacaaattgcttaagaagttagcaggatcacaggaagctcttttataagatgtgaaaggcttagtcatgtttgtatagatggaagaggagtcaatggagatgggaaaaattaaagatacatgaggaaaaaataaataatatagaagcatcctgaagtagatgagagagagaaaaggcttaggggcccaagtttaatcccagcaaggaaagaaaaaagttatcctctaaaggaaaagaaatgtatagaatgtttagaatacggagaatattgacaaatagaaaagtgaatttgaggacatatttatcatataatcttattcttgcaacttagagaggctagtcacttggtgagaatgagtagatgggaatgaaattgagaggatagagaggtaagtttcaacaacccactgttgatgagtttaaacaaaagatagagtctacagtaaaattagagctggttgctgaggtttgcagcttattttactgagctcttttttttgtcctaatagtgcaagagctgaaccatcccagacaatagaagcacaatttaatacttgtcccataggctttgcttttgacattacagtaaacaattagaatgatgttaaattattcaatttgtttacaaaatttagatgaatttttaattatttacacccagagaataaggcacttgagtattttttattttttaattcttaaaaaagacaaggccgggcgcggtggctcacgcctgtaatcccagcattttgggaggccgaggcgggtggatcacgaggtcaggagatcgagaccatcctggctaacacggtgaaaccccatctctactaaaaatacaaaaaaaaaaaaaaaaatagccgggcgtggtggtgggcacctgtagtcccagctactcgggaggctgaggcaagagaatggcgtgaacccagaaggcagagcttgtagtgagctgagatcatgccactgcactccagcctaggctgcagagcaagactccgtctcaaaaaaaaaaaagacaaaaaaactttacataattatgttcttcaaggtttaggacctagataatggccaagtatttttctaattaaatagtctccaccagtatgattcttattagttacgtaactgtgggccagtcactttaccttaaaaattctcaagtatcttttgtacaaaatttggtattagatagtgcataatggtgcaaattctttgcaagttggaaaagaaagttggaaaaaactatgcagatttagaatacttttaagatcctattccactaaaagaagatttttatctacattccaatatctagagcagtttagggacttccagttaaggtggctgattgaccacacaattttaattttctttctcattctagttaaatgatggcaaagaaatttggaaaaggtaaaaagtcagagaaagagaaaacaatggtggacaaaaattgaaaaaaatgtagaaattggaaagagaagtgataactgatttagaaaaataaatgagggagctacaatctaaactgacagctgagtgagagactgaagaagcatgaccctaatcctcctaatcccctgaggaatcatttagaagctcatgacttgaaggcaccaggtatttcagaaggtggggtaacactcagaaggaaaactgcaaggactggttgaaagtctgtgcactgaacagtgaaattgtcaagtctccaattctatccccatgaaacaaggtgagtatgtgttccatctcctcctctggtaagagactggagattacttttcagaatttaaataggtgtgactttggattcagagaaggctgaggctgaaaatggaaaatgggtaaaaactaagattttgaatgatgagacatcctccattcctatctgcacacagccacacctcaccttcagcactaggaagtatgcctcaaagcaggaggctgaagaaatcttctctcaataagctgaataactccattaaaagattgctgcatataatagctggggggagattctcataataatatgactggttcccttgccaaatggcattctacagagaaaccccataagtctcacttatgtacaaagtcatatcatcctgagtaatactattattttacaatctataagaatagatatcccaagatcaccagacattggagaaaagcttcccatgtgaaaaacaaggagacaagcaaacaggaagtgggggtaatctgtagttaatgcaatcaataataagtagctatgaaaaaagaataataagaaatcttagaaaccaaatatgacttctgaaatacaaaactcagcagaaaatttgcaggatgaagtcaaagaaatttccaaaacaaatagagaaacaacaaaccaaaaaaggcaataacaataaaaatcaaacaaacacatttatagatttgaagagaaaatattgagacttactgagttattttaggaaggtccaacatctgatcaataggagttcaaaaggaaatacaaagaaaatggaagaaaggaaactttttttaaaaataaaatttttctaattgaaagagcccacctgggtcaaaagtacaatggttgaaaaagacctttaccaaagtacaataagatgaaattttagaacaccatggaaagagagaagagctttccgtttaggaaaaaaagattgtaacacaaggataagcatcagaaaagcaatggacttctggccaggtgcagcagcttgtagctgtaatcccagcactttgggaggccgaggtgggaggatcacttgaggccaggagttcaagaccagcctgggcaacatgacataaccccatctctactaaaaataccaaaattaactgggtgtggtggcacataactgtaatcccagctactcgggaggctgaggcacaagaattgcttgaaccaaggaggtggaggttgcagtgagccaagatcatgccactgcactttagcctgagctacagagctagactctgtctaaaaaagaaaaaaagaaagagagagagagaggaagaaagaaagaaggaaagaaagaaagaagaaagagagggagggagggagggaaggaaggagaaagaaagaaaggaagaaaagcactagacctctcaacagtaatttaagttgctttctttggttttctttcagaatttgaattctgtgagtaccttctaagataccccttatcctgactaatttgaggtaatttagattttacaactatcatgcacttttatttttttgattgttacttgtgctatgtaaaaatgcttatattttatgaaggaaagtttatggcattaccagcaaaagtttagacaagcatcactattttttttctctgtaaaaggccagtaataagtacttcagactttgtgagaaaaacaacaaaattgaggataagtaggtacttacgtaacaagagagaaataaatttctatgatttttaaaattgataaaatttaaaattatttcttttggaagggtgatgcaatttcaattaattagagtttaaaggtgttttctattatcaaatcagttgcaaatgttcatctgtgtaaaccattcttaccatgcaggtcatacaaaaacagacggtgggccagatttggcccatgagctgtagtgattggctaacccctggtttagtcatccgcttttattacctgttactgaactttcgttctggcctagagagaaattgtggcattttacctgggccactgctgcctatacacatgcatgaaacttgagagagccgtcttttgggccactttctttgtctttgatactgaaagtgtcctccctgaccagtagtgtaggtatcacctgggggcttgttagacatgcagaatctcaggctctgctccggaactactgactcagaatctgcatttaaactaggtctctagatgattcttatacaaattaaactatgagaagcactgctcaagcatataacactgtcaggcctgatctagcaaaatccaatgaaagactgttctccagaaaatttcaagcaaagcacacatatttagtttattgtcttagtttgcttgtgctgttattcaaaaaaagtgtgagactgagtaatttataaagaatagaaatttcttttctcacagttctaaaagctggaaaattcaaggacaaggtgctggtagggttggttgtctggggagggctgctttctgcttccaagatggcacgttccacatggcagaaggtagaagagcaaatgaaatgaattctatcaagaccttttataagagcacctaatcccatttatgacagtggaacactgatgactcactctcctcccaaaaccaacacctcccaatactgttgtactggggataaatttcaacatgaattttggagggaacaaaaacatacaaaccatagcactcttacctaggtattttagggcaaagcatattttagagtatttaaggatctatgtttgcttcttatttgctactgcactctggtgccaatgaaaactaactttcttaaaatttaaagcaaactttgattccgacctaaatttaatccactccatttttaattcttaacttgtatgagataataacacacccaaagcagagtgcagtttatcagaatgtacacattttaaacctctagcagatctgtacttacaagataaagcacaatggttgcataggagatattatattcagataaataatgtgtgttttaatactgcctgtgtggttgcagacaagtccacaagagtcttgaagttcttataatttatgctattattgaaccatgtaataattttccaaattagtctacaatgaaataaaagacattccgaatttattgaaacattagggttgcacttgtgatttcataatgaagctgaacttatactaaaaaagtgggcatgttaagattctttaggtattggtataagattctttaggtataaatttatttgctgagaaaactatgggtttctatgtgtagtgtgatgtttgagtttctgatatgtaagctcacagccttaagtatgaaattctatggagtccttgagaaattccctttggatccatgattttggcaaattcccaggataggaaatttgctcagtgttaatatatcattcagtgttcatgaactactctcataaagacagctataattttattgtcttatgtatctgctgcctttggggaagatatttgtcactcactttttagggtggcatatgttttttatttttattgttttcccctatttgtggcatgtttttatacataatatatacaaaacacgacatgttataagtatatatgtgtatatatatgtatatgtatatatatgtatatatgtatatgtatatgtatatatatgtatatatgtatatgtatatgtacatatatatgaccttctatcttttgtttctctgtagaccattggaattcatttcagaagacccagcttcagtttatgttttatttctgaatgtagaacaggtagtcatttacatagagataaaatatgcaaatgtatctctataaggcatcagttatttgcttcagattgcatattagatgatctacctcacctctgatttaattccaacttgatgttacatttaagaattgagaatactaatgtgcttatatcaaacaaatgtgcaaccgaatgaatgacttattcaggctagatgtttacaattcatggtttacttcttttggtgtttacgcagttcctcctatcaagtattttacaatgggtacataccatgatgtttcttgggaaaatatatcagtttgaaagctgtatcaaaaaagaattttccctgagataattgtacttgcaatgaaaataactggatccttgacttggcttttagcttagcaaccactttggtttcaaccacaaaaagaactttatacaactgcaagttattagaactagttgaggttactggttatgtatacagggacctacactgactgtgactatatcataaaagacttttagctggaacttgaattttcatgtttttattttaaagaaaaaaggtattgcagttatgtgaatatatttcatctacatttaaatttaaatgttatttaaaagccaagataattgctacctactgtgttgtacacttctgctttgtgtaagccttaataacaatcttaattaggctgattttggtcagattaatacttgtgtgtgtcagcactaactactgaatgctccatactgcaggattttaattaatgctaaggaaaggaaatactcatagtgtaaacatttgtgaactaaaaaaaatataaaatgaagtaaacccaattatgatagaagataaattacaataatatcattagttctggatttgtagtgaattaaggttgacttaaccagataaatccacacaagtgtaatattaagaaaatgcagcccttgataaaacactctgagcctatgaagtctttgcctttcacagtcttggaagacttagaggtttttctttttaatagttggagaccctgacatatttcttgacctccataggtgatgaactcaggaatgttgcatcttgaatcagaaacacctttgttattgcattgtttatgagctagataaaaaagtaagttgattttttctttataaatttctagtttgaccagctgggtaagatttccccatctctcactcttggtctgggctgtgattttgcatgtaaaacattaggcattgtcattgactttaccatctgcctccttaaacatgacagtccctggaaggagaatacgaatacctggatgtggaagggcatgtgacagtataaggagtaactgcccattgtgatgacaaaaggagtttttcaggtatttcatggcactaactggaaatatcaataaggatgccaagctaacatcaatacattaacttctataatctaacagctacgtttagccgctaagcagaatagtaatagtaataatgataaagttatgcccttaaaattagaaaacctgttcaaatgacactatctttgtgaccctgatctattaaatgatggtttatcatgagattaaatgtaatatgtgtatgaaggttcctaaattcaaattaggaactcacaaatatatgttcattcataattcatatacctatatacttcacccacattttcaggcacttgagttcaaagtgaaaggtaactttaatattagactaattcagttatgtaaattagtatcaaaaagtaccccaggttggtacttttatgtcctgataaaacttgttaatctttcataatcataaccagaatatggaaaacttaagcaaatatctagtttaaaagacgcatatcatcgcacttttatattcccatagcaaaacgttatgcaaataaacgtacaagtatgcaaatcaatgaatgaatggagtggggttcagaaacaactgaaatcagtattctgtacccagtggaacgtagcttagtttcttttgaagtgagtctagtttttcctttttcctgtgcaataggtcttgttaccaatcttgaaggggaatatttaattcattaacaacatcaaacaatatactaaataactctgtctaacttttctaaatccagaaaaaaagtactcttctttaggaagagatgtgatttcaaatatgcaggagtagagaattgtccaaaagaaagttgcttaactttaaagttaatttaagatttcttattctcaggaagaatttattttagccatgttgtatagaatatttttctagggtacccaaaattttaaaatttgtggtaattaagcatgatttggaagctcagattggggtgtttcatgacactgtacaaaactgctgagatttttggcatttcacaatatgattttactcctattttgtcctgcatgcattatgtttcaatcatggacttgctgaaggtatatacaaaccatgtcttacttttccttttttatctttattttactgctaatcctggacattcaccaaatatgtgctggcttttggatttctacattggcagacagaaaagcactttttaagtcttaaggattatcaaaacctaaagatttatagtttgctaaagcctattacaataaataaagatggggttactggcttaagaaatacatctcaaaaggttatatactaaagtcctcctctataattgaagatgataaaataaactaaggtgagtttagtcacttttagttctaaccaaaaataaacccactccatgatgtgatcttgagtgatctggtagataaagaacaggaaacacacacaatgaaatgtaacttctgtaaacagagaagcaacaaaaaatacctgtgactagaagattccgccatagtctcctaagtctcttaataagaacaggttggccgggcgtggtggctcacacctgtcatcccagcactttgggaggccgaggcgggcggatcacgaggtcaggagattgagaccatcctggcttacacagtgaaaccccgtctctactaaaaatgcaaaaaaaaattagccaggcgtggtggtgggcacttgtagtcccagctactcgggaggctgaggcaggagaatggcgtgaacccgggaggaagaggttgtagtgagccgagatagcgccactgcactccagcctgggcgacagagcgagactccgtctcaaaaaaaaaaaaaaaaaataagaacaggttaaccgagagaagagaatcttctatatgcctgaccttgactatttcaatagaattgtttctcaagtagaggataagacattaggttaccattgcatgatattacttaagaatttcaaacttcctttgctttctgtttatgctcaccaaacaattaaatgtgtcccctgcacataatgactcataataatagctaacatttatagagcttttgctatgtgtctggactacgttctgggcactgatgtcatcctgagtgatttcaaaagttttagagaacaaaatgatccaaaatttatctagggtatgtccctcaatgaaaaaaataagcaaactaaaacaaggaagtttcagtggctttttcaaagtcaccaggagcagttcaatgtcagagttctctgattcttagattgaaacttgttttactgtacccccactgttctcttgttccctgatggtgtcgaaggaagacaggcagaggagaatatgatcagaatggacttccatccttctctcccatttcaatcagataaatttcattttatgtcctattgattatgttctgagaatgatatcctaaattgcactatttgataaagtactgtattgaagctgtaacttacaatactaatccttaatcaattttgttaccgattcagaaattaaaatgatcttttggaattaattaactgtttatttttaagaacctatttgacatagacttaaggggtaaggactgcctgactttaaggataggtcatttggtagtgctggaaatttcaccatctctttatatcaggtgtgtcttctgaggagacataaacataaaaggataggaagaagatgggacacatgtctggctagagatttcggaagatgggtgttatcagtcacaaattcacctgttttccatattatcaaaatctgacactactcaggagcatatagctagttcggatcttagcagaatgttgttttaaaaaagtttcaaacgattcgcatgaaatggttaaattgtacttactgatgcatgttgacagaaatgatccaactctcttagagggaaacaggcaggtgctgaaatactccagaaaaggagccagaattagtaatggtaggctgctgatggcattcattactgcaatcggcagaagaaatccatccaaattcaggttggaattcatagtttgcagataatatcctgaaggaatctgtattcgagagggaaacatccatgcattaagacaggggtttaactttgaagaaagcatcgtccaccagaggcctaccctcttgcacgtactctgtgatggatgagctggatgttgcctagtttttcaagttcccagttatgagctgataaagggtcttcatctgtggtggtaggagctctgtctagtctattgacaatagtactcattactcatgaaatactctatcatcatttagtctctcttaatttttctatgaaaagtaatgatggccccaattttgtgcttaagatgacacataaaaagccaaataacttaaattctgtagataagcaaaatgacttttcttcatgaacactaatataaaaccagtaaaaaatactaaagacgtctgtttttaccctgatgaaaaaaatgaggctagaatagattctttaaaaagcatctagtttggtggcaatatagaaacgactttttcctaagaagaggggcccaatgtggacacgtgttaattgctgtaggctgtctttgagggggctatttagagaggctttgtttccaatgtgaactaagtaacagggggaggaaaaaaaaaccttgtgtctttgccctcccttcaaactaattacgtgatgctagaattccataaaggaaacaacatgaaaaaggtttgcatgataaagtgaaagatacaatttttttaaaaaaaaaccctgtgctccaccccaaatcctcaatgtattgttagaatttcttcattttaaaaataaccccaatgctaactaaaactctaacactgatttggagcctcttagtgtattccaatcctcttggcaaccgagtgtgatatcagaaccaagggatgatgtcacatgaaagaggtgtctcttcacttttctagtacatgagctttgttacagcttcatcagcttcatcatgatcttttttatttttattttttttgagacagagtctcgctctgtcacccaggctggagtgcagtggtgtgatctcggctcacggcaagctccacctcccaggttcacgccattctcctgcctcagccttccgagtagctgagactacaggcgcccgccaccacgcctggctaatttttctgtatttttagtagagatgaggtttcaccgtgttagtcaggatggtctcgatctcctgacctcgtgatctgcctgcctcagcctctcaaagtgctgggattacaggtgtgagccaccgtgcccggcccatcatgatctttagtagcgcatagtatttctttaattcccagtggtacacaaagctattgagtgtcatagacagaaagtcaaccaagtcttcttgaggaatggatcctccaaactcgtatggtacaagagctgcattaggatccctgcttcaccaccatcctgggagagcagcctcgctcaaatatccagatgataacttctcatttgaaacatttgctaaccccttctctagactcaattgtacaattcaagagggtatatatggagaatcagtattatggtgtcagtacagctgttaccaagtccactaattgtaaaatgagcctattgccatgttaactgcgcaaacacaggacaagaccacattttcactgagattctttctgtagacaacgtgtcctggtgatcatttatctcccaatctttaatttgacccttagcatagtaaacaaggattgttttggctgagtacagatggcaagagttaaaggaacattagttagttctgccctacttcaataaaattattaagcatggatcccccatcggaggaaaatgaatgatgtgttttaacaaaaagtgctggcagcggaacaactctaagactgaaaggctcccagcacaacttggaagtttctgttactgatttcaaatgagaattattgttaataggaataaagttattatcggcatgaatcacagacacagaaatatgttaacttaataatgtggcaaatgtactattaatctttagtgaagcaatattaatatattgcctaatcttagaaaaggctgcagtgtcttgaaagcttgaaatcatttctgcctctgcctgaagttctgaaatcatcgccctgtaaaattttaaatacttttatttcatccaagcctttgagtattcagaaataattgctgtcaatagagattcattctcacctttgactggccagtaatgtcaaatggcaacctcatcagccgtaatatcaacatattttagatgtatgtcttgcaactgaaggtcaataatggctactaaatttaaaatatgtatgaaattctatgatgttttattcttggtactttgattgcctttgtactggtgattatttcatctgggggcaaaaaactaaacccagcctatcctattggaaattcctctgcctccctggtgaagtatgatctaagcattttctttgaagtttctagcataacattactgtatataattttggaatctatgtagtttgtatcagggacttttaacccaatgcaagagtgatattgaggataataaagcatggcgcttgacactaatcctgaggtgggatgttgctctgccacacattagcaaggtgactgggaacaagttgcaacttagtttctgagcctcagatttaggagagtaatagccatgtagccttgctgtggggattaaattacgtactgtgaagccatcttttagaagctatggcacttaataggtgatcagtaactattagtttctgtgctttgcaataagttgcacatctagatttggtgatatgcttaaaaattagtttatcaaaatttattgtaatttatgttcaattaaaaaatatatgacagtgtgcaaagaagggtccaacttagtggaaagaaatgtcaggtgtcattgcattatgaaggtaaggaactggtattctgtgctacttgcacataagcttttgaggttagctatgggccatgtagtaattttgtactgtttatcggttcctccaatctaagatgttttattatattaatgcttacatatatgggtaatatttctgctgtattctgtttttgtgcctactgctattatagagtcaagagggagtttgaatcttctaaatcagactagctttcatgcattatttagtctagaggtcaagaaattttctgtaaagggccagatagtaaatatgtccacatatgggttccgtggcaattactcaactctgctatttttgtgcataagcagacatagatacgacaaaacaaagagcatggctatgttctgataaaacttcatttatggacgctaaaatttaaattttatatatttttctttgctttttctcttttttttttttttgagatggagtttcattcttgtttcccaggctggagtacaatggcatgatctctgctcaccgcaacctccgcctcctgggttcaagcgattctccagcctcagcctcccaagcagctcggattacaggcatggccaccacacctgactaattttgtatttttagtagagacggggtttctccattttggtaaagctggtttcgaattcccgatctcaggtaatctgcctgcctcggcctcccaaagtgctgggattacaggtgtaagccaccacgctgggctaaattttatataattttcatgtgctagaaaatactattctttttttaatttttttcaaacatataaaaatgtaaaaatcttcttagcttacaggatgtacaaaaatagtggactggatttggccttcagatagtggatggctaacccctggtttagaggggcaagcactgtactgagaggcagaggacagattccgctttcccttacactactattaactgtgacctacggtgcctcacctctaccaaaagaaagtcacttaatttttctgagcctaaggttcctgtttaacaaataaagtagtttatgaagttaatctctaaattttgttgcagctctattattctatgatttctaaatgtaactcattcatgagtcttctaaattccaagttgggagttagcaatgaacaaagtcccagatttgttcaaatacttttgtaatcatttatttttctcagtaaataagttagtctttaactctaaccacattaaaaaaatttaaaatcacatatatctataaaaggtactttgggctttgtattttctcttgattttctcacagcacaggaacgaattccccaaggaactaatagagtgggtggggagagaatcacttgctcattagtacttatatttaagagtacagtggaggtggtactcaaatcagtcagtttagctactcgttagtaccactttctaaaggtttaatgagggaggaaggcaaaacctttggctaaagggaagtttggtaattgcctacagatctgatatgttcgtgcactgctcttacgccttacgactatgcattctgaagtactgtctgcacctactgacagacatttatagctccacaaaagaaacacatcccagggtctcctcaggtatacctctgcctgaccccgcttagctctggaaatcagagcctgtaatgatgagaagtttctgtggggataactgcctgccgacatatatggaaagcgctcgttggggagaaaattcaccttgacttgcactgttgacatgcaatcactttcctgttgttggggtagtactcatcgcctgtccttacctgcataatgcacattctgtataggagctgaaaaatgaagagagggagaagggtgaggaaaaatgttgtgtcttctacatggagctcactgtagcagccaccatttttttctttggcatggtctaactggcttgtcacgtctctgccaagatggcagtattgcgggtggcatgttttcagtgcactaaccaacaccccaacgcctgtcaggagagaacaacctgcaagtaatcggagatattatgtattagtataggaattgttctccagtttttcaagatgctgatcagaaagataacgattcaaggattcacggcagtgaagtgagaaagtttttagcacccaaggggtcggactcaaaggaccacgcttctgacagtgattctggcatcctgatgaccagcccatggtggcacctagcagttgatgtcaaaagtgtaaaaggtaagatcaatgaaaacatattaaaagggaaagaaaggtgacaaaataatacgccaaagttaaggacttcagaatctctcagaagtctctaactttaatgcattaatgaatacaataaactgaactttctttaacatccttaacacaaagaactagtactattttttcatataaattattatataaataatcctcattttacttggcaggtagagggtggcttcttattgtgacatggagatgaagggaaatgtaatctctgctttgactttatccttggatttagaaataaggttagactatgaactctctaaatgattttatgcatgttgatagtgtcattaagagttcagattagattagttggcttttgacttttccagtagtttcttctaggtttacatggctgttgctgcacgatcagaagcgctttattgcttcagatggcagcagtcacttactgctagtgatttgcaacctcattgttgcttcttttatgatcttttagttcctaccttttctttgactccattaggatttcctgatacaatgacagataagagacccccgtttaggcagcagttcagctgtgctgtcatgatagttacaggttttcatagcactccctttgaccagataaatccccccagaaattacgtagacaccaaactactgttgccaggtaaatggcataataaatgtgaaaatgtttgtgtttctccaaagaaggctgctatagaaactcaaagtatagtttgaaagtcattttgattatgttcaagtttcctataataaaattctagataaaatgcattctaatgaaattcatttatatgccatagagtcttggtttttatgtttaaataaagaatatgtattaatatatttttatagctataaagtggttagattgatttgatctggtcttttcttcaagagttgtaatagacccattatgtcagcctttgattaattgaggaagctgggggcctggtaattgaatatggagcctttcacctctaagtcactgaatcaaatccagcccaaattggtagtgaccaagaatgattacagctgtggctctttggtggcctttgtgaagtgtgtttaggtcatctgggagtatgttgggatacttgctaacaggagataggcttatatctatggtcacttttgtctcttcttagtcactattgcctgaagtagatgaaggcccaggtactggtaaggccaagaagacagaagccactgtgagaggccaagatttgtttctcttaggaaagaagtaatagggactgctctttattattagagaatgaactgctctattatgagactttcctagctatttcaattagtttacttaaggtttaggtaagatgagaacagagaatgtgttgatgaacagtctggagactgaattcgaacaagcctgggctgggtggcttaacttcctgacatttccttacaatcttgtctctattactcatcaacctgttctctgctaaactcttgcagagtggtgctgggtagatagtagggttattatgaacactgatccaaattaactttatgctttcagataggtttgattattaaatgataagtacttgcaggatgaaagattatttccaaagatattttccccagtttccccccaatttttaaaattcaggaatttgtattaaatataatatattttaaactcactaaccgtttttttgtataaacaatcactatttgttgcaagataaacttggatctgcttctaatacatgacaaattgatacctgcaatcttattaaattattaaatattgccatcattttatttctaatgagaggtagtggtagttcagattagtgcttttcaacctgtgttaaaaatgagtttttaaaaaaatatctcaactatcgtggtcaattcatttgtgaaatccaataaaaatgaaatatctaaacataaaataaagacatacaaaatataagccctgatatttttattattagattcaacagacataagatgtcactgtccataaatatttctatatgttttctcttagtgtctgtatttattttgttgtatactggcaacaaacagttcagagaccagcactgctccatgaaccatgctttatgtgaagcactggcttcagttgaatatgtactttgaaaaatgaacttgtttaaacaaataaaattgtatcagatatagtgatatgaagcaacaaaaacaaaatggtcaagaaagaagaaatgagaacatatgaatgaggtctaaaactctagctaacacagcaagggcatataattgatgccaaagaaatgtcattacaatcattgatttattccacgtacttactgagaatctactaggagtcagaaaactgttttgggccctgaaaatatagcagtgaacggtacctacaaactcctgattcttctttgtggtgggggagaccctaaaagcaggaaaatattaggcaagttctatgatgaaaacacagtgggctgttatgatagagacccattgtggggtagaggagacctcctagagagttgacgtatgaactgaggattaaatgactagaaacaggcaaagagacgtaggaaacatatgccaggcttatcatgaagtagaaattagccaggacgggttcagaaagcataaaggccaataggcaggagctcagttagagggaagattgcggggagatgaggtctaggaggttgtcaggggggtcagatcatatagctcaaagtaaggaacttgacgtttatctacaatattatagaaaaccattaagaagttttaagtatactagagagatcttatgatgtatattttaaaatagttaccctggaaccctagtagctgcatggataatgaattttagggacctggggaacaggcaagagatagtggtgacccagactagtacagtagtagccatgaagagatatgaagagaataggatggtttttgaacaatcagtaaaattttctgatgtgggaaaggggtgaagaagtgagaaaatttgaagatgtctacttttttcccccttaaacagctgggtgttggtgactttattgagagggagaaaacaagaagctggtgtgtagttagctgaatcaggagttgtgttttggtcaaattaagtttgaggaattattagatgataaccaagtcaatatgtcaaataagaagtagaatatatgcttttcaaggtcaggagagaggtcaatataacattgagtggtgtattagatggcattaaaagccatgagtccagagattagttaaggaaagagggcaggaagagaagattcagtgtccctggaatgaatcctagggctgcacatccgttaggaagttatcacaggagaaaggttggttaaggagactgagaagaggtagacaatgtgctagatgggttgtaagagggaaagaaagtggtgaagtaataaacctaagttgatcaactggactgagagagacccagtaagtcagcaagagagtccaagaaaaggaactatacaataatctgtctacccaaagggagtggcccttgtcccatgaaactgtagttaccactgaatgttaggatggatacctgttgaaaacatttacatctaaacatcataccacttccttggattaatccattagacttaatagaaaactcacgccttctatgcaaataattttgggtgtcatgtaggctcagcctttaaaaaagtccattatcattacagttctcaaattgattttctgtaccaggagcagaaatgggaagttgacgaaaatactgaaatgaaaaattcaactgagacttcaagctctggtttaaatgtgcatggcaaacacaccaggcgtgcacattttaaaataaaacagatgagctattttaagtgttttattgcaaaacttaaagattgtagttattactattttttaaaaaacttttagaaagcagttttcctattctttgtacctttaagtccttggctctaatattctactcttctgaccttgatctaatcatgaatatctatgctacttaattataattaaaaaaaagcctacattgcactctagatggtagatgcacattttttcttctttggtcacctgccagttctcaaaattatagcagtgggaagaaatgcaaatgaattccgtgcttgacagctaaacataatgaaatgcatggtccacatttgaaaagttaccttaaaataaaaggtagcatataaaaaatcatttctttaaggtcacctgtggctttgaattacagctttgaggaatttccaatttagtcatcagaaagaagccaaaataaggattacacacctcactaaaggaaagacagagttttacttcatcatagttgggtgagcttagaaatagtaaacaaaacaagcaaaacaaagcacaaccctcaaatattcattttatagagccttgtgtaaagtcagccacttgagagcattttctatgctaattgttcctgtagctaataaagttttttcttgttaacatccaaaaataggttaccttatcacatgttaaaatgtgtaatatatggactgcaataggctggcagtaaacagagtttattacatagatctgtattagttgaaagagaattgtatttcttgattcagatgaatgtatattcaaatagtagattaagaagcaaatgaatggatgctgaacagttatttagaaaatttgaatccaaaaatagtatatatgaatatatgtatacatatgtatgcatatgtgtgtgcgtattcacaaaactccaaattatttgataattggacacttgagaaagtgccaaagtggtttttaggaaaaatcatatactttacattttcttctttttttgctattggggactttttgcatattgaccgcattctatagactactaggaggacatgtactgctaagtgtggtccacaggccacagagctctcagaaacagggcagaggcttctgtgtataatattttcaatgcttcactgcctcagtatgtggtgtaatagaatgagctccagcctaagaaaaataggcttgggttctggttccacttcagctcttttctgtgacatcttgagcaagtcatttaattatattatgtctcagtttctgtgctcagcttaacaataacaaacactgattgaacacttaccatattcaagtatttataagacacaggaatttctaattgtgtttataaatagataatttcaacatgtggtaaataaaatggtaaagatgtgttcagagtgctacaggagcagaggcaaagcatccagagtctagtctgcaaaaggtgcccttcccacctacattgtaggtatatgataaaaataaaataacattggtgaatgcgcttcatttttaaaaatgtaactcattgcattactattggtagtagctgtatagagaaatagcaggaaaagaaaaatatgttacgaattaaggtctgagttaaacaagatgaatagagagacttaacaatggaacagaatagaaactccagaagtgcaagcgaaagtacgcaatgaagatggcgtctaaaatcagtttgaaaaacatagactttttaataagtaagattaggataagttggtaataatatggaaaaaagatacagttgggtttattcttaaaagatattctaacataatttatgaaggggtcagagaggtaaagaaaagaggcaataaaatgaatactaaaagaaaatgtgggttaattcttttataacctgaaagtgagtaaaactttttgaccatgactcaaaatgtagaagcaataagggagaatattgaagaattttattacaaacataagccccaatgaaagacaaaacaaacacatggaaaaccctgtgcataaaaaaataacacaagaagcaagttaaaaatatgtgtgataaatagggaataatatttgcaacttttgtcatggacaaagtgttaatactcccaaaatataatgctctaaaaattgacaagaaatgaatacaaaacaacctattcttaacaaattggacaaagaagaaatcacaagggaatttagaaaatatctggacacagattaaaacaaaaacacactataccaaaacttatgagatgcagcaagagtggtaaatactaagaggaaagtttataatggcaaatgtttacattaataaagaagaatgatctcaaatcaataacttaaccttacacctcaaggaactagagaaagaacaaacaacacaaagtcagaagaaagaaggaaataataaagattagagcagagataaacaaaatagagaatggaaaacagtagaaaaaactcaatgaaagcatgttgatttttggaaagattaaaaaaattaacaaacccttatgtagactaagaaaaatagaggaaagactcaaataattaaaattagaaatgaaaggagacattacaaatgatgtcacagaaataaaaaggattatagaggaagaattgtacgccaacaaattatataatctagaagaaatggatagctttctataaacatacaacctactaagactgaatcatgacaaaataaaaaatctgaaaagacctaaaactagtgaaaagacttaaacagtaatcaaaaaccccctaacaaagaaaagcccaggaccagatggatccactggagaacggtaccaaacatttaaagaagaattaacacctgtttttcttcaactcttccaaagactctaaaaagagaaacattcccaactattctgaggccagcattactttgataccaaaaccagacaaagacataacaagaaaagtacagatcaatagttctgatgaatattgatataaaatagaaacaaaccaagttcaatagcacattaaatggatcatagaccacagacaagtggaatttatacctggaattcaaaaatagttcaacatacaaaaatcaatcaatgtattacatcaatgtattacatcacattaacaaaatgaaggacaaaaaccacatgatcatctcaatggatgcaggaaaaacatttgagaaaattcaacaccctttcatgataaaaacattagacaaactaagaatagcaggaaactaccttaacataataaaagtcatatatgaatatcccaccgctgacatcatactcaatgggaaagactgaatgcttttcctctaagattaggaacaaggcaaagatgcccactcttgctactataattgaacatagtgctgaaagtttcagacagagaaataacaagagaaaaaactaaaaagcatacaaatcagaatagaagaaggaaaagcgcctctgttcacagacggcatgatcttatatgtaccaaacactaagaattcgacacaaaagtcattagaattaataaaggagttcagcagtttcagaatacaagatcagcactcaaaaatcagttgcatttctataattaacgatgactgatctgaaagcaaattaaggaaacattcccatatactatagcattgaaaagataaatacttagaaataaacttaacgaagaaggtgaaagacttgtataatggaaactataaaactttactaaaaaaaattgaagaatatacaaataaatggaaagatatcctgagcttgtgaattggaagacttaatattgttaaaatgtccatactagccaaagtgatctatagattcaatgcaatccctgtcaaaatctcaatagcatttttgcagaaatagaaaaaaattcctgaaattcatatggaatattaatagtgaaaacaaacttgaaaaagaaaattgaagttggatgtcccacacttcttgattttaaaacatactacaaagtaacagcaattaagagtacaaggttctgatatgaagatagatataagaccaatggaacagagtagagagcccaaaaatacaccttcgcacatgttggcgaataattttcatcaggggtgccaagactacgtaagggggaaaggacagtctcttcaacaaatagggcggggtaaatcggatatccacatgcaaaagaatgaagttggatccttgctttagaccatgtacaaaaattaactcaaaataaattaaagacctaaaaccattaaactcctacaggaagaaactatagggcaacagcttcagaagactggatttagcaatgatttcttggacatgacaataaaacacaggcaacaaaaaaattaaaaatagacaaatgggatgacatcaaacatgaaaacgtcggcatttcaaagaaaacaatccacagagtgaaaaggcaacatatggaatgggggaaaataattgcaaaacatatgtctgatatggggctaatatccagaatatataatgaacttctacaacttaagaaaaatccccccaacctcaaataacctgtttaaaaaatgaccaaaggacttgaatagaattttcttcaaagaagatttacagatggccaatacacacatgaaaagatgctcaacatcactaattactagggaaatgcaaatcaaaaccataatgaggctgggtgccgtggctcacacttctaatcccagcattttgggaggatgaggtgggaaaatcctttgagctcaggattttgagatcagcctaggcaacatagggagaccctgtctttgaaataataataagaagatgtcacttcatagccatcattcaaggtgggcagtattaaaagatcagaaaaatactgcgttgacgaggatgtggagaaattgtgggtaacccttgtgcactgttggtggaaatgtaaaatggtgcagccattgtggaaagcagtaaaaagagttctcaaaaactttaaagtagaattactactatatgattcagcaatcccacttctgagtatatatccataagaattcaaagtgagattctgaggaaatatttacataccctcattcatctcagcattatttatatttgccaagagctagacacatcccacatgtccattgttagacaagtgaataaagaaaatgtggtatatacataaaatggaatgttatgtggtattaatatcctaatattctcaaggtatatccatgttgtagcatgtgacaggatgctacaacatggataaacgttgaggatattaggctaagtgagtagtcttaaaaggacaaagaccctgtctttgaaataataataataatatgattccactcatatgaagtagctaaagcagtcaaaaaatagaaacagaaagtagaaaagcatttaccaaggactaggaggagtggggaggatgaattagtgtttagtgggtatacagctttagtgttgcggcaagatgaaaaagttctagaaatccattgcataacaatatgaatatacttaacactactgaactgtacacttaaaatgattaagatggtttatttcccttaacacaatgtcttccagttctactggtgttgctgcaaatgacaggatttcattcctttttatggctgaatagtattccatcgtgtatagataccacattttctttattcattcatttgttgttggatgcctagactgattccatatctcagctattgtgagtagtgctgcaataaatatgagggtgcaaatgtctctgatgtattgattttccttcctttggataaatgaatgaaactgcaagacattatgttaagtgaaataagccaagagaaagttaaacattgcatgttctcatttacatgtggaagccagaaaaagctgatctcaaagaagtaaaacgtagaacagaggatattagaggctgggaagcataggggcaagggagagatttattaagtgacacaaaattatagctaggtaggaggaatacgtattagtgttctataccactgtaggatgactatagttaacaataaaatattatatagttttagatagctagaagaaggatattgaattttcccaacacaaagaaatgatgtttgaaatgatggatctgccaattaccctgatgtgattactataccttatatgtattgaaacatcactatgtacctcgtaaatatgtacaattattattatcagttaaaagctacaataaatagtcctgatagctgaatgcctgagctgaaaattacatgttcatcttatacactcagaaaaaaatgataaagatggtaaattttatattatgtgtttttttaccacaataaataccacaaccctatagaaaagttgaactagaaacatgaacaggtaattcactgaaaaagaaattcaaaatgctctaaggcaatgaaaagatgctcacctcttctcaaaataagaaaaatgcaaatttaaaccacagcaagataccattttccactctcaaattggcaaaaatcccaaagtttgacaatatactttgtttgagaggctgtggggaaaaaggcattcttgtacatttttggtagaaatacaaaatagtgccacaaccactatagaaaggaatttggcaacatatagaaaaattatatatggacttacttttgatttggcaatattacttctaggaatctatcctaaagatacactggcaaaaaagaaaagcaaagagaaacatgcaccaagctatttgttagaatctacttaatatggcaaatgtaaaaaaaaacccaaatgtctatccatatggaactggtaaaataaatgatagtttgttacacgatgaatatacaattataaaatgatccctaaactatactaagtaaaaaaaaagcaagtgagaaaagtgtgaattatatgttacttcttacatcaaaagggcagacaatatatatgcctacatgcacccacacatattttaatatttgcatttatttaaaaatggaaggataatccataaaacaaaggaagcaatgaaaaacagcaagaggcttatctgaacgactaaggtaccaacatgaaggggacttcactgtccaagtatggaaacaaatttgagaatcactagctgtagtagattaaaatacataaaaaatgcttaagagcataaattcataatcatagtttttttaaagaaatcctaatagttacattagcagaatgttgaaattcaactcaataatttgcaaatctatagatagaaggaaataattaaatgtttatcttctttttattacatatactatacctcaatgtaactagctgatgaggagatacctgtctttatgaaactatttcagctagtaaaagaggaagaaatatagaatatgatcaccttgcaatcctcaataaaatattggatttgggcaaaaatcatcaatgaatgctaactctgcaaaaacagacattatgcctcttaattaaagtacataatgccacctatgaagaaatttgaccaaaataaaatctgaatctgcgagtatctaggtctgttagaaaatttacgggaaatacagagggaaagcactatgaggatgcaattcacaaaatcccgactatgggaaatgctctaagaaatgttaagatttctttttaaaaaataataaattaggggccgggcgtggtggctcacgcctgtaatcccagcactttgggaggctgaggcggacagatcacgaggtcaggagatcgagaccatcctggctaacacggtgaaaccccgtttctactaaaaatacaaaaaattagccaggcgtggtggcgggcacctgtagtcccagctactcgggaggctgaggcaggtgaatggcgtgaacctgggagtcggagcttgcagtgagcggacatcgcaccactgcacgccagcctggacgacagagagaggctccgtctcaaaaaaaaaaaataataataataataaattaaatagagatagagatgcatggggaatagatagatagatagatagatagatagatagatagatagtttctggacatatctggcatttggaatgtttaaaccttttttggatttgatttgaacaaactataaaacaaaaaaacaaatttcaaaaaggaaacaattggagattttaacagtgactagatatttgatggtgttaagaaattttcttcctccacaaacacatatgtgggtgtgtgtgacagagagagagagattgataatgacattgtggttatgtttttcaaatggaatttaacttttatgtatgcatacacctacataatatattacatataaataaatataacaaaatacaagaataagaaatgctataatatttagtttttgcttgaaaattacccgggtgagaagaagaaaaagtgagtgaagatgagttgataattgctgaagctcagagctacctaggtgaggttcatgtatagtctttatctacttttgtttatgcttaagatattccattattaaaattttttcaaccagggaaaaaaggaagatggggagaagaggaatctctacctctcaacttttcattgggtctaaatcttgccattagaatcccattgcaaagaagcagtcttaatttttacttaaaaatattcttgcagaccattgctttatcaagggtaatatctgacacaattttcaaattctgagttgaaagagaagttataaagaatcaaagagaaaggatatctgtcaagaaaacaatataaacccagaaatcaatgtaacgcataatttacttacgtttttctgactgataaattaggttgtagtatatcatatgaagagttatcacagccataagcatagacataaaaggaataagtaaaacaagggcccaggcctgtgagtgctggatgtaagatattcccagaaacacaatagttgcatttaggttcatgagccaataaaacctggggtatacagacagacaaaaataaaaataccattgaattgctttagataactattgctaattttaatgcttctaatcaaatgtaaactaccaaatgatggcatgttaactgaacccaattttgcaaatgttgtttatcagatttcttaagtatataaacatcagccctgacttagcagtttcattatctttgttttatccttgtttagaatcgatatagaaagaaggcgctctctttcatctaaatcagaggttggcaaaatttttctctaaagggctgaatagatagtaaatattttaggctttgcaggccatacagtctctgtagcactgtggtgctaaagaagctatagacaacacttaatcattcaaatacccctaatgaaactggaaggattaaaaagttaatccttcctgtatattccagttttcaaagtataggaaaacacaaatactcagaaatatctgggttatacttagaatagcatgtaactgaagaaatgagtgacatttgaataaaactttccatttttcttcccaatgattagtatcacagagaggtacctaccccagtagtctggtttgcaagttctgggaaaatcatctctacctctcaacctttcactgggtataaatcttgccattagaatcccattgcaaagaagagatcttaacttttacttaaaaaattgacgtaaaattaaatgcaataaaatttactcatttacatatataacttatatacatattagtttttttaagtgtttcagttgtgcaagccttagtacacttacactatcattaaaattttagataagccttagtacacttacactatcattaaaatttaaagggcttatgtgattagatgagacccacccagtataatctgggctctgatcaactcaagtcaactgatgagaaaccccaattatctctgcaaaatcatttcacctttgccatataacataattaggggagtgatatcccataatctttcccatattctattggttagaattgggttacaagttgtgcctgcactcagggggatgggtccaaacaagtgtggtccactgggggtcatcctggggcatgtctgccacatcttctttttctttttttttttttctttttcttttctttctttcctttttttttttttttttttttttttgcgacaaagtcttactctgtcacccaggctggaatgcagtggtgcaatcatggctgactgcagctttgacctcccaggctgaaggaatcctactgcctcagcttctctcaagtagctgggaccacaagcacgcactaccatacctggtaatttttttttttatttttagtagagatgaggtctcactgtgttgcccaggctgcacatctgattcctctctcctctcctcttctctcccctccccttttctttttcctttccttcattctttccttccctcctttcctccctcactccctccctctcttccctccttccttccttccttgttccttccttctttccttccttcgtccctccctcccccagttcctccctccttccttcccttatttccctctatttcctctaagtaaaaggagaagtacagacaacaggtagaactggctatggaaagggaatattgaaggtttgagaagaaagaaaatgtttagaagttgtaatctgaaggagaaggagagaaattgggcatcatatacttgctaggcaatgataaggaaccagtttggtggtcatgaacttaatgcgatcatagtataattttgcatttttctcagacttgttgctgtgtgagtacaataatggaataagtggagagttgaattttaactaagattatttcctccatcacacaggagagtatgacaaagtaagctggggggatggggagggaaaaataattgaagacatggaatattattgctaattaattggagactagccttgctgcatactttctggttgagagtggaggctcaactccttgctgtacccagctgacaccacccgggcggggggtaagttagagcacttccagtttctgctgggcaggagatccaagacaagttcctcacttggcctcagcaacatcacccgacttgggaatcagagtgttcctgtgtgattctccaagtgttaatgtaaaatattaagtcttgctcatgtctgctgaaactattaggccaggaatatgcaggggaggcagtgtttttaatagtgtttggctagagaaggacagatattgtcaaaaatattttctgctatattagtctaccttttccctaatactttgtgtaaggggagcaggactttttttggagctgcccattacttgccacacctcggctcttacccatctgtacctggttccaggttctaggtttttccatagccccactgataacaaaaagaaaacccaggaaattcattattgtccttcctcaagttcaaaagcccctaggaagagactgtcttctttccaccttttggaatctccctacgttcgtttgttgtgttaagttcgggttttttcaatgtaagaagtacttgggagaaatagggctcttctcatattggctaatactggaaatcctcttttttttttttattgggtagtttcttttcctatcattgatttgtcaaaggtcttcatatattttggatgcatgtcatctgtcagatacatgttctacaaatgttttcttataatctggggttttccttttcattttctcaatgatatcttttgataagaaaaagtttaaaattttaataaattttagtctatcaatttttatctttattggttcatactttttgtgtcccatgtaaagaatactttctaaacctaagtcacaagtattttcccgtttttttttttagatcacttttatgggttttgatctcatataaagttaataatctaatttgaattaattttagtagagtgtcatggggtaattatttcctatatggatattcagttattacaataccatttattgagaagatgatcttttcctcagtgatcttttgacacttttgttgaaaatcaattgaccatacaaatgtaggtgtattttctgactctcagttctgttccactaatctatccttatgccaataccatactgtcttggttactgttactttcttttctcttgttttttttttaaagagctttattgagatataattgagatgcagtaaactgcatatatttgaagtgtgcaattttatgttttgaatatgtatgtacacacaaaataattacgacattcaagataacaaacatatccattgcttctaaagctcagtcacatccctttgtcatccttcctcttaccccttctcatttccccttcctcatctccaggaaaccactgatcttttttctgccactataaattagtttgcaattcatagatttagaaaaaagtattaaattatctgtattttttaatctggcttctttcacttagcataattattttgagattcatccatgttagtatatttatctgtacccattcctctctgttgccaagtactattccattatgtaaatgtaccactgtttgtttatgcatttatctgttaatagactttttcagcttattgctattacaaataacgctgttaagaacattcatatacaagcctttgaacagacatagacattaatttctcttggttaaaacctaggagtgtaatggctgggtgatatgatagatgtatatttaatattttaagaaaatatcaaatagtttttaagtagttgtaacatttttacattatcacaacatgtgtatgagagttctaatctcttcatatccctgccaaaacttggtatactacatgtgtactggtatatcattgtggttttattttgcatttccctaatgactaatgatgttgagcatcttttcatgtgcttattgaccatctgcatatcttctttggtgaaatttctgtccttatgtattctggctataagtcctttctcaattatgtgatttgtaagtattttctcccagtctgtggcttgtcttttcattctattaaaagtgtcttttgaaaagcagaaattcttaattgtgatgaagtcctattataattttttttcatggatcgtccttttagaattgtttctcagaaatcattgcctaaactgaggtcagaaaacttttctccctctctttcagagaagaaatctgaactgggagaactgaaatgactcatccaaattcacacagctgtgttgcttgtagagccatgagcagaagccatcatcctggtacagggctaattcggctaaatatcctgttaatacttctttctgcatctttgcagttatcaatttcatgacactatcattttcttgttaatgcagcctttaacatttgaaattacctttcattcctctcattcctctcattcctctcatcacattttatatatcaatcattaactgtaaatgttgtcctgcctcttcagactggtagtccaaagacatgagttagagtcacaaaatctgaaaatcacatggtctgtgatcttctactctctggaattttaaaaattgtaatcacaccctctaaacaaggttttttgttaagaattttaatgaagaacattaaatgaagaacatggattataactacatggtgctaagccaatgtcatcatcaaatgttcatttttctccaaccctgatttcaggaacaaaaatagcagtgaagttggaacatagtgagtgatatggtttagttctctgtccccatccaaatctcaacttgtagctctcataattcccacatgttgtgggagggacccaattggagatgattgaatcatgggggcgggtcttttctgtgatgctctcgtgatagcgaatgggtctaacaagatatgatggttttaaaaatgggagtttctctgcacagctccctctttgcctgctgccatctatataagatgtgacttgctccgccttgccttctcccatgattgtgaggtctctccagccatgtgtaactgtaagtccagttaaacctctttcttttgtaaattgcccagtctcaggtatgtctttatcagcagtgtgaaagcagaataatacagtaaattggtaccagtagcatggggcactgctgaaaagatacctgcaaatgcacaagtgactttggaactgggtaacaggcagaggatggaacagtttggagggctcagaagacaggaaaatgtgggaaagtttggaatgccctggagacttgttgaatggctttgaccaaaatgctaataatgacatggacaatgaaatccaggttgaagtggtctcagatggagatgagacacttggaaactggaacaaaggtgactcttgttatgttttagcagagactggcaccattttgcccctgccctagagatttgtggaactttgaacttgagagagatgatttagggcatctggcagaaaaaatttctaagcagcaaagcattcaagcggtgacttgggtgctgttaaaggcattcagttttataagggaagcagagcataaaagtttggaaaatttgcagcctgacaatgcaatagaaaagaaaatcccattttcttaggagaaattcaagcccgctgcagaaatttgcataagtaacaagaaaccaaatgttaatccccaagacaatggggaaaatgtctctccagggcatgtcagaggtcttcatggcaacccctgccatcacaggcccagagttctaagaggcaaaaatggttttgtgggccaggcctagggtccctgtgctgtgtgtagtctagggacttggtgccctgtgtcccagctgctccagccataactaaaaggggccaaggtacagctcaggctgctgtttcagaggatggaaaccccaagccttggcagcttccatgtgttgttgagcctgtgggtgcacagaggtcaagaactgaggtttgggaacctccacctaggtttcagaagatgtatggaaacacctggatgtccaggcagaagtttgctgcaggggcagagccctcttggacaacctctgctggggcagtgtggaacagaaatgtgggatcagagcacccacacagagttcctaatggggcattgcctactggagctgtgagaagagaaccactggcctccagaccccagaatggtagatccactgacagcttgcaccgtgtgcctggaaaagcagcagacactggatgccagcccgtgaaggcagctgggagggaagcagtaccctgcaaagccacaggggcagagttgctgaaggccatgggaacccacctcttgcattagcatgacctaaatgtgagacatggagtcaaaggagatcattttggaggtttaagatttgactaccctgctgcattttggacttccactgggcctgtagcccctttgttttggctaatttctcccatttggaatggctgtatttacccaatacctgtacccccattatatctaggaagtaactaaattgttttcaattttacaggctcatagatggaagggacttgctttgtctcagatgagactttggactgtggacttttgagttaatgctgaaatgagttgatactttgggggactgttgggaaggcatgattggttttgaaatgtgaggatatgagatttgggaggggccagaggcagaatgatattgtttggctctgtgtccccatccaaatttcatcttgtagctcccatattttccacatgttgtgggagggaccaggtgggagatgatagaatcatgggggcacatctttcccatgctgttctcgtgatagtgaataggtcttacaagatctgatggttttaaaaaggggagtttctttgcacaagctctctcttcgcttgctgccatctgtgtaagacatgatttgctcctccttgccttccaccatgattatgaggcttctccagccacatggaactgtaagtcaaattaaacctctttcttttgtaaatttcctagtcttgggtatgtctttatcagcagcatgaaagtggactaatacagtgattaagggatgaaatattagaagaaaagataaaccaggaagtgtggtccaggttatttagggccttgaagttcatggcaagaagtttgggttttattttcagtgcattgggaagtcatttgaagggaattgagcaggggtctcatatgatcttgttttcagtggaaagattattgtgtcagcttcatgaattgcagatgcggcaaggtagggagaaaatcacagctattgtagcaaggtatggagaaaatcacagctattgtaagtctggatgagagctaagagcaaactgggccatggtggtagcaaagaaaagagatagaagtggatagatatgtgatatgtgtttggaaagatgtgtgaagttgagctagtctgctcactgtcccagaaacagacctactcatgtttgtctccttaacttgtcctatttcttggcttgccctgtctcactttcaaagtcctatattcagtctcttttccttcattaaatactttcttgaatattctgcttgttctctcctgtaaacttttttgttttttgagacattatctcactctgttgactaggctggagtacagtagcatgaccttgactcactgcagccttgatttcttgggctcaagtgatcctcttgcctcagcctcccgagtagctggcaccacaggtgcacaccaccatgcctagctaatttttttttgtattttttgtagagatggggttttgccattttgcccgggctggtcttgaactcctgagctcaagcaatccacccgctttggcctcccaaagtgctgggactagaaacatgagccactacacccagcttcttctctgaacttctaaagaaaatactctttcttcaattatttcatttttgtcagttttgcttttcatttatagattgtgaagctccttgatgataagattttattctttatttctttatctccatgagacctagcacagtactaggttcaaaataaatggagattaaataacagattaataatatggcatctcataaaaatcaattaatcaaacaaacacaacgtaaaaaaactaaaacctctcaataattggcctagaaagtgatagaacatggaacgtgaccacattgagcaaactgatttactgtgatccactaaatgtatttatcataaggtaggtgaggtacaaaaagttataattttctaggacaactgggtggagtccctaggctaagccacaggttgtcctttcttgctgctgcaagctgtacacttgacttgtggctgtagcaacacagagaatctggagccaaaagcactgttacagtgctttcagtctttaggaaactctttttaaaaagttaagcattgttgagaaaatctcagggaacaccgtgtgactcttcagtataccacatggtgatgtaaactgcattgctctaaagagggtcaaggaaaattacaactattccaagacttaaatcttgtgaaatgtagttagaaaccaaaaattatagtactgaatatgtatgtctaggaagagattttacatgaagtactaaatgtattttaacaaatgccacccaacatatttgattgtgtaattttctgaaagaattacctagtacagtcatgttttatatatgtctttgttgatccatggacaggacaagccacagataattaaggatgaaattgtatatgtatcatctataaaaaaaagaaataaaaacccacagtcttcaaacttaccattaagactcctttcatctcatagctcactagcaaattgaatttataaagcacctctcacacaaaaagtcagagagcaaagcactaaagcaaaacaaataccagtgattaaggaaaattgaaagcagcagtaaaaatatgtttctttagcctacttttaaatacagactgagaactgcaaataattgggagtatatataagtggtaatttttttgtcttcatgattgcatggtattgaatacaaatgagaaaaattgttgctgcaaaactcagcaatccttatgagattattttaaacattcacttaattaatttagtaataaatttaaattactcaaatattttgtcatttcttagactggccagttttgatgtgcttcgtgtttacttttggtgatttgaagagaaattatttaaatggtctttcctaatctgagacagtatcaaagaaagaaggcaaattttctataagtttcaggtcttcatagcattagtgtaccatttaaatattccagagaaagtattttattcgacattgatcaatgttcagataattttccaggggatttgtgactcttcagtgggataaaactgaactgtttagaggagtcagtgaaataaaatacttgggcaccgatttcatggtggatggctgttgtcaatcattgcttcttttagcataaccattggccactgaagtacttcaaagaatattctggcagccaaatatttggagaaagaaggggaaaatagaaactttagagttcctttttatctgtaaatacatatttttttttccagcagagctgttaaagacaatttaataaaatattgattttggtaactagacattaggattgaagaagttaagtttttaatttaaaaatttgggggactgctttactctctctcccaagctctccctacctctcttactctttaacctgtttcattccctttctgtcctttcccattccctctccctcctttcccattccctcattcttttgccaacaacccccgcccaccccccacctttttttttttttttttttttttgagatagggtctcactctgtcacccagactagactggtgcagggtgttcacagctcactgtaatctcagcctcctgagctcaagcgattcttccgcttcagcctctcaagtacatgtgactacaggttcaccccaccatgcctgggtaattaaaaaaaaatgtttttttggtagagatggggttactcaggcttgtctcgaacccctggccttgagtgatcctcctgcctaggcctcccagagcccagggattcaggtgtgagtcactgtgcctggccaacacccaaattttaacagttgtcctgactcatgtacctttcaagcttaaaagagaacatgcgcccggctctgtggctcatgcctgtaatcctggcactttggaggccaacgtgggcagattgcctgagctcagggatttgagaccagcctgggcaacatggtgaaaccccatctctactaaaatgcaaaaaaattagctggcgtggtggtatgaacctgtagtcccagctacttgggaggctgaggcaggagaattgcttgaacccgggagacggaggttgcagtgagctcagatcgcaaaggtaaagaaggaagtgcttgttgttattagggtgagagggtagcatttgttaaacttggctagagccagtgcaaatagaatttgggaaggtctggtgattttttcatagctatttacaagctactactcctcagcatgcaactcaaaggacattttgagtattaataagattatttcatgaactgctttgattttgtttgctgaaatgtaccttataaattatgattttacgattgaagagtatatgtagatttatatttttttctctctcttttcagaattatgttgaatttctcaatcaggcagatttctaaatgtgagataattgctataaaattgtcagaaagttccaaagcagtctgaaacacagtagtgggttcaatcaatgattagtttcatttcttttcaaaggcatcactagattttccttatggctctggagttgttttcaaactttgttcttctgaatcacctgaagtacttgatatggtaggaatatttctgtcccctcaaatttcatatgttgaaatcttaacttggtattaggtgttatacctcctataacaatggtattagggagtggtgtatttgggaggtggggcttttgctcataggggtggaacccttctgaatgggattagttcctttataaaagagacctccgagagctcctttgccccttccactatgtgaagacacagtgagaagccagcagtcttacagccaggaagagaaccctcaccagaaccctgatctcagaattctggcctccagagctgtgaaaaataaatttctactatttataagccagccaatctctgctgatttgttattgcagcctgaatagactaagacagtacttgtttaaaatatgcatttcccacctgtcctcccagaaaattctgatccaggaggttcgaggtgggacctgggaaacattttcaacaaggttctcaagtgataattaaaatgagcaacactgcgttggaacagtggttctcaactctaactgggcagctttaaaaaatcctggtccctggatcctacctctaaccaatgtaatcagaatctttggtggcaggacccaggcatttgtactttttaaaaaagaatcctcaggtggctttaatatgcacctaggattgacaatcattgttctcaatgttcttgtgaatattaaaatagattctggaaaaatgctgtgggataatacatttttacctctagtgcttccctaagataaaatatatttaatttgagtaagtgttaaaatcagaatatttcagataccatgtagagtcaatttgagtaccagatagtcaacatttctggggtgaaataagtcagtctctagactttcttcaagaactttaccaatattctatttgggcttttaatcatgtatataattcaccctagtaaccccttagcaacagactgtgatatgcagataggatgcaaattatcaggtgaagaaagtagagaaatgcagaagcaagatttgaggttaattgtggtagaatttaaaattgtggccaggaacagacttcattatcctccttctttttgcttccagaaaagaatctgcacaggtgtatttacctaggtgatctccagtatggcgattcttaattgtccatctcagcttttggaatatgtggaaagccaggctctgatctggataatgacacaaggatgttggcagattattatgtctcttgatttcagggagtttagctttatttttgtagtgaggtgcattagttgaggaagatccagtaccagatggtaatgttggctgggagtggttttctcacctacatttggcagctttactcggaagtggtgctttcagtgcctgagacttccagtctatgctacttaacatgatcattgggaagctttaggtggtatagaagcaatgacacatctcattaaaggtcccataactatgaacatctgacatctgtgctgcaaataggactgaataaagccttcaagtggttacagattcaaggggtatgttgttttttaaaggcacggctgaaattcgttatatttaccagtcttgtaatttctagaggcatttttgactggaagacatagattacacattaataaactgctcctttcaaagatgacctcctcctaaatgggttccctctttcccagcatttagacaatggtttcagctgatggcttatccatgatttagcaataatcataacaatagctatcataatttgatacctataatatgctaggatactttatatataagtgatacaatagctctccaagatattcccactttgtggatgaggaacctggggctctgaggaattaaggaacttgccaaagaccataaaactcctaagtgacagagccaggattctgccagctgtctggttgcccagtggagtctctgtccatcttgtcaccagcccccgcactgtgtacaggaatggaatcagcattcattgctataaactgcagtaaggtaagtgaacattcataaaagttggcctgtagtttagtatttaaactggaaaaataaaaaaaggcaagacaaccagattcagccttcaaggatcttaccatccagttcttttatcacattaaaaaataacagcctgattctttatacacatttctagatgctttaaatttttaaaatagtgagctgtttagtgaaatcagaaaataatttttaaaaatctaaatatgttcatcctaaatttggcctggttccttacagctgcagaaattcattttcaccccattccccatcccccttcctgaagccctaaagcacacacccagtgggagtcccctctgtttcccaaaggaaatatttcattcatataatgtctcctttgtaatcaacactgagaaatgtcactttgattaaacacaactctgaatgactaagaccacagtacaataaattctccagagctatctttcagaacaactgattgctctccagtcttaatcctccagagtcttatttaatcaaaatgatgttgctaattaaggattaaaacctccgaatagaataaaaaagaaggatttttctttctcctttgggcaggtcaaggaggcagaatttgctgcaaggaagtaaagagtcccttctacctttggtaagactgcattgttctctgacattaggacttaatccaaaatagggctgagtgctttgtaatattaatataattggagaaagaaaaaaggggagcaagagaaagaaaaagaaagaaagagaaaagaggaactgcctcggatagctacatatgcctatacatacacatatagacactatttactctaaaaatggacaatgtagctcacatctgtttgacatccactgatagataacaaagaataacaaagaagttttatactaaattcttaactaccctcccttaagatccatatattaatttgttttcttgaatttgtatttggtaatataaattgtttccttaaaaaacacaaaaaccgacgaactccataagaactcgttgggagagacaaagattcacaggaaggctgtttgattttcatggaatataaactcttttaggtgttgggagcgaactgggtgagaaacagagatgctgggtgatgctttaacaaattgcaaaatacttctttcatctttgcatcttctctctgcattggcctagaaatttataatctctgccaaattagtctattacaatacagacatactaacagctaccattttttgatcacttactatgtgccaagttctttgccagcaatacacatggtgttacctctaataaaaccggagaagaggaggtattatcccccttcagaaatgaataaactgaggtagagaataaatgactaggtcaaggtcagtcagcctgtgttaagcagagtccagacttccacccaggtctctttggttccaaagccacattctattctgcaggacaaggcacttcaaatctttttacctggaggataaatgtgtccgcgtgtgttgggaaggtgctggtgagttgtactggtctgcatgagacttagaagctcctgtgattactgactgaatcatcatcacagattcatcacatcatcacttagcccaattcatcacaaagactgagcaactactacccaaatggaatcagaaagtaaacagtgagaatggtcataagcctcttttctctcctagccagtgctacttaccagttaaaaaaagacatcgttttttgtgatccatactcctgaaggccaaaagcacccagtggacagacgatggctcttacgcctccaatgccaaggcaaatggtcagcagtgctacataaaacagcctgtgctgctctgtttttggtatgttgttaactgcatggtaagtgcccagatagaaatcttccaagggaaaagccaccacagataacaaagcagtgcctgtaggtggagaaaaaaaaagagtaaatgtagcatagaacaagtggatcaccaaatcacattttaaacagggtttttctctgacagtggcatcattttgtgattgtcttatccaaacatttatggtagtcattgcaatttcagggatagcctgatgttttccaattgtaaaaatttccttcaatatgtgtctcaactaatccggagttttaggtttttttttttctcctcaagcttgaactatgttttctctcagaatgtatgagcaaatcatgtttattttgccaaaattaaaataactcaggaaagcattgtataaaaaatgaagctgttagtattcccacccccagagaaaaccactgttaataaaggttatttgttcttaatcaatcgagtgacagaaaacaccatgatctcacacatctcagaagcttattacctaaaagcttttaagaagaacattatcagagttagaggagaacacagcctttttttttttctttcctacttctgtttctccttgtaatgtctttcttatttctcttatttctcacacagctggatggagccttctttgccacaaacagagttgagaaagctggggacagaggagtgtgagtggaaggagaggggacctaaagtgacaaaagaaggtcgagtatccttctctcttccaccttgcagggaccacacttgatgactttccttgtctaataaaaataactatacaattccatgcttttgctaagctctttatattttgccaagcatgctcatggactatattgtttcatcttggaaaaactttgtgatgtgagtggatagattttcttattcaatttttttttaaagaaataagttcagtgagattaagtggcttgcccaatgttataaagtaacccagttgtaatctccctcttcttggacctcctaccatcaagtagtcaaataaatttttttttttttttggaaatagcattcccccccatcagattacaaaagtaatacattcttacttcagaaaatttgaaaaatagaggaaagcactcagaataatacaaaaggcccataatctcattactcagagatcatctttacatatataattttacttttataaaataaaatattttaaaaatatttatattttacttaaaaatattttacttatatataaatatattttataaatgtattttacttaaataaattgaggttacactgttgagtttttaatgtaaccaaataatatgaacaatttttaaaatacctttatacttttccaacatgatttctagtgatgatgtgatattctaatcataatgtgttttaaaataccttttcagttatttttaaatgaatactgtaaaataccctgacacataagttttgtgcacatctttattagcctaagttctcagtcaaaggcattcctatttttattgcttcttaataccactggcaaatgttctttaacaatgcaacaagttaatctcctaccatcattgtatgagaagatcttcattcatactagttagcatcattaatttttttgttttgatgattcgattagtgaaaaatggctcctccatgttcgttttgctcttcattttattaatttggcattaatgttatttggtataaatttttatacagttatttcatgtgatttgttttctcaattagattataaattccttacagataaaaatttggtctaatgcttccatctcccctacagaggctttcacaatgtaaagactatatgcccttaatagctatttggcaacagattcatttaccatgaggtgagccctttaaattattgagtttgaaatgttcccttttaaggttagccagatatgaaactaactgctctctttctaccacttagtcttctcttctgtaggtgtgacgtgaggcctggctagacaaagggatgtccaaagaggagggacaggacaactatttcatgcaggaactattaggaacaaggcacttttagtttgaatgatatatttgtgtaacttaggcactttacttccatcttttgagaaaatgtcataataggctgattgtgttaaatcaaaactttatccctatctgttgtaaaatgatgcagtaaagagacaaaacaatgacatatatgaagaaaagtctcctctgtgatgtgtgcaattgtgtatctcatcatcagtatgcctgcatttagtagctctgtagaagcaccatgatgtgtcataccccctgccaggtgatgggggtccgctgaaggaaatgttgagtccatcagagaagtcagccatgcaggtggacaattatattataaagtgatggatgcaatcgtataagtattatatgggtgtggttgaacacagagaagctagcaacaaacactatttggttcttgaaagaatagcaggagttttccaatcatggataagggatggaaagataagggaaggtgacaatttcagaaagagagaagagcatgtacaagattagaaaactagggaaggaggccaggagaagttagcaaggttggggttgcgtgttgaacaacaagtctagagaggtgaacttagaataggttggtaaggttgttgtatgctaaattaataagtttggatttcattttttagataatagaagcaatatagagatttatttgttcaggaagtcagtgttgttggtagaatggagtacaagctggagactgactgagaactggcagccgagtaagtaggccattggaatggttaaaaagaagaaagctgcattttttcagctagggtagtagcaattcagacagaagacctttcttatatataacctctgaaatttagtgacagttggaatttgatggcagctgtaagtggagggcaacaaagaaataacttttagtaaaaaaatgaatggatgtagagttgacttaagtcttttgtttgccagattccaaagttgggatttccatcctgtctgatgactgacctcagaatttagactgatagaaattaccatgttaaacaagaagtcaacaaatgctactggtgtggcctgttaccaaggtaagcagagtaagttagtctgggatttgcttaaatgtcttcttatcagaaaactttttctcggtaccaagtagcagcctcatcaccatccattccatcctgtccccctacccagctttatttttccatcctaactcattgccacatgacatcatatctatttcctcttttattttctctctccctgcaccaaaaagtcaactttagcaggaacagacgactttcttctctattgcatttccagacccagaataatgtctggtacagagtagtcaataagaaatatttgttgaatgttgagtgattatttgccatgcagtgacctagtttttattccacagaactaaagctgtgaagtttccaggtttgacttaaactccaatggattctctgaatggtaatttaccacctgcctgagattgtgtgatatgttgagtacctgatatctatccatctctttctcatctgtccccctaccaatactcatttcagctgcacttctcattattggtgaacagcatgctatattcccaagttgctcagatcagaaacttggagctaatttttgacccccatcacatttgtacctttatttagttgccttacagcttttcacttgttctctcctgaattggcactttattgcttaaaccatcatcctgagattttctgatctctctctatttaattcctcactgtggttgtccatcctgtattgcagaatagcatttctcaaatgttgttttcatgatattttcagagacttcttgttgcttaagaagaataacttgaacttttcagtttaaaattctagtctgttcttcaagttgctctctatttcttattaaactatcttgatattttcccagcatttctcacaatcggtcccaaacttttgcagatatatattagtatatatgtaaagatgcacactatagtgtctaatttactcatttctaaagcatataatcatagttaaaaatatagaaatcatgccatcatatgcaatcttaattactatatgactaattaaaagaccacctttggataaaaacatttctcaattattttacatgaacttcaaaaaccttttttagcacatttcatcttagttgtgaagcaaatacatttcacatttctgagggaatttgtcatgaatttaggcttgaggtaaaaaggttttgggaaaggagggcattctaaggagtaagatagatatgtaaaggagtaattattataaaatataaatgcaatgatataggcacaaaacattctctaacacacacacacacacacacagacttactagcattcttcaaatagtacaaagaatgaaatacattgaacccacattcttacttcatttatcacattttatgctaagagcagagtgaaaataatataaactaaaaattctaacaaaaatctacttaattaagtcacaaaacaatccagtcagcagaggacactcacctagaaaatgtagaaacaagcaaatgtacaccagtttgtttcttcctaaatagacatcagtgagccatctgacaaacacaggggtaagtattgaagttccaataaaacacaagtttaagatggctgcttggcaattgtgatagccaagcttgatagtgcaaaaggggatcatgttgcagacgacttcaaagaacgtgaacctctcacacagctccaccagaagcaagcagattccaacctgaatttttttcacagagtgtgaggaacacaaatcgccaatatgtcttacagttttctccttctcaatgctgtgatataagtgtactttctcatcagttatggtaaagcctgtaacagacatgactaccctccttgaacaaaacttatgttagtggtttgaacttggtgatattttgagccccatccctctgatgaaaaaaataagaacgttgctttgaatttcacatctccatgctagaatttcataaggtttgttttttgcacatggacgttgttccttttgatgatccaagagcatgagtatttaaatgttcacagtagctcagtgtacccaaatctgatttgtttgcttaattacttagcggctaaattaggatcgtcctccaaaattgtattgaattacatgaatccagttgcaaacatgtggaaactcatctgcctcatactgataaaggtttaaatattgaggcagaagaagcaggttttcgggagaatttgagcactagatcaagaaataatttgagtctaataatttctgatactttaattaaacaagccagaacagtaccaagagataaagcgcaaaaggaaatctgttttgaagggcacgatatcttatcattattacatttcttgttatttttggttggaattctgataagaaacttaattaggtaacaaaagtgctagtacatttaggtaacaagcagagtttacaagaaagtaatttaagtgcactaatgaaaggagaaaatattaaacgaaaccctgcttccttttagttgaccccatgcttgtagaacagcctctcagaggaaatcagaatcaaaaggtgctatttaactcctttattattaatcagtagtcagggatacagcaaccagcctacacaggctttggggaatattggatctggtatcaccctgacccttcagctgggtgaatgggtgttagcattctattttggaaagcaggagggccaattaagctaaaaaagcagcagtgaaagagaacaccttaacatttagtggcttagctgcaaggacataggaagaaaagggaccggaactattgggtcaaagtcataataattcaacacttgagtataggaatgttattttcatgctgtagtcaaaacctaaagaccaatagggacttttgactctggttatcatcttttggttgtgagagactgggggcaaaatactctgttttgaccccttctaatagcctcattgtaatggtagctatttgtctctgctcagcattgctactttggtaacgatgccctaaatttcctttgtgtaaattgatcatgcaatttatgatccaaacttggacagttttgtgcaggtgaaaagtgatgctatttatggttactccccaaaaaaaaaaaacagttataaactgggactgtccagggcaacactctaacatgtgttcaccctacctttggagaatgactcctatctattacctgagatcatggtggggctgttgatcagcatatgccttttcttctaaccaagtgggtcaacacccggtctaagatagtccttttacttttctcctgtggaattttaatcttgagtggaatgacttaagaatgggcatggtggcagctgagttattcagatggcagtgtattagtctgttttcatgctgctaataaagacatatccgagactggataattataaaggaaagaggtttaatggacctacagtttcacctggctggggtggcctcacaatcatgacggaaggcaaaaggcattatcttacatggcagcaggcaagagagaaaaatcgtagccaagcgaaaagggaaaccccttataaaaccatcagatctagtgagacttattcactaccatgagaacagtatgggggaaactgcctccatgatgaaaatacctcccactaggtccctccacaatacttgggaattatgggagttacaattcaagatgagacttgggtggggacacagtcaaatcatatcagcagtacccaaaagggactgcccatgaggccctgatgaactcagcacctccctgatactttttcttctggagctacgattactttttccttctgtagaaggctcaaagaattcccattaattttggtttgatttagttagccccatttggcttgtgtggcttacaaagaaccctaaatgatactttacttttttgtttaccctagatgcaagggcaagctgttctctagccactggctgatttctttagaccctgacaaagtgctccttcctaagcagagtagcactgctctttcccagggcctgatgatgatcccatctggattgtttggctcctctctgtatacttgctcaagatcaggctccatttgcatttgagcctgatcttgagcaagtatacagagaggagccaaacaattcagactggccatcagagaaatgcaaatcaaaaccacagtgaaatctcacaccagttagaatggtgatcattaaaaagtcaggaaacaacaggtgctggagaggatgtggagaaataggaacacttttacactgttggtgggactgtaaactagttcaaccattgtggaagtctgtgtggtgattcctcaaggatctagaactagaaataccatttgacccagccatcccattactgggtatatacccaaaggattataaatctgctgctataaagacacatgcgcacgtatgtttcttgcggcacgattcacaatagcgaagacttggaaccaagccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacacactggggcctgttgtggggtggggggaggggggagggatagcattaggagatacacctaatgctaaatgacgagttaatgggtgcaccacaccaatatggcacatgtatacatatgtaacaaaacctgcacgttgtgcacatgtaccctaaaacttaaagtataaaaaaaaaaaaagcattacaaatcagcaagaaaaaaaaaaaaagatcaggctccaggtggtggtaacctgtggtttggggacacttgagttagtaagagcaacagcatttgccgtctttggaggggatatttggtaaccctccaagagagccacctatttagaaataaagtttattttagttatctgtaagggggaaaaatctgacttcaatagggacataatagttagccaataggatattcatttaagtgggagttaggagaactaagttatattcctgcccctttatcacttaaggcaaatttcttcctgtctatgagcctattacattaactgcaaaatacaaacagtaaagcctgtctcagaagatcatttctgaggcttggtataaaaaacggcttatgaaatgtcaagaattgcacatggaaatgcctttgttattacttgcttctatattcctgcattttctagctactctaagcaatgagccataaagaaatgtcatggaaccacttccaaattccagtttgcacaagagacagacgttaggaggcctggattatgcggaatagagttgaagcaatgggaaaccaccgcctttttatttgtcacatccctactagttctcaatacaaagttcacagtgagctcaaaggacaagtagtaattccatttgagaataatacttggcagagtatattgaatgtcatcatctttatcaacagacttgggcccttgagtaagacttatgcatactttagttttatgcaaacccctcccccattccaacccaggcttgttctctgtccctgcctcttctctctgttataaagtgatatttttctcctttatagaggcagtgtatggaatgtacgtaagttggatacaatttggaaaacatctaaaaatagaagaaaaaccatggaagtttttgaagcattttgttggatgttttctccccatggcttgttctctttattagtagatttaacatatttaaattgtataattgtatacaattattgttcaataaattttctaccccatttgtaggtactgttaaaaagcattttaacctgccattatgaactctttgtaaacatagttttttatggttgcattaatggagacatagtttacttaactattcttccatcgttggttagttatatttgtttcagattggttataagccagcctttgtcaaacgtttgaccatgaacccacagttgagagaaaaaaaacctttataaataatgctgaaatgaatatttgtgcataaggctttccccattccctgattatatccttaggatggtttttcagaagcaatatcactgcctaaaagtatgagaaagtgtttcggtttcttgatatataatgcaaaattacaatataaacttcaggaattttttaaaattggaaagcctacattgtttttggaaggcaaagactatacttatcactagaattcttcattggaaagacaaagtcacaaatgaaacatagggagtaataatgttggccatacttgtacatgttggcaaatgcatcttatttaatagagaaaattagtcagatgctcatttcgtgagctgatgacatccatgtttttttctgaggacccagagcatggatacatcagatcttgtaaggattgtttagggaacacactaggaatgcaagccctgcttctaaggaggctatttttaaatattcaggattagaaagaatctctataagctacctccaatatgattataaattctgagaaaatggtggtgccttttaaaatgtttgtacagggggttgctgcaatgcttttccatttgtgtatgtattttcagaataacttttcataggtcctctaaacagtaagtatttttaagggaagagcttttctagctcagtaattctctgtaaatggtatacacaaaggtcatttgaagatatttattcttttaggcctatcgattccatttaattccattgactatgaggtttggtagctggtttgaaagcattgtcaagaacatgaggattggcttccctataatttaattgttaaaaatggcacatcagaggcttggagtgaaatttttgcttcattgttcaaggtgtaaagcagaaatgaaaaggtaacatattgggctttactttttgctttgtaaagaagatattctctgtgtaaacctctgctcgtccattataaagaggctatggcaattatatgatatctataccttgatccttctgtccagtgtgaaagagaattacttcagccctgatacggtttggctctttgttcccatccaaattttctgttgaattgtaatccccagtgctgggggagggacctgctgggaggtgattggatcatggaggtggtttccccttgcctttcctgtgacagtgagtgagttctcatgagatcttatgctttaaaagtgtggcacttcccccttctctctctctctctgtctcctactctgtgatgggaagatgtgcttgcttccccttcaccttctgccatgattgtaagtttcctgaggcctcccactcatgcttcctgttaagcccgcagaactgtgggtcagttaaatctcttttctccataaattacccagtctcaggtagttttttatagcagtgtgaaaatggactaatgcaagcccctagcagaaaataacttatatagtcccaagaatatataagatattcaattctctaatatagtgtgtttttttcctttttctggggacaattaagaatgaagggtatttttctcctatttttccctccacactatgcaatgaccattacaaaccttgctattttgttgaattctacatgcaagataaatcagtataaagtaagtaaagtgggaatgagtcatcacatgaacaccataatggtttattttatgtatcaacttggctgggcaatagggcccagatatttggtcaaatattattctggatgattctgtgtgtttttggatgaaatttgcatttaagtgagtggactttgagtaaagtagattgcctcatctaattgattgaaggcctgaatagaacaagaggctgaggctgagcatacccccgctttcagcaagagggaattctccagcagactgcaaacttcctttgcaacatcagttctacctggtttcctagcagactgcctttggactcaactgccgctctttcctgaatctccatactgtcaaactcacatcagattttggacttgccaagcctccacaatcacatgagccaattccttaaaatccattgatatatagacacaagcatatcctattggttgtttctctggagaatacgaatatagacactgtccatatcatccctattgttcattctgttcattcttttttttctctatttgatcacaaaggaaaaaggatttaaatacaacactggtagctttcacattgatgtgtggaattgagacttcttggagtttttggtaggtgggtacacacttccacctagctttcatgtcgaaaattcaaactcatcctgttccaagcttaactcatcatcttcttgcctgatcctactcctctttttccttctcttaatggttcatggcatcaccacttatccacatattcaaggtaaaaaactgagatggcctaggctctttcttcacttctttgcctattatatttacctttttcaggaaaatatttattgggtccctaacatgtgctaggctattttatacttggtggtggtggggaggggcagtgctgtcagttcaacatttttaatgttttacaaatccatcctttttctttgccttctactctgctgtagtttgagtcctttagcggtctcctttgcactgctgcctcaggcactgcttccatctttctcgtaccttagtcacttgtacatcattttcatcagtttgccctagctgcctacctcttgcccctctgactggcctgatttttgccatatgttatactgttttctttttttgccttatttcctaaatagtgttatttaaaatggcttacttttaaaaatcaagtaagtttatttaacaaggaaacttttattttaggtgcgggggtacatctgcaggtttgctacctggccatattgcatgatgctggggtttggggtacaaatgagcccatcaccttggtagtgagcatagtacgcaatagtttttcaatccttgccttctccctcccactccccagtagtccccggtttctattgttgctatctttatatccatgagtacccagtgtttagctcccacttacaagcgagaacacacagtatatggttttctgtttctgtgttaatttgcttgggataatggcctctagctatatccatgttattgcaaaggacatgctctcattattattttttatttttattttttcccaagatgaagtcttgctgtgtcgcttgggctggagtgcagtggtgctatctcggctcactgcaacctcggcctcctgggctcaagcagttctcctgcctcagcctccctagtagctgggattataggcatgcaccaccacgcccagctaatttttgtatttttagtggagatggggtttcaccatgttggccagactggtcttaaactcctgacctcaagtgatccacctgcctcagcctcccaagctctcattctttattgtgatttcatagttccaaggtatatatgtaccacattttctttattcactctactgttgatgggcacctagactgattccatgtctttgctattgtggatagtgttgtgatgaacaggtgagggcatttgtcttttcggtagaaagatttggtttctttcagatatatacccagtaatgagattgctggattgaatagtagttctaagttgtttgaagaatctccaaactgctctccacaatggctgaatgaatttacattcccaccagcagtgtctaagcattcccttttctccacagcctcaccagcatctgttgtttttttgactttttaataatagccattctgactcatgtgagatagctcattgtggttttgatttacgtttagctgacgattagtgatgagcatttttaatgttttttttgggggggccacttgtatgtcttcttttgagaagtatctgttcatgtctttttgccttttctttaatggggttgtttgttttctgcttgttcagttgcttaagttccttatagattctggatactagacctttgtcagatgcgtagtttgagaatattttctcctattctgtaggttgtctgtttactgtgttgacagtttattttgctgtgcagaagatctttggtttaattaggtcccaattgtcaatttttgtttttgttgcaattgcttttgaggacttagtcataaattctttcccaaggctgatgcctagaatagtgtttcctaggttttcttctaagattcttttagtttgaggtcttaaatttaaatctttaacccatcttcagttaatttttaatatagtgaattgtaggggtctagtttcatgcttcttcatatggccagccagttatcccagcaccatttgttgaatagggtgttgtttccccattgcttatttttgttgacttaattgaacatcaacaaaggtggttgtaggtgtgtagcttcatttctgggctctctattctgttccaatggtctatgtatctgtttttatactaatgccatgatataaaagcctgtgccatgctgtttttgttactgcaggcttatagtatagtttgaagtcaggcttatagtatagtttgaagtcaggtaatatggtgcctccagttttgttctttttgcttaggtttgctttggatattcagtctctttttggttccatatgaattttagaatagtttttttttggttctgtgaaaaatgatgctgatagtttgatagaaatagcattgaatctgtagattgctttgggcagtatggctattttaacaatgttgattctttcaaaccatgagcatagaatgatttttcatttgtttgtgtcatctgtgataccttttagcagtgttttatagttctacttgtagagatctttcacctcaacaatgaaactttaatttactatcataaatgaaattacttgccataaatggaaggtaacgataaagaaaataatactacttaaaaataattgttaacatttactaactgcttttctttggccaggctgttctaagaatgaattcatttatctttgaaactatcttatgaggaagataccatttttatgagccccatcttaccattatggaaactgaggcacagaatgggaataacttattcaagatcagttacaagtagtagagcagggacttaaatttaagtgacctgatgccaccacctccactcaacatatgctttttcctttatataacaaaaaaaattaaaagatagtacataaacaaccacttttcttactgcaggattctacattatctaatgcccaaaccacatatcacttaaaatcatttcaatttccaagatattgggaaacacttttctatttaatcctccctaaacctccagagattttttttttgtttaatctaaacttgttcaatatgctcccctgcttacagtctgtaaataatccctttaaactgtgagatcaagttagaaattctttgctggcacaaaaggccctttatgatcaagttcctgccttgtgataagagtcttcccttgctgttctgccatggagctggataacatgctcacagtcccaggactatgccatgttcttttaccttgtcttggtttttcacatgctatttcttgttcttgggacactttcattttccattcactttgggaacttctcttcattctttaaacttcagcataaatatcacgtctcagtaaatgtttctttgattctcaaagatagtctc

SEQ ID NO: 313 - DNA, 101607 bp, Homo sapiens
aaagatagttttctaattcttactgttcaattcagattcttcacagatgcgtataaaaataaaaacatatttaaatatcctgccaatttgtgcaatatataatgtagacaaacttcattggcttcttcagttagtgaaggagacctgcattaattaaaccatccaatgaaatagagcagaaatcattttaatattgggtagaaaaatcaagaatgcattgctcataaaaaaaaaaattcttaccctgagttcagttccgtctgctagattgtaattaaaggtgacaccaagttcaaaaacaacttcaatgtttcgaaaagtgcttgattctttgactgtgaatttatttccttcttgtgtaattgtcagcttcaaattgtcatgagctgcaagcttccttttcactatattaacacctgtaaaaggtaagacaatggagaaaataaagtcaaatcccataggaagtgtttatttttccaagttatgttttgtttgtttattttgagggtgggaagaaaactcggtagcattgcctttgcacaagaacattcagattgcttctacagaagttcaggttcaatcagatcaagagaactgattaaagttgtttttccataacttgagaaaaattaagtagagtacagaattatagaatcttagagctgagcaaccttaataagattaacaaactgttcatttcagtgttaagtaaatcaaattctagaaatatcaaatgaaggattaaaatgtatattcatatatttataaggaagcacatctttaattccacatatacagtattcttttttcttaaatgcccctttgtttttcttagtggctttaacattttgaactttatagttctatttgcttcttgtggcatttctttctgacacaaaaatgagaaaattagcaaatattaagccaaaatcactataagaatctacaacttttataaatttaaacttagagttcctaaactgtaagctataattgatgcagatttttcttttaggggaatgacacaaatttgtttgcctatcttgtatagtatatgggctgccagagtattggtatcaaattataaatcagttaaattaaacgccctggagaaaactacacagcttctcaagattattccaaaacttttttaagttagaagaaatcagaattaaatctaacttattcagcgctataaattttaagagaaccttttccattactttcttatatggtctttgtttttccatctcctagaatttaacattttcagatctggaagttatcattacacgctgccattttcttactgtaaacaacaaaaaaagtcatttttcagttaaagagggaaggaaacatttctggatctttttggtgtgtttcagagaacagcactcaaagaatcttttcttccattagtgagatagtggattcttcctaatgtaagaagggagaatatggtttccctcctctgaacatcttctggatcctctctaccacatcaggagctatctgtaagctatctgtaatctcctagagatttaggagttagaaagaaaaatgtttgtaagaaagcaaagaatgagccacaaagaaataaagtctttacccattttttccatgaacttgtcatagttttcactccggtctaccttccaagtgctgtcaaacgccatgatttcagttgagtcagcctctaggcagctagagattcaggtctgtccttgggcgagaatttattatatttcttatcttagaaccaacttcatactgtgatgtggaagcttaaagttcaggaaatcacctaactatgtcaagcaattaattaattcttattaattaattcttaattctcgttctgtacattcctgagatcttctgaaattcaactgaattaaaacatgagaagcatacctattctgtcttaaattacagtttgtgggcatacttatttcaagaattagaatgcatgccgtctgaagattgtttttctaagttcaaagtgcagactatgttggaggtaatataatttatagcatatatcaaataacatctgggaaatgagaccatgacctttccctttttcacaacagcaattatcttgtaaagtaagactttatgatgaaatacagttgaaaagttaaagttaataagattcgttttctaatatgtctttttgcattgtgtttagcattgccaggagtttggataaatatcctggcactttgtagggtgcatgacacacaataagtgctcattgatttttgtcttgatcctgaatggtgataggccactgagcaaaaattcaagaggtacaaatgaggctggatggtgtaaaaacttgcataaaagaaagaatgagctttaaacatctgccatgtgcagagagaacaaaatccagttttagctgtgccattaattaaaaccactccttcattttactctcaatgcctctcatccccaaacccagtagagtcagaagccacagctcaattatgtatgtagggtcagggtatagagggtagctagaaaggtacaaagaaaaggtcaccatatctctcctttccctacttcaggctgccagccaggaacaggccaagcttggggaggaaacttggtgtgaagtaaagagttttaattactagtcttaagatgtttattactaaaatgagtctattattgtgactgaatgtgaccagataacatcttattaactaagggtcaggaaagaagctctagggcttgcccaagatattacttagggtcaagggaagataaatctaacagatttgaacagaactttggggaacagaatcccagtttttaaattttgatattattttatattttgatttttaaaaatcttttaaacatgttagatattgtttgattttttatttcgagttgcccactttttattttattaagtaagcactttaaaaagcaaactattttctactagctctattatttcattaaaaaagaaaaagaggccgggcgcggtggctcgcgcctgtaatcccagcactttgggaggccgaggcgggcggatcacgaggtcaggagatcgagaccatcctggctaacacggtgaaaccccgtctctactaaaaatgcaaaaaaaattagccgggcgtggtggtgggcgcctgtagtcccagctgctcgggaggctgaggcaggagaatggcgtgaacccgggaggcggagcttgcagtgagccgagatcgtgccactgcactccagcctgggcgacagagcgagactccgtctcaaaaaacaaaaaaacaaaaaaacaaaaaaacaaaaaacaaaaaaaaacaaaaaagaaaaagagttgcctggtgcagtggttcttgcctgtaatcccagctattagagaggctgaggcaggagaatcacttcaggccaggagttcgaaaccagcagtttgaggccagcctaagcaacatagggagagcctggctgtaacaattataataaaataaattagccaggtgtaatggcacatgcctgtagtcccagctacttgggaggctaaggcgggaagatctcttgatcccaggagttggagattgcaatgagttgtgatcatgccagtacactccagcctgggcaacagagagatcccatctctaaaaaataaataattttttaaatgtcaaaaaaggaaagaaaacacatatacacactcatgagttggggacaaaggtcataatgggaagtcctttacattcataatttagctttactttcaaaattaggtacattgtgattttttaatcttttttcaaagaattaaaactgtatcacttgggagctatcaacctaatacactttctttctttttttattacactttaagttttagggcacatgtgcacaacgtgcaggtttgttacatatgtacacatgtgccatgttggtgtgctgcacccattaactcgtcatttaacattaggtatacctcctaatgctatccctaccccctccccccaccccataacaggccccggtgtgtgatgttccccttcctgtgtctaagtgttctcattgttcaattcccacctataagtgagaacatgcggtctttggttttttgtccttgcgatagtttgctgagaatgatggcttccagcttcatccatgtccctacaaaggacatggactcatcattttttatggctgcatagtattccatggtgtatatgtgccacattttcttaatccagtctatcattgttggacatttgggttggttccaagtctttgctattgtgaatagtgcccctataaacatatgtgtgcatgtgtctttatagcagcatgttttataatcctttggttatatacccagtaatgggatggctgggtcaaatggtatttctagttctagatccctgaggaatcgccacactgacttccacaagggttgaactagtttacagtcccctcaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccacttgttgatgtggttgtttatttttttcctgtaaatttgtttgagttcattgtagattctggatattagccctttgtcagatgagtagattgcaaaaattttcgcccattctgtaggttgcctgttcaccctgatggtagtttcttttgctgtgcagaagctctttagtttaattagatctcatttgtcaattttggcttttgttgccattgcttttggtgtttttagtcatgaagtacttgcccatgcctatgtcctgaatggtattgcctaggttttcttctagggtttttgtggttttaggtctaacatttaagtctttaatctatcttgaattaatttttgtataaggtgtaaggaagggatccagtttcagctttctacatatggctagccagttttcccagcaccatttattaaacagggaatcctttctccatttcttgtttttgtcaggtttgtcaaagatcagatcgttgtagataagcagcattatttctgagggctctgttctgttccattggtctatatctctattttggtaccagtactatgctgttttggttactgtagccttgtagtatagtttgaagtcaggtagcgtgatgcctccagctttgttcttttggcttaggattgacttggcaatgtgggcttttttggttccatatgaactttcaagtagttttttccaattctgtgaagaaagtcattggtagcttgatggggatggcattgaatctataaattactttgggaggatggccattttcacgatattgattcttcctacccatgagcatggaatgttcttccatttgtttgtatcctcttttatttcattgagcagtggtttgtagttctccttgaagacgtccttcatatcccatgtaagttggatttctgggtattttattctctttgaagcaattgtgaatgggacttcactcatgatttggctctctgtttgtctgttattggtgtataagaatgtttgtgatttttgcacattgattttgtatcctgagactttgctgaagttgcctatcagcttaaggagattttgggctgagacgatggggttttctagatatacaatcatgtcatctgcaaacagggacaatttgacttcctcttttcctagttgaatgtcctttatttccttctcctgcctgattgccctggccagaacttccaacactatgttgaataggagtggtgagagagggcatccctgtcttgtgccagttttgaaagggaatgcttccagtttttgcccattcagtatgatattggctgtgggtttatcatagatagctcttattattttgagatatgtcccatcaatacctaatatattgagagtttttagcatgaaggttgttgaattttgtcaaaggccttttctgcatctattgagataatcatgtggtttttgttgttggttctgtttatatgctggattacatttattgatttgtgtatgttgaaccagccttgcatcccagggatgaagcccacttgatcatggtggataaactttttgatgtgctgctggagttggtttgccagtattttattgaggatttttgcatcgatgttcatcagggatattggtctaaaatctctttttttgttgtgtctctgacaggctttggtatcaggatgatgctggcctcatgaaatgagttagggaggattccctctttttctattgtttggaatagtttcagaaggaatggtaccagctcctccttgtacctctggtagaatttggctgtgaatccatctggtcctggactttttttggttggtaagctattaattattgcctcaatttaggagcctgttactggtctattcagagattcaacttcttcctggtttagtcttgggaggatgcatgtgccgaggaatttatccatttcttctagattttctagtttatttgcgtagaggtgtttatagtattctctgatggtagtttgtatttctgtgggattggtggtggtatcccctttatcattttttattgcatccatttgattcttctctcttttcttctttattagtcttgctagtggtccatcaattttgttgatcttttcaaaaaaccagctccagaattcattgattttttgaagggttttttatgtctctattacactttcaacttggagggaagtagaaaactttgtttaaagctgaggactcaacagtctctcaggtagttgactggctgtggtgatttgtgaactcagaagcctatggataatgaatccaatctttatttctaggtcagaaaactacatgtatctggtcactgaaataaacgtatggtagagtgaaaagaacatgtgttttagaaacaagacccattgacttgggtttcagtgctgactaaacatacattactctgcagaatcttcgtcacattacttactcaatctctctgagcctcagttttctcatcaataaaatgaagacaataataatacctgatatgtatattttatgaacaaattacataaagcacccacctgaaacaacttatagataacaggtcctcaacaaacctttgtttctctcctaattctctgagaaaggaaatctgggagcaataacaatgttttagaagcatcctaggtctcaaaccagtgatattttgttaagaaaacccatgtcattctggtgtttatgagaaagtcacctaaaagttacttaggtattttatgatttgcactagtgatcaacttgggactggctatgccttggatttgcctgttaaggatagtattgcactgtatcaccctctgggaatacatgtttccactatgtgatctcatagcaattgaaattaaagtgtctgattcaagaaggaaggttggcaggaagaaactaaagtggcttcttaccattttcaccatgacctaacccgtgtctcatggccattttaagcttcgcagaaggatccaaataggataaatataaagcaaatagcccttgggctcacagaaggctggtaacaaaataagcatgttaaactttcagtcttaaatttatcagtggcagtgacctaatttaaccttaggtaggacatcctgttatctctgttaagtagcatcattagtttttttttttattaatgctcagattacatttttaacattacacttttccttctccagctacccaattctgtagcccctcggtttttatcacttatctgtagtccatctagaaaataatatacggaacttagggaccaatttctctacagaccttttctactgatgatatgattgagccaaccagctaagggcagacccagccctttcttttccattttgataatattaaaagacttgagtattgcagtttgggggtcgtgagtggactaagtatatgtgtgcatgtggatgcagatgctatggaggtagagctatagctgtaccctctctctctgggctctacagtcaacatcacccacggagtggtctggaagaagtggaaatcagcagaaactcctgtggatccctattccattcctccaagggaaagtacaaaccacaatccttagcatggtttacaaagccactacttaaatctccagttgatttttccattccctactgtgtactgcaagatctagatctattaaacttcttgcagtccccaatcccctgaatgtccatgcctctgttgcttcaggtctcagcttggatgctgattgctcaaagattcttgcctcgaactatcaagagtgagtcaggcaacccttcttctcccaggtgtaatgaccttctaaaggtctcagagtagctcataaaagacaagaacagctgattcatgataaccaaaggaatattgttatcatgaagcccagcgacatcattagcaagggcaataggatgttaaaatctcatctcaaaggaataatgttttagagatcacaaaaatccttttaccccattgtataatagaagggagtgtttttgtagagtattattctttatatatccttattgtgaaatagcattttaaggcatattctaatcatctcagaatttatgtatcctattttttgatcttaagttgtttagctttttatatgtcaaaaaatagaggtctctatcagaaatatatgagagaaggatttgagggacagatagaaggagtaacaggaaagtcttaaggttactgtcaaatccctagcagtgaatggggaatgagagagaattctgaagtttgccgacaaagcttatttcattctgttttaatgattagcctctaaattttagaaatattatgacctatttaattaggttttagattttgtatctgggatgactggttggttttctttcaaagagattataaatgtacagcagtgtgcaggagaatgtctaccatagagtggtgagtgtggcttgctaattctcattaataacaaaacagcctaagaaaacagccattttagaagattaatgtgtccattgaatgatcttgcatgaagaatttatgactccttcttagtctgggtttatcccagaaatgatgagccactttcaagcaatgtagataagaggttgttcatctcctatgcccctcataccacaggtagaaaaagatggatttgcattatcacagctccctactgccacaaccaaaccattatgtttctgcctttttcaaaacaaaatattgttttctgagaccactcccatttggctgtggtccagcctacttcatcattgttatctaccatccactccctctagcattatcatctaccatctatcactgaaaatcttggtacttggctcaccatcatctgtgtcctgccatcatcctgggtgacctcaaagtccatgtggataagccacttgtcagtctggcttcacagctccttaaccccctcatatctaatgacctttacttcttttatgctttatctacttacatccagggctgtgtcctgtgatctgtcatcattaaagctgctccttctgttgtatttaacatgccactctgaccacaactttccatgctctcagctcctttattttattctgcacattagttattggctgggagagaaattttcttagttgttgcctctatttcctctcaagttaaagccccctcctgtttgtttaaattctttattcaattgatatcctgtttccaattttaaaactctctcactttttcctgcactgacctaggtgctattaggcatgcatggtttctagtcttagagtaattatcagcactccctggaatgacttctgtgtatttcaatcagcttcctccacatttgcgacaatggctgtgcctttagtcaccctcctgtagccttttacctttgccctcagcagacaacctgcacattacttcacagaggaaagaaaccatcaaacaattccctcaatttatgccttctcaattacaaagttacctactattactttctttactcctattaattgttacactcacgtatgaggttgtttttgcattgctataaagaaatacctgagactgggtaatttataaagaaaagaggtttaatttgctcatgattatgcaggctatacaggaagcatggtggcatgtgcttctggggaggcctcaggaagcttccgatcatggtggaaggcaaagggggagctggcacatcacatggcaaaagcaagcgagagggggaaggtgccacatacttttaaatgaccagatctcgtgaaaactcaccattgcgagtacagtaccaacggaatggtaaaccattcatgagaaatctgcccccttgagccaatcacctcccaccaggcccaacctccaacattggggattacatttcaacatgagatttgggtggggacaacatcaaaccatgtcaacccacttactctttcaatgtgtattttaattcctcctatggtctaggcactgtgccacattataaacagaaaaatagacacagtttcagtcaagggaaagcaaggcttgaaattgcaatagtgtgtcacatgtaaagttttttttttttctccctgtttcttcctatcaccctctctttcttttttatttatttgcttatttggatgaggtgggatgtgaagacgatcaagtctctcccattataagacataaagatacctaaattctgttgacatttctagaacctactcaatctttctccttctctttgtagccaggcttcttgaaaaaataatttgtactttttgtcttcacatgcttatccttcattaatacctcaatctactgcaacatggctttcatattcaccagtccactgaaactactcactaaggtcatagatgaatttttagttgccaaacccagtgcacatcttggcccttattttatgtcattgtagcattgcataccattgactcttcttcttcttcttcttctttttaatttctccttttcttttgctgacttttttctttcttgacattcctcttctctggatacttcttttcaggctcttccataagcaacttttccttaactgacagataccttaaatgttggaattgcatctttaaatcactttttattccatacaatctacctcgatcatctttttcattctcatgtcttaatgttcaaaccatatgtctctaaaatttagagatccagcccagacatctttcctactgggtaggaaaagtgctgtaatcccagcactttgggaggccgaagtgggcagatcacctgaggttgcaagttcaagaccagcctggccaacatggcgaaatcccgtctctactacaaatacaaaaattagctaggcatggtgtgcctgtaatcctagctacttgggaggctgtggcttctcattcagaagcagaacagaaaatgatgcataatgtctaaaactatagatgtgagatatatatacatatatattaggaataactagttaagtgagaggtaaaggtttggggtttgcttaattttagaggttatattcatgttgagtacctgtttcatggcttcatgtaccatccatgtaaccagtgattcccacatttctgcctccagctaaacttttctctccaactctagactccaatatttatctggtgatttgatgccttcacttggatgtctgatgttttaaaaccaacatgtataaaaacagctcttgatctctgcctatctcaaacagtttccacctgcagccttcttcatctcaatgaacagaaactcagtcctttctcttgttcaggccaaaagacttggagtcattctgactttctttgacatgtcatatggttgtttcaacagatctcgttggctgtatcttcaaaatgtccagaacccagccagttttcatcacctccactgcaactatcctccctaagccactgtcatctcttagtgaattattgtaatatcctgctaaatagttgcccccttttcatctttgacccgtgtagagtgttctcaaccagcagccaaagtggtctttggaaaacataagtcggattgtgtcactcttttgcagtgtctcctcatttcactcaaagtgaaaggccttaggatatcctaaaaggcccattgtgatctgcactcccctctcctgctcagccccagccttttgccaaagctgcaagggccgtagttcctggaacataccaggtacatattggcctttgctgtagttactacttccatccggacgttcccacaccccctagtcttttgttcaaatctcagttctcaactaggccttccctgagcaccctatttactgcagattacacccctccaccatccccacatttctcactctcttcaccctgccctgctttttctatttccataacaccatttcctaacatgccagttgcttccctgacttgtgttgtcttcccctttcccctcaccagactccaagctctatgaggacagggatctttgttttattcactgatatattccaagtgccttaagagtagcgattggtacatggttggtactaaaaaaaaattgctgaatgaattaatgaatgatatttaaaaatgaatcatccttttagaaatgggtcaggaaaggaagagaaatgcagcaattaataatgattttgcttgttctttgatatatatacaagtatgatatttttagacttcattttttaagcctggttaaaaaattggtgccctgattttttatgtaatagctttattgaggtataatttacataccataaatccacccattataattgtgcaatctaatgatttttattaaatttataaagttttataaccattgcttcaaaaagttgtcttgtgttcattaatttgcagttaattcttgcccccctcctcatgggaccctgatttttttggttaattttatggtcctaagtcttgaaagaataattcatgtagcaatgctagtatagccttgtgtgcttaaaaaatgtaaatttaaatattcactgttcagtgtaggaaatggtattgaaatattagtgaaaagaacaagatggagaatcagactggccatactcttacccagccctaccatttacaccgttactcaaactattctcttcatctgttaaatggggataataatagtaatttgctcagagagttgttgtgaggattaaccaaataatgaaagtaaactgctcagcacagggctgccatatagtaaatacccaataactattaactaacatgattaatctcaattaatctcttgttagtataggtcaaaatatatggggttaatatatcctggcaggtagagagcaaaatttaaatcagattctaagtttctgaagtttgtgtaaaatatgatcctgctctgtcttggtttgttaataacgtacgactatagaagtttgtaaaagcaagttaatttccaatggagaagatcatttctcaacagttttatttggagatatctgctaagccacttctactgaatattctgtgttgatctttgacggaactttgacaccagggaggtaattacccactttttattgaaaccatagtgtccatcagaaactgttctcaattgtcttaaccttacattgggatattctgttcatgagacttcctctaaataagtaggggaaggagacattcattgtctctcttgtagcttgataagctgaactaaatgatctttaataagatctttttctgtttttgttcttttcttttatgtacaggtgcacaaagcagggtcatcagaagcctcttgattcaaaagatgataataccgaaaaacactgcccagtgacagtgaatccttggcatatgaagaaagctttcaaagtcatgaacgaattaagaaggtatcattatactaatgtacatgcaaccattggtttcgtccctttatttttcagttgtttgtagtgaatatataatcaaccttccattgttgctttttctggtacacagaacattaaaacctttttctgcaagttttttaaaggaaaagagcaaataatttatcagaagtgtggatggtgtggggctcctctattagtgtggtagccacttagccacatacagctagtctgatgagatagtttggaggtgaaaaatacacaggggatttctaaatgcaaaaaaaagaaatgtaaatattttattcatacttttaaatgtattgattccatgtagaaatgataatatactagatattttgagttaaaaagaatacagtaggccaggtgcggtgactcatgcctataatcccagcactttgagaggccagggcaggaggatcacttgaagccaggagtttgagaccagcctggtcaacacagtgagactctgtccctattttctttctgttaaagttaaaaataagagaatatattattgaaattaatttcttttgtttctttttacctttttaatgtgattactataaaattgtgacttgcgttatgtttatattggacagtgctggtctagggcttctaacttactgtggcaaagaatatggaaagaaacttttagagaaaaatgtaaccctttttttgtgggagtggtggtagttttggggggcagtgacctgcctgttgctgaggtaattctcaagtgtactaaggatcactgcaacttttaagtagtgttaaaagttgattgaaaaatgagtagctttttttaattaaaagggtaatatatgtattaagagtcttgcttttattttcttagcactttatgaaagatctgctttttcccaccattccctttgtgaaagtactctacgtatatctatctgaaatgctgaaagcctggctaagaagggattaaaccttccttaatctttctatgcttcctaaaagctctcccttttaggcccatcatttgtttgtttcttctttaattaaattagggattcaataaatatttatctgctaggtactgtaggtacaatggtgagcaagaacaaatatggttgccacccttgtgggcccatagctgactgcaggaagtaggcattcatcaaagaatcacaaaaataatttactgtaatgacagtaagtgctgcaaaggagggctgctggtgctagaaaggtggataacagtggtcaggaaaggctttcttgagaagacaggaataattatgctgatatctagaaggaaaagaagataaggggataaagtcaggatgggagtgaggagagggagaacagtgttccaggcattgggaatgcagtgccacaacttagggtaggaaggagctggcctcattggaggaactgacagtgttgctgcagtgcacatggcgatggaatcacacaggagaggcagctgagttggtaggaggggccattggactgaggtcctgaaattttggtcttaatcaagagttgccttgagagaaagccagtggagagtgttaagcaggagtgtgacctgatcagatttatattttgaacacactggctgctgggtaaagaatggattggagagagataagagaaagttaaactgaatattggatcatttgatttgctttctagtaccgctttgacaacattttcaaaatgtgggttttcacttattctttgggagaatatatagctggaataatccagcaagtctcagggtactgtttcaggtttttaatcctgttttgacagtaattattagaatgtaaaatgcattggttactaagtggaactgcaagaaaagtaggaaaaatagtctggttgttttaagactgggatctttaatggctcttttttctctttgagaagtctaaaaagactgacttttaataggactattcaaatgttctttttccccactcctatgggtggggcacgggtagccttggctttctgctggtgttaatgtgagtgggtctctgttgacctgggcatgactcactaaactgcagggaaggtaacaccaagtgctccttcccttggggtgaacgacctgagtttggggacagactctggtctcgagccagttattttacttgtttgagcctgactataaaatgagaggcatggacaagatggtgtctaaggttcagtgctgctctgacattctcagcctagagatgtttttcctgcttacctgcaagccctgtggtgtccttgcctggccctaggattatttataagctccagtcttcattcatctgtttgcccctttttggatgtgaactctataactgtgagatagtaccttcttgttctttgtgtggcaccctttcagcagctagtatgtcactgggctggtagttgatgctgattttcagaacaaagaatgacctttgaatagccagagtattggctgccaggtctacaacctggattgttttaatgaaagcgccaacaacaacagtatttttaaaaatggactgtcgttcgggttcatcagacctttttaaaaatgtcattcccttccacccttaaatcttatagccattttgagtaattctttttaaaaaaatctctgaagaggcctattccttgtacagctgaaaatcattaattatttcctgtccttgcatcaacttcctcttgcccagaaagggtagttgagagtgttttcctgacttctgggaagggagaacttccttgttctcaccactctgcccttgggctctaacctcaaagtggtacagcaacagctgtactccgaagaatgttaatgtgaacctttggctgatggaagcaaaattttaggagtaaaagtcactttcaattatggctgatgtaaggtgtggttgtgggaatgggggtaggaagacaggagttctgtaaggtttaagttacagaattaaaattgtttgatagaaaaagtacatgacattttattgatttcttaaactaattgtttttagacaggaggcccagagacctagctttatatcccagcctggtaagagcttgaatatcttgaaattatttggtttaaaaaccctgcagtcatatgtaaacaatgtattcaacaagtattggtgagcacctaatcagctaatatgcctgaaaggctatgtgggatccaaaaacagtatcagacttaggccatgccctttgagtgtctagagagctgctggacacatacagagaggaggatgaggcagtgaaaaagtgtgcaaatcatgggtgcccaaacggattctcatggggaaaattcacacagcccacagaggtgggcttcagttgggccttgatgggagtgcagcaggattcactgaggggatggagtgggaatgtctttcctggcatgattaattgcacaagtcagggagggaataaacatcatctgttggataaagtgaatcaagggttcatcctggggagtctgtgcagaaaaggttaggaagcaagagaagggcagaattgtggcaggcttaaatagtatgatgaattcggacttaatcctctgggcagtgggattcagtgaaggcttttgggaaacagagcatcatgctaagattaatgatgttggagttgtgaaaggacggcttttaggtcagcagtgcatctctggtgggaaattcagatcttaactctaaatttcccaagtgtggatgggggaaatttttcaaaacaccgacattttcaaaatcaacccaatagatcttcacagaatgcttataatgtgcaacacactgtattaggtctatagaggggacagagaagcagactgtaccccaggtaagtttttctttttctttttttcgagacaatctcactctgccacccaggctggaatgcagtggcgtgatctcagctcactgcaacctccaactcctgggttcaagcgattgtcccacctcagcctcccgagtagctgggattacaggtgcgtgccatcacacccagctaattttttatatttttagtagagacaggattttgccatgttggctaggctggcccagataagttttattgacaaaattagattgctagcttttggagaagaccaaagagcaactgttgaaaggtggcattttgtgtttaaaataaaaaaaaaaaaaaaaacctactgttttttaggctataggataagactgtacttgagctttaacaatttcaatgagtattagtggtgggggcacaacctattagctttatttacaaggaatgtaagtttgatccttaatatttaggagttgaaagtattcagtaaggatgaatcatatgaagcaattcaaatgttcacctttatatcctgtacaacccataaatattgagttgttcattcataacagcagttcttaacattccagaagatatttaagcaaaatagcctgatctgccctcttaaaggaatggttattgtgtttttcctccaggattttaggcatcatgggacctatatcactactaggattagattatctgttgtgcatccataaaaacatttgatttgtggctgttgaattttggctaaattgttattgtgtctattgtatgaattcatactttgttacttagatggcaagtgaattaaacagtgaacttaagggggtctccctttttcttcaggtatacctaagatattttgatacaggtatataatgtataataaccacattagagtaaatgggatatccatgacctcaagcatttatccttggtgttataaacaatccagttatactcttttagttatttttaaatgtatcattaaattgttattgactacagtcaccctattatgagacatattttacttttaagaagatagacaccgtgcattttaaaagcagtgacaggtttttctcagtcttaggaattcattcattttatatcagaagacccaaggatgccttagtgtgttcaggcatgtttcataccttttcaaagcagtttctttttttcctgagaaggaccaattttcatgatacaattttatttaggagatggagtgccttcctttattctgtgctatttgagttttacattaagcctatctaactcctgttcttttccctttagatttgagcttagaagccactttcattctgaagcttttccataaggttgagcctagcttctcctgtgtgtttccaaatatcccacacttgtcccatcttaaagtcatgggttcattttataatcacttatttccttgtctgtctccctcacatgactgtaaacttcatactgtcatggctgttaatcttgtttattttggtaagctcacacagtccttgataagtgaatgaataaatgcaaattttgctaaataacaacttatttataccattattttggaggccttcttttcctacagtttatccctcattagatttcaagtaataggaacataaacttagaaattcaccatggaagactttgcatatgggctgctaaaagaagtttttcttatttttagtgccagacttttcatttgtagctctctcactcaaaagtcattcagcttcttgtaagcatgcaaatttggaaagaggtaagggccagactcaatgtacacacactgatatacactcattgtgtacttagtgacacaaactagtaagagtttgttagctctctcatctctgaatgctgttttaaaatatgttattactgaagacagataaaaaattgaatactaaaactaagcatgtccttaatgtgtaaagtggctctgagacctaacccaggatgtggctgcataatattttagcagtgttttaaccttattagttaactaacatcaactaataagtcagtaaggccaagttaattatgtaagtgacagccagcaggtattatgttagaaggtttggatcaatgaataattgtaattgaagccaaatgtaattagttatgtgatttttgaggtgttcaggtgtaattccacttgtgttccatcttgaaactaaagcactaggagggattactgacaaaaggaaaataggcataaagatgcacttgactcatgtttgagttgtgttcaaatccccaggtcacgaaagagaaacctggattgctttattctagagagaccatgcatgctctgctgaccctgcttacctgcctccagagtttcttcgctcccacccttctctgtccccactcttcttggcccacagttccgcattctgctttgctgcttcaggtctccatgcgatagtacatcatgttctctttgggattcttttgctccttctcgatccagctaactcttacttgtttttagaactcagtttaaggccaatagctgcaggaagccctttctgatccccagtctgatttaaacgcagcccccccaccccaacctttccataacatctttattacggtgctttccactttatcctataatttttgcgttgccagttttttctggtggtcttcttaagggcagagatggtcttgcagtactttgttgaatgaatgaacaaactttgatttttaaaaatattctgtagaggtagtgcttaaaacccactaaatttggagcttttattagctatatatagaacttaaaaatactttctagtgtattgtatgtcaaaaaataaattgttattatttataatttatttactatttccctttcttgttttattcaaactttaacagatcttaaaacagtatagctttaggttttgtgtagtggtcaagaggctctggagttagcctgtggatttgaatcctggcactgcctctagttggaggactttaaccttggtttccccagctataaatttggggataaaaataataccttataacattgtggtgggcactaaatgaaataatacatgcaggtaaaactcttgcatagtaccttcctgaaaacactgctgacaccactgacttttccaccctagttatatgtgaacccatggaattcatagaattgcagaatggttttatattctcagagcagatggtaaactttgtcagttctctaaaatgatctggaggaattgtaaattagtgatactgtgccaccttttatgactccaatatgagacctgctttatgtctcatacagcatcatgagccattaaactggtaacacacgagccatactataatctaaatggcatagcagtctcatcagcaatgaggccctgggatgcagtcatcactgatgctggggtagtctttttttcttccatttctcctaaactggaaggagaatagttaccagtaggctctccaaaaagttttggcatgaactttatgggaacaagtttgcaagcagtatggacaggtggaaaacttcaaggacttcgtcaagctcatggaaaatgttgcttgtaagctactagaaaattacagaagtaggcaggccaactttttaggaaatagaacagtagaggagggtgccaagtgtgacctgcatgcactatgcacatagacataaattcagtgcttgggtatgtgaggtgtgcaagggacatttgctttcaccacacctgtttcagtcattcatagtatgactactagcaaggcaggttgtaggctttggagccttcttgcttattctagaataagcatcagcaacgttttctgttaaaaatattctatgacgttattaattacctggatagtatgatctggcaccacgtattgcatgtcaaaaatgctcaccacatgtttttagtgaattacaatggatgttttaaaattagagatacaataatatggttgctgaataatggttttgaggtaacaaaacgctttttttttttgaaacagagtctcactctgtcactggagtgtggtggtgcgatcttggctgaatgcaacctctgcatcttaggttcaagtgattcttgtgtctcagcctcctcagtagttgggatcacaggtgtggtctaccatgcctggctaatatttgtatttttaatagattctgggtttcgccatgttggccaggctggtctcaaacttctggcttcaagtgatccatccacctacctgtaggggtgggttgcccctacacacctgtgggtgtttctcgtaaggtgggacgagagatttggaaaagaaaacgacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggacggtcaggtctttcccttcccacgaggccatatttcagactatcacatggggagaaaccttggacaatacctggctttcctaggcagaggtccctgtggccttccgcagtttttgtgtccctgggtacttgagattagggagtggtgatgactcttaaggagcatgctgccttcaagcatctgtttaacaaagcacatcttgcaccgcccttaatccattcaactctgagttgacacagcacatgtttcagagagcacggggttgggggtaaggttatagattaacagaatctcaaggcagaagaatttttcttagtacataacaaaatggagtctcctatgtctacttctttctacacagacacagtaacaatctgatctctcttgcttttccccacactaccttggcctcccaaagtgttgggattataggcatgagccactgcacctggccaaagtgttttttaactttagatgtaatattttctggccttgaaggatgagatattttgcattggtaaaatgttgtgattaagttaagcttcaaatgctcaaagccttttaagcagcaagtgtaactgaatataattttaccattgcttgatgaactagggtcttttaagatttttttttttggggagggggcgggtatttgacccaatttagtttttggcatgtgttttttcttcatcttcatgtcagactacacctgccacttctgccgctacttcttattcagatagcctcttcttttgcagtccattgatggtttgctgccagtaattgcctttaggttgagaaatcaataatcaagtttgggaagatttctgtgtttttcaaaggcaggattcttagtgagggtccaaggcatgttgggcctttatcccagctgtcttctatgtacttcatgtttagggatcatgtcccaaaggatggctgttttttacattagtctccacttgatgaaagtgggctttactgtaatatttttgcataggatgttcaatacattcattgttgatatcatttaaattttttctctctgctttttacacagtcaaaatttactgtgcgatgtcacaattgtggcagaagacatggaaatttctgctcatagagtggtgctggccgcctgtagtccttattttcatgccatgtttacaggtatgaaatagtttagttatgggaattttaaaaaatgtattcagatctgtgcttttcttaccacattttcttttgttattaacattttacttttatgaaatgaagaattatagtggaagaaaatgttcttgctttgttccaaattcctcctcgtctttgtttttcattgttgggggtcagtaagcctatacataggtacgctcacaattttatgctcaactttctccctgtaagttatacttatgtgtattagttcctgccatttataatagctttttggcactttattattttgacaaaaggaaaccactttacattttttaaaatgatttttacatttgtttcatctagtgttacattgaagaaaaagatgtttatttaatatccttcatttggaaatataagaaaataaagcgatttatctacaagcttacattttgctttggcaactgtgaaaatatatagaatgattttagtacttctggaaaagaagtaatttatgtctgtcacacttgaatcccttactctcattcttttttaaaatatattgtacaaagaaatgaagtttttatctgttacatcaatgagtttataatcttagggtattggtatgccaaatagaaaatacaaatagaaatgtagttataccaaaaagcaaaaatacaaagctcttcttactttagaaactattaagtatttctggtgctactgttttactagatacttcaaggcatacaaaaacaatgtgaacatgcttcctgccccaaaagcatcctgtgtagctaggcagatggatgtgcaccctttaataggtaatagtgtatggaagatctgagtgctcacagcagtggtcagacgttgagggctgtgatgggcagcactgagagaaggatttccccagacctgatggattgaggggtttacacagatgaagatgagtgtagaagtcagatggagaagacggactgagtgaaaacttttctgggtgtcttgggagtagtgaggagaacagagccccgctcagttttcagccttttatgatcttgctgttccagaacagagttaaataatcaggaatgaagaaggatagcaggtgggttctgagccaagtttgggagggttgcctttcagctgagagctgaggttgatctgaaaagtcaatacctgtgaagtgagactagtcagatttttatgtcttggggttcactctagtctcttgatttacatcttatttattactgctggacacttttctagagagagagagtctctaaggcttgtaagagaaggattcgatctggaatgtgctgggctactttaggaattcccttgtaaagtgctgtccccttggtggccttccttcagatgacactgctgttgccacttacttgttggaactactgggtctttggaaaacttaatctgtgcttcagtttccccatctggaaaatgggaataataatattacccacatcctagagtttttgtaaagattaaatgagaacatatgtgtgaatttcttagcacttgacacatagaaaatgatcagttaattttgacagtaattattatggtcatcatcaccattcttttttactccaacttcctaaatttctttatattctgtacaagattggaaagctttaagctaggctcttttttttttttgataaatgttttattgtccacagagtgacaaaaatagagtgattaacttatacctgtaagatcaaggttagtttcctttcccctcaaaaggctttggagacttagtgtctccaaactccctgagccttagacatccagtgaaatggatgctaggtagagataggagagcttattatgtctttagctctcttttctgtttgctttataatctaaactgcattttggtttccctcttctgtttttgtctaatggttctctatgcttcatgatttagctgacatggtttatgaatatgtgagctttgcctaatgaagggaatgaggcattgaagacattctgattttctaagtatttatagtgtattacaactaactagtaggtaggtgcttttgcagttcaactggtttctgtctgagaatataccttttatgcttagtcaaattttagattgctatgtgctaaagtacttgaaaataggaatactatgttaatttctggcacatatacaaaatgtgaattgagtacctaatgtttttttttttttactagtttattgaggcatattttatatatcataaaatttacccatttcagggctggatgcaatggctcacacctgtaatcccagcactttaggaggctgaggcaggtggattgcttgaggagttcaagaccagcctgggcaacatggtgaaaacccatctctatcaaaatataaaaaattagcttagtgtggtggccctagcctagagtcccagctactcaggaggctgaggtggaaggatcacttgagcctgggaggcagaggttgcagtgaaccaagatggtgccattgcatgctagcctgggtgacagagtgagaaaaaaaaaattacctatattaagtgcacaactcactgatttttagcaaatttactgagttgtactgccatcaccataaatcaattttagaacatttttgttctcacataatgtttttgaggttcatccgtgttgtaaatgtttcaaaggaaggtttgctgttcttattgctaaatagcattctgtgtggatagaccacttttgactttccatttaccagttgatggatgtttttgtgttgtttcaatttttggctattatgaataatactgctatgaatattcatgcacagttctttgtgtggacatatatttttatttctcttgggagtagatatctaggagtgtaattgctgggtcacatggtaaatttatacttaaaaaattctgctaagctgtttttccaaagttactgtaccattttacattcctactagcaatgtttgaaacttcctatttctccacaaccttgccaacacttgctaccgctttttaaaaaattatagcccttctagtgggtgttgaagtagcatagtattgtagttttaatttgcatttttctaatgaccaatgatgtcaagcatctttctatgtgcttattatttaggctaaacttttatggtttttcagcagtagatgttatttgactttctagcaatctttgtactgttttttttttcttctacttttgaatctactgtttagccaacaatttggcagaaattagataaaaaagataaaggccactttgggaagctgaggcaggtggatcacgaggtcaggagattgagaccatcctggctaacacggtgaaaccccgtctctactaaaaatacaaaaaaaaattagccgggcgtggtggtgggcacctgtagtcccagctactcgggaggctgaggcaggagaatggcgtgaacccaggaggtggaacttgcagtgagccaagatagcaccactgcaatccagcctgggcgacagagcaagactctgtctcaaaaaaaaaaaaaaaggtaaaggcagggcgcagtggctcatgcctgtaatcccagcattttgggaggccaaggtggcagaattgcttgagcccataagttctaaaccagcctggtagaaatagggagatctcatctctgaaaagatttttaaaaaaatttactgagcatggtcacacgtgcctgtatagtcagtcccagctactggggaggctgaggcaggaggattgcttgagcctaggaagcagaattgcactgagctgagatcatgccactgccctccacctgggcaacagagtgagaatgtgaccctgtctcaaaaaaggaaaaaaaaaaaaaaagaagacacggggattgggtctaggtaatttagtgtatgtagactcatttaagtatttgccagagtatgagtactttgtttctttgtttttcatggtctgaagccctgctaagcttttttttttttttttttttttttttttggcaaaaattatggtgaggttaacaagtagaccattggatgctttcattccaccaaacatcatgtacatttacattctcttgctcagggacagggagtttccctactcttcttttgttttcctgtgactaacctattaggaaatggggaatatgcagatgttctttgttgggtcttacttttaatctcataaactgtaggtgaagttttcatttaaattatatcacctaagaaataattctgttactcgtcatagttccaagtatttgagtagagaagggaagtgaaaagtaattctgtgatgtagtcacagggttttactttgtgaagtatgggcctatttagagtaaggccaagttatttaactattacttaagaaagaacataccaaattgggttcttgtgtttttagattacttcttggttacaaatatggcatttagaaagctgtttgcttaacacatactttgagatttatttgtgccacaggctaacatttctgaaatctggtgggaagtactgaatactgaatttttatttttagccttttttttggtgtgctttttgatttcttttgtcatattgaacatgattcagtaaaataaattagaataggaaaagacagattattgtttgagtgactaagaagtaagattttaaaaagctatatacatggttatgtttgtctaagattcatgctttcattcatcaaggaatatttattgagaatcttctctgctaggcattgtcctaggctttggggactagagtgatgaataaaacagataagttcctgttctcattattctagttaggaagaagaagaaaggttagacagtaagtaaacacacaaaagataatttctggtattgatgatggctctgaaaaaaattaaatagaatgttgcacaaagaacttaagttggaatgctttaggctgcctgtaacagcaaactccactcaaactggtttaaatactaagaaagcaggctgggcaccagacatgattggatctacagcttgaaaatttcatcaagaatcttcttctgtctgtctacccttctatcctcaataaaaatatcctaaggtttgttcctctcctaaatgaaagatgcctgcaagagtggacccaacatgtcaaggaaggaggactctgtcttttaggagctaagaaacctttctcagaagttacccaaaccagaccaaaactggcagggcaatgcagttaccatgttggccttagatttgctgtagaactggagagttacatactctgaccatcacagagagtggctggtgggccacccaggtcacctggccaaactgaaaatgcctgtgtgtcagtaactgctttgtaacctaagaacaaaaaggtagtagtgattagagtagatgacaagtggaacttgcaaagtaatggaataagatttattaaacatagctataaatttgttatttatttcttagagtttcagcatagtcagagtttctgtgttacacttttattctttttttcagatgttttgtgtgctaaataactgaaattagaatcatagaatttttaaaatgaaatgaattttagcgtttatctttttaaacctattcacttttcatttattcattggataaattcattttgcaatggataagtgaagttaccagtttatgttgggcttcaggagtcctgattaaagatccttgagatggaattttttttttttttttgagatggagtctcgctctgtcatcaggctggagtgcagtggcatgatctcagctcactgcagcctccgtctcccggtttcaagcgattctcctgcctcagcctcctgagtagctgggactataggcatgcgagatgggaatgtttttagccatatatgtattcttacactttcatgttttggaggacttccttttttttatcaataaaagtagatatgagacagggtgcggtggcttatgcctataatcccagtactttgggaggccaaggcagaagaatcatttgaggccatgagttcaaggctgcagtgagctgtgattacacaattgcacttcatcctgggcaacagaatgagactctgtctcaaaaaaaaaggtagagatgatgtggtatttgccagtgaaagtgtttggctcactctgtaatgtatagtgatgttcaataaatgtttgttgactgaaatcctacatagctagaatatccatgtttaagactaattttaaagtgccattagttacgttaagtaaaaatgctatattttatgtatttattcaatttatttgaatctctgtcacccaggctggagtgagtggtgtggacttagcttactgtaacctccacctcccggggtcatgcagttctcctgcctcaggctctcacgtagctgggattacaggcatgtaccagcatgcctggctaatttttgtatttttagtagagatagggttttgccatgttggccaggctggtgttggactcctgacctcacatgatccgcctgccttggcctcccaaagcgctgggattacaggcgtgagcccctgcgcccagccaaaatgctacattttaaattggcacttgctttactttttattcatctagtcatttacttatctaaccagtgtttattgggtatctactagatgtcagacatgttatacagagataagaaaggcttcatccctgttctcagtgagcttaagaattcagaggaggagaactaggtaaagagttgattatgacagagtggatctgcatgaggtacccaactgtacctaatccagccttgggccaccaacagataaggctacctagagaggttccagtggagattagcctgggaaatgagtgggtggggagacagagaggacaatgttcaacaagagcatcagggtaagacattgctttgtgtctgtagaaaacaacaaacagcttctcaataatgtatttcaagtttagaaatagcgggaggagagagagaaggctagacaatgaatcaggggctggacatgtgtgcttggactgggagaaaccaaaggatttttgaactccgtgctcaaatttgtggagtcagtactggaggcaggaaaataattaggaggtggctacattggtgtgagcaagagattataggatccccaatggtgagaaggtgagaagatttatttgagatctatccaaggttaattctgcaagttttagtgaactgtgggactggtgggtaaggaagaggagagaatcaaggatgactctcactcaggtttttagtataggtgtttgtatggatagcataatgtagcttcagagttctgatataagctcagagttatgtgatcaaaacataaacaagaaactataatctctatagagactatgggaggttacaaatggtaaggataaactatgtacagtatcattggatagcctagtttattttctgtttgttttaaataggacagagtcttgctgtgttgcccaggctagtcttgaactcctgggctcaagtgattctcctgcttcagtctccctagtagctgggattacaagagtgagccacagcacctgactctcattgatagtttttaaaatgcgttagcaatcagaaatctcacaaagccatactgtttaaagatttcctctgaaaacacagcaaagggcaaaaactaaggtaataatgtaacaactggaattagatataaataacttttacaatactctttagtatgggctttgattcatagtaattagaatttttaaaccattaatacagtcatgggcacattttttgtttttcttactgtttttgtaaattaatataaaaatattaaaatgttttcaaaacagtatataattgaaattgaatttattggaagcagatacagttttctggggagaaaaataatcttaaaaatgacaaatatttgaactagcaaaatgcatcttatagcaataccttaagaactataatattaaaaactgtttggcagagaactaattatttttcagtcatacatgtaaattaaagtcccacttggttttgcctaaggtaagtcacgcttaactgagtactggctgtttggctttgtgctcatgtggccccaggccctgaagggctttgcatattattggggctctgtaggtgaatcagttatggcctttgtctcaagtccaagtgggaatcaccagaatgtcttaacttttggcacaaaagaggcttcagtttatacagactatcagtttataccccaactattcacaggatccagcaagaataggatagaggaaggtgccttatatgtggctgaagacttatttttctgtattccttgaccttcctttttccccctttctgtaagcacgggaaaaacatttgctgtagcaccagacatacaactcagtcccctttcatcctgctatgtaggtataggtacatctttctcattaactctcctacttcccttgtcatacaaagagatgtttttcttcctgggaagtagcagggtagttttttgggatattttagctctgaggtgaacagcttctttctgagatcttgtcagagataatctccagggaagaacgcggttaaatgtacaccactattgttatttctcttctcccagggttttgtttacaaaggaattttgtgtaattatgatttcccatagacttttctgatagtttatggttgctgacagtgcattgtatcagaaaaagaagtgagctttcaagaaatcttgaggctatgttatggtttaataagagatgctgggttaaagtgaagatgatgaatagtggcacgttctcatgcttcttttacctttgaaacttagtgaattctagagccaaatcttttttgcccatggccctcagcattattcttggactgtccttttagtttttaattgaatccctccccacccgcattcaattgcttgtgtctccatgtatcatagttcacttatgttgtcacacctcggtgcttaaacttgcctcctactctccccaagtctccttggcttagggaccatcccttctctttcctccttccctatttcttttccacaagtgggtattaggaagaaagtcttgtactgtttttttagcaggcagttttgtggaaggatacctggttttagtaataaagctggtatggaaatgacttcagcgtgaagttgctgcagttaacaaacaggaactgaatctgaggtagaagatctctgtaataagctttgctattgactaactctttgttattattgtgatccctgttatgccttgcattctctaagcatcataggtaatttgttttctcgttgtctctggcatgaggattgtgacctctcactgagggtggagcctctgtgtctggtgcaggctatgcatgccccggcaggcatttgtgtgtttgttgaaggagtaatgctaaccaggtgggtccttttcagcagctgttcattgctattagccaaaggcagtaacatcattactcttctagtcatgactagaaatccataaagacaacaaatgcccaaaagcagggacagcctcagctactgatcctatagccacaagaatagttcatgcagctggacatatggcacgttcattgttgtgatatgatttgcaggtgcaagtgggtaacaaaagtacattttatgatttgctcaggtaagcgtttggaagaggaaggggagtgttttcagcctgcaaaaagtggctgattatgctgcctgttgaatacagtgagtggcaagaagatgtatcaatgtgcattggcactggaacttccacagcagtgtcttgctgtaacatcactcttattcctttgtgttttaggtgagatgagtgagagccgagcaaagagagttagaataaaagaggtagatggctggaccctgaggatgctaattgattacgtttacactgcagaaattcaggttacagaagaaaatgtacaggtaagagtaaacacttcacaccatctagctttttatgcatacagttttttttaataaaaaaagcacacccacacagtatacatttttcaccaaaataataggattcattgtgaaaattgtatttctaaaaaatatttggaatgattacacctttttagtaatgtttctgagttcagtatcttttatattctttaagatctgagatacagatcctttagttctctgaatgatgcttgttctttcatgaaaacactgtcatattcatttataactgttcattgatgctgcccacaatttctctttattccttggaaggatatagtctacaaagaatgtttttgactgccaatattctttctgtcttttttttttttttttttgatacccaatcttgctctgtctctcaggttggagcgcggtggtgtgatcatggatcacgcagcctcgacctcctaggctcagggagtcctcccgctgcagcctcccaagtagctgggactacaggcatgtgccactatgcccagcgaattttcttattttttttgtagagaggtctcactatgttccccaggctgatctcaaactcttgggctcaagtgatccgccctcttcagcctcccaaagtgctgggattataggtgtgaaccaccatatgcccagcctattctttgttttactatttgagcatcctctttaagtgattctggagtttaggtaaaagttgatattgcatcttatattctataaagaacaaatgttttatgtgtgttacataaatgtttaaataatacagatggatgtggagtaaaaggtgaaaatccctcttcagaaaatggaccttctcttcgataccccagttcacatacattgattcacttcttcctctctagagggcagcttctgttatgtactgtgaatcccttcagaccattttccatgcatttattcacacaaacgtacacacaattgttttacataagaaatactatacttgttctgaaacttgctttttgaactgagcagtgtcttaggggtcttcacacattagtgtatatgggtctaactcatgttaatcagctatatatatatatagtatgattttttcacctgtataaaaacagtgcaatgagtggacatttttatatttgcatccccaaattttataagctggattcctcaaaatggaattggtgaatcaaagagtacatgcatatattaattttttgatagcaatgccaaattgccatctgaaaatgtgtgtttatttatattccttctaacagggacactgtgttttgaggacaacaaaaataactaggactaaattcttaagaaataatctttaaattctacttgcacaaataggaagttgttggttcaatccttatccctgctaactagttgaaatatgctacaaaatgaattcggagactgaaatctttgcacttgttaagacatgctatcgattgttccatgtgaaatactggcagtagtaaggcctcctggtgatctttcccagatggcctcattagcttttgcttagaagttccagttatgaggtaaggcatttgaaaaaccttggtcaatattggagttgtttctaaatgtatgcatcagatgctagatgaacttttttttttttttaacatggaagaaagtgtttggtatatgtcatgagatcactgaactaatacgtcatctcattctggtcttttaggtacatttagactatttgctagattctggggcattgttttcaacaagagtttatcttagtttctttttgttcattctttttattcattttagtgcatgggcctcattatgtccttatatttgaccttcaacaaatgaattactgatttctttgattcacataatgggccacatgggaaaaaattgagaaaaatcctttaggccttagagactaaactgtgtgaattcagccctgaatgttgtttgtagtagttcttgtggtggggacatgggcctattaggaattaggagaacgcctctcatgtttcttttaataactatcatgttccagtcctgaaatattagtcatcacagcctttcagaaaactcttgccatcctaatttgcctcttgtgtatatattgcttagcttttagaatatgcaggaatacattctaagagttacatttggcaggcttattaaatgcttaatatttgtatagttttgttttgtttttaagagggagagggatatctcttcagcatagggctatcatggtttgtaaagctttcttttattttcaattgaaaaatacttgttttggaaaaggcagttgagaaataaattagattaaaagtagctactttttccatgacatgtgtttttcaatgaaaaaaataagactataccatataaagatacaccagactcctatttcctgctttgtgtattttttgtcaatctatattttgttaaatctttcttgtaaagtgttgtccaccttaaagaagaaggtgtctgttgttattaatgttaagctgaagttttaagtggccctaactggaagccgtgctctgaatttatatgccctgaaggtgctgacagtgggaacagaagtttctgtaattcaaatgtttcttggtggtggtatatttttctcactggacctagactcaaatcttttaccaggtgacctcccttttgtaagtttctgttttagtagtaaagtacaatattgggctagaaagtatctttgggattgcatgttttggtgtagaatcattgtgctgtggaatgctgaggtccagccatctgttggcagtcagttggcgacagaacagggctgtaaccctggtttcccagattactagtgtagggtctcttccatgataccatatggtctccttattacactaattttaaacaatataatacctatttgaagtgaaggttgttaacttggagtcagaatgagagaatgagtaatttaaaaaattaactccaaacaagggactattgttattatagtcccttctgatttatacaagcaatagggcttgaattcttggccattccaggtttcctagctttttgtgtgtttgttgctgctgttgtttttttgtttgtttaggtttttaaactttggctttatgtttggatatttggttttatttatggcaaaattggaggataatttgagctaaatgaatttacagtttttttttaaagggagataaaaggagaaccaatattttacctatgactacacttgtaattcaacttttttgttgttgttgctgttgagtgaattaaaatttaacttgtgtctagagtttcaaagcaaactttatgaactgcataaatctgggaaatagagaaaatacagccaaaggctattgaaaactatgctctttgacatttggtggttatggacacctttgagaatatgatgaaaaactgtcaacccttttctaaggaaagggcacattagcttatctacacaaagttttgcatacattttcaatacactttcagagaatccgtgtaccttgctgcttgccccaccttccactgttaagaatacttggctttatttttaaatttttaaatttttttattttattgagacagagtcttgctctgttgcccaggctgtggtcagtggtgtgatcttggctcgttgcaacctccgcttcccaggttcaagcaattctcccacctcagccttccaagtagctgggactacagacatgcaccatcacgcccggctaattttgtatttttagtagagatggggtttcaccatgttggccaggctggtcttgaactcctgacctcaagcagtctgccaaccttggcctcctcaagtgctgggattataggcatgagctaccactcccggccaagaatacttggctttaggtataaaaaatataaatatgtaagtgtgtgtgagtctgtgtgtgtatgtgcatgtatgaaggattttcacatgggtatatctctagttatatgctaagcattttatatgtagctcatttgatgtttttgcctccatgtaagataggtgttaccccaatgtgattgaagaaataggtttaagaaggttaaataatttgctcaacgtcacacagcaactattaaatcgtcattaactagtattgcttacaaagagagtttataaattcaaaaatgtaaatgtctttataactgaaaattttttttcacgatccaaaaattattcaaggtacatgctatgtcattagatgtgttaattaacacttttggagaatcctaaaggatcttgaacttcttaaagcatttacttcattgctaaatttgtagttttgttacatgagtttgacttctccgcctttgggtatttgttttggcttcctaaaagtaggtaagagtttctcacttgatgtaagtgttaaaaacaaaggtaatgctgttaataaacagtgcccatgaaagtaaatgctctcattcctaaattaatattatgagtactcatctacagattctttccatattagaactgttatcatctagaagaatttgagaaacatctgacagttttgaatggataggttttaaaaagttcatgaaatatatgttggatgaattggaattatttgagacagacactttctatctctttagaaatgaaacaaaatttaaatgagagtttttcaagggacatctaaaatcagttattggtaataaacagactaaatgtttaacacagtctcagtatagtagaaaattcaatatagtgcgtccattttattggtggtatagggcaggttgttgttgttttgcttcaaaccagaactgctaggagtatgctgtatagatagtgttttactctgcatgttcccaaaaggaggacatcacatggaggggcttacatggtaccaggcctgttgacatagttgaaaaagctttaagttagcttaatcaataaaaagccagccaaagtagggaaatcaccaaaacagaatacatgtgtaccctaaatattttaacctcaaacatgtaggtttacaattgtattccaatctttgtttgtaaaactaagtatggtaagctgtttcaagagccacatgtccttttttgcacaaaccataccataatcatgcaccaactataatttccaggctttttttttaagtgcagcaagaactgaacttgaaatctcaaggcaaaatcttctttgaattatacagtttatctttcattcctcccatgtctaattggattgaaaacatttatttttttttttccagtaacacgttgatcaagccactccaaagcagccaacttagttttcatagaaagagctctttttacattcacatttcattgaattcatttacttaaattgtgtaatttcaataagtgcaagtgtcataaacagatgtgggagcaaatccaacatgtatgaattggtaaaatgcatcccagctggaggagcagacgtgtgcaagcacagtagagtgtagttactgagggcatggagagagttggttcatcaggtgagtaggtaaagtggattttggtgaagagtgcttttgctttgtgtatttctatattgtgtgggtaaacattgaaatgaaattcccagtaggtggagatttgttttaaaaatctgtcttaaaaatatttaagacaccccatcagttaaacagtcattgatggaatttctgataagtactcggtcctggtgctacaaaaaaaaaaaaaaaaaaatgaacagggaacaaagtaatgaatagagtatatacttagagtgggtttggatcttggctttgctgtttaaatgccatgtgaccttgcctaagttgcttaacctctgattggcattggagcttgagccagagatgaatagggctaggcgtaggagcactgacctgatggagcaagcattcaacaagtattttttttctgtttgtgtttgtgtttgtgtttttttttgacattttcaaaaaataattttaaaactgagggtaggctgggcacagtggctcatgcctgtaatcccagcactttgggagggatgccaagggaggcggatcacctgagctcaggagttcaaggccagcctgcccaacatggtgaaacctcatctctactaaaattacaaaagttagccaggcgtggtggtgcacacttgtggtcccagctactcgtgaggctgaggcaggagaatcgcttgaacccgggaggtggaggttgcagtaaaccaagatcgtaccactgcactccagcctgggcagcagagtgagatttcatctcaaaataacaataacaaaaaaaactgagggtagcatgcagtccgaactgaaatgtttagaggtgagttacagattcaggtctgaatgagatgctgcagagagcctggcagcaggactttcgtggtgttggtagtggtggtagcatatactcttaggctgatggcagtgcctttatccaggaagagctgccctgggtgaacactcaagcctatagctcttatgtttctggcttgtctagaaagagacttggtaagggctgggcaattgtaatgaccacaaccaagtaattttgagattgtggagggtctgcattcccgtaggaaactgggcaacaaacccaggatctggggcttgttatgtggggcattaggagtcacgctgtggcttggcaagcatgagggtacttgggggagcacatcacgtttagggcagcaagattaacgccagactgtaaacactgatatggtgcccaataagctttgtggtattggtcaggattagtttaggaccgaattgaactgcacttgaagatctaagatttgtaagacctgtagctggatcaggccagatcaggtatggatgaagaaccactttactgctttttatacatggcttaccctttcccttccctatatctaagctgttgagcttacctctttttttcactgccagtattgatcctgatgaatttcatctttcaatcaatagtttactaaatatttatggggtatctattctatgccagacactgttccaaccattggtgttacaatgtcaggcaggatagataaggtccttgtcttgaaaggctttacattgtagaggaggggtagggacgagacaaataatatacccatagatagagaaacaggtgaattttacctgttattctctggggaggggtcgtttgagcagagacttgaatgaaaagaagggagtgatgtaaaaataaaggcagagaacattccaagcagaaagagcaaaggacctgagatgtgaataagtttggcgtgttttatgggccagaaagaaaagggcgattattatttgagcagagtaaatgatgagagagtggagaaagatgagattagattagaaaggtaaatagggccagacaaagtgggtttgtagactatgataaggaggtttgattttgttccagttgtagtttgggcagggaattcatgctttagacagtttgttcccctttcccatctgctagctggaggatggactgtgggggcagtagaagaagttggaggccctttagatacctgttggggtaggctaagtgagagactagtggcttgggcctgggttgttggcgtgagatggtgaacaatagatttgggagatatttggaggtagggccaatggaatttactaatggatttgcatgacgggatggaggaaggagaatgatcaagaatggctcctgcatttttggcctgagcaactgggtggattatagtgctgttgtctgagatggtgaagacatgggatggggacatattttcggggtggtgggaattaatggttctattttggttatgttaacttttaccagttgggcttacaagtggagatgctgaataggttggttctgtgatgggaaggggtcaggttagggaggtagatttgatgtattggtggcatattgaagtggatgaggtcactttaagaggtagtgtagacagagaaagcaagcaagccaaagacataatctggggcattccagattttagatgagcagatgagggagatggagtactggtgatgtaggaggaaaagcaggtgtatgtggtgtcacagaatgctagttctagagaagaaagtgcttcaaggagacagtgtttggctgtgtcagatgttcttgataggtcaagtaagtgaattgagccatatcagtgtaggtgtcgctacattcgtttgcctgagacagtcctattttatgcctgctaatctggtgtcttctctgattagtgtttactttactcagaaatgttccagtgtggatgatgaattatatggtcccactggtcattagtgaccttgggaaaagctatttagaggtgatggtgagaatgaaaagtggtttggagtggactaagaataagtggactcagagagtaccgaaagttctttcaatgccctttgctgtgaaaggggagagaatgtgctggctgaaggggatgatgagtttaagggtgtttttgtttgtttgttttgttttgttttttgatgggtaatattttaaagcatttttatgttaattagaataacctagtagaaaagtgaaagttgatgtgataaaggggagaaagaaacaaagggtataattgcaaaagtgagagaggttgccatctaaaacaaaatgaaggggcttaccttagatgggagcaggaaaacttctctgttaaccagacagaaggcagactgtgttgttgtcagatacaagttagtggcttggatggtggaaaggtaggtattttatcagcttgcatataattataaaggctgtggcaagtaatcagccaaaaggaagatgaggaagaaggatgctggagatttgaactaaagatgataaatcattgtcttgcaaaggatgaagatgaatttactagtgaagtgtagtcgaattgtcaggccatattgagagctcatttgagatttgcagtcataaatatcaggtagaatggttgtgtgattttcttcagccatgttataccacttatacttagtatagagatgatgaatgtgttagctattgccacaaaaatgccacagaacaaagtatgccaaagctcagtggcttaataaaaaaatcatttattcttatggatttgcagattggctgaggatcaactaatctaggctgaggttggctgggtgattggctctacaccgtgttttaaaaattattctggaataagaaagtctagaacaagactacatgagtgggtagctgagaaaaagtggaggaggaagtggtagttggaactcaggaaaccgagatgttctatttggatgtttatgtcatcaaaaattgtcagaagttgtggtggagagaacggtgatttaggttttaaaaagttctctctctcgtgtgtttgagttagcatgacgacaacactctggggtgattgtagtaccatactaaatctttgatttagaaccacctgttccatctcagtatattagatgaagttggccaagtaaaaaaagtcatctgtaaatgagtaggagtgactgaggtgtcgttagatagtcccaatgaggaaggtgagcagacatgtgcttccaaggagcaggggtttttgaagaaaggagaaaggaagtagcaatggggagctgcatctccaggccttaaagcagcatttttgtttttcaggtgtgggtggtgatcaactagtgggtcaagaaataaacttagtaggtcattattagcatttaagagaaaaattagagccaagagtaggaaatgctattcaagcttaaagtctatttcagaagaaaatagcagatcctagcaagtctgcatgttttgtgaaactttgagttctaggttgtgaggtaaaaagtcttactatgtagtgtggtcaaaagaattggaaaattcagctataagttacttggagtgtgagagagaaaagtttcatgaatagtagagatgtgactgaatatatgttattgattatgcataaatacagtgatttttatgttatttgtgtatatattttatttttctaaactgtattctttagcatgcatttctagcatggaaatacccaacagatgactaatagatgttgactgcttagatgtcaggaagacataggtactcagtggtaatccagaaagtatactttgttttctatgctggcttatggtgcaattcctggaacagggcacagagattcagatggacctgcttgagatggtgagcaatgaaggtgatgtcacagtaggggttagacatcgcttgcccaatctatttcttggctttgcaggtctagaaactattttgttagctctttcagagttgatcagacttttgggaaatagctcagagtagccaaaatcagaaaactaatacatgaaccaaaatgatcttaaactaattttcagcgggtaacaggtgtttctagggactgtgtttacattatccggtgtgcatcattctcaggatctagatacctaagtgatagaattagtaatcagagcttcattgggtgagcacaaggaaagggaatttacttcaaagggataatggaaagtcttaccaaactggcatcccactgcaaagtatacctttctagtgatttgagtattgattacatactgtgaaacccaatgtctccttacctttcatggtactgggaaaactctgacaaataattgctctttggataacccatttctgaatttttttgtaatctggtagttgtctttttctatccccaagcacttgaggatgtgccaaactccaccagacacagtgattcattgacacagagattctcaactagagggcagggtgccctggtatttttaattcttatttatctccttgtggagatttaataatgtggaccattttaaacctcatgttaaaaatagtttcttctggctgggtacggtggctcacgcctgtaatcccagcactttgtttgggaggctgaggcaggtggatcatgaggtcaggagatagagaccatcctggctaacacagtgaaaccccgtctccactaaaaatacaaaaaattagctgggcgtggtggcgggtgcctgtggtcccagctactagggaggctgaggcaggagaatggcgtgaacccaggaggcggagcttgcagtaagccgagatcaccccactgcactccagcctgggcaacagagtgagactccatctcaaaaaaaaaaaaaaaaatagtctgttctgacagagactatcactatatatttgattatgttttgagctttgttacagtcatattccagatctgctcctccaacactgccctccacccattttgagtggatgaccatgcttcattcatagccacacatctagaagttgccaagtagcaaggtgttctgtagaaagctcatcttcaaggtgaacagaaacatctactgagcagttttttaaaatgttgttaataattcctcaaggtaaaatcatttgaattacacgtataatgctgcatatttacattaatgtggaacaactcagaaataataaggagcccttacgttggctttctgctagtaaacttcatggcccagtggactttggctaattatagtattaaaattcagagctcaaatcttgaatttattactgacttcaagaagagccttgagtaagatattaacctttccgtttctcagctattaaatgaggccaacagtgctttgccactgcattgaaatggtgtaaaaatataacagttaaagcttgcaaaaatatctaaatgctctataaatgttgagcagaaataagagatgggcaggaataaaaagacttaagaccaagaaaaagaataactcattaaaattatttgggatcactgggtagaaaatagctcatatgacttttccttccctctttatattctgaatcaggtcatataaaaaatgtccctaatttgctatagagttctctccctcttgtgcatttgagttggcatggagaccacacttgggtgattgtagtaccatgctaaatctttgatttagaatcacctgttccattggtttgacatgcagtgattagagcaaaagttatgtatctcccagcagtgtctatggaaggcttattgcttttccatttctgttttctttctctcatgggatagaagtcctttgtgagtaaaagggtttggcagatgatgtgcttggaaaacacaggttaaaacttaaaaaaaaaattacataaattcctgaatcaaaccttcaggattagtggttgtttatgatataaccatgggtacttatatcattgtaatgaatttatctgacattctagcacccagaaatcagttaccttgatattttatcactttacctggttagtactaatttattattatccagaggcataaaaatttaaattatttaccatttgagttttgatgttaattgtattttattatattttaagtctgaatttggtaatcctcatagttttaatcaaaatattagaccaactagaacatccagtctccattctagttaaattatttttattcaatataagaatatagaattaaaaaagtcttatttaaaatttaatatggaatggccattgaggtcagctagtttgagaaaacctagaaaccttagtataagagcgtcttataaaactaggtggatacgacacccaaagtggtttttaaaaaatttattgttcggagcaaggctaggtactctagaagcattagtaattgagttacttgtggctttgtattattaaaatatatggtccttgaagatgtctccacggctgaatcattttgagattcacgttttaagtagtttcatgtggtacataaaaggcatttatcttgatgaacaaaaaaatgactccatcctgtttatgatttagcatcttataacagcgtctttgtaatttgaactcgaacaagacaaataaaaacaaatcaaagtccttattagaaatatatccagttcaaagtggatttttttttcttgtttgtgatgttgtttaggtatggagcctgtgtgtgggatagcacatttgtatcaggctagttgccagtgttcagggtacgcctctccaatccagtccaggtggtcacagtctagagttgttaaattatatgtggttctggcatgtttggtttgacaccagccaaaggttttataaaccctagcattattgacatatagtcttaaaaatattattacctcttggaccttaatgtcttaatctcattgttaggttagtaaaattaatgtgcttctgataatctggtttaagtgtattatgccttttcttgggctatataatttatgaaaactttatttctagctttgtacagtggcagtatcatagccaatgaggtttatctgaggcatgattattgctaattgaaaactttatttcttgcgaaaatagaatatagctatatcactgacatggatgcacaagctactgttttaaaataagtttatcaatgctagtgtagcaatttggtcacgtaaatgcatttttgcggggttgcctcttattttggattctatcaggtaggattattattttctatttgaaaatttatttcatggcttataaaggctgtccgttgacctctggttaatctattagtatggatttaaagtacagctgtccctcagtatccgtgggagtttggttccatgacttcccttgggtaccaaaatctaagcatgctctagtccctgacttaaagtggcatagtattaatatttgcatataacgcatgcacatcctactgtatacttttttattttttatttttttgagacggagtctcactctgttgcccaggctggaatgcagtggtgcgatctcggctcactgcaacctctgcctcctcctgggttcaggcgattctcttgccccagcctcctgagtagttgggattacaggcacccaccaccatgcctgactactttttgtatttttagtagagacaggtttcaccatgttggccaggctggtctcaaacttctgacctcaggtgatccacccgcctcggcctcccaaagtgctgggattacagatgtgagacactatgcttcgcccctcctgtatactttaaatcatctctagtttgtgtacaatacctaatacaatgtaaatgctgtgtaaataatcattaatatggtatggtttagggcataatgacaggaaaaaaagtttgtacataatcagtacagatgcactatttttcctgaatatttttgatctgaggttggttgaatcccatggagggttgactgtacttgattgtttttcccctagtgggatataatttacataccatagatcttaactgtacagtttgctaagttataacaaatgtacacatctattaatccacacccaaatcaaggtattgagcatttataacctcaggtctcttcccaataaatctcccactccctttccaggcaaccattgatgtgatttctattataataggttagttttccctgttcttgaacttcatataaatagaatcatacagaatgtattttttttaaggctgacttcctcctcataacatatttgtgagagtcatctatgctgttgtgtatttcagtagtcgtccctgtttattgatgagtattgcattgtaagggtttattacagtttagcatgttaatggatatgtgtctcctctgactagagatgggatgggatccacatccagtgctgccagctgtaggagtgaaggatgcaagggcaggagccaagctgtcattaaaaaaaccagtagaacactttgtttactctgtccactacgtgttaaaaatacttggtgtggaagtgttcagtagttcgttctgtttgtgtcaacattgttttattttttaagtttcctgagatcagaggagcttgttgtccattaagttgttctaatatgatgataggttaaagctgtgtgccaagtccatttaattttataataggattgtttgttatagcaaatactttagaaatgttagttatttttaaagccattattagtctttattattactgattataacatttcatcatgtggatttatcatattttacttaattgttgccatattgttagatctttagttggttctggttttttttctactaagtaatgctaaagtaaaagtcatttatgtatcttattccattttttggacttttttctcaaggtagattttcagaaacataattttagggtcaaatgttttaaacgtttatattttttggtatctattgatcaatgttccttatttgttttctaagggagttgattagtttacagtgacagcaaaaatatgctaagggccaaggcttactgtactttagtttgaatatatattgtctggaaacattttgttgtttgaattgggaggtgctagaaagaaaagtaaaaacattttgtattatacttataaaatgcactctcatggttctatatttgataactaatgaagcatcaaatacatttctcatttttgtatgctatgtttctttttttgcaaattttccctgattacatcttttatgttgagaatatttgatcaaaaaaggaagctacctatattgtgaatgatctgggataaaacatcatcttatgcgggagagactaaatcttggtgttcaattctcatgaggtagaatgttcaatccaagaaaaaaagccctgagtcagagctgatgtgctacatggtcattgccatgcattgtgttaaatcgttgactgacatttaatttttcaataacctgaaaggtaggtggtgtcttcattatccatttgacccactctcaaataagtcggacttttaagagaaaccttgggttaaaagtagtagaagtagcaactggaaaaaggatagtgtaggagagatggctttcagtctgcctgaggctgctttgcccccaaatttcttctctccatactacctttgcttttctacttcattaattataacattggaaatgccaccaattgcagttgtattctgcttaagagtcaacctctcttaaaatgttaaaaacccctagaaggggatttattctggaagatcttgtgttattagctattaatatgacctaatcagacagttttttttttgtggtggggggaggttgttgtttttgtttttttaaactctgtgggacatacctattcctaggggtggagtgttgggaggaggcaggcgaggttgcatgtgggttacaggaaagaaggtggaagaaagtttccttcctctttctgggatgtagggggctggcccggtgcagagttttgacataggaaatgcttgtccttggcatcctgccatctccttattcatacttctacatctcaaaaccctactccttgaccgcaaaacccagccctctgctatgtgcatccaaccatgactctccacccagatctgcctttcttgtcactaagcgtttcatcttctaaacacatcacccttgcctgccttctccccacactcctccccaagctccaccttgcaggatagctatggctagccgagtcaaaaacaacagcaacaacaaaagctgtcttttcatgcttgcatgttttcttagatatttagaagttatatatatatggagcaatcggaccctttggtagtctcttcctaataaacaaactgctaatggctcaggatttaaaagacatactacataaattatttccccctatggaataaatgcccaagctgaaaataaactatagatcctaatagccaagcagaaggagtatacttgtctaagcaaaacatcttctatgtaatttggcttgtcaaacaatgtgaagtaggatgaaagcaacttactttaaaatatgcagctgatgtgagagtgtcacacagatgttaattgtttggcttgggtgtcttccatttctcatgctctacagtgtcttcactgatcagtggtggcttctcccctccatttctttgttcattgcagaaagcatctccaaagtaaaaaatgtgcagccttttatttgtctccattggttggaaatcaacatatacaaataaaaaagcttttttttttccctgtttttcaaaatgacaacattttaagttagatttatttaatcaggggctatgtccttctacttcatgtttctccaaacacttaaaactgttgctgttcaccgaacaggaagagtaacgtgtagagcctggttactgttctacaaaacactggcttgatgatcaaaggcctttcagactccaaaggcctttcaacacgccaaagtgaggcaatctctagtgagtggtgggtaatatttcccagagaagccacagtccatatatagctccccttaacccttgttatatttgttagcattgtagagatccagaaagacattcctttacttgctccctgactttcttttaaataatatttgaccatttaaatggtacatagaaaatgcaccacttaacaaatacataaaatttaacaaatatgtaaaaataaataggaaatgttcatatcacacctaaccagagataaaacgtattaacaattgtggtatagccctctaatactgtctgttgttatgcacacatgtgtttacccaaaaaaggggtcatactgtagattcttttagaaactagctttttatactaaatgtattagaaacatttttccaagtcattaaatatttgtctactagatctcttttaagagctgcaaaatattcaatttcattgatattatagaattgacttcatttttctcttgttattggacatttaagttcttctcaattttttataatttaaacaacactataattaatagttctatagctaagtatattcacattcacagtttgttccattgtgtaatataacagcttggggtccttctgcaagcaaggcttacatgcagttcatttatttgggaagtgatcccaaggagccacagtgagtgaatggaggacttgagctggaaaggagggaaaaccggttcataggtgcagtacagatctggccatagctacatgtgacaggacctttgaaagccttataacatatgtctcagaactgtcttctaggagaataccagggggaagtatttctcttcctttgatccgttctccactagtcaagggtggtcccacagcattatttcccacatgcttccagactatgtgggtatgagcccagtgcatcactgaaggcctaggataggaagccagagagaggtatggccgggggctggggtgaggccctgttacgatacatcttcagaaaggtggtcaaagcctgcttgggcctggttgccgcagtggtgggttgggcaagaagtaaggctgagaggatttgtagtaggatacaagaagtgtctggtacatatacattcctagaaacagagtttgtaattttgtctcaaaggacatgcacaattgtatctcaaaatagaaatacacatgggagtcataaaattatgttcaggttgattcatttatgaggtacacattctgagacctgaggatgtggcagggggtaacagacgtgatcctactgccacagagcttacattcctttgcaggaagacagtaaacatgggaacaaatacataacatcagtgctgacagcagtaggtgctgtgaagcaaatgaaatgaagcagtgctgttagtagtgacttgaaagggactgagcccatggtgagaacaccagggttctcatgattttagatggcacacagataaactgagagtgaagagactcagggttgggttgatggaatagaactaaaggagaaggatgtaggaaggaggggcgagggcctctttacattcactgtccgctttgcatttttcctagaggcagatgtacccaagagagatattttggcttttggagtgtggccttccctcagtgtatatactatatggaatttaatcactcttagattcttagaaaatattattaacattcaaaatatatatcaaattataattgctccatctttgatgttttggaatatacttcaggatcatagagtgccttggggttatttttaatcaatctcagtgttaacactagtgcaactctgcactagatggaaatttccattagatggtggctgggggtttattttatcaatgtaattctacttcatatgagaagcagcactgttcaactgctcctttgctttagagagctcagaaaataagtttcaaagacataaatttattcattggaccttttagttacaatgcccaagatatttttgtgacctaaatagcaaattaagaaatcacctctttacattgctaggtgtttctcacatttgttaccgatagtacaatttatccacttcagtagaaagtaagccatgggattatgatagctccagattaaagcacattcttctttttcagtgatatgtaaaaccacaggatcagaattatattagatattgaaatattagaatattaaatctgatctcctaaatcagggttttccacattctgatcacttgtaatcatttgtgggccagcttcaggattttgctatattctacaagtgctgatgctattaaatttttaatgtttttctctacagtgagtcaatttttgcttaaataagtttacttgggaaggaatgtttatattattgtattattgaaataaatggaaaataactttaaaaaatgtatttctaactatgaacctatattctcttttttttttctttgagatggagtctcactgtgtcacccaggctggagtacagtggtccgatctcggctcactgcagcctccgcctcctgggttcaagcgattctccttcctcagcctctcaagtagctgggattacaggtgcgcaccaccatgcccagctaatttttgtatttttagtagaaacgaggttttgctatgttggccaggctggtcttgaactcctactcctgacctcaaatgatctgcccaccttagcctcccaaagtgctgggattacaggtgtgagccaccaagcctgccctgaacctatattcttaactattaatgcaagaagtttatctgtatgtcatctaaaatcattatgcacattttggttagtaccgctctcatagcaggcttggcctgtcccataccaggtgtgtgacctttagcaaattatccagcttctcctaccctctgtattcgcttgtgtatgatggagataatgagatattattgtctggcaagtgcttagcacagtgcctgatgtagcaattactcagtaaatggaagtaactgcaataatgcattgttgaagtggttgttgtctttattattcttcatgaaaaggaccgtgttggagatttagaaattatacaaatacttccattctgcacctaaatttggggttgaaggtattagaacagtagaccaaagagttgaccaatttgattatatccctagctttccatgactcgctgtatgatttggtcaagctgtttaacccctcgagggtgtggtttcttcatcacacaaattagaaggtttgatttgatttgatctcaagacattcaacttgcagggtgacagctgtttgagtggttttgatcatgggatgtggttcatctgaagtcagagcattttaaattttgttttaagtggctgtttgacacacaaaataagctaggagttgatgtggccccagctgttttcctgttttcattatgagtgactgatggtcaccaggcgtcatgttagcaagctgggtcaattagtaattgcttttgaagctgtatataattaattacataattatgagctattgaagtttagttctagtaaaactacatcataaaaccaaggcaatttcaaaagatttactgacaaaagaaaaatatgaacaaactttttgtacatttgacttacgtttattttatgtttagtatatatttgtcaagcatgtaaccacttttcactgtcatcaataaaaattatatgtgaatataatgtagccacatggaccactgttgaaataacttttatatttctacctagatgacttgttatgccccttccagataggagaatctacaattttatgaatttcggtctcctaatacggtagatctgaacttggtaatgattaagttgaaatcaataaagcaaaatgaaatttaaaaagcctgctacacacacatatgtgtgtgtgggggggtggtggcggtgtatatgttagcataatataccaatgactaatttttttttcactcaggaatatattttagaaattatctcatttattagtttcctctttcgtttgaatgactgcaattgaatggatgattccaattatttgatcagtctccttatgatggacattaaaggcttttttctaattgctattagccacaataatgctgtaataaatatcttgtgcatgtgagattttgtgcatgtgttagcatatctataggttaaattgctgggtcagaggacatgtgcatttgtaattatgaatttgaaataaacaaattgttcttcatggaggttggaccaatatgtgctcccaccaccaatgtgtaagtgagcctgttttccacccaaccactttttcctcatcgttctgtgtgaccaaacaattcaagtattatactgttttctctaggaaaatgctagttagaggggtgatcatactatttgtgcagatttcacagagattgaattttacactgaagaccactttctaaactatatgtagaaatttaatttgctgaattaaatggctgtactgttaagcatcttggaacgcactttatgttgcttcagagcgcaattacactggcatggaaaaacctgcaatttgaaaattatcaacaaattaaagccttctgtggatattcattctcataataaaacctactatacatatcatgcaaaaagtttggctataacattatttatactttattttctatttttatttttattttttgagacggagtctctctctgtcacccaggctagagtgcagtggtgtgatctcggctcattgcaacctctgcctccagggttcaagtgattctccttcctcagcctcctgagtagctgagactacaggtgtgtgccactacacccagctaatttttgtatttttagtagattgggctttcaccatgttggccaggtggtctcaaactcctgacctcaagtgatccacctgcctcggcctcctaaagtgctgggattacaggcatgagccaccacgcctgacctatttttcttaaactcagaaggtaaaggccttatgtctagatactgtttctattttttcttgagcctttaggttcaggagttaaagcttctgcgcttcctttaagaaggtaagaagtttgttacagagagatgtgaatgatgtctttcttttttatgtttaggacttactccatagatttaggaaagtcataacatatagtcataaaccactattatttttctgtctttgggctgcagtgtggcatatatgaaagtcaatttctgaaggaacttagatctttttttaatgctaatgtcttttctaaaatttaccattgttcgagtaattgaaggttttttttgtggggtttctttggcttttataaaggatcaccagaattcgataacctttttttgaagtttttctccttaatttgactttcaaatatggtcctttatatagcactgtaataattcacttacaaggaaaaatgtttttctattattgacttatttgaaaagcacttgtagtgttggatatagtatttatagtgaagatagtggttcaatcccacagaataacctataattaatataaaattgcttggagttactcaaataaaaatgaaaattaaaaagttattagataatcacctattacattttccttgttagcacatatattacattctagagaaactgtctgcttataggtagagactgttgttgaactttaaattgttctaccccgtaaggaaagcagttgttatgatacttatacagtagaaaaacaggccttcagcaaaatgaggcttcttgtgatatggattgctctggggccactccttctccacaaatcactgaagcgcatgactgcttgaactaagagaacaaaaccattttcattgaatcatagcaccccctagcatcctaataatttatgggtttttgttgttgttgttgttgttgttttgttttgttttgttttgttttgtttttgagatgggatctcactctgtcacccaggatggagtgctgtggggtgatcacagattactgcagcctcgacctctcaggctcaagtgatcctcccacttcagcctcctgagtagctggcactacagttgcgtgccaccacaccaggctaatttttatattttttgtagagatgaggtcttgctgttgcccagcctggtctcaaacttctgaactcaagcaatcctcctgtattggcctcccaaagtgctgggattacaggtgtgagtcaccaggcccagccaagaatttgtgtttttagaagtcaaaggaacattttgtttatgcttataaaacaaaccatgaatcttgtaagatctgatatctcatattcttctgacgaaggagaagaggcctttgaaagattacatggaaattatggggaatgtgaagagtcatcattgttattgaaaataatttttatatttgttttctagggaatatgggggtatggacgcagataataaactatggctgaacatcttgtgtcctatgtagaagtggtcaaagagacagtgtttttccacccaagtgcctaagaatattgatgtgtgtgttgcaggtacttctcccagcagctggtctcttacagttacaggatgtgaagaagacttgtgaatttttggaatcccagcttcaccctgtcaactgcttaggaatccgggcttttgctgatatgcatgcatgtaccgaccttctgaacaaggccaacacctatgcaggcaagtggagtagacctcagctgaatttgggaggaaactgcttggtttttgatatgattctacagtggtctctggaaagtcatgtcatatttctggatctgggctttaaaaacatacatttaaaatcttataatggtcacactgcataactgaagcatactcataaaattctgaacttaaaaagcaagcaactatacattgggattgggcctgaataatagaatagctaggaatagctaggttttttttttttttgagacggagtcttgccctgtcacccaggtcgtggtgtggtggtgcaatcttggctcattgtaacctccgcctccagggttcaagaagagtagctgtatgtatttttctttcaaattgttaaatgaataggcatatgagaaactgtatgcatgtgaagttattttagctctgattttttattcttttttttttttgcatctatgaaaacaattttgtggcttaaaaaaatcttcaaagcagtgaaatatagatatgtttggtggagtagaaaagtagaccaccaatagaagcagcccactccttgcatgctggttccatggcctactgctactgctggcatctccctgtggcagagggagggcctgttgctgttttcaaggagcccttgctttagctgctgttcaggcccttcaggcccctcatctctgcagttggggaggggagattgttatagctttgaatgcacacacatagttcacaaatgtaatctatattttatttgagtttataaacaattaaaaatatatattgaaagtgattattaggaaatttcttttatttttatttatttatttatttttaaattatactttatgttttagggtacatgtgcacaacatgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccttacaaaggacatgaactcatcattttttatggcttcatagtattccatggtgtatatgtgccacattttcttaatccagtctatcattgttggacatttgggttggttccaagtctttgctattgtgaataatgccgcaataaacatacttttctttttttagtttctttatgctttcattgaatgattacatccttttttttattctaatagctttaggagtacaagtggtttttggttacatggatgacttgtatagtcacgaggtctgggattttaatgtacccgtcacttgagtagtagacattgtactctaatcggtagtttttcatccatcaccatcctctcaacctccccacttctgagtctcccatgtccattataccactctgtctgcctttgcatactgatagcttagctcccacttataagtgtgaacatgtagtatttggttttccattccttagttacttaacttagaataatggcctccagtttcatccaagttgctgcaaaagacattatttctttctttttttatggtagagtagtattccatcatatatatatatatacatacacacacacacacgtacgtatatacacatgtatatatgtacacacatgcatatacatatatgtctacatacgtatatgtatgcgtgtatatatgtgtatgtgtgtgtgtgtgtgtgtgtgtgtgtgtgtgtatatatatatatatataacattttctttatccactcattggctgatgggcacttaggttgattctatatctttgcaattgtgaattgtactgtgataaacatacatatctgggtgtctttttgatttagtgatttcttttcctttaggtagatactcggtagtgaaattgctggattggattttaatttctttgaggaatctccagactgttttccatagaggttgtacgaatttacattcccaccaacagcatataagcgttcccgtttcaccacatccacaccaacatctattgttttttcacttttaataatagctattctggttagggcaaggtggtatctcgctgaggttttaatttgcattttcctgatgattagtggtgttcagcatttctttcatgtttgttgaccatttgtatatcttctttttaagaaatatctgttcatgtcatttgcccactgtttaatgggattatttgattttttcttgctgacttgtttgagttccttttagattctggatattagtcctttgtcagaggcatagtttgcaaatatttcctcccattctataggttgtgtgtttactctggtgattatttctttggtcttgtggaagtttttttttgtttaattaggtcccatttatttatttttgcgtttgtcacatttgcatttggggtctttgtcataaattttttgttttggccaatgcccagaagtttttcctaagttttcttctagaattttgatggtttcaggtcttagatttaagtctttaatccatcttgggttaatttttatatatggtgagagatagggatctctcaccatatataaaatgtgtacacgtgcacaacgtgatggtttccagcttcatccgtgtccctgcaaaggacatgaactcatccttttttaatggttacatagtattccatggtgtatatgtgccacattttcttaatctagtctatcattgatggacattgggaggttccaagtctttgctattgtgaatagtgccacaataaacgtgtgtgcatgtgtctttatagtagcatgatatataatgctttgggtatatacccagtaatgggattgctgggtcaaatggcatttgtagttctagatccttgaggaattgccacactgtcttccacaatggttgaactaatttacattcccaccaacagtgtaaaagcattcctatttctccacatcctctccagcacctgttgttttctgactttttaatgatcgccattctaactggcctgagatggtatctcattgtggttttgatttgcatttctctgatgaccagtgatgatgagcattttttatatgtctgttggctgcataaatgtcttcttttgagaagtgtctgtttatatcctttgtccactttttgatggggttgtttgtttttttcttgtaaatttgtttaagttctttgtagattctggatattagccctttgtcatatgggtaggttgcaaaaattttctcccattctgtaagttgcctcttcactctgatgatagtttcttttgctgtgcagaagcgctttagtttaattagatcccatttgtcaattttggcttttgttgccattgcttttggtgttttagtcatgatgtatttgcccatgcctatgtcctgaatggtattgcctaggttttcttctggggtttttatggttttaggtctaacatttaagtctttaactcatcttgagttaattttttatacagtgtaaggaagggatccagtttcagctttctgcatatggctagccagttttcccagcaccatttattaaatagggaatcctttccccattgcttgtttttgtcaagtttgtcaaagatcagatggttgtagaggtgtggtgttatttctgaggcctctgttctgttccattggtctatatctctgttttggtaccagtaccatgctgttttggttactgtagccttgtagtatagtttgaagtcaggtagcgtgatgcctccagctttgttctttttgcttaggattgtcttggctatgtgggctcttttttgtttccatatgaaatttaaagtagttttttccaattctgtgaagaaagtcagtggtagcctgatggggatagcattgaatctataaattaccttgggcagtatggccattttcaagatattgattcttcctatccatgagcatggaatgttcttccatttgtttgtgtcctcttttatttttttgagcagtggtttgtagttctccttgaagaggtccttcatatcccttgtaagttgtattcctaggtattttattctctttgtagtaattgtgaatgggagatcactcacgatttggctctctgtctattattggtgtaaaggaatgcttgtgatttttgcacattgattttgtatcctgagactttgctgaagttgcttatcagcttaaggatattttgggctgagacaatggggtttctaaatatacaatcacgttatctgcaaacagagataatttgacttcctctcttcctaactgaatacgccttatttctatctcttgcctgattgccctagccagaacttccaacactatgttgaataggagtggtgagagagggcatccttgtcctgtgctggttttcaaagggaacgcttccagtttttgcccattcagtatgatattggctgtgggtttgtcataaatagctcttagtattttgagatacgttccatcaatacctagtttattgagagtttttagcatgaagggctgttgaattttgtcaaaggccttttctgcatctattgggataatcacgtggtttttgtcattggttctgtttatgtgatggattacgtttatatatttgcgtgcattgaaccagccttgcatcccagggatgaagctgacttgatcatggtggataagctttttgatgtgctgctggatttggtttgtcagtattttattgaggatttttgcatcgatgttcatcagggatattggtctaaaattctctttttttgttgtgtctctgccaggcctttggtatcagtatgatgctggcctcataaatgagttagggaggattccctctttttctattgtttggaatagtttcagaaggaatggtaccagctcctctttgtacctctgttagaatttggctgtgaatccgtctggtcctggacttttttttgttagtaggctattaatgattgcctcaatttcagaacctgttactggtctattcagagattcagcttcttcctggtttagtcttgggagggtgtatgtgtccaggaatttatccatttcttctagattttctagtttatttgcatagaggaatttatagtattctctcatggtagtttgtattgctgtgggattggtggtgatctcccctttatcatttttttattgcatctatttgattctcttttcttctttattagtcttgctagcagtctatcaattttgttgatcttttcaaaaaaccacctcctggattcattgatttttttgaagggttatttgtgtctctatctccttcagttctgctctgatcttagttatttcttgtcttctgctagcttttgaatgtgtttgctcttgcttctctggttcttttaattgtgatgttagggtgtcgattttagatcttttctgctttctcttgtgggcatttagcgctgtaaatttcccgctacacactgctttaaatgtgtcccagagattctggtacattctgtcttcattctcaatgacttcaaagaacatctttatttctgccttcatttcgttttgtacccagtagtcattcaggagcaggttgttcagttcgatgtagctgtgctgttttgagtgaatttcttaatcctgagttctaatttgattgcactgtggtctgagagacagtttgttgtgatttctgttcttctacatttgctgaggagtgctttacttccacttatgtggtcaattttagaataagtgcaatgtggtgctgagaagaatgtatattctgttgatttggggtggagagttctgtagatgtctattaggtctgcttggtccagagctgagttcaagtcctggatatccttgttattaaccttctgtctcgttgatctgtctaatattgacagtggggtgttaaagtctcccattattattgtgtgggagtctaattctctttgtaggtctctaaggacttgctttatgaatctgggtgctcctgtattgggtgcatatatatttaggatagttagctattcttgttgaattgatccctttaccattatgtaatggccttctttgtctcttttgatctttcttggtttaaagtctgttttgtcagagactaggattgcaacccctgcttttttttttgttttgttttccatttgcttggtagatcttcctccatccctttattttgagcctgtgtgtgtctttgcatgtgagatgggtctcgtgaatacagcacaccgatgggtcttgactctttatccaatttaccagcctgtgtcttataactggggcatttagcccatttacatttaaggttaatattgttatgtttgaatttgatcctgtcattatgatgttagctggttattttgcctgttaattgatgcagtttcttcatagcatcgacggtctttacaatttggcatgtttttgcagtggctgctaccagttattcctttccgtgtttagtgcttccttcaggagctcttgtaaggcaggcctggtggtgacagagtctctcggcatttgcttgtctgtaaaggattttatttctcctttacttatgaagcttagtttggctggatatgaaattctgggttgaaaatccttttctttttaagaatgtcgaatattggccccactctcttctggcttgtagggtttctgctgagagatctgctgttagtctgatgggcttccctttgtgggtaacctgaccttgctctctggctgcccttaacattttttccttcatttcaaccttggtgaatctgacagttatgtgtcttggggttgctcttcttgaggtttatctttgtctttgtggtgttctctatatttcctgaatttgaatgttggcctgccttgctaggttagggaagttctcctggataatatcctgaagagtgttttctaacttggttccattctccccataactctccggtacaccaatcaaacgtatatttgctcttttcacataatcccatatttcttggaggctttgttcatttcttttcactcttttttctctaaattgtcttctcactttatttcattaatttgatcttcagtcagtgatatcctttcttccacttgatcaaatcggctattgacgcttgtgcatgcatcacaaagttctcttgctgtggttttcagctccattaggtcatttaaggtcttctctacactgtttattctagttagccattcgtctaaccttttttcaaggtttttagctttcttgtgatgtgttagaacatgctcctttagctcagagaagtttgtcattaccagctttctgaagcctacttctgtcaatttggcaaactcattctccatccagttttgttcccttgctgccgaggagctgcgatcctttgaaggagaagagatgctctggtttttggaattttcagcttttctgctctggtttctccccatctttgtggttttaactaccttttgtctttgatgttggggagctgcagatggggttttcgtgtggatgtcctttttgttgatgctgatgccattcctttctgtttgttagttttccttctaacaggcccctcagctgcaggtctgttggggtttgctggaggtccacttcagacccggtttgcctgggtatcaccagcagaggcttcagaacagcagatattgctgcctgatccttcctctggaagcttcatcccagaggggcactaccctgtttgaggtgtctgtcatcccctactgggaggtgtctcccagtcatgctacactggggtcagggacccacttgaggaggcagtctgtcccttctcggagctcgaacgccatgctgagagaaccactgctctcttcagagatgtcaaacagggacgtttaagtctgcagaagctgtctgctgtcttttgttctccccagtttatgtttttgtatgctttgttggagatcagtcgtttctaaatatttactttatttctgggttctctcttctgttccataggtctacatatctacttatatgccagtgccatgctgttctggttatgatacccttatattagtataatttgaagtcaggtaatgtcatgcctctagatttgttctttttgcttaggattacattggctatttgggctttttaaaaaaaattccatatgcattttaggatttttttttttctaattctgtgaagagtgatgatattttgataggaattgcattgactctgtagattgctttggacagtatggtaattttcatggtattgattcttctaatctatgaacatgggatgtatttccatttgtttgtgtcatctatgatttctttaagcagtgttttgtagttctccttgtagagttcttcacctccttggttaaatatattcctaagtattttattttattttattttgtagctattataaaagggattgagttcttaatttgattctcagcttggtcattgttggtgtgtagcagtgctactgatttatgtacatggattttgtaacctgaggctttactgaattcatttatcaaagctaggcgccttttggaggagtctttagggctttctaggtataagatcatatcatcagcaaacagagatagtttgactttctcttttccaatttggatgccctttatttctttcttttgcctgattactctgtctaggacttacagaagttgctaatttgtttttaaactatatttctgggagataaatctggtagaagttacaatccaccaactgcctgcaagactctgctttgcatctatgagactcaataggaatagttcctatggaagcttctgtgttcactgctcctttaataggctctagaactgtaacttccccagctttcaaatgcaagagccgtttgtctaaactgcttcagtgtgcttactctgatgagtaaggaagcttttggtccatagatctgggtaagggagaatgcatgtgtgtatatatatgtgtgtctctgcctgcacagagcattggagagtagtagtcctagaatccctatttcatttaccaaataaataatggttcaaagtggttagttgaaaaaacaaaaaccagagtgcttcactaaatcacagtaggtccaataaatttagaccttattgatttctattgggtggcctgatggcctaactgccctttagaaaattatttcagtgaaaaaatgtgatctgagttctaggaagccgatttacagatgagcttttagaacacaacccttctgtaagttggggaatgcctgtagtgtgtaacactattcatgcagcacttttgaatagaatgaagcattttatgaaaaaccaaagacaaatatgaatttattggtgtattccaatgcaagcaattctgttcaactaagtagaaaatattacttctaaattcagattccattaactgctagacttaatgcacctgttataagtgacttctattaggaaaaccaagaaagatttcatatttttagatattttttgctgcatgaaacaatcactgtttaaccttttatctttcctgggctgccagttttctctatagtgcttgataaatgttactgactgctaatggggagaggagggtcagtgcctggggagagaatgaataaagtaggattaatgcacaggatatccaaacatagttcatatgatgtactagaactcttagttttgcttatatcagaagcaactcatttactgtgtttttaggagatcattagatttttaaaaatctttctcttatttaaaatcttaaatttattctagtatactacaaaatataaaaaattttccaccagaattagaacacttctgtttcctagtttgtagtgtcctcctttgtaattatgccaagaatttttcatgaaaaattattcactttcagtaaaattataaagaagcattgattcttcatttttaatgcactatattttgcatctgaatctagctttaaaggatgtactgcttttataccacgcttctgaatcttgtatttgcttgagtttcttaggttttaggtaacattttaaaacatctttcattatgaaaaattgcaagcatgtacaagaatagaatagtactcatcatccaacttcaacagttgtcaactcagggacaattttgttttaattataaccttcattactccccttcccttttttttatatgcaaacattttactgaagtctaatgcacatatagaaaagtacacaaatcatgtctacagcttgaggaattttatacatcctcttgtattatcttgaaggaattgtcatgctttacctatgtatttcatccttatattttaaacaaatgccattacaaagaccatgcttgtataatgaagctatttctatatctttggtgtattgataactagttgcaacaaactttccaaaataatccagaataatactataaaacaatttgatatggtttggctatgtcgccacccagatctcatcttgaattcccatgtgtggtgggaaggacccagtgggaagtagttgaatcatgggggcaggtctttcctttgctgttcttgtgatagtgagtaagtctcacaagatctaatggttttaaaaatgggagtttccctgcacaagctctctctctttgcctgctgccatccatgtaagacatgacttgctcctccttgccttccaccatcattgtaaggcctccccagccacgtggaactataagtccattaaacctctttcttttgtaaattgcctagtcttgcatatgtctttatcagcagcatgaaaacagactaatacacaattgttcctcatagtgaaactatctgattgttgttgacattttaagcaaatatgaggtggggagataaggagtccatgcagtaagatgtctatagctccttttctaccataaacaaataattgttgtttaggtgatttgtctttaaagcactctatttgtccagaaaatttacccaaaccttcaaattactttcaagtcaaatcacatagcttgtgaagaactccaagagggtgacgggacacagtggcagtaaagttaatatttttccttttctttttcttttccctatcataggcagtaggacttgtgacaggcttttctaggtaggaatgaaaagaaggaagggaagaaataaatagcaataaatgactcaatacatacatacatatatacaagtaaagcagaagggaggagaaagaagctgagggaaaaaaggatggataaggagagaaagcctgcaggacctcggggtattgtctggtccatggtgtgactgcatataagaagagcactctcgggccgggtgcagtggctcacgcctataatcccagcactttgggaggccaaggcaggcggatcatgaggtcaggagattgagaccatcctggctaacacggtgaaactccgtctctactaaaaatacaaaaaattagccaggcgtggttgcagtagcctgtagtcccagctattcgggaggctgaggcaggagaatggtctgaacccaggaggcggagcttgcagtgagcagagatcgcgccactgcactccagcctgggtgacagagcgagactccgtctcaaaaaaaaagagcactctctatcctttgaaaactcactggagattccggacataagaactgcttcatttctttctcttgcccattggaaacaagctttctagaatacattataattaaattaaattgtacaggtataatgaaaaaattaacagtgttccatggagatctcttccatgaactcatgcttatttttaataacatcagtatctttagggaaagtaaaaatgtgagcaaccaaatgggtaggttagagagtgagagcaggggaggatgtggaatccacactgctcaccctgagacgctctcgtggcttcagcagcgtggctctggcagtgacagcccgtcgcactgaacaccctgcttctccaaggcgtggagtgacagctcagtgtgaccagaccacccaggttaaatggcctgcatgctgaggcatggtgttctggactatggtcagcctttgttacactcctgaaacatttattttattttattttattttagcttaaaaagctgtatgaaattattttttgtatcatgtctaaaaatgaaatttttctcagttaaccccaactgtactaacttattcagagagtgctggtttgtggactcttctcatgtttcttgggtggtatctatattttaaccatttctcaaatcattagcacctttatttttagcatttttggcaggccaaaaatatagaggagataaaaattgaactcattggtttagatgcatcttaatagttctagcaaaagactctttggaaattggattttaattataacttgaaatatgaattttattcagtatttcttgttgatagccaagcacatttaaggggaaaaaaattgtttcagatttttagtcattcctatacatcaccacttcccatactgaaaatttgagaaactacttagtactagttctaactgatctttggcgaagtttgtggtatcattttctttttcttttttaaaatagagacgggctcttgctgtgttgcccaggctgtgctcgaactcctggccttaagcagtcctcctgccttggcttcccagagtcgggattacaggcatgagctaccacacccagcctgactatcattttcaagctagagctgtagctgaaattctgggcttggtaagcactcagcattcctcagtaacaggactacctgtggagaattccttcagagctgggcatggtggcccccacctgcaatcccagcactttgggaggctgagatgggcagattgcttgaggcccggagttcgagaccagcctggccaacatggtgaaacctggtctctactaaaaatacaaaaaaaaaaaaaagagccaggcatggtggcatgtgcctgtagtcccagctatttgggaggctgaggcaggagaataactttaactcaggaggcggaggttgcaatgagctgagatcgcaccactgcactctagcctgggcgacagagagactccatctcaacaataacaacaacaaaaaagaagtcctccagttaccgatgtgctttcattttattttccattctttggctcttaactctgttattagtttatatatcccaggccccggtggtagtaactactttacccaggcctgttcaggcatccctcactgtccagcttctgtcctttccactaggcctataaaatgatcaaacttttttatatgcacaagtattttcatgtgtgtcccctctgtctttgtcgtaaacgaaactttgtgtttctcccaaacctgtatgtcgtgagcagacttctcgaagggatcactcaccacagctcactgggaacctaggtagaagggtaccacttccagaccattgctctcgctgccatcagcctcacttttttttttcactgtttactacaaaacaaagtaatttcaagatattttttaaaattgacgttaagaagctagattaggtaacttcttataatatgtgacattaaatattttgagaaattcttggtttcattggaaggcatttgtaatgataaaccttttttcagttataataagatactaagcagagataattttgtcatcccagatagcaatttcttattaacaattgataatatttgaactgaaagagattcttggctttatttctatatttttttctatttaggtatttaacttttttgacatcctcttatcccctcaataggatccgaaatatgtctaaaattaattcaaaagaaaactatttgaattattgcttgtgtttgaaaacagtacttactgtagtattccacagtttcttcttttttttaggctaagacaattaaataaaaatgtaatggataagaaatatagttgaagtcacaataaagtatattttcttttatggacataaaacataaattttaaatgttggctatttaagaaaaaaattctcctggtaaatattatgcataaccattgctcaaaaatgtatacagctgttttccaacatatttatatacatagtggttcacttaagaccagccctgttagaaccttctgaatataatgtgctcttaatttataaatgggctaccctcagtgtataaaatatataggcatatatgttatacatacaaagtaaaaaatataaaaaggaaagatggaagaaaaaagaaagtatcctttcctataagatccagacagaaagtcattataattagtgggaccatggaaaatattggaaggatttcagttttggcaaatacttttcagaaaaatatccaagctatgagaacactaaatgtctatcttaataatttagtagatgtttctattcaaacattcagtgaaggtgtttccatcttctactatgtagaaaagaagacttttggggtgtctgttaaaagcgaagagctgctcatttttaacaggttagtaataaccttttaatcaagtatatgtcatgcagagactcaagtcctgttccagtagtgtttgagtatgtttgatggaagattccaatggtgagcatctgaattcttcgtacatcttagagggaatggagcaggatgttatggcaaaggagggggtcagccccaaaggtagctggcccaaccttaactgtggatgttaaaaaaaaaaaaaaacacacacacacacacacacacacacaccaaatatttctatagcattctttttgctgcattttctttattttaagccacaggtctacttggagggtcacgcagcaagtggcttataaataaaatgaaagtctatgaatagtgtcatcgcattaagagacaattgctgggttgttctttcattatgtaaaaagctcgcatcttgggaatccatgagttggtaggttttatggaatacctgagatgtaccttgctctgattaacattgccatgctactcactataaaaaagcccaagggcagactacagaagacactagggtcaccactttctggagattgagttgtaacccaacccattgacttcatcacagctttcttccatgtagaataacgaatttcactttcctcagcattaatctgaggttcaaaccgctccattgtgacggcggagaaatcctcaggttcaagactccatacgacgactccttctgcagcccctgccgccatggcagcacccaatgcagtggtttcgggcatcaagggcttcactactggaatatacagaatgtctgcttgtagctgcataagaattttgttgctggtccttcctccatcaacctgcaaatgactgagtggaattccacagtctcaattcatggcatccaaaatctctcgaatatggaaacaaacagcttctaatgcagcaaaagcaatatggcatttattggtaaactgagtgagtccacagattatccctcttgcgctgggctcccaataaggtgcatataaccccgaaaatgctgggacgaagtagctgccataagaagtacctacttctttagcaagtttttcaatttcttctgaggtctttataattccaagattgtctcttagccagcgaataacagcaccagctatagctacagaaccttccaaagcataatataccggtttgtctctgccaagtttgtaagccattgtggtgagaaggccatgatcagaaaatacacacttatggcatgtattacatagtaagaaatatcctgttccatacgtatttttggcttgtccaatctggaaacacatttgtcccaccagtgcagcagactggtcccctgaacacccagatattggcacaccttccaaggccccagctttcattaggccatagatctcagaagaactccgaacatgtggaagaatttccgttggaattccaaaaaattcacagagttgtttatcccattccaaagaatgaatgttgaaaagcatagtcctacttgcatttgttacatctgtacagtggacacctccattgacgcctcctgtcaaactccaaataagccatgaatcaatagtcccaaaaagagctcgtttttcttcaacggccttttgaacttttctcacattgtcaaggagccagcgaagtttcactgcactgaagtaagtgttaagtggaaggcctgtcttggacttgacaaagttattatttcctggaattctcttactaagactctcaacggtagactgtgttcttagttcaagccacaccacagcattgtagagaggctctccagttatcttgtcccagactacagtggtttccctctggttgctgacaccaatagcttttatgttggaaataccaatattgagctgtccaagtttctcacatgttttcgctatacactcatagacagaatgtagaatttccttagggtcctgttccacccatccttctcttgggaactcttgttttatttccacttgatgatgactaagtagttcagctgttcttgaattgaaaaccaaaaagcgcgtggaactggtgccctggtccactgcccccaccaatggccccaaaactgccttttttgaggctgccatgaaaccagcttcaggtccgcccgcatttgcggccggtttcctgggtgacggcggcgggagggggaggggcgagtgatgagtccaaagagcgaggccgcgcgagtccgctgaaccagcctcacttctttactggctggctagcaggctactgcattctctctgcagctcattttctcccttggcctccaggcatacatctgtctttaacactgagattatctttccctgtgtattttgtttctcctgccataaacgccttcagaatctatactgttggctcacgtgagactccttcatagctccttgtgactatcatcttccccccacaaacccattcatcaccttagactgcagttccagggtctgttggacctttctggtatttagaactctggggtccccaccttggttcggactagatgtgtgccttctcattctcttgtatttcttcataaatctgtgctctttggcccttgttcttccagccaactcttggccattcagcctagacccagtagtcagtcatttcaaagctattctctttatgtgcctggcattgcccacactgttgtgtgtgatagataacaggctcaatacaatttaacccttgcttataatctaactttatagtccagtaacaataaactcacaccctaattaagtatatttggaatatgcgttattctctgtaaaaccagtttttataacagtttcttctatagaaaatttacttcaatcatttgcccacctttctataatttaggctaggaatcactgcttggaataaacatcggttagaataaactcgatttgaatgccgccctcttgaaagaaattagtgttgagtgagtggttttaataatagtattactagccttagccatgggatatgcatgccaaagaatagatgctgattattcaacagtctattgtaatgttaatttactgatacagaagattcttcctttggagaactgtgaaagcacttgatacacagcactttttagctgaagttatgccaactcaaatgatgcttcttaaaagagttaattatttgtatattcatgcattcattatggtcttctttattccttagtaaactacatgcagtctctgctgtgccttgttgacagcaattttttctagcttacatgagttaactgttttcaggtttcattaaaactgccttatgttaatagaactgctggagacatacacggtttttttctcctaaagattaatagtgttgaaagtcaaagaatcacagagtattaatgttataggaaatcttagcagttatctagtctaacactttcattttattaattaggaaaatgaagaccagagatatttctgttttcccaaaaacactttgtctgttagggatgagctgcttgtggatctaagatgtggggaaaagcaagagagatcagatttttactgtgtctgtgtagaaagaagtagacataggagactccattttgttctgtactaagaaaaattcttctgccttgagattctgttaatctatgaccttacccccaaccccgtgctctctgaaacgtgctgtgtcaaactcagggttaaatggattaagggcggtgcaagatgtgctttgttaaacagatgcttgacggcagcatgctcctcaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtcccccagccccacacctgtaaagggtctgtgctgaggaggattagtataagaggaaggaatgcctcttgcagttgagacaagaggaaggcatctgtctcctgcccgtccctgggcaatgcaatgtctccgtataaaaccggattgtatgttccatctactgagatagggaaaaaccgccttagggctggaggtgggacatgcgggcagcaatactactttgtaaagcattgagatgtttatgtgtatgcatatctaaaagcacagcacttgattctttaccttgtctatgatgcaaagacctttgttcatgtgtttgtctgctgaccctctccctactattgtcttgtgaccctgacacatccccctctcggagaaacacccacgaatgatcaataaatactaagggaactcagaggctggcgggatcctccatatgctgaacgctggttccctgggtccccttatttctttctctatactttgtctctgtgtctttttcttttccaagtctctcgttccacctaacgagaaacacccacaggtgtggaggggcaacccaccccttcataagagactactgttattcatacttttgccctgacttctcaaatgggactctgcattgagtatagaggaattatggagaccatcatggcgttttaattttgttcaaaaaggtgcttggtgtttagaaatcaaatacaaagggtactttgtaccttattacaggatacaaaacagaacaaataacatttgagacttatattgttgattttattacacttatttgggatgagggtcctaacctgatgctctttttttttttttttttcattttttattgagatggagtctcgctctgtcacccaggctggagtgcagtggtgcgatctcggctcagtgtgagtgctgcctcccgggttcaggccattctcctgcctcagcctcctgagtagctgggactacaggcgcctgccaccatgcctggctaattttttgtgtttttagtagagataggggttcatgtgttagccaggatggtctcgatctcctgaccttgtgatccacccgcctcagcctcccaaagtgctaggattacaggcgtgagccaccgcgcccagccctgatgctctctcttgacctggtatggcaaattctagggactgtctttcatttcatgattagcttattttatttcctggagggaaatagaaaagttcaattgctttagagagtaatgagcatatatgttaattatggaaggaatggaatgtatattccatatacatatatggaaggatgcatatgtatattatatattatgtgtgtgtagtttatgtgtttaacgtatatagcatattgatggcatagtctttactacctggaattgttccctattgcagttatggtatttgtttagagagaagcaactgatgattaaatgtcagtataactatgttgggctttattcagtggccagtggtgaactactgaaggtaaattactaatgtcataagctatgatccataaacaaaatgacctgtcagtatgtgggtgaaaggttgggaagcaataattgaggttggtaatagggttagaactagtgtaatgaacatagagaggaggtgaatgaagcaagatcatagatatgggaactaactctgagtataagtagaggaaacagattaaactctgagatgacctaccttttagcattacattttaggtaaattctttgtaggtacattttagtgtgtgcatatttacagcaagtgtgcagtagctgttgatttttactgtaccttactgagatacagtaggatgaaaaagaattcattcactgaaacggaagaatttttcactttggctgtgttgcgttaggcttatattaaccaaactgatgcaaagatgttaggcttttagttgatggtatattcagtgagaaccaattatgtaatcgtgtccagaaaggtgtaaggtgattatcctgttctgttctgtccagatcagaccatagctatgaaattgagtttatttttcggttcagtgttttgagagagactgatgcactagagccctgaatttatagtcagggtgatgatgaagaccccaaatcatgttgtgcaagcagtggttgaaggacataggatggtacagaccattgaaggataatttgggaaaatataatgctctctgtaagattttgaggaatttcataagagacagattaattaatcttgttctgtttattgtggtggcagaattatcagtgttacaaaataagagtgaaaaagattttagagcaacgtacagaagaacttctaatagtaagtgtttgtattagtccatttccatgctgctgataaagacatatccgagactgggcaatttacaaaagaaagaggtttattggacttaacagttccacgtggctggggagacctcacaatcatggtgaaaggcaaggaggagcaagtcatatcttatgtggatggcagcaggcaaagagagcttgtacaaggaagctcccatttttaaaaccatcagatctcatgatacctattcactatcacgagaacagcatgggaaagacccatccccataattcagtcgtcttccactgggtccctcccacaacacatgggaattatgggagctgcaagatgagatttggtggagacacagaaccaaactatatcattccacctctggcccctcccaaatctcatatcctcacatttcaaaaccaattatgccttcccaacagtcccccaaagtcttaactcattttagcgttaactcagaggtccacagtccaaagtctcatcccagacaagtcaagtccctttcgcctatgagcctgtaaaatcaaaggcaagttagttacttcttagatacaattggggatacaagcattgggtaaatacagccattccaaatggaagaaattggccaaaacaaagggtctacaggccccatgcaagtctgaaatccagtggggcagtcaaatcttaaagctccagaatgatctcctttgactccacgtctcacatccaggtgacactgatgcaagatataggttcccacagtcttgggcagctcctacctcctggctgccttcaggggctggtgttgagtgtctgtggcttttccaggcacatgatgcaggctatcagtgataccattctgggttctgaaggatggtggtcctcttctcacagctccactaggcagtaccccagcagggattctgtgtgggggctctgaccccacatttcccttctgcactgccctagcagaggttccccatgaggaccccgctcctgcagcaaacttctgcctgggcatacaggcattttcatacatctgaaatcgaggtggaggttaccaaacctcaattcttgacttctgtgtactcacaggctcaacaccacgtggaagctgccaaggcttgaggcttgcacccttggaggccacggcctgagctctatgttggcctggcctatgttttctgtcatcttcttctgagctctccaaactgttccaacctctacctgttactcagttccaaagttgcttccacatttctgggtatcttttctgcagcaccccactttactggtaccaatttactgtactagttcattttcacactgctgataaagacatatctgagactcggcaatttacaaaagaaagaggtttattggacttaacagttccacatggctggggaggcctcacaatcatggtggaacgtaaggagaagcaagtcacatcttacatggatggcagcaggcaaacagagcttgtgcaaggaaactcccatttttaaaaccatcagatctcgtgagactcattgactatcatgagaacagcacgagaaagacctgcccccataattcaatcatctcccaccaggtccctctgacaacacatgggaattatgggagttacaagatgagatttggatggggacacagagccaaaccttatcagtgttcaaggatgatgtgactgtcttgccatctgttgatgtgtgtaaactacagccagataaccatttattgtgaaaatttttgaggttatgcatacatattatagaagctgtgccaggtgacctttcagatctcttatactattaaatcttttgatttttatggcattactgagaaagaattaacagggtttatgaaataattcacattaggggttaaaatagagtgggatgacgagggaaagggtaggtacttaatgaatttcatatttgcaagatgaaaatgttagatctttttcataacagtgtgaatatactactttttttgagatggagttttgttcttgttccctaggctagagtgcagtggtgcaatctaggctcgctgcaacctccgcctcccgggttcaagcaattctcctgcctcagcctcccaagtagctgggattacaggttcccaccaccattcctggctaatttttgtatttttagtagagacggggtttcatcatgttggccaggctggtatcgaactcttgacctcaggtgttccacctgcctcggcctcccaaagtgctgggattacaggcatgagccgccatgcctggcccagtgtggatatacttaacactgttaaactttacacttaaaaatggttacggtggtaaattttatgtttttaatcacataataaaagagagggagggaggcaagaatcactgtgactaagacttcattcatccttggaatcagagtgaagccattaggacacaaagggaacacgggaggtccagcaggtgtctggaggaggtcactgaaacggtttgaaatgtaggtatatcctcatcttgtttgcttgagggggagccagcagtgaagtgcagtatcaatttaaaggttctcagattgggcaagatgtttaacagtagccaaagacagcttggccagaggaagaacttgatttatgttgagaggaatatcaacagacatagagaatctttatcaaagtatcaggccaaagagtgaagcatagcatcagtggaaaaatgcacaatgatgaaaagtcagaccacagaactcaaaacaggccaaggtaagtggcccaaggtagtaattaatgtgaaggttttagaggactgcttatatgtgttactggtttcatggtgtttgggtggctctgtcttgtttaaaagagccatgatgattagatcatattcatatggagactaacagacagctagaaattcaaacattggggtttgggggagaggttggatctggaagcaacaatattagggtaataaagataactgtggacagtaatatacattagatagttaagacagaacaagtggagaatcaaaaggaggctgaaggcaggcaggaccatagtaatacctagttttagggaggtaaaggaggcagattcagtggtcagaaaggtagaaaaatatatagaatcctaaccagtagagaaggccattaagcttaaaatcagcagagaggttgagaaggactaatgccaagaaaaagacttccaaagaactatttcaaggtaaaattgagccagaggctatgccataacataaatatgtgagtgtgcatcagcacgcagaggcttcagaattgagatctgctcttgagaagtctggtgtggaggctgacaaggtaagagagcggccaaacgtagggatgttaacccagtgatctttctttttttagcagagcaggtatttgtccactgaagtcaagacagtgacatgcattgactgtctatagcaacacttcctttctcactggggaaggaaagtagttgaatctagttgcttgttttgtttttatttttgttttttaattttcatcaccagtgttttcaaatggttataaacttttaaaaatatttgtggtaaagaacatataacatgaaatttaccaccttagccattttaagtgttccactcagtagtgtcatgtgtaagtacttgctttattgtgaaacagatctctagaacgtcttcattttgcaaaactgaaactctgtaccttttaaacaacttgtcttttccactttccactgtccctggcaagtattattatacttcctgtttctataaatttgactcctttagatacctcatattagtggaatcatacagtatttttttatttttgtgactggctcactacacttagcataatgttctcaagcttcaaccatgttgcattgtgacaggatttccttcctttttaaggaattgtatgtatatatagtgtatgtatataccaatttcatttatccattcattaatccagcacatggccagtgaggacatagcgaatgacgaggagcacatggtcatccatgaggaggagggggtgatgatgtcattgctgatgacggctttagcaccactgacactgatctcaagttcaaggagtgggtgaccgactgagagtggggacagctctggggaggagccagagcgcaacaagggctttcatgggaaggtatttgcacctgtcattccttcctcctttactcctgccgccccttgctgaatcctgagcccccagggtcccccgatccacctgcagtttttggcaaagtctatggtcccaccccgtccttctcctacacattctcggatgcttcctcctcaaccttggcacccacctccttcttactgggcccaggagccttcaaagcccaggagtctggtcagggcagcagagcgggccccctacggcccctacccctggggatgggggcccagggacgccttccaaggtgacctgtttcctcccaatggatcctgccaccttctggtgcaagagacctgaaagtgtgggcgacctggagctaccaggcccctcagtcattgtggtccctcccaacactaaggctttcctaggcaggagctgggctgagccacccagggggcagagcctgaagaggagaaactgggctttgggggttggggcagagggaaccccacggacatggatcccgcactggcggaccccaccacacccaaatgcaagatgagaagatgctccagctgcagcccaaagcccaacacccccaagtgtgccatgtgtgatggggacagcttcccctttgcctgtacaggtggagaagccgaggacgggctcagggaaccggagacggagaaggcgctgtcctcttcactgcacgcgccctggaccagtgctggccttgatcatgcagctcttccaggcccactgcttcttcctgtccactaggccacagctgccctccaggcccactatgcacacatcttcccctccaaggtttgttctgcccctgccctgactcccagccctgcgggggtcctgaccccacctcacctggctcagactctgatgctgccctggctgccccaccactgcctctgcccgagagtcacgtgaggctgagagtaggggcaggggcagcagtggtgccagttggggggcggtccagtgggaggagcctcagcctcgtgggctgttccgtgggactgatgactgcatgatcttctgggcacctcacggatcttcaactgcaggtgaaacggatgctggtggtgggtgcagggccactgggagccgctgcatggtcccagaggctggactggggcaggtgccaactgaagctgctggggcagcatgggcaggatgttctgcacacaaaccttggagaagaaaatgtgtgcatagcgggtccactgctgctgcccctgccctgactcccagccctgcctgaccccacctcaccctgctcaggctctggtgcaactctgggtgccttgcccctgcctctgccccagagttggggcctcgacagcctggctggaaggggacaccccagccctgcctcaacacctgggtccctccataactaccacaggcagatgggcgaccccaaagaagatcccaggactcacagtaccccctgagaacatggacagtatgtgggggtagccatggaggtcaggatggttatcttctcccgggtaaagccatttaatcctttcagtttgggatggaataaggcctgctttttttaatttttttttgagacggagtcttgctctgtcgcccaggctggagtgcagtggtgcgatcttggctcactgcaaccttttcctgcctggttcacgcaattctcctgcctcagccttccgggtagctgagattacaggtacacgctaccacgtccggctaatttttgtatttttagtacagacggggcttcaccatcttggccaggctgatttcgatctcctgacatcgtgatccgcctgcctccacctcccaaagtgctgggattacaggtgtgagccaccaggcctggccaaggcctgctcctcttatatatacccactatccctgcagctgtaccgggggaaagcttggcagtttccctcctccgagcccctgtacatatcatgaagtgtgggaccttcagagcttttcacttttcggaaaatagctcctgctggggctacaggatggagtgtgaagagggccttgggccacagggaggtgcctgtcgactatggggagttcatgcaccccttctttccccagaggggctggactcaggtgagtatgggggtggaagctcctgcacttcgacacaggcagcgggagggttttctccccattccctctgctatcccaacttgagttgtactttttaagaaagtgattcaccctgcctttgcccccttccccagaacagaacacgttgatcacggggatattttttattgtgccagaaagttgccatgaccgtcattaaacctgtttaacaccaaataataaggaaaataaaataaaaaattcgggcttggtgcagaaactcactccaaataaattacctaccaaaatatttatataatgatggaaatattccaaaattccatattttgggatttatacacaaaagataaaaaaattagagtccaagaggctgccagaagtgaaaaacggggcctggaaaggccgttgtgaggaataagctgggcctaaagaggccactggcaggcgggagctgggcctgcagaagcggccgaaaggcaggagctttggactggggaggccgcagtgaggcgagagctagctgggcgtggagagtccgctgtgaggccgaggccgaggccgggcccgtgcaggccttcgggaggcaggaggccgggactgcaaaggccgactggaggtcaagttctgggcctgaagaggctgccaaaagtcaaaagcgggacctgggaaggccgctgagagccatgagctgggctgggctgaaagaggccactgggaggcaggaggagctgggcctggagaggctgactcgaggaagttttgcacctggagaggccgccgagaggacggagctgggcccggggaggccgacttgctgctcttccaggcccaattccaggccgacttgaggacgacttgggcctgcagaggccgccgggaggcccaagctgggcctagaggagcccaccgaccggaggccgtttggggcctgcagatgccatcggagggcaggagctgagcctggagaggccaccgtgaggcctgacctgggcctggggagcttggcttcaggaagctgtgggccgaccaaggccgccaggagatgggtaggcactgagtccaaagaggttgttgagaggcaggagtcgggcctggagacgcaaccaggaagaagagctgggcccagagaggacacccggagggtgcaagtgggtctggagaggccgacttgaggaggttctgggcccggagaggccgccggaagggaaaaactgggcctggaaaggccgttgtgaggaatgagccccatgggcctgaagaggccactggcaggcgggagctgggcctgccgaagcggccgagaggcaggagctttggacttgggaggctgcagtgaggcgagagctagctgggcgtggagagtctgctgtgaggcagaggctgggcctgtgcaggccttcgggaggcaggaggccaggccttgtcgaggcctgcagaggccaccgaaagtcaaaagcggggcctgggaaggccgctgggaggcatgagctgggctgggccgaaagaggccactgggaggcaggaggagctgggcctggagaggctgactcgaggaacttttgcacccggagaggccgccgagaggccggagctgggcctggggaagccgacttgagaacgacttgggcctgcagaggccaccgggaggcaggagctggccctggacagactgacttgacgacagtctgggcctgcagaggccgccgagaggaagagctgggcctggagaggccgactggaggaagtccagggcctggagaggatgcaaagcagcaaacactaggcctggaaaggctgccctgaggcatgggcttggcctacagaggccactggcaggagctgggcccgcagaggctcccgagagggaggagcattgccccaggaggccacggtgaggaagaggtgggcctggagagcccactgtgaggtagaggccgggcctgtagaggccgccgacaggcagggaatgggcctgttgaggccacgagaggcataagctgggcctcaacaggccagtgtgaggcaggagctgacacttgggcaggttgcaagaggcatgagttgggccgaaagaggccaccgtgagggaggagctgagcctgtacaagctgccaaaaggcaggagcagctttggactggagaggccgcagacagggaagagctgggtgtggagagtctgctgtgaggcagaggctgggcctgtacatgccctcgggaagcaggaggctgggcctggagaggccgacttgagaaagttttgctcctggagaggccactcagaggcaagagctgggtgtgaagaggctgacttgaggtcgattttggcctgtagaagccactggtagctaggagttggccctggagaggctgacctgaggacagttttggcctgtagaggccactgggagggagagcttggtctggagaggccaagtggagtaagttcagggcttggagaggatgcacaaaaggaaacgctcagcctggaaagtgtgctgtgaggcattagcttggcctacacagcacttggaggcaggagctgggcctgcagagggtgacttcaggacgattttggcctgcagaagcctttgggaggaagagcttggcctggaccggctgactggaggaagttttgggactggagtatgcatcaaaaagcaaaagttaggctaggaaaggccactttgcggcatgatcttggcctacaaaggcaactgtgaggcaggagctgggcctgtagaggctgccgaaaggcaggagcttggcctcaggaggctatgatcaggcaagtggtgggcctggagggtctactgtgtggtaagagtctgggcctgtgtaggccgacatgaggcaggagctgagttaggagaggccaacttttggagaatttgggcctgcagaggctaacaggaggcaagagctgtgcctggagagtccattttttagcataagctgggcctaaagagaccattgtgaggcagcacctgcctgggaggcaggcagattcgtggcctggggaggccaccgtgaggcaaatgctcagttttcggaggatgctgtgaggcagggagaaacttggctttcggtggccgcagtgagggaatagtttgattgctgaggctgctgggaggccgaaggtgggcctggaaaactttactttaagaagtctgtggcctacagaggctgccagcagctcagcaggagttgggccaaaggaggttgttgtgaggcaggagatgggcctgtagacgcactgggaggatgagctcgtcctggagatgccgagttaaggacattctgggcctggacaggctgcaaaaggcaaaagctgtgcctggaaaagtcgccatggggcatgagcttggcctgaagaggccactgcaaggcaggagctggccccgtagaggctgccgaaaggcaggagctttgcctgaggatgccacagtgagacaccatctgggtctgcagggtccactgtgaggcagaggctggcctgtagagtccgacagtagacacaagttgggcaaaaggctgatttgaggaagttttgggcttcaagagtcagccaggaggcaggcactaggcctggaaatggcccgacagtcatgagttgggcctaaatgggccaccgtgagggaggagctgtgcctgttgaggctgctggcaggcaggaagaaatttggcctgaggcagctgccatgaggcaagagctgggcttggaaaagcccctgggaggcaagagcaggccctgcagaggctgttctcaagtcaaagctgggcctgttcatgccaccgggaagcagaaggtgggcctggagagtatgacttgaggaagttttgggcctacattggctgccatgagctggacaggaactgggccaaaaaaggctgttgtgaggcagcagttgtgcctgtagactcagccaagaggaagagctgggcctggagaagcccccatgaggcagaggttgggcctgtagacgctgacaggaggcaggagctgggccgggagaggtcaacttgaggagattttgggccttcataggccaccaggaggcagcagttgggactagagaggctgacttgagtaagttttgggcccggagatgacgttctgggacaggagctgtgcctggagaggtcactgtgaggcatgagctggatgtagagaggccagtgtgaggcaagacctgggcctgtctaggctgctgggagacacgcaggaatctggccagggaaggttgccatgagacgaaagttgggcctggaaaggcccttgtgaagcatgagcttggcctaaagaggccactgggtggcaggagctgggtgtgtagaagctgctaaaggttgggagcttggcttggggggtccacagtgaggcagatgctgggcctcaagaatctgctatgaggcagatgttgggactgtagaggccgacgggaggcagaggctgggcctggaggggccaccaagatgcaggagctgggcctggagaggctgcaaagaagcatgagctgggcctggtgaggtcgacttcagaaagttcagggcctagagagaaggctgggaggcaggagctgggtctaaagaggccattgtaacgatggagctgtgcctgtggaggctgttgtgaggcagtaggctcatctgcggagactgccgtgaggtagggtatgggcctaaataggccattgtgagtcatgagcttggtctgtagaggctgactggagaaagttctgggcctggagaggctgccgggaggtaggagctgggccaaaagatttaagcacatttacatttattaggcacttcgtttccattattacactgtaatatctaataaaataattatagaactcaccataatgtagaatcagtgggcatgttaagcttgttttcctgcaactggatggtcccacctgagcgtgatgggagaaagtgacagatcaataggtattagattctcataaggacagcgcaacctagatccctcacatgcacggttcacaacagggtgcattctcctatgagaatctaatgctgctgctgatctgagaaggtggagctcaggcgggaatgtgagcaaaggggagtggctgtaaatacagacgaagcttccctcactccctcactcgacaccactcacctcctgctgtgtggctccttacggctccatggctcaggggttggggagccctgctcaagtgcatccaaagcgacccttcccacaccagtcttcatagtggtcaagtgcagtaaccacttagctcccaaggcatgtgcctcagctggcatttcgtcacaatcaacagtaagtggtagcttgagtcattgtgaggtcacttcctggaaatcaccagcatcccatttcccactggcaaagagctcagcactgccccctgggaaaccaaacctatgcccaaatcccatctgtgtgggtttatctcctgggacccttcctaacatattagtcagagtccaatcaggaagcataaaccactcaaaagtttaaagtggtaaaatttaatacggagaattattcattataacaggtgaacggcataatgagagattggctaacccaaagtaaagagaactctagagaatacaggactagcccaggccaggcatggtggctcatgcctgaaattccagcaatttgagaagctaatgcaggaggattgcttaaggccaggagctagagaccggtctggacaacacagtgagaccctgtctctatccaaaaaaagaaaaaagttagctgggagtggtggtgcacacttgtagtcccagctactcggaacgctgaagtttgagcctgggaggtcaaggctgcagtgaggcatgattatgccactacagtccagcctggtgacagagcaggctgtctcaaagaacaaaacaacaacaaccatttacagacagaaaagagatagagctaataagctaaggaaagatgttgaaatgtgacaagtaaagtaatatgaggtcttttatctatttaaaataatcaaacaaaaaatgacttagtaaattataataccctgtgctggcaaaggtgcagtgaaacgggcactttcttgtactatgaggggtgtttaaattgtgtataagccttcccgggtaaagcttgtcaatttcttaaaataatggagacagggtctcaccatactgccatactgcctcctccaactcttggcctcaagcactcctcctctcttagcctcccaaagtgctaagattataggctgggaggcacccaaaaccctgtcaatttacatcaagggtaatgagaatgtccattcaccatgtctcacagtaatcttacttctggggagataattcaatctaaacaaaaggtcatctgtacaaacacagtaaaaatctgggagtaactgaagacagagttggtaagtgaaataagaaacagttataagaaattaaactatgatatcaataggcacctggtataaaaggtcagttgatgttagctgctacttttttgttgttttgagacagggtctcactctgtcacccaggctggagtgcagaggcctgatcatgactcattgcagtctcagcctccctgggctcaagtgatcctcccacctcagcctcccaagtagctgggactacaggaacatgccaccacactaggctaattcatgtatttttctgtagggatggtgactccccgctttgtttccaaggcctatcgcaaactcttggcctcaagccatcctcctgcctcagcctcccaaagagttgcgattaccagtgtgagccaccacacctggccagctgctacttttagcaatattattattattccactcaattaaaaattattattttcaaggctatgcaacagtatgtatcctacagcgtaattgtaaaaacatatacagtcgtcgtccctcagtatacagaattagttccagccccccatctctgcatataccaaaacccatgcttactcacgttttgctgtcaccactctggaatccacttatatgaaaattccaaatattagttgggcatagtggcaagcacctgtagtctcagccacgtgggaggttgagatgggagaatcacttcagcctggaaggttgaggctgcagtcagctgtgatagcactactacactccagccttggacaacagagggagaccctgtctcagaaataaaaacaaaacaggttagaaattgtactgaggtctgttgggcaaaattccatataagcaaagtataaattaataaagcaaatcgtgataaattagtacgattgactttctggagtttcagacaataaaagtaaggaaaatgcaaaacacaaagacagagagtaaaaagagaaattaggaaagcattctacatgtttaataggaagacgctggccatggtcgtgcagcggcagtatgtcgtgacatgacataccttggagagaagttaacagatgaggaagttgataaaaatcatcagagaagcaaaatactggtagtgacactcaagtaaaccacgaaatttccataacttatgtcagcaaagtgggaatattgtacagtgtgtgttaaagttcctatacaacattgtttatctgccttttgtttgtttgtaaggaatgtatatactaaaagttcttcttgctgtcaaaagaatatgtgtgaataagtcattgtaacttcttcttctgtttttcttttatcttcctgccatcatcccacaaccttactttagaaattttttctttagaaaattgaacaagtgctccttgtggtggcacatacctctaggatgggaggcaggggtggaagggtcacttgaggccattagtttgacaccagcctggccaacaaagtgagaccctatgtctacaaaacaatttaaaaattagccaagtatcgtcatgtgtacctacagtcctagctactcaggaggctcaggtaggaggatccttagcccaggagttcaaggctgcagtgagctgtgatagcactactgtactcaagcctgggtgacagggtgagaccccatctcctaaaataaaaaacaaagaaaaaaaatagttcaagtagcaagttgtatgtggcttactctgaatatttctaaactagaaattctcaatcttttggggtctaacatccctttacattttttaactttattgaagatctctaagactatttctttctgtagataattatattaaaactagaaaataagacacaaatttttaaatattattcatcacatattaaagccattacatgttgatataatacaagattttaaaaatatttaatattcattacatattaataataaaaccatgacatgttgatataatacttttttttttctttgagacaaagtcttgttctttcgcccaggctggagtgaagtggcacaatctcagctcattgcaacctccaccccgcaggttcaagcgattctcctacctccgcctcccaagtagctgggattacaggcgtccactaccacgtccagctaattattgtattttcttagtagagaaggagtttcgccatgttggcaaggctggtcttgaactcttgacctcaggtgatccacccgcctaggtctccctaagtgctgggattacaggtgtgagccaccgcgcccaccccgattaatatatgttttaaaacactgattagtcaggcaacaacaccgggcaggggtctcctcattcccagcgacgcaaaccccactgcacggctgaggggttgcaagggctgcagagccaaaaggctctgacttgagatattattttacttgtatttttatttgtattgtgagacaggtcctgctctgtcacccagactggagtgcagctgtgcacttacagctcactgcagcctcgacctcctgggctcaagccatcttcctgcctcagctccccagtagctggtagtacagttgagtgtcaccatgcctggttatttttttaatttttttgtagagtgaggggtcttgctatgttgcccaagctggcctcaaactcctgacctcaagagatctgcccacttcagcctcctgagtagctgaaactacaagtacacatcaccatgcctagctacatttatttaattttgaaaaatatttttgtaaagagcagatcttgctgtgttgtccaggctggtcttgaacacctgcccttaaaagatactcgcacctctgcttaccaaacagctgggactacaggcatgagccactgcaatgagcctgaagagatttctttaatctagcatcccatacttggtaggattgggaaaggcagtagtgttttttaaaattacttaataatttcagtaacaatcaaactcaaccttgacccctgccttctctcacaccccatatccagtctgtcaggaaatcctgttgattgtctttgacatctactaaagatccccacccagcaactccctggcctcctcccctagttctcccctctgaccatctctcaacaccaccacgaccctggtcaggaccaccatcatctcccgcctggatgttgccaaagcttggcccccatgcttctatcacatcttcccacagtctttctcaactcagcagccagagaatgcttttaaatcgggagacagatcacgtcgcctctctgctcagaaccctcccgcagttcccatctaagtcagagtaaaagccaaagccccaccaataacctcccagggcttatgtgatctgtactgatcctcacccagcaactccctggctccctcccctaattctctccctctctccatctgctccatgggcctccttccagagccggagacacacctcagacagtttattctattgtttctgcctacaatcctcttccctcagcaccttggccagctccttcccctccttcaagtctttactcaattttcacttaggaggccacccctgaccattctagtcaacactgccatctgtccccatgcccaccatgctcatttcttctttctttactttcttctttctttttttcaagatctcactgtcaccaaggctggagtgcagtggcgaaatcacagctcactgcaacctcaaatttccaggctcaagcgatcctcccacctcagcctcccgagtacctgggactccaggttcatgccaccatgcctggctaaattttttagtattttattttattttattttattttattttgagacagagtttcactcttcttgcccaggctgtagtgtaacggtgcgatcccggctcactgcaacctccacctcccagattcaagtgattctcctgcctcagccttccaagtagctgggattacaggtgcgtgccaccacgcccagctaattttttgtatttttagtagagccggggtttcacaatgttggccaggctggtctcgaactcctgacctcaggtaatctgcccgcttcggcctcccaaagtgctggaattataggcgtgagctaccacgcctggccaattttttcattttttgtagagacaaggtcttactatgttgcccagactggtcttgaactcctggcctcaagtgatcctcctgcctaaattcctaaagtgcgggcattaccggcatgagccatcatgcctggcttcatgttcatttcttcttgctgctgcaacatagtttgaagtttcctacatttagtggcttaaaacaccacaaatctaccatcttacggttccaggggccagaaacccaaactaggtctattaaggctaaagtcaaggtgtcagcagggctgcattccttctggagactctaatatgttcccttggcttttccagcttctggaagccacccccattccttggatcatggcccctgactccatcttcaaagccagaggtgaagcatcttcaaatctccctctcttacctctgctttcatcaccacatctcctgctccaattctgaatctcctactctctttcttttataaagacccttgtgattgctgggcatggtggctcccacccagaatcccaacactttgggaggtcaaggcaggaggaacacttgaggcccgaagtttgaaactagcatgaaaaacacagtgagacccccacctctagaaaaaaataaaaataaatattagcccgacatggtggtatgcgcctgtagtcccagctacttgagaggctgaggtgagacaatcgatttagcccaggagtttgagatcagcctggacaacataactaaatctcatctctacaaggacgaggtgggaggatcacttgagcccaggaatttgtggccagcctgggcaacaaaagaagaccccatctggccaacatggccaacctggccaccatggcgaaactctgactctacaaaaatgagctgggcatgggtgacatgcatgtggagtcctagctacttgggaggttgagatgggaggattgcttgatctcaggaggccaaagctatagtgagctatgatcacatcactgcactccagcctggatgacacaggagatcctgtctcaaaaaaaagaaaagaaatatatatttaatctctgtccctggttcgtggcacagagcttctaaagctcttacaaagacctcagtgatagatgtgacaggaacatcttttgttttaatatttggtcttggtcccaggttttaacacaagagcctctaagaactttgggatctccagcatgtaagaatgcatttggggatgttgttgagatgactgggtgactgcaagctcctaaatttcctcaagaggagggctgattaccacgcaaccacatggtaagaggcttggaactttcagcctcatgcactgaactccaggaggaagaggggctggagactgacttaatcaccaacagccaaagattttatcaatcatgcttgcataataaagcctccataaacaccctgaacggggtttgcagagctttcagggttgctggacacaggagatgctgggagggtcgcatgttcaacagagggcatgggagctctgtgcccctccgaacttaacttgccctgggtatctttcttttttttgagacaggatcaggctcttttgtccaagctagagtgcagtggcacaatctcagcttactgtaacctaagcctccccagtctccagctcaaggtatcctctcaactcagcttccctagtagttggaactctaggtgcacagcaccacaccggttattattattatttttaaattttttatagagacaggttttcaccatgttgcccaggctggtctcaaactcttgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctcacatctgtaatcccagcactttcagaggctgaggtgggaggatcacttgagaccaggaatttgtggccagcctggccaacacaacaagacccatatatacaaaaaataaaagaaactagccagatgtggtggtgcaggcatgtctactagggaggctgaggtgggagaaccactggagcccagacaatcaaggctgcaatgagctatgactgcaccattgcacaccagcctgggcaacaaaataagaccctctcagaaaaaaagaaaataaactgtttttctgagttccgtaaactgttctagcaaattattaaacccaagaagacagttatgggaacccccgattggtaacaggttggtcaaaagtacggtgacaacttaggacttgccattggcatctgaagtgaggatggcctcgtgggactgagcccctaacttgtggggtctgtgctaactccaggtagtgtcagaataaagtcatgggatacccagttaatatccagagcactgaagaatttggtgtagaaactccatacatacattcagtcggaagtgtgtgagtagagacaaacatgggcttttctgtcacttacctgcttaactgcataggagaggcaatatgtggtgctcatgaacaaagcaaacattaaaatcagaccaaacccaacatttgactcagtcttaatatccaggcgagcttgggcaaatcattcattattcctaaggcttcatcactccattcataaaatggggataactgtggcacctacctgtgattctgtgagaattaacgaaatattatgcttggggttattgtgatcattatacctattccaaactatttgacaaggacagtgatggatgatgacatcaaaaaatcagaaactgcaatgaggtctctcaggcaaaattccatacaagcaaattactgtgtctacaaagcattcctgccacacttaattcaccattccctgaacaaaatatgccatctttgtggttcaggtctgtacagtgctggtttcccttcccgggcagtttgcgctatcccatcccagcccattccccatccctccacctcccccttccctccccactctcatacaactcttcctcatctttcaggacttggcttcaatgtcaccttaactggaagcttctctcactctccagaagagcttcccattgcacttgatgcatgcactattatttgatcatttttaagttagtccaaatctttttgtacctgaataacatgttgcccagtcagtctctcttcctggattcagaagtctttcatggtagatccagctggaagtgacaaaaagacatcttttgacataaagggatgacacagacagacataagttcttacatgtcttaaatgttatgtgaaaattaaacagaattcaaagacttgtggggaacacttaggagggaaagttactgggaatgtcataaagggttaatttgtattttattttattttattttttgagacagtctcattctgtcacctaggctggagttgtggtgcaatcaggctcactgcagccttgaccacctgggctcaagtaatctcacttaatttttatctggtttaagaaagtcttggttgagggtggtggcctatgcctgtaatctcagcactttgggaggctgagagaggtatattacttgaggccaggagtttgagatcagcctgggcaatatattaagaccctgcctctaccaaaaaacagactgagtgtgtggaagacaatttttccacagactgggagtgagggaataatttcaggatgattcaagtgcattacatatattgtgcactttatttctattattactacatagtaatatataatgaaatgattctacaactcactataacgtagactcagtgggatctctgagcttgttctcctgcaactagactgtccatctggggtgatgggagacagtagcagaatatcaggcattagattctcataaggagtacacaacctagatccctcgcatgcacacttcacaacagagtttgtgctcctatgagaatctaatgctgctgctggtctgacaggacatggagctcaggtggtcatgcaagcgatgggaggggctagaaatacagatgaagtttcccttcactcgcctgctgctcacctccagctctgtggccctgtggttggagaccgctgctcaagtgcattcgaaaggatccatcccatgccattcttcagagtcatctttactgctgcagtggtcaacttgtagcacccctaagctcgcaggacatatgcttcaactggcatttcacaatcaacagtatgtggtagcttgagtcattgtgaggtcacttcctggaaatcaccagcatcccatatcccattagcaaggagctcagcactgctccttggataaccaaacctactcccaaatcccatctgtgtgcatctatctcctggtacccttcctagcatcaattctgtatttgtaggagtccaatcaggagacacaaaccactcaaaagtttaaactaaaatgagcaagatggctcacacctgtaatcccagcactttgggaggccaaggtgggtggactgctttgagctcaggagtttgagaacagtctgggaaacatggtgaaaccttgtctctacaaaaaaacacaaaaatcagctgggtgtggtggcacttacctgtaatcccagctactcgggaggctgaggcaggagaattgcttgagcctggcaggtggaggctgcaatgagcagaggttgtgccactgtactccagcttgggtgacagtgtgagacccggtatcaaaaagaaaaaacgtatacatatgtaaatttaatataaaaagtattaattttggccaggcacaatggctcatgcctgtaatcccagcactttgggaggccaaggcagacagatcacctgaggtcaggagttcgagaccagcctgaccagcatggagaaaccccatctctactaaaaatacaaaattagctgggcatggtggcacatgcctgtaatcccaactactcgggaggctgtggcaggagaatcgcttgaacccggcaggtggcggttgcgctgagccgagatagcgccattgcactccagcctgggcaacaagagtgaaactccgtctcgaaaaaaaaaaaaaggtattaatttttacagaggatcagcacaatgagggacacgctagcacaaagtaaagacaactctagagaatacggaactagcagaggccaggcattgtggctcatgcctgtaatcccagcaatttgggaagcctaagcaggaggattgcttgaggccaggagttggagaccaatcagtgctaaatagtgagactctgtgtctaccaaaaaaagaaacattagccaggtgtggtggtggtgcacacccgtagttccagctacttgggagtctggggtgggagaaatcccttgagcctgggaagtctacactacagtgagccaagattgtgccactgcactccagcctgggcgacagagtgagaccctgtcttagaaagaaaaaagaaaagaaagtgttaatccccctatgggaatctcctcttctcctgccctctctggaacctcacttgtcagttcttcctcccactttcctgtatctttaacctatcccccacttttagctccttcccatcatcatttaaattactcaaacttcttctgttttaaaaacctctccctaaactcagtgagaggtctcctgcacacccattgagccatctgctctccctggcgccttctctacagcagcctgagccatgtctctaatccatgaatctcatcatgttactcccccatttacatcacttctccttgcctcagggattaagtccaaactccttaacagcccctgctctgccctgccttgcaaggcagcctcactgcttgcccctctccatttcatctgctatggagtccaactgagcctcatctgccccttcaacgcacactctttctcctctaggagtctctgaagtgggtaatatcctctgcttatactatgcttccccttaaacctctactctcttcctagctagcttcgactcctctgtcacttgtccgctttggcatcacctcctcatagaagacttctctgactcccgagattctcaggagcatggcaggtgaggtgctcctcccatgaatggatggagattagggagtgtgtgttattcatgcttaattcacc

SEQ ID NO: 314 - DNA, 290833 bp, Homo sapiens
tattcccccagagatcccaagttctagatcaacatttctccctccaagagaccttttaaaatattttaaacactgcgtaaagcaagtttaacttgggtgcgaaggagcctaatttgactctgctgttaaattaataaacatttcaagacaggcaattcttttgctattattaagggttaaggctgaggcaaaataaacaattttaggaggcaaaagttagatagagcagatgtttatgtatgcagaaaaaatatgtattcaagttccttttttattggattcattgcacagtgtttactgaaacactgaagtttttttttttgagatggagtctcactctgtcgcccaggctggagtgcagtggcggaatctcggctcactgcaagctccacctcccgggttcacgccattctcctgcctcagcctcccgatcagctgggactacaggcgcccaccaccatgcccggctaattttttatatttttagtagagacgaggtttcaccgtgttagccaggatggtctcgatctcctgacctcatgatccacccacctcagcctcccaaagtgctggaattacaggcgtgagccagcacgcccggcctgaagctttttataatgtgaacatactgataaatttggtacaatgagaaatttcacttgttcaccataaatgatttttttaaaaaaaaccttattgtttcaagatgtcaactttcagaattgacatgtaaaatatattgaaacatggttattttcaataaattttctaagcccaaaaacattgaataaaacctaagatatgatttgtgagatgtgtgtcgaccaagaaaaattatgtaagatgggtgtctcagttattgattaatccaaaagttgtagagttgagccatgatctccagaaagtgcccaaatgactatatgtatgtatgcaatccgtgatccaactggcctactccagaagagattttttttgttttgttttgttttgagatggaaacggggaaccctctaagctttgtttgtacttcccgtttctaacaaaaataaatgaattattttcagagaggggtctactctgaggacatgaggcctccccatctggcatcttgctctggtcaggtgaaccaagcccagtactttagccagtctttagtcctttccaaggtcatgtttttagaataaagttccctgctgcatttagtacagtggaaattttgccttcagtttcctgctataaattatactcatgtctttttctaaaacaccacaagatcctcttagatccctccatcctacagcctttctcaatatcctgattgatgtttctctactttctgtgcttcagagtaagagaaattcctttaaactgtcttttcaaagagatttgcacccttattctcttctaggccctatgaccagccctagagcaccaaacttatgccagcttttaagaaagaggctcttcctgggttccttggagtttgaaaagctggaaagaaacattgctgtcatctatttcaacctcctcattttacatataaagaaacagagaagcagagaggtcatatggcatgaccatggccacttcttcacccactggttgtagctgtagcatcttacatatgtggtgtgcagatgagttcaaacagaagggccagttgataaaaccataaataaaaatacccgtttgttaattgacatgaaagttataataatattaaatagtctattttggcagggagtggggaagacatattttgtttctgaaaaaagtcctacggatgatgtattttcttttggaacattctgaagcttcagtttaagtgtccaggcaacgagaagtatttcccgttagattgtagagaatgccttaacaaagattctgtttctcaaaacacgggataaccaatctaggataaagaatcaaagtttctttttttgtttttctttttttttttttttaaatttcctagtagacttttgagctgtttttcttagctgaagaagctcgacaagggagattacaacataagtttataaaggctctggattctgctctatctatggcttatcaaagagttatctggatcctcttgggacatagaggtgacctcagaaaatatacaattaagtatttcaagtttgaaagtacactttatccttttctgtcctatcttttttcctagttacttcacttctatttttccctctactttccaataactggagtgctggaagaagtttaatacaaccactacattcagtgcttctctggtatattaatattttcctcaatagtcaacaacaagtggctgcctggtttcttccttaacatgtctaatgtcttaaagtgtccatcctatttttagcttgttctgttgtttataaatatctctttatcaaccccaaatttgtctttctgtaatttttgccagtggaatcttgttttgtcttctggagtgacagagatttctaatacttgttaacatgacaactctcaagatatagttattgttgaaagtcacactccatggatcattgctgtttccgcatgtctttacagcagaggcagtgacaatattttgttcttttcaaagagatttgtttagagatcgtatctccctttccctaaaaaaatggctgggcaggtttgcttgcagcccattatgaaagactgggttttcctaagctcagagttcccctcctgtaatgcagcccattgtgtgtgcaagcaccatctggctttttttgtgttgccctgtgggaactggagcttaaggaattggcacaggaaaatgctgatactcagtgttgtgattgctgtaaatgataaactgtcctttgcctctgacccagaggtcttgtgtcttctgccggcatccatgaaactgtggcaaactagttatcctgtaagtagggtaaaatctcagatcctaccttgttcttgatggttatcatattcccccaggataaacaattccagcaacttcaaccaccctatataattttcaggtgctttgaattatctcttatccttatcaaaaattctggatgctcttcagtttgaccatctccttggtacctagaaaggaaaataatagttcataggtagtctgactaaaatgaggggaatcaaattatcacttactttgttttgaaaaccgcatgacgttttatacctgactccctcattatcgtattcattgcagtctccatctttgtatcacctgtaaattggctcagcaagccttctatttatttatccacattaatgataaaattttgaacatatctgagccagagagagagagagtcctgggccttgccacagagatctcaatgcacataagaagtcaattggcagcagtaattgtaagcaactgctcccatggaaagctccatggagcacgtccatggagatgttcaaggacggcgagcatatgaagcatgatgacttatacaagtcatgcagtgaagcttcaaaaggaaaccaccaaagtgatatttgtgtagcttccagagctcagctaaaatgccatggattcaaatgggcaagtggaagtcaacactgagtggtgacaagggactctgaacacattgtctaggacttaaaattcactggcactgaaaagacttttggctacacctccacgtctctgcccagcactgtaactgtttatacataatcatgccttatttgcctgaggaaaacttttcctcgaagggattatcagttatttattcatcagctagagatagcacagggtagtgaaagagtgcatgcctgggactctggcaacctgggttcattactgtttccataaggagttagcttagaggcttttgaaaatcacttaattttggccaggtgcggtggctcacgcctgtaatcccagcactttgggaagccgaggtgggcagatacccgaggtcagaagttcgagaccagtctggccaacatggtgaaacctgtctctactgaaaacacaaaagttagctgggcatggtggtggatccctgtaatcccagatactcaggaggctgaggcaggagaaatgcttgaacatgggagacagaggttgcagtgagccaagatagcaccactgccccccagcctggagtctgaggtggacagactccatttcaaacaaacaaacaaacaaacaaagaaaaacatttaatttctctgggcctcattttttttcatttgtaaattcagtttgggccaatctctaaattctgttttacttcctaataaacatttatagctagaattttgggaacaatttgctgaataccaatatgaaagaggcttgaagaacttggatagtaagccccaggtcacatggtccatgtgaagcaaagcaggaatttgaattcagtttgccgtgaatgccttcctatctacaaaatagaaccaggcttcaagcaaatagaaaaaactataggaataaggaaaattctagaaatagaaataaggttttccgggaaacactaaattgcgttaacattctgctgaagttattattggcgtttttatgaaacctccaggaaaagaggatttattagctaaaaagtagcttttgacaggtctgtgaggttgttcggtatacagttttgttttgtttcggatagatcctcatcctgtttgcattcagcctccagctctcacaatttctgtgaccttgggaaaattaatttttttatacctcatttcctcatctgtaaaatgggcatggtatgaatagcatctgctccacacaggtttttacgagaactaaatgggaaggtgagaatagtatctaataagcttgtaataaatattggcttaataaatattacattgcagaagatattttttacatgggtagcttgctgaaatcctaaattatttaaatatgtgccaaagcacaaaactctggaattagactaataagtgtaaactttataaaatttttctttatgattgtttcatttgtttttccaaattcagaatataataaagaaaatgtttagttagagtgaagattaatttgagctctgtgcttgaaataaaagctttatctttggaactagcacagacctctaggcattgagagaacaagtttctctttttcattcccagaagtgctctttcatcatacatattttttttctttatatgagccaactttcaaaatatttggaagaagaaaggattcattctcaggtttctcattattgctttgctggtgaccttgggaaagtcaattaaattctttcatgtttttcataacatggaaataataagtgagactattcagcacataaatcaatgatttgggagtgcttaaaatcctgcaaaaatatgaaataccagaatattactatttgaaaataatgaatttctgtttgtgttccaaaaacaaaataatcacatattttattgataaaggaaggtacatcgcacatgtgacaaatgctatttcctagtccccagttaacatattcaatgctgaaacatggaggatttattgtggatgttctgtagcagtgtaatccttgccccttgccagcctgcctccccctctaagataagtagagacttttgccgctatttttagtttgaaattagatttaaatagggaaaacattaatctcgtgattaccctcctcacagaattccaagcctgagctttcacagaggtcacactgttccttagagtgatctgtaactgaagtttcaaagaatacccagctagtgagtccaggaatgaaactatgtgtttatttaaatatctcaccaaggagggcaaaatatgagaatgatgtgtcctctaacatttgcaaagaaatctttggcaataaatcccaatgactctttggaattggatagctctgctcagtatgttggacagatttacaggatatcaggttatggggcacagcttttggtgatgatatttctatggaaacaagacctctggggagatgtctacaatttgtgcaccctacaggacttctctgggaggtcaagtgcagtaggccctgtggttagctgccatcttgccctagctcctcttcttagagtaactttcctctttggccctggaaaagacctgcctggtttcttggattgttctatattaccgaatcattattttgttctatattaccgaatcattctttgcttacctttgtggataattagaatttaagaggtgaagttttctgaatattgccaggccttatgttttatttattaattaattcattctgaacatgcaatgctgagtgtccattgtgtatcaggcaccgtacaagatcctcattagcgttacaaagagaaaaaacagagtacctactctcaaggagtgtacattctagttagggagcagaaaacgttctgcttttatgaatacctattgactccttagtaacttttgaagaagctaaccttttgataaaattttgcccatttaagtttggtttgcattttaccttctagaaacaaaattttcgttagtttttcagtgaatatgattttaaagcatttcatagaatttagtaaaatatgatatatgagtaaatgttattgaaatatgttaatgttttgaatgagttcttcagattccagaactgctcaaagtttcatttctgaaaatgggtttaagacagatttagagaaaatgcttggatttaagtcaaataaagaatcttaagttataggaagacaaattaaataagttatgactagaaacagttatctgggtaactgagaccccttctttcccaggagtcagtgcttatgtctgtatgtggagaggggttgatattcagatcaactgatctatgaacagtatccatactgcccaaaacttctgaggatagaaattatttgtaatcatccttaattaccttatatttcctagccaacacactgccttgcatataataaacattcaacaattatttgctgcatagcattgaagtgaattgaattaagtcaagtgtctaaatatctgcttatccccatgaccactaaccactggctgtgataaactttcttggtttgactcttaatattgaaaacacaagggcctgttcctgactttttctttctaccctctgtgtctcatttaaaaaattactagtaggcccactgtgagtgaattttgtttttgtgtgtggattttccttaggactaatttcatttggggctgagcttttccttctaaccctcccttgagtcctatgtaaacaacatatttaaaaatagaaatgtattgattttttaaaagatgatcccatacacgaggtatataaaattactgcttttaaaaagtcactgcctctccctcatccagcttgaaatagcatttagtataataaacatttacttactaaacatactggaacagaagaattgggtgacagattattttatgtttaaacatccactggcaaacactaaccaactctttttcaagttaactagactgggtctttttggctggaagcctctcttcacttagctgaaatggcactctgcatgttttaaggagacacacggatttccaaacttaatctttaaatccctaatactcggtctgtgctataattcactaattctcttcttgttaaaagacagtcttaaagaggaggagtgaaattatttttaaaaaatcaacagcaaacttcgaaatgtgtgtgtaagctttttgttcaagggaatcagaatggactgcatgtttgttttcacattttcatgcatccattttccaatattatagatttagtagccaaggtctaaattgatacaacttgttcctttgtttaataatttatttgacaaaaaggcatagagagtttcctgtgtggaaggcatcttctcagtggacacacactgtctcagatagcatcatcaccttcacttaacctatttaagatccaagacaggagctaaggatcacaaacatctagcaggttacagtctgagtgtgggcaaataggctgaacggtaggtcactgctggttggacactgtggaggaagtgccatttatcttagatcctgaagaacagggggaattctaacatgcaaaatcagaagaaaagaagaaaaataaattatgtggtgaaaaaagtacgggactggaaagcaacagatctgggttctggcctctatcagaaattgatttcatgagctctagtacctcaagcttctcatttataaaatgaagaattgggctagatgatctccagcttcttttccagttctaccattctgtgactatatggcacttcaaacgaggggaatgacctgagcaaaggtatagatttagtatgaatggtaatggatgaacagtaatcatgatgagctggtatgtagggttcatgatgaagaaaataacagtaggctttggttttgaatatcaaggtgagattacctggaaaaatattagtgatcataacaagatctgatattaaaacagtattttgattgtagtttggaaaagcaaaacctttcagtttgctttacccatcttctgacactcagaaaatagtactgaatggccagatacttgcatgaagttttgttgctcttcttattgtatttccagttgctccaattaattgcttcaggaaagtttggtgatttcttgctcttctcagagagaaaccagtcccaatggtgggtaaaatttagacatttgggatgtttaagaaacaacgatatcaatcttggcatctcagaggaggagccaaggccttctgggggcatcagaaacctttctttctaacctgtttgttatataggttgctggtttttgtcaacaagttggtggttttggaaatacatgaaagaagatgtactatttcaggttataaaatccttgtgaaggatatctttttgtgagccaggcttagtcaagtcaaagtcactgggaggtgccatgagacgccctcactacacacacacacacacacacacccatacacacacacacacacacgaaaagtaaagttcttccagctaaacagagcttcatcttgctgtgcatttctttgccgtcctaaagcatcatagctcctatgtgaagagcaaggagtagggggctgcaacagtttggactttatttgaaggacagggaggagtaattgtttttgtttttttatttttgagtagagagtggttttatttgaatctttcattagtaaggttgatttggagacagaatacagttcggatgagacaaattggagtagggagactgtacaggcagagaaatctgctaggatgtattatgagaagcttaaaatagataataatagtaagactagaatggaagaaattttttaaatgttgagaaggaagactagaatgatgtagaacagtgctgtccagtagaaatataaagcaatctacatatgtaatctaaactttctgatgaccacattaaaacaagacaaaaagacataggagaaattaattctaataatatattttattcaactcagtcatttcaacatgtaactaatttttaaaaaatattagtgagatattttatattcatgctttttgtactaagttttcaaaacttggtgtgcactttgcacttacaggtctcaatttagactagccagattgtaagtgctcagtagacacatgtggttagctgctaccatattgttcaacacagctctggaatgatgacaaattgcataaattggactagaagaaggggagggagaatctgagggattgagtctaaaaaaagaagagtgcctcctttattaaaactggaaatatcagaagatgcatatgattgaggaagagagtggggatagaggatgagcaagtaatgattccatcattttgacttaaaagggccagtaaaacacctgttgggggatatgtggcaggcaaccgtaaaagtagggttattcagcatggaagacagaactcaaaatggagatacagccttgggagctggttctaagagcatgaacatcagaaatggtgatattcaatgtggttactagtgcagaggtacggagagaggagaaagccttgagcaaccctgaaagtggagggttcaaggaagaaggtgatttggcaaaggagaaagggtcacagtcgaaggctgggaggagagccagttctagcagtgcctgagtgagggattgttgagctgaagtctacccaggattaggaaggcacataaggcaggagaaaaatggaagcacaagaagaaacttatggtaacaaaggggtgtttcaagtttgaatttcattctgccattagctaactagataactttagagaaatgactccatctttctaaatctttgttttctaattgtaataacaaaataatagacgctaatacatactacttgcttattctcctatatgccagacactttgttaagtgctttaagaccattatttcatttcatttttataaaaaacattgtaaaatatattttaggggttatgctgacataagatattattagatgataatacaatcaaggcacctatttttaacttatcttagacagcttgcttcctaatgaagctcttatgaagtagacagatgcataagggacatgaaaaatagcaagtgtggtaccctttacattttctgggttctgccttgaaccccaacttaagcgtctaataaaaaggctgaaatgcatgagccttttcactcctccgtgggagaccatgactcagctcaccacccagcagtttaaaggagacgtgccagagacagacacactcatgtgcacatctttctttctttttatgagacagagtctcattctgtcacttaggctagagtgcagtcgcatgatcacagctcattataacctcgacctcccaggctgggctcatgtgaccctcccgccttagtctccagagtagctggaaccacaggtgcccaccacctcacttggctattttttttttttttttttttttttttttttgtagagacgaagtcctactgtgttcctcaggctggtcttgaactcctgggtgcaaacaatcctcctacctcggcctcccaaagcgctgggcttacacgcatgaactatgacacccagcccatgcatccaactttcttgtgcacagtgacctaccactagtaaaaatggctcaataaattacctggtctctaaccaaccaggttagttgagggtgtaaagaggagtgatggcagaggggtggataaattaaatactctctgacttttctttgaggtctccaggaagttttcttgtccctattttatgagaaaattgaggcctgaagaacttcctggagacttgacttttgtcaagtggcagaactcagattcaaaagcaggcctgactgattcctaaggttcttaataattgaacaaacttagaactagcattctacatttctgcaagtattttattagaaagtaggattctcaccaatttattttgacttctaaagtcatattatttatattacacttcactgtctttttttgttattgctaacttcatttctacaaggcaaattagtttagttatattgcactgacatgcgagaaaacataggcagagggtgtcgagggaaataacatttgcacagttatttggaactaatgttattacctagctgccttcttggcctagttttgattttaattattttatctcacatttcaaatacatatatataaatatatatatatatatatatatacacacacacacacacacacacacgtatatatatacatacatacatatatacatacatacatatatatatacacacacatatatatgtatttgaaatgtgagataaacgtaaaatatatttgtatatatattttatgcctcataaattcaggaaattttgcatttattttatatatatgaaattttctatacatactatatatacatattatacacacacacacacacacacacacacacacagacctagtttatatatatttctcccaagatcaacatcatttctgtcagcttagccacatactttcttaggctgtggaggcatatgaacctcagaacaccaggttattatattaggtttgctcctaatatcaactttctcttttcaatttgatctaaactgttaggtgaggatctaaaaaaagattaagattggggaaggataacagttcaggcttttggtacaggctgaccttgatcatttttgtcttgtgtttgaaataaacctcccgtcatttaattcagacctcaccatccatatcctcttaaacagattatttgtcatctagaatctgagcttaaaatgactttggtttcttcaagccaataccagtcaactttttgtgtaagtggccaatttagaaatctaagctatgattttcattcattcaatcatagcaaaatagtcattatttgtacagtgctttctaaatacaaggtcttgtatatgctgttcatgaattaatttatttaattttcatattattctgtgagttagctgctataattattcttattgtattgaaagtaaatctaagcagagggcatttaggttacttgctcaagatcatacaactagtaaattggagagctgggattcaagacaatgtggctttaactactaagctatgttatatttcaaacagaggacatgaatgcctggaatgcacagcaacattctaaaaattttaggccccaattataattttttaatcaaaatgacaagctaattggaaacttggttatttcaatctattaatatttatttatttagcatccgtgacacaacaaagcaagagaggatatggtaatgcataatgataacacaaagtccttgcccttgaggcatctagttgggaagatgaaactgccacatggaatattcagagagcaataaaagtgtgtagttaaatgctgagtcatgtggtgtattaagacgtgtactagaagagcatggagaagaagaagaatgcaaaagaccagtggtcaggaaaagacttgtagagtccttaacatttaagatagggagaaacagggtgaggagagaggctataaggagaccctggcaagatgagtaagaggaaggtgactggaatatcagagagtggaatgaatgtggtatggtttctatattcttcattcccttggtctctcttctgtctctgtatgcaaatacatacatgcatgcatatttgtgctgtatatgagtatatataggtatacttcacagatttataatgtttgttttgtaccagtattaaaatgtctctgataaactcagaaacatgatgggagtgatggttaatactgagcgtcaatttgatgggattaaataatacaaagtattaatcctgggtgtgtctgtgtgggttttgccaaaagagattaacatttgagtcagtgggctagggaaggcagatccacccttaatctggtgggcacaatctaatctgcttccagtgaatataaagcaggcagaaaaatgtgaaatgttgagaaggacctagcctcccagcctacatctttctcctgtgctggatgcttcctgccctcaaacatcatactccaacttcttcagttttgggattcccgttggctctccttgcttctcagcttgcagacagcctactgagggaccttgtgatcatgtgaaactcaatcttagtaaccttccatatctatctatctatctatctatctatctatctatctatctattatctatctatctatctatctatctatctcctattagttctgtccctctaagagaaccctgactaatacagattttggtaccagaagtggttctagaggaacagaatactaatgatggagttctttcattggttttggggtttctggagttggctgcttaatgattagacccaaaaatgctaaggactctacttttaatagtatggagaacactgatagtccttggcatgagctgtttagggagttatccaaaataaatgcatttgacacacttgattcattgctcatgagaggcaaggagtttagtgactctacacataatacctttgaccatatgtggagaaccaaggaacataataaagctggttggttgcccctaaattcagtggaaaaagtgatgaaagaaaattatgaactcaaggattctgtctcccagcttcagaagcagatattgaacctcaaatctgctaggattgccctgactgagaggcttatctcctgtagaaagagaactgaaattgtggacaaacagacacaagctcttatcatgctagtggctgacctgcaacagaagatgcatgcacagcctcgccaggtgtctattgttaaatgaaggcattgattggaaaagaataggcccctgaaacttggaatggggatgtgttgttaaatgaaggcattgattggaaaagcatgggaccctgaaacttggaatggggatgtgttggaagaccctgatgaagctaggacactgagtttgtaaactctgatgaagtttttttgccaaaagaaacagcttccccatccccagtagtggcaatatcctctccctgacccatgttgccatcagcctgtccacctttgtctgaagagataaaccctgtgctgcctgaggcaacagtgatggcctcctattaggcagttgccaggcaagataatgttgattctcctcaggagccacccccaacacctctgtttgcttctagacctataactagactaaagttccagtggacccctagaggtgagattgagagtatgacccattaggaagtgcactgtactcaaaaagaactgtttgagttctctgatttatataaataacaatatggagaacaggcatgggaatggatataaaggatgtgggttaatggtgaaaggaacatagagttggatcaggctgaatttattgatttgggcccactaagtaaggactctgcttttagtgttgcagcttggggagttaaaaaaagggttctaatcatttatttgcttggttcactaaaatatgggttaaaagatggcccactgtgagtgagctggaaatgtctcatctcgcttggtttaatgtagaggaagaaatccaaagatttagggagattgggatggtggcatagattactcatgttagacctactcatcccagctgggagggcccagaagatatacccttgaccaggtataccagttgcaaaatagatttgtgagggcagcacccacatctttgaatagccctgtaaattctcttctctgtatgtcagatcttacagtaggatccacagccactcaactacaaaatttaaatacaatggtaacagttggatcgtgaggtggcaggagccaagtggcagcactcaacaatcaaaggcaaggtgggagtagctaccataatggacagcagaggcaaagtggcaatcagaatagtctgactcatgtagagctctggcactggataactaatcgtagtgtttctagaagtgaaattgataggaagactactgcattcctacttaaattatacaaacagaaaatttctaggttgaatggacaaaagactaatttgaattacaaaaatagagaatcatggcccctcaattaatttccgacttgagccagtttactgacccagaatcccttgaatgaaggggagaccaggaccccttgaggaaggaccccactgcattaccaacaatttatgtggtgaatctttctcccattcttccccagggagacctctggccttttaccagggtaactgtgcattgggaaaagggaaatgatcagacactttggggactactggacactggctctgagctgacgttgattccaggggacccaaaatgtcactgtggtcctccagttaaagtaggagcttatagaggtcaggtaattaatggagttttaggtcaggactgacttacagtgggtgaagtgggtccccggattcatcctgtggtaatttccccagtgccagaatgcataattgccatagacatacttagcagctgacagaacccccacattggctccctgactgatagggtgagggctattatggtgggaaaagccaaatagaagtcattagagctgcctctacctaggaaaatagtaaatcaaaaacaatatcgcatccctggagggattgcagagattagtaccaccatgaagggtttgaaagacacagaggtagtgattcccaccacatctctgttcaactctcccattgagcctgtgcagaagacagatggatcttggagaatgacagtggattattgtaagcttaaccaagtggtgactccaattgcagctgttgtaccagatgtgatttcattgcttgagcaaattaacacatttcctggtacctggtatgcagccactggcttggcaagtgcctttttctccatctctatccataaggcccataagaagcaatttgacttcaactggcaaggccagcaatatacctttacagtcctacctcaggggcatatcaactttccagctttgcatcataatcttatttggaaagatcttgattgctttttgctttcacaagatatcacactggtccattacattgatgacattatgctgattggatctggtgagcaagaagtagcaaacacactggacttattggtgagacatttgcatgccagaggatgggcaattaatctgactaaaattcagagaccttctacctcagtaaaatttctagggttccagtggtgtggggcctgtcgagatattccttctaagataaaggataagttcctgcatttggcccctcctataaccaagaaagaggcataatgcctagtgggcctatttggattttggaggcaacacatccctcgtttgggtgtgttactccagcccatttattgagtgacccaaaaggctttgagttttgagtggggaccagaacaggtgaaggctctgcaacaagtccaggctgttgtgcaagctgctttgccacttgggccatacgacccagaagatccagtggtgcttgatgtgtcagtggcaaatagggatgctgtttggatcctttggcaggcccccataagtgaatcacaatggaggcctctatgcttttggagcaagtccctgccatcttctgcagataattactctccttttgagagacagctcttggcctgttattggacttcggtggaaactgaacacttgaccatgggtcatcaagtcaccatgtgacctgaactgcctgcctatgatcaactgggtgctttctgacccacttagccataaaatgagctatgcacagcagtattccatcctcaaatggaagtagtatctatgtgatcaggctcgagcaggtcctgaaggcacgagtaagttacatgaggaagtgactcaaatgcccattgtctctactcctgctaccctgccttctgtcccccagcctgcaccgatggcctcatggggagttccctataatcagttgacggaggaagagaagactagggcctggttcacaaatagttcttcatgatatgcacacaccacccgaaagtggacagttgcagcactacagcccctttctaggacttccctgaaggacagcagtgaagggaaatctttccagtggtcagaactttgagcagtgcacctggttgtgcactttgcatggaaggagaaatggccagatgtgtgattatatgctgattcatgggctgtagccaatggtttggctggatggtcaggaacttggaagaagcatgagtgggaaatcggtgacaaggaagtttggggaagaggtatgtggatggacctctctgggtggtcaaaaattgtgaagatatttgtatcccatgtaagtgacctcagcagaggaggattttaataatcaagtgtataggatgatcctgagtgtggacaccactcagcctctttccccagccacccctgtcatcactgaatgggcccatgaacaaagtcgccatggtggcagggatggaagttatgcatgggctcagcaacatgggcttccactcacgaaggctgacctggctatggccactgctgagtgcccaatttgccagcagcagagaccaacactgagccctcgatatggcactattccttggggtgatcagccagatgcttggtagcaggttgattatatcggacctcctctatcatggaaagggcagacgtttgaccttactggaatagacacttactctggatatgggtttgcctatcctgcacgcaacactttttccaagactaccatccatggactcaaagaatgccttatccaccatcatggtattccatccagcattgcctctgatcaaggcactcgctttttgcctaaagaagtgcaaaatgggctcatgctcatggaattcactggtcttaccatgttccccattatcctgaagcagctggattgatagaaaggtggaatggcattttgaagtcacaatgccaactaggtaacaatactttgcagggctggagtgaagttctccagaagaccatgtatggtctgaatcactgtccaatatatggtactgtttctcccatagctaggattcacaggtccaggaatcaaggggtggaagtggcaccacccaccatcacccctagtgatccactagcaaaatttttgcttcctgttcccacgacattatgttctgctggcctagcagtcttagttccagagggaggaatgctgccaccaggagatgcaacaatgattccattaaactggaagttaagattgccacctggacagtttgggctcctcctacatttaagtcaacaggctaagaagggagttacagtgttagttgggatgactgacccagactatcaagatgaaatcagtctactactccacaacagaagaaaggaagagtatgcatggaatacatgatatccattagggtgtctcttaatactaccataccctgtgattaaggtaaatgggaaactacaacagcacaatccaggaatgactccaaatggctcagacttctcaggaatgaagatttgggtcactccaccaggagaaaaaccatgacctgctgaggtgcttgctgaaggcaaagggaatacagaatgggtagtagaagaaggtagtcatcaataccagctacgaccacgtgaaccagctgcagaaatgaggactgtaactgtcatgactatttccttcttcttttgttaaaaacatgtttgcacatgtaaacacttgtactaagaaaatatcttcattttatttccttttcatttatcatgtaacataagatttattggcctcatgtcagcatttaagtactgttaactgtatgtaatagtatttgggttggggattggtgcatttccagttgcatgaaggatggttggattatgttaggcataattatgacctcattattgcctttatttgaatattatgcatgtgtatgggttcacactgagtcagtgtgctggggaaggcagatccacccttaatctggtgggcacaatctaatcagcttccagagaatataaagcagacaggaaaatatgtaaaaaagagagatgggcctagcctcccagactacatctttctccatgctggatgcttcctgccctcaaacatcggactccaagttcttcagtttggggacttgggttggttctccttgctcctcagctttcagacagcctattgtgggaccttgtgattgcacatatatatgtgtatacatatgtgtgtgtatatatggtgtacatatatatcctattagttttgtccctataaaagaatgctgactaatacagtgggttactgggagatggcaattgataacttctaaatctgcaatgactcgtctgtaagagagaaatgagataatggctatccttcaaccatatcctgcaatactaccctcctttcagaaatcaaggacaagtcaatacttacaccagaaagatatttttattaaaaaaaaaactcctctgtatatggtaaaattgattgttttttgattgacaccacattttactcttgtacacttttttggttttatcattgctgtaggcaatagagaggaaattgctctgtaatattatccctctgtatttgacaataaaatccaagaaaaataaagtcttcctccagtacagtgagttaggtgattgagatgaaaattcccagttttatgggtaggtagagttatgaatcatgggtgctgttaccaaaaaaagctacatttttaagaccaggataggaaattcttacataaaattctctcgtcttatgcagccttgattatatgaaacaaagaaaccaaaattcctgttttttttttgaaaagttttgagacatagtaaattggtttttatttgccacaagatttttttacaactgataaaaaaattttttcaatataattcttatttaccccaaaactgtaatccaccgacttgacttaatagctatctttttttcgggccaggcacggtggctcatgcctgtaatcccagcactttgggaggctgagacaggtggatcacgaggtcaggagatcgagaccatcctgacaatcatggtgaaaccccatctgtactaaaaatacaaaaaaaaaaaaaaattagccaggtgtgttggtgggcgcctgcagtcccagctacttgggaggctgaggcaagagaatggcatgaacccaggaggtggagcttgcagtgagctgagatcgtgccactgcactccagcctgagcgacagagtgagactccacctcgaaaaaaaaacaaagctgtttttttcatgtcagttgagtataatattcttgttctacttttgtatccttaataacccactttgagcaattagtggaggaaaaaccgtatttgtattctgcactcagtggggccatttatatttggacatcatcatatctggtagttcactgacagtagaatcagatggtaaaattgattctcttcttatttcttttacaaaattcatcacaatcttatagatattacaataagcttcagtggtagtgttgatcttgatttcatcaacaggaggtacatttgtatgtacgtctgtgtgtctgtgtgtgcaaccaaaatggcagcctttcagagtaattacatattctctagattcctagagtcgcttttcctttagtattgaagcaaaaaatttattcagttatcttctcacatattattggaaacctatcatattttcccatagctatgctgattcctgttgagtttgatcagtggggggatgtcacttgcattttttctgatcgcttctgacttctagttcttgctctgttgaattacaaagttcttctcaacctttcatttcctacctgtaaggccatatttcactgtgctttacactgtccaaactgtttactactaaagtcctctgagtctagaatatgtgcatagcagactttcctgaaggacttgggggactaaaggagaattatataaaataggcaacatacttgatgtaatctaaccttcagtgttagacagccttggtcttaaaagtcacttattcattctcatcgcagttaatcatcattggttatatatttgactttgccttcagcctattgccatgctgttggacttccctttcttccttcaactgttttccctctctcttcagcttgctaatctctaacccaaaattcctgttcatttcttctatagaatagtttattcatatccttgagttgaagaatattaacaagaatggctatactcagctttgctctgaagttcttatctctgttgccagaataccccttgatataatttatatggtcaactcataacttaaaatgtttttctaaagaatgatacatactaaaaatattatagaataaatgatatgtctggggcttccttgaaaataatctgagggagaagaatgggtaaacatagaggtgaaatgatattgactatgggttgttttgtcaatattgttgtgctatatcaatattgaccataagtgttgaagctaggtgataggtgcatgggggtccattatatttgtttactttacttttgtatatacttaaagtactccataataacaagctaaatttttttctactatgtattgtaatacgtagtatatgttctataaataatagataattatgtagataattactataagccaatgtaagaaattaatagactaaaactcagggtaaaagcaaatattggaagggaggcaaacttaagggtacattgaaaaaattgtaaggagagatgcaatgataacaaatatacttgttagcttccagggcacaaaaaattaccaaaacttagtggctgaaaacatcagacgttcattatcccaaagctgtgggtcaggaatcggggcaaagtttaagtggatttctcaggatcaagatgctttgcaagggtgtcatgaagttgttggctggagcaccaatcatacgaggctgggctagatgaatatccacttccacaaacacatttatgtaattcttggcaggtctcagatcctcgctggctgttgtccaaagacatcagtttcttgttcacatggttctctccatagggaaactctacaacatgggagagatttcccttaaagagtgattgagggaggaactccaggtagaagccacagtctttttgtaatctaatctcaggtgacagacacttgcttcttctatattctactttttagaagtatgtcaataagttaggaggagggtatcatttggggccatgttagagggtgcccaccatagtctgcactttgggcctcaataatttacctttctctcacattccaaatacattcattccctcccaaggtccccaaagtctcatgtcattatagctatcagctcaaagtccaggatctcatcaactaagtcagatcccggtacggaagagatttctcagggtgagttccaaagttcagctccttatatggattctcttactatagagacctatgaaaatagaaatccaggttctctgcttctcacacatcaatatactatggtgaaacaggtataggataaacactataaatattccttcaaaaacagggaaaatgcaggggttgggcacaaaggagtctctgatccataacaattctgaaatctaactgggcaaatgttggaaattccttaattaggtcttaaggcctagcaataattctttgtggctgttggctctgtcctctggaattatactgtcagcccaggctcctatctatataccaccagctggatgccttaaacaacagaaatttattttcccacacttctggaggccagaagtccaggatcaaggtgtcagcaaggaggtctttcttcctggcttgcagatggctgcctcctcactgtgtcctcagatggtctttcctctgtgtgtgtgcagagaaagaggggagagagagcgagagagagcacgcgcgtgagagagaggtaagaccggtacagcatgaacatagagattagaggaacaattttatatattattcataccaatcatcgtaataatttcccaggatgcctttcttgtaggtgaaggtaaagccactaaaaattccacgggataaatcaaaatcatgttgtctagaacttaaagaattatataatggtactattatttgattatactttttatctaatacaaccttgattttgttaatattccatctactcatttattcaacaaactattgttaaccagttactaattgctaggcattgaggttaccttaaaagagctagcaaattttagtttctaattctatagggtgatttaattttctatgtaagaaagtaccttaactgaaataattttttcaggctttttgtagacttcctaaatagttccatttttgtaaatagtttgaaaaaataattttttcatgaacatgtttaaaagctagaagagcaattgaaattttctaaatatatgaatatttttaaatttagattttaaatacgtattggctttttcacatctggcagagaagatacttgtggtttacagtgaaacaggtagctcagtgatttatactctttaaaggtgactgtccctgtggaagactcaataagagaaggaatgatgctcagaaatcccctggctcgctgtcgcctgaatcaagagctacattttaatattagtgcttggaagataaacgctgcagcctccaagggagatgatcctcactgggtatcaaatgactccaagtgggagaacagagaaacgactcagctgttgacaagcagagctaagtaaatatttacgccagaaatgtgcacatttgctataataacatcacccctactcagccaccccaatagataaatagatattttagattcctcccaggaatatggcattcgtgggatattattttaagttatgtagcttttgatgggatgttaaagaagatttctgtacagacaaatatactacatacctgataattccttggctaatttaacagagccccagccaatgttctttgtggtcagaggccatcacttgactagtctaaaatatcaccaacaagtctcttctagtcagcatgctctgctcttctaatgcctggtacagagaggtgctctgccccactgggagaatattactcaatattaggaatgacctgatatcctacattcattttgacaaatgaaatattgtcctagagtccttttgcagttccatcttctaggccattactgaaggcatggtgttcagaaacccaattaccttttttttcccctttgctagaaatgccacacacattgccaattttccttccaaaattcagaagtgatacaacaattaaaatggatttctgtgtagaaagtggtagagcctagcagctcagcatttcttcacttaaaagctgaaaattgtattttcaaatagtcttcgtattagaggagacttttgtaagcctgctttgattctttgcctttgattctttgaatactgagttatcttggttgggatattttagtttgtttagtaaagcccacattatcattttctcggtgtagggaaaagtcttagttaattaagccacatccatgaattggatccatttcaattatttttgagatgtgatgcaatagcaaatgttctttagaaaaataacattatatgagtcataatcgaattctaaaccacctgaaacataactaagtgaatgaggaaaatatgccactagaaagaagctgaaaagtagaaaattttttcttgagtttataattactatagactctttggcatgaagtattgaacaagttacaagagcctcagtatggctaagaatctttgtttcactgtagcctcataagaacaaaggagagattcctaattcacatgtgatgttgttcttcatttctcgtgttgttttttttagaactaccagcagtttttctcaaccaggttaaaaaacaaaacaaacaggttcacttttgccagatatcttagaatgaagaaaaccacagtgcaagtcaggcaaaatgagaaatcttgaataaccatttttcattgtgtaagttgctgtgagattctctggtttttataataaacagtgcatacaatgaatggaagagaaaataccaagtgtctcagaagtccatctcagaaactgtaaaatgagaaaaaaaaccttctaaaactctcctaatatatctctcaggactggaagaactataactattttaggcctgcccttctgaccccactttctttctagcaagtcaacagaattcaataatcaaatgcttcaaatgatgccaaaaagtctgacataatacccaagcacagttattggagttacagctggggagaggcagaaaccataggtgggtctttgttgagtctaggtctgattcaaaaacaagagaaaaaccataaaagcatcaagctaagaagacaattgtatgtttggccttcctgtagagacaatggtaggactattagacttccacattgtttcaaagtgagttcctggatttcctgtatcataatttccctctctgagactttcagagccacccatattcaaggacaaggcattgtaaaaacaagatttaattagggacccaggaggtggtgaagatttagtattacccaatcaaattaaatattcttctgcagctttttattttcttacaacttagcaaagttactcagaatataaataaatctaatggagaataagcccaagtgattaactcaatagtggcaaatgctatgaccttctcagagagcacttggttttccacttttgtctgaatccatttcaagaagaattaaattcaaaaataatgtggaaaattgtttgatccagtgtgcaaaaattcagggttctttcagaaagaataaaattgtgccatatgtctaagaatttacagaaaactatttaaagttctaagtgtccactatggaatagctaggaaagcactggggtctagttctggtttcattcattgactcattcactgtctcacccatttattctttccataaatgtttgttgagaactactatatgctaggacctgtactaggcactagtgatacaatgttgatcaaaatcagattttgttctccaaagtttattagtctagagaggaggaggtatatgtttctaaatagttgctatattgtagattcaaaaggaatacgatgctatgggtgtagacctcaaccaatctaggcatctaggaagggttccttgaagaagcaggatttaagctttgatctaaagaatgagtaggaagagttcatcatgtgaagaaggaaggacattcatgtagagggaacagcatatacaaaaatcatggggaagcagagagcacagtattttggagacattaaagccagtgttcctagggacaacaacatcctaaaagccatgagtaaactaagtgtctagatcttggtttctaaatatcactttttactaaaaagagacagtatgcctcagagaaaaggccatattttccaggacatcttgatgtatcagaaagtaagaaagtgctgaaagaataaagggacttggaacttgtcaaaataacactgacgcaattccaagaggttccttttggccaaatttctgacaatttgagtacaaaaataaatgatgatagcaatagattataaaacatgggataaaataataaactatgagtctatgttgatcaaattactaggcatgaataaattaaaaatttgataacaaataggatattcacatagtctcaaattactttcccacaaatacttgttaattacacagaaaaaaaataatactttacaatggagaaccttggcaaacaccaccttaacaaagttaacatcattagtattggtacaaaatgaaattgtgtgccattttatagtaatcagtgagaagagcacagatcatttctctagcattcctacaaaagtatacagctatcatgaaggaaaatcagaacaatctaaattgaaggaaattctccagaataattggcttgtaatcatcaagtttcaaggtcctgaaagtcaagggattctatgagtaacttgtcctagttgaaggagactaaccaaacacgataactgactccaaaatggaactttggttctaaaggaaattatttgagtactttgtgaaagttgactgagttctgagagatgaaatgactttaagttgctgattttgatggttgaattttaattatgtagaggaatgcccttgtttaggaaaaaaaatgcattgaattatttagaggtgatggtatatcctgtcatcaatgtgtgcacccaaatgtttcctgaaaaaaaaattacatgtactatacttggaagcttcctagaagtttgagattgtttcaaaataaaaaattaatcaattaattaaaaaagacaaaaaaaggccagtgtggctagaaaccttggacttcagtttccacattgggacaataaagaagggagctgaaatccatgaatctcagatccagttgtactgtagtgtgctaactagtccccaggaatgatatacaaaggggaaaaaatgtgcattacttttctattgctatgtaacaaaataccccaaatttggtaggccagaagtttgggatggcctgagttttctggtgaaggctgaaatcaagttgtcggcttgaagcccccaccttcttgctggctgtcatctggagacagctctcagctcctagggattctcctcaggtccttcccttatagccccctctatcccagcaacagagagccttccttacatcaaatctctctctcagagatttgaattttctctttctcatctgttactgtctgcagtaactctctgcttttaagggccttgtatgattaggttaggccagctagataatttttccatcttaatggattagtaaccttgattatgtctgcaatatcccttttgccatattatataacagaatcataggaggaacagcagtggaaaatattgtgggggccctcacagaattctgcctacgacaaaatagttgagaaaaatgaatttgggtctgttatcaatcaatataggtacagaaaaaaagagtatacaactctgcttctctgattcatgaattgagggttggggaattctagactgtggtctctgagacatcgtcagcagtgaagttctttgatttgtctttattaggctgtaagagcaggcacagactgtttctgatttactgttgcattgctagcacttagcccaatgcctcgaacctagtggatgctccaaaatgagggtataaagaataaataataagtgaataattatatatagcaaccaaaaatttgttttcttgtttgactaatcaaaatcttcaatgctggtccctcagtgaattattcttcccaaatagccaggttaagaagaaatctgacagttaatttccagttccattttgatagataagatttgtgtgtatatagaattctggagggattttttttaagtaaatgtaatttgccaagacttggaacatatccatttatcaatagaagaggaaaatacattgagcatgaaaggatcttatgatgctatattgttccaattaacagatataataatgaaagcttgaaacattcctatacgagggtataggaggaaatcattttaaagattattttggaaatagctttattgctttttaatattatgaaatgtgaatatgcttaagataaaatattggaaaataaggtataaagaaaataaagataatttgttatctacaagtcaaagataatcgttctcaatattttgatagatatcctttcacacattttcctctgcacctatgggtgtcaacacaccagcatatacacatgcagttctatatagataatgcagttctatatagatagtttgctcttttcatttaaaaatatatcaagatatattttcatgataataaacatgatcatttttaatagcaacaagatattttattttatagttgtcatattttatttagccaatccttcctgatatactactaaataattaccaatttttctagcagtatacatataacttcaatgaacattcttgtacatcaatctctgaactttggcttaattatttctgtaaaataaatatctaaaagtactattgataagtcaaagggtatgcgaatcttgatattttcagattgccctcagaaatgtttaaccacataagtagattatgaagtacctgtttacccttgccaacaatagatattatcaactaaatgtttaatgtttgacacatgaaaatgatatattgttttaatttgtatttctttttatatagtattttacatctttatttctcttttgagttttaaaaaatattttaaggtgaggtttttaaatagctcttagacattattttttcttattaatttgccggaaactatagttttaccattttaaaatatttgtcattttctacatcattttcaagtgcatcagtgtggtgggcaacctctaaaatggcgcccaagggatcttaagcacctgatattcacaaccttctgtagtctcctgcccttgagtatcagccagtcctgtgatttgcttctttgtacagccagcataatatggaaaagggaatggaatgttgcttccgtgattagattataaagtctcatgacttctatcttgttagcagattctctttgttgccttcttagtttgcctgctctgatgaaacaacttgccatgttggagagaccctcctggcaaggaactgaagatagcctctggccaagagccagcaaggaatggtcaacagcccatgaggaaatgatttctaccaacagccatgtggtcatataagtggatccttccccagttgtgtcttcagatgagaccctaggtctggctaacaccttgattacaaccattgccatactcattcttgccacaccaattccattcttgccataccccttctattattccaatatctccaatgtttacaatgtaaagtttccgatgtacagaaatgtgactctaccttttattttatagtatatggattaaatatttatgctgaaatttcatattatgagttattatatattgtatggcaattgggtgattttagtgtaaccaaatggaaatttggtcttacatctgtttatttttgacaaagaaagatgataaaagctcttgtagatgagctgtaagtttcttagtctgatagggtgttggaagaagaataaataattatatttacttagcatcttctgtaatgagattttgattgccttattacctgatgtatttgacgtatttgtgtcttgtttttgttaaagaacttattggatatacactcaacattttattcttcaactagcactgaggtttttaaggacactcctgttttgatttcatgataaacattggaaattttataactatttatttgcatgtacttgtatttatatatgtttgagaatatgcttactatgtgtcctgactcatctagattctgttaaaaataaaagataaatatcttactttttaattccggcatgcataattcccctgggaaatgttccctgggagggctgggaattatataaaggcacccccattttgtcttgagacgatttgagagcacctcagtttccttgcctagaatgacagcagttgtctctcagcagttctgtattaatgtgggtgaaagtagttaaagatttaagccattttatgaacataagggaattatccatgaatgtcttatttggccctctgcttataaggcattgtgagggacctagaaattgtaatttagggaaaaaggagaaagcctctcttgcttcccacattaccttcacctcctttactccttgactcctgccttcaccacattaaatataacctcaagagattcctttgagaaaaggagagtaacgttattttcttttcatttaaatgtcctttattccaagagatagagctaaaatttaataacaactaattgggattttattcctacattcactaagtgtaagtttccacattttcacaaaatattgaattcagtagtgaacaaaacaaaacagattcatggttttatctaccatatacttagctatttctattttattctcacataaaggaggttgacaacacaggaattttaaagctgaaagttagtggtagactgaagtgggtaagggggagaacgcaaaataaatagatggatgcagaagaggaaatagatcacctcatttgcagttgtaccctaatcaagccacttttgagtaaccacacattttgttctaaacaaaagagattatttgcttcccttctggcccaaagtcagattcttcttcctagtatgaactttcagcactttattttgattagttaagagaagtccaaaaatccatgctaaatatcaagataattcttagccttggcaattcaaaaaaattaaaacttacgatgtttcctatggaggagttaagaaattaatctacttttcctaagtacagggaaaaaaacctgtcttcaatgcaaacttcaacagaatctacatctcaggaagaagatggggactgaaccacttagagcatctccagtcctcattacagaacactgtagtagtaagatgataatttaacataagaaaactgccttcctggattttccttgagaagtgattaatatgtaagagtggacaactcagggtttcacttctaccttctccatttgatgactctcagaatgaccagatatgccatgcacggtgatggagaacaagaaccatagtttgaaatcagaacaatgggattccacccggcactggtacctattaaatctcttcgaatctcagttttctcattagtaacaatctcagcaggattgttttgaaattcattgataaaaagtatgaaaagagttgctgtacacattacctttgtgatttttgttgtgtcatgtgtgtaaattccagaatattctaagagaagcagcatgatttagttattcaaacacagatgctgtgacagaaatttaactctgccactcataagcagcatgaagaatttaaatgttcattccattccttcagggtacatccaaagatatgcctacacaagggatccctggaaagcatttttcaattgacataaaatttttaaaaacactttgaagttcatcatgcaaattttaaatattaaaagaattcaactaaaatatatttttctaaaaatatattttctttcatctaccacacagaaaaacaccagccagtcttgttatataaatgacatccttttaattaatatgagttttaagagaagccaacccttgaattattcttgttgaattaagttgccatgtcccttgcagtcaacagaaagtgactgcaaaaaaaggtgaagtttgagataatattactatctgttgctgaaaagatgtgaggcagtgggatgaaaggaagagggaatcatagccacttctctagttcccataaggatatattgtgatcattaggcttctctgacatattcagtggatgaacttgagtgccctctttcatgatctatgatagccaacatatatttggagtgatgggagtgtgtaggcaatagatttttagcatagagatgaaaagtatgaattttagcttcaaaaagacctgtatttgaatcttagtcattctggttcctggctgtgggatcttaagaaaattattaaatttctgtaagaatcatcttcttcatatgagatggagcaataatcataacaattgttaccagagttgtaagaattaaatggaataatataaatagaacactaaatcttgtactttatgagagctcaataaataggaactctacatatattgctattttccatgtgctcttaaattatgtataaaaattgagatgtagtcatatattttaatgatattcctaagtttctgagcccattcatcctcatattcaatacacatatatttctcattttatagcgtcatttttcttatactttcttttgtaatatagatgtagtcctgataaactaaatcaatattttgtaaaccaaattatatttggtgatgaggggtaagtattacattagagaaacatattctgttaaaggaataattttcaaatgtattaaaatgcatattcttttgaaaatctgatgatagctatgtatctgttttctacccaaacgcacaaatccttacatgaaccaaacttcatatataattaaagggacatatggaccttccctacaatttttaagaaatttttaatgaagtggctaagcatttgagccaatagttcaaccattatttacctgtataaagtcaaatgtatgtatggtaacttttaatgaagtaccttacattaactttaatgtttaattccatctgaaagatttcatatgtcacaatgtttgctaataaaattatttttagcctaggtttatgaactatgctgtacctagcagtttcatatccagcaaataaactgtcaccagagaaccataaatattagtgtcaggtggaaatatcaaattacacaatctgattaattacttttcttttatgtttcttctgcaccaaagagccagaaaacattttttttctagaacagttcttttaaaactctatattttcggtaaacatcttttagaaatttctataaggtacttattctcccagcatatcaagatgtaacaggcatttgaatcttaaaatgagtcagcaagttggtaagtttacaactaaacactcagcttcactccaacacttgatattgtattaaagttaatgcaacatggtgttttagtatttaaaaaatcaaattattaatagactccaaagacttccctgcagcaaaatttggtatttcttttaataagaataaatcccagtgacaccttctgaatctgaatttaaagattggtttcagaagatatgagatcttaaggaaatgtagtttagttattagataatctttaatatttcatttatgaagttgaacatttaccggggataacctaggttaccatctcatttgcaatttgatctccattatgtctccaaaattcaactaagggagcccaattgttggcttcaccttttttttttaactatgagattttgataatccattatctgtgataccttattgcaagatttaccttcatttgtttgctttaatgtcattaggtaaatcaagaggcacataaaagcagttcccatcatggtgctgagaaacaacctacactggcagttggttgggttgtttatctggtgcatctgacatgtgtaaaatgacagcaggatcactcaggaaattcaatatacccacacacagaagccaaatatgtcagcttattttgggaaccactctatcatgtagatgcatttgttcttggagcagcctcagaaagcctcttctttatccaactgtctcttgattaaagaagcagccaatgtatgctacataaagaatggtttttctctggaaaagttgtcttatagtcaatatttttcttattgcaaggaagatattttattgctaaatatttgttaattgtctgttttggtagcacagaatgagagatggttcctggaaggctggtcatagtcatctgataaatcacaaatagttagtaaatccttgtaatgatgtatatgacatttttatcatataaacgatatgcttctgaagcaggatgtatggcaatgtatctgctgtttgtttaaaatgttagatttttattctttatacttgtagtatagttcaccaaaaattatttagcaactaaaatttaaaaattaattcaaatgctattgtgtttttattagaacattttgataaaagcaaataatactatattaattgtgactaaaaattaagaatgatatttgttagggcactaaaccaggcttttcctctttcattcccttgaattattttctttactttacctataatttctaccctatcttgggatttgctattcgtgtagcttctcttgctaattctatccacaatagccaaaataatactttataaacgataagtgacaaatatgatatattgaaagtatgcgagtacctctgtcttattagtttctgggacttgacactactgaattgcttttagattcagcaaggatttcacaaaactcacagaaaaataaaatcatcatcaacatcttgcaaggacaagcaatgcttcactgattgagatgtgtggcagatttggagcattttttctctgtgtgatatagatttaatgtttctaattaaaaccaagaactgtgacaaaactgtttgcctttttgagcttgtctactgaaaaaaatatttttttcttgtttctaacctgccatacattaaacctctccaagatcaaattgttctttccttacattgcagttaacaattcattttctccccaaaattaaaactacaaatacaacatttctctatgctttctagttgtttgagataaacttaattttgaacagtatccatatgttttttatgaggcaaatgctgttgagttttgaaatgggcagtttctaggaggaatcgtttctccaccatttttggcattaaccacactgatagcgcatgatgattaatacttctagaatggcgacacattccctgcattgaataagtacagatggtgctgattgtttttcctacttgtcattgacttttaactcacattcacattgagtcccaaagtgttatcctcttggtgaagaataacgatgatgtgacctccagattaaagatgtgacttgtcagtcgttttcagactctggcattcggagttgagaactcttttcctgctgctcggtggcctgctattagcactttgtaaaggcaagatatctacctttattgcatccctgttctctctagtctctacctcaactctgaatctccaatctctccttccttgttctacgggcttcaggaagggttccagaaacctcttaaattccttttcatttgtgcaaacaccacacacatgcacacacacacacacacacacatattcagtgcttagtggagtgcccgatacaaactattaataaagttcggtaaattgctgataaaataaaagaataaccaatgaaattaattacattgaaatatgaagaaaggttccagtgaattttggagttggatgaaaacgtttgttttgttgctgattctatgaaggtaaatataaagaaagagtcattatttaagggaatagagagattaatgtggataccatttataagttaaatgcattaatagacattaacatttcaaaataattcctaagctacaactacaaggtgattggtaattttctgaaagtaatgtaattattacattgtgaaaataaattatatatataaaactagttagtgtttattaagtttaaagttttgtctacgaaactgattctgaaattatttttcagattaaaatcttaactgttctcctcaccctttctttaactttttattttccttactggtacattatacctcattaagaaagaatagaaataaagaaagagagaaacaactgtaattgttgcaaagtaaattaatcttattgaatatttttctagtctagataatatcaaaaagatgtaaaacatgtatatatgtcaacaccttatattagtaagatatgatcattattatttctatggttgagaaatgtatgtgaattacatacaaattgtatgcaaatatatacctgcattggatagtgttagagctcccatacatatttcacccttccccactatgtagtagccctggaatttgagtgggattgatcccactgacagctctaagggtgagttctgatggatcctttctcattgtcacagtgattggtttggggtgggcatatctttcagatggaagccagtcaacatgtcctcagtcgtagtgattacctatttaagatcagtcaattagaataaaacataggacttctgttctaaggtcatggaaagcaactctgtctctatctctggccatgaacaaagtcgtctgtagtcccagttctgttggcagccactccatgcctgcaaggaaagccagccctcagaagaagccacactgtttatggaaagataccacatgctgataatatcaatgattaaccttgaagtacctttaacttctggactttataggcacatgagccagcaaattccctgatgagttaactactattagtcaccttttctgttacttgtagctgaaaatatccttcacagaacaatagccatcaaaacaccttcatccatttgacaacaagccatgagaaaatcctggaagatgatttttgagaaatgtcttcttaggattccctactgtcttgtttgtttttacttatttgagaccagattctttattgaaagtatatgaaaatgatttttaaatgaaatatttagatgaattacatttaattttacagctaataaatttatgagaaatgttattggaggcataactagggacataaagaacatggattccacaaaacctagagtagcaaagcattagaaaaaacatgaagaatattttaaaacatagtgacagcggaaacaacctggaagacatttctcggtgaggatagcagcctaacgaatatgtcttgaaaccatgactgttttgtaccatgcctatctctaatggcttgcattgtgataggcacaagacaatgataaatgtttccaaataagtgatctactctcaagaagtgaatgttataaagaaaagtaaataaatcctaggaaaaccataattaggtactcaccaacacagtagtaacattttaaggaaaacagcgtatataagcaaaagaatgaatagagattgtgctgtaagttgaacaattgtttcctgggtaaaaatcaagaataatatgaaaaatataagtatgtgaactaggcatttattggtagaaagtaataggaagcaattttgactagaaaagaaaaaaggaatttattgttggcatattggggctcatggaatcagcagaaggctgagttaggtttagaaacgagcagaaaccaagaccactccagagactaagaagcaagacttataacaggaatagttaggtcagaatgctgctgtttaaggacaagatagaggttggtggtgaccaaatgaaagctgttttggaagagtctatgaatactcgattggagaagattgaagagagaatggaaaaacaagccactcttctgaagaagttttcacaaaagggagcatagaaaaagatgaggtcaagggaggtttgtttgtctttaaatggtgctagttgagcatgtttctgtgatgacaggactgaaccactggatgcaacacatttccctgcaagcgccccaaagctggttccttctcatctttcacatctctgctctatgtcacctcctggtcctagtcttatgacatcgttttattttctcgataacacttgtgtctgtctgtaattatcttctgtatttgtttgattgccctctaccaactaaagtacgaaattcatgagagcagcaactttgtcctgcttatcactgtcatataagcatccagaacagtgtctgtcgcaaagctgagccttaataaatatttgtgggataaaattaaaaaacagataactagaacttcaactatttctttccttcttatgttaactgtttgagattcaaagacccaggatccagttgctgatgagccaagttcaacgctgtgtagtcctttgtctgggcagggtctgcaccaccttatattatttgacgggggctagctaggtaactgagtttactgtcagtccaaagccaactatgaggggagagaggccattctcacaggaaaatcaaatactgctaggaatttccaaatgacaattgctcagcgcagtaaggcacagtaaggagggagaagaaatgttcatttcttgctacaaacaagccagaaacgaaaagtttatattccggctgatccattaacaactgtcagtttcatccctaggtttcccaagaaaaaattttaggaccaaggggacagacaagtctgtctgcttacacagataaacatccctcttcattaaaacaggctgggagtctggagataattagacccactgcgtcaagcaatcagcaacacagggaagaggtcagaaaaacaatgacaagtgacctggctaattcttaagagaaacagaggaaagcctttgcaatcacttgaaagactttttggctgttgtggctcatggcctgatctgtacttgtttgtttgctgttactttggtttctctgtcactttcgcccttcctcttgtcctcccctagcacagacacactcacctagactctcagacatgggcacagtcacctcgcgttcatcacaatgaaaacatagtgaactttcccaggtcagctttgggaagggtggtcatttttctctgcaagattctacctccccaggaggaaaatctaagaagtgctcctgtttgtttttatttgcttattttttttattttttatttttttcagtgcttgggatctgttaagttagaagatctttttggaaatcccaaacgtgcttcatcaattttttccaataagacgttagtagctactagaatgatagcgtgataaaataatgagctccacgagggcaggaacagtatcgatttcattcgtgctgagcaccttgcctagcacaaagtgagttttcaataaatatttggtgaataaacaaatcaatacataaatgaaagagtgagtggacagatgaagccaaagggctattttccaagcagaggctccaaagaccactgcagctttctctgctctcctcagccacaccacttcattgtaaatctattatctcttctgtcttgcccttttctcattgcaatgttctcccttccattcccctttctgatcctactgatatttactcacctaagttagataagacatcctgataagcacgagccatggaacatataaaatatgcatattcttaagattcctccttgttatatacgcattatatgatttctgattctaagaaaagatatgtttttgataggctacaaggtaagttttaaaattgtacgtaataatctacaagatccccaatgagcttacagcattttttcaatttaaaacaatgttaatggtggaagtgtcaatgatttatatgtatttctagaagttttgttataatacctctttgttttctttacatttagagggagaaaatgtagtttttctaaactaaagctcaactttttaaaataaaatcatttgagtgactttcataagtacttttccttaattataaaagaaaaataccattaattttattagttagcatgcttagaattctgtaggtcaatatgcctttaatgacccagccaatttcctcagcactaccttctgaaatccttcccatgcagtatttttttaaaggagaaatgggaatggaaaagtcactttgtttttcaaggactttttgaaagtctgcttttgtactagccatatctctccacctctctttttgatcagctagatgtatgataagattaataaccattacaaataattagtgcctacagtgcctttcaccagccattattgagatgacttttcttttataaaatattatgactacaactacacagtgaacatctggacattcctctaaaatgcactaaagtgtaatctactctgtgggtttttttttttttttaaatgagatgagctaaagaaacagaacaaaaatgttagctagaagggatgacagaaatagttcaagtggttcttcctttttttttttttttgagacagagtccggctctgtagcccaggctggagtgcggtggcgccatcttggctcactgcaagctccgcctcctgggttcacaccattctcctgcgtcagcttcccgagtagctgggactacaggcgcccaccaccacacccggctaatttggttctttcttaaagtaacaaatccaaagcacagagaggtaagatgatttctgatccccaacaggctgctaactacatgcaaggccgattgcccaatccttgcctttccacaactacccatttagtgttggcttttctatccagaacaacaaccgctcaatagttcttaattttattcatagggttttttttaccaaggggctgggtcacttgaagttttgttgaagaagtaaatgctaattatactctttaatagatcagtcttaactattcattcctgttactattgtagttacttgctctataatgctctaaccctagaagcaaattctgtgattagaaacattgctgtcatgccagtctaatttattttaggatgagccgtgtgactagattgggtgagtccaggacatacagaccaaaatccaggaatgattctgagctgtggactgcagggatcctacctgtacttcctgtcagagcagaaagtgaagcggatacaggttcacctgggtctacaaatgcatccagggagagatacagcaactggctgggagaaagtagctggtgtctttggacaagcaacagggaagatggagcagcagttgcaggtgaacagtgagcaaactaccagctaatcaggcacaatgaatcacttgtgcaatcctgtgttaggaaagaagctttcatgagaatgtggccgggtggggtcttctgtctggggccggcgggtcccagggaaagcagatcatcacaataaggggttggtctgtggtgacaccactgattgcctgtaaaccaatgcatttctgggtgtgcacccctctcagacagcagtgtggctgtttccttagcattggttctggatgtaaacatgccttggtttgagcacaaaaccactgtttctgttccactttgaatgagttttccagaaatgatggctatgtggtgattcttcacctattctcatgcctggatctgatttgtgagatgttttgagaggttactgcagctttgtaacggagatttttttctttgggaagttaactgtcttttccacatccattgtggtagcctagcaacaagggacagcagagcaatagcagggattctaaaactctaaagaatgatgcctgttgacgtctgtcccagggacaggggatcccagtgggtctggcttgagatgggacaatgctatagcaagaaatctgtggtcccagagtctgacacctcagagagaagcaggtgagttcccagctcctctcatcccaaaataattcatgggaatttctggataaagtagctttcactcagtacttaaaaaaaaatctttctttaaagtctggggaataacagcagacagactttttatcctttcctggagagtgacccctttctttgaaagctgctgtcttcccagatcacagggcatggcctgacacacagtaggggttcaataaatatttgttgaacaaataaattgtcccttacttggtcttctaaaaatcacacactcacccaccccagccattttactgatgtgggaagggggagggtatgaagccagccttctttcagttgaaaggaaatgtcatcttcactactctcttgccaagagatgcacacacaaaaagctgggtcattcctcctctacatgttccccacataaaaacctagatcaatgttggctagaaatatggaagtacagttcacttctctaattgatctgcatttaattactagaaattttgcatgttgacaccatactcatttccctttcaaatgtggaaatatcttccatttacaattttcttttaaatcttgagtgagaggtggccacatctctgtagcaggagctacatcctatagggcagtatccttgtgggatgttcacatgcaaccatggttctgctttttaaagtttttgtttgtttgtttgtttttgagacagagtctcactctgtcatccaggctggagtgcaatggagtgatcttggctcactgcaacttctgcctcccgggttcaagtgattctcccacttcagcctcctgagtagctgggattacaggcatctgccatcatgcccagctaatttttgtatttttgtagagacaggctttcaccatgttggccaggctggtcttgagctcctgacctcaggtgatctgcccaccttggcctcccaaagtgctgggattataggcatgagccaccgtgcctggcctgcttcgttaagttttaaaatgtattttccttatgtgaatgtgtgatccttgttcttatttgcttttcgtcttgggtctatggtctgtggatgatatgagaaattcacaaatctaagattttatgtaaaatgttgtttatttgtgcaaaggattccataagcctcaaaaattaaataatctatgggagggagtaaggctttatccatttattaaagctaatgaaatttagcaaacactcattttcttttattttcccagaacaaagcagctaaagagataacatatctccccagtaagcctagatcgcgacactgcactccagcctgggcgacagagcgaaactccatctaaaataaataaataaataaataaataaataaataaataaataaataaatcatttattcacccaggctaattggtgactagtcctccaatttgacatgaagaatgaagtaaaaagtttagaaagcggaaagacatttcatttaaaggaaggaaatttcaatgttcttataatgcactgagaaaaatgccgtatcattactccctgccaatagaaatttaaagaagtttttccaggtttccagtgaaccctgaagtaagaaaacaatgcaataaaaacaaactttataaacatatttgttaattatattttgtctttatctcaaagctaataggctttctaaagctttcttccccccttaattattgtacaacatgacttctcctgtgtatgctgggttaccatggttactctgaggccatgactcatgacctttaaatataattgtcaggcagccaaagctctcatttttaaatcaccagttttgtttcaggcattattatttaaaagtagtctcaaattgtactttctgtgatgcatttgtggcacatctgagtatgcacataagggtattgcactcacgtattttgttttgtttggtttcattcggtgactgaatatgacttttttgcccagcataaaaaacaaacgaagcacagtccttgtcctctatgagggtgtcactgagaaatgcaaaacacaggtagagaaataatcacatatatcatgaaccataataagggctgcaagaggtggatgtccaaaacctgcttgtggaatacaaaggcaagaaatacttctgactggtagggtcagagggccttcagggagaggcagcatttgagttatggtgtgaagaaatgtaagatttcaacaagcagagaagagagtatgagtgttctggccagaggaaacaactaagaagaggataaacacacactctggactattaggctgtacagttgagggaaaacatccgttttgtgagtttcactgatagaagatgaaattcattagagggctccatttattaagatcctttaaagccattttttggtttgtccagcaactgtgatgaccaagagtttgttttccatttcatgataaagaggtgttgtcaagtagaaagtaccaaaatactgtttttttgctgatttgggtgtcgtgcgagaaaagcaattacatctcttagagcaccagtgtctccttccactaagtgagaacttaattaattttgttcagtagtcactgattactttgtgaacatttgtaaatggtttcaaattttttgaaaaatgagtaaaagagagacatgtgcacagaaatatggaaataaaacaatgtattcatgaggaagatagtgggatagaaaataataaaagtaccttgggatttaaaagtaaggctttattggcagggcgcagtggctcacgcctgtaatcccagcactttgggaagccgaggtgggtggatcatgaggttaagagatcgagaccatcctggccaacatggtgaaaccccgtctctaccaaaaatacaaaaattagctaggcatggtggcatgtgcctgtaatcccagttactcgggagactgaggcagtagaatcacttgaacccgggaagtggaggcagtgagccgagattgtgctactgcactccagcctgggtgacagagcaagactccatctcagaaaaaaaaaaaaaaaaaaaaaagtaaggctttattgattgacaacaatagaaaggaatctgttacatctgtgaggtttattagataattcatttatttattcaacaaatatttgttgaccaccctatccttcttcaagatgctgagggtaaagtaacaaaaacaacagaaaaaatttcctgtcttcaaggagtttacattttcagttgggagatgacacaaaaaatataatcaataagcaaactatatagtatgttagaatgtgataagtatcacagagaaaatagtatggtgatgaggtgaggggttaaattttaaatgagatacatatggtaggtcccactgaggtggtgacatttgatcaaagacgagaaggaaggatgagtaagccaagtggatagactgaaagtatccagggcccttggatgtgctgggaactgagtgaagaaagtatttcagagagagagtgataagtcatgtcaaaagctgttaaggtgagttgtgtaaaataatcactgggtttaggaatgcagagatctttggtgaattggacaagtgcagtttctgtggagtggtactagtagtggtactagtctaattgcagtggctttagcaaaaaagaaagaaaactagaagggaaggaattggagacagtgagaatatcgttttgctgtaacctgaatagcaaaagaggtcagtataatcaagtggaaactaaaacggtaagaaggctctaggcatgataaataacaacatgtttataagctaatggaaatgatccaggagatagagagagaagagagagggagagagaacagtgtaggagacaaagaattctccacgtctgctgattcttaggaggttatgctttcctctccccacttttttttttttagttgaaatacaagattgttcaggttttcagaacagattgtactgttcagactacttattctcaagagaacttttaaaggctattttatcttctgcgagtaaagtttacattccattatttttatttcccttagaaatgtccagaaattgacatttggaggaaatactttagaaaatttattttaaatgttacagtgtaatgatctattcattgtatgtgcgggggtgtgtgtgcgcacatgagagcctgaaataaaattttggaattctaaatgtttactttttttcagcatgacgtctggaagttcagagtcagatataccacaagaaaacaaagtatcggtaagaaatgaagtttgtatgaattctttatttaaaaaaatcattacaggtaatgaaactaacttctttaattaatattaaggttttcttgatattgtttagttttcacattttactagtaaagattttagaaataaaacatagaaagttgttttccaagtagaagattgatgtaaagtggggtggagtggtaactatgggatgttactggggctttggaaaagttacatgtgatgtggcacagcctttcttattttgacatgtaataaatgccacactgctctctgtggccctacaatactatagacatccctgggctatttttgaagtgtcagcttgtgtatgaggaaatcctggaattcacacacgaatgatatacattgggtacaacacagtatttggtttagctagactgaggtttaaatcacagtctattccagatacatctagttttattctctttcaagtcgctgtgacccttgaaggcttcttacaccatgagctccattatgtcttgggaaagctgggtcctttctacctgagcaccactgggtccctccctaggcctccagtgaaagtgtgggttgctaagaggtgctggagctaggtgatgggtatacagaagatcattataccaattctctacttttatgtaagtttgaggatttttctttgaaaagaaaaacattagctatctatatttccctcaatctcctttgattcaggttgaagaccctctggactccaccagagatatttctggaacaatcttttcagctctaatatagaggcagtatagtatggagaaaaattacagactaagaatcaagacttgggatgaggccaaaatttgccatctccaacctttgtgatgatagccaagtcatttaaactctccgagctttacttttcatctgtagaataaagataatggacttaactagtgcacttcaaataagatttttgggatgtgaaaatggttaagtgcctgagagtgtacaggagcatggttattcggaattgatagcattccagtgggcttccgtgtgggccaggggactttgttctttaatttctctatttctttctggattcagaagttctggcctaccagtccgttggaatcccggcatcactaggtgtagtagttcgttctcgcaccactataaagagatacctgagactgggtaatatataaagaaaagagattcaattggctcgcagttctgcaggctgtacgggaagtatagtggctttggcttctgctactggggaggccttaggaaggttccaattaggctttcggaaaggggtggcgaggcatgtcacacagtgggagcaggagagagagagagagagagagggagagggagagggaggagagaaagaagagagagagagggggagagggggagagagggggagagaggtggagagagggggagagagagagagagagagagagagagagagagagagagagagagaaatgctacacactttttagcaaccaaatctcctgaaaactcactcaccatcatgagaacagcaccaaggcaccaaggggatggggctaaaccattcgtgagaaactgcctccatgatccaatcaccttccaccaggcgtcctcctgcaacgctgggaattataattcaacatgagatttggacagggacacagatccaaaccttatcaccagctaagaataattgattcttttgtgagtgatatatctagaacctcacttctgtagaattatttttgatcataaaacgttaacatctctcttgtcagtgtagttcattttacctggtcctagacaaactggacatagctctcaaatttataataattttcagaaagagtgtttctcttgaagaaatattagccaaaggcaaatcaaattagtttggtttcagttaaaaatgtattttctaactctagtgataatttaatcttatgttgcttttttcagctaagaaaacctgataatgaagttttgcttcatttaatggagctgtttatgatactgttgcccaaagagtgtccctcactggaccatatgaaaacaatttttctctggttggtggggacccttgaatttgggatatgggaatcttcagggcaccaatttctacttaactgccctgtcttctaaggatgctaatcaaccagcaccctagaggtaaccctctcatggacggtatctacactgaaaaggacaaggtgccaattacctactacctttaggatttctgccaagggcttcaattagcttcctggagttcagaatccatccccttccaatttacaatgggtaagcttgggatccctggggcttgaaggaactggttgtgcttcggtttctgatttttaaaaaaatatttctaaagaaatacatttagctggagggagttgggattagagactcaaagtggtggggatatccatgattactgctgccttcttccacaacgcagtctcttttaagtcatggaactcacagagcacagaactcagcagaatggattctgctgtgaaccatgaggaaccgaattgcaggtggatctcagttgcctcttttaaataattgcttttagttttggtcgagaagacagagatgagaaaatcttttcatgaagatttcttgaccaccaagcagaattaaccccgctctctctgcctttgtgtcttggtggttctttatttgcctttactgcactattctctgaatctactttgacttttgaactctgttggtaaactgtgcattcctagagaaaggactgagctttattagtctctgggacaaaatttcagacatcaaaatggctctcgatcgatatcatttgaaataaaacaaacagactgagctccaggcgtagtagcaggtgattgaaattccctgtccctctgaatccgtagagcagcccatgagggtggtgtctggcatcatcattgttatattgataattttcttcctattgttataattaccaatttagaaattaagaaattgagattcggggagattcaaggagctccagaatgttaagtgatcaaagaatatgtgtttactttatcgcaggaacctgatgggataatccagtaagactttgtttaaatccactctcaggtgccaggtagtccccatttatctcaaccctatctattctttgggcctgctggagaattagaatgttatttaaactattgcttttgctgcattttaacatcttctgacagaatagctagtgcatataaattatctcatttgaagctgtttaggaaataaaaattctattgcaagaagggttggccaaaataggatcacgactgctccctctgaactatttctgagaatctagacacatagaaataagcaatgtaaaacatataatgtcattggttatgtggagtgccacatctaaaagtaaggctatgggtatgaattcattagctctagaatatatatgaagtattttactcagtgtgcaaaactaggcttattataaaatcccataagccctttagctttcaagtagtaatttagtgatcactttattaaagaatcactattttaagtgccaaatatatgaaagcactttttggtttttaatttgtaagatcaaataatagcccactatataggaagtcagctttataaagtgaccttaaagtagctaaaacatattatatttgataagttggggaaagcaagcagtgtcttatttgtgtcaaattatataaattctgttcttcttttaatacttagtgtaatatactattagttttgctggaaacatacatttggtcatatttctggtatctataaattttaacattctaagatgactttcaaaagattctttcctttgatgagcaaactttcaaatcgttaatgaatcaaggttatcaatatatcatttgtgttttaaataagtgatttaaaggaggtatcgctgtttattgttaagatgagaacaatataaaattgtatatgtatctatatttaaataaagatttgttgctgttctgggaaataggttaatttttttaccactctaataggtaagaaattacatctcaaaactctttgttttgcctttcctttctttctctctctttcagctttactaagacataattgacacatttaaagtatacaagttgatgagttttgataccatgtgaagctaccaccacaatcaggataatgtgcctatctaccaccctcaaaagttactcatgcaccttaggaattcccccacctgcctctccccacctgcccacacccctcaagcatttccttgagatttttataaacggagacatacagaatgtacccttttttactgctttctttcacttagaaaaattgttttgaaatttatccatgttgtagtgtgtatcaataactcatttttattgcagaatagtttcccgttgtattggaggtaccaatctgtttatccctgctgcagattggatatggtttgtttgtccccatcaaatctcatgttgaactttgatctccagtgttagagggagttctaatgggaggtgtttgggtcatggggttgcatccctcatgaatagattaacatcctcccttgggggtgagttctcaataagctgattgttaaaaagagtctgacacctgcctgtgttgtctccttgcttcttctctcaccctgtgatatctgcacattcctgttccttccaccattagtggaagcagtctgagatcctccagaaactaagcagatgctgacaccatgcttcttgtacagcctacagatccatcagctaaataaacctcttttcttttcaaattaccaagcctcagatattcttttatagcaacacacaacagactaagacaatcctttgtctgttgactgacatttagattatttccagttttaggctcttaaaaataaggcttctatgaatattcatgcatgagtctttgtatagacatatgctttcttttctcttgggaaaatacacaagagtggtggtagagtcatatggtaggtgtacttttaacttttgaaaaacctgctaaactgttttccaaagtcattgtatcatttaacatccccaccagcaatgcatgaaaattttagttcgtctacattctttgcaaccctatgaaggtcagcctttaaaattttagtcattctgtggccgggtacagtggctcacgcctgtaatcccagcactttgggaggccgaggtgggcggatcacctgtggtcgggagttcgagaccagcctgaccaacatggagaaacgctgtctctactaaaaatacaaaattagccgggcatggtggtgcatgcctgtaatcccagctactcgggagactgaggtaggagaatcacttgaacccaggaggcagaggttgcagtgagctgagatcacaccattggactccagcctgggcaacaacagcgaaactctatctcaaaaaaaaaaaaaatttagtcgttctaataggcttagttataactcattgtggttttaatttgcatttccttaatagctaatggtgttgagcaacttttcacttgcttatttgccatccttcaatcttatttagtgaagtatttattcaagccttttgtccattttcaagttgtgttagtttcttatttgataatgagagtttaaaaaaatatgatttggatgtaaagaatttttcatatatattttgcaagtattttctcctgtctgtacctggtcttgtaattctcttagtaatgtctgtagatgaacagaagttttttattttgatgagatctaatttatcaatttgtattttcatggaccacgctttgacatctgatctaaaaaaatctttgcccgaggctacaaatatttctcctaatttttattctaggaatgttatacttttagggattttttcctgttgttttcatcttttaaaaagtaattgacacataataattgtacatatttatggggtacagtgtgatgttttaatatgtgtatataatgtgtagtgatcaaattaggataattagcatatctattacgtcagacatttataatttctttgctaagaacattaaaaatcctcttttctagctgttttgaaatatacgtattattgttaactgtagttactctgctttgcagtggaacactagaacttattcctcctatctagctataactttgtatttatccccctataccaccatctccctaatcttcttcagcctctggtaacccctattttactctctatttctatgaaattgatttttttagattccacatataagtaagattatgcagtatttgtctttctgtgtctggcttatttcacttatcatgatgtcctccaggtccacctatgttactgcaaatggcacaatttcagtcttttttgtggctgaatagtattctattgtgtaaatagatcacattttctttagtcactcatccactgatggacacttagttggagttcatatctttgctattgtgaatagtgctgcaacaaacatgagtgtgcagatatctctttgacatactaatttcatttgctttggatattgacccagtagtggggctgttggatcatagggtagtttatttatttatttatttttagatagaatctcactctgtcacccaggctggagtgcagtggtgtagtcttggctcactgcaacctctgcctcccagattcaagtgattctcctgccttagcctcctgagtacctgggactacaggcacatgccaccacacctgcataacttttgtacttttttttaagtagagatagagtttcaactcctgacctcaagtgatccatctgccttggcttcccaaattgctgggattataggcatgagccactacgcctggccagtagttctatttttaatttttaaggtacctccctactcttttccacagtggttgtactaatttacattctcaccaacaatatataaggatctcccattctccctgctctcaccagcattcattattttttgtcttttcaataatatccattctaactagggtgagatgatatcttattgtggttttgatttgcattttcccaattagtgaagttgagcatttaaaaaatatacgtgttagcaatttgtcttttgagaaatgtctatttaggtcttttgcccatttataatgaaattattaggttttttttttgctattgagttgttcagtatccttatatattctggttattaacgccttgtcagatgcatactttgtgaatattttctcccattctgtaggttgtttcttcactatattgattacttcctttgcaatacagaagcttttcaaattgatgtaatcccatttgtctaattttgcttttgttacacatgtttttgaggtcttattcaaaaaatcctcacccataccaatctcacaaagtgttttccctatttttattctagtggtttcatagtttcaggtttacatttaagtctttaatccattttgagttgattcctgtaagttggaagagataggagactagtttcattcttctgcatatggatgtccagtttttccagcaccatttattgaagagacagtcctttcttcagtgtgtattattggcaactttgttgaagctcagttggctgtaaatgtgtggatttctgtattttatgccagtggcatgctgttttgtttaccattgctttgcagtatatttagaagtaaggtagtgtgcctctagcttggttctattttatcaagattgctttggctgtttggagtcttttgtggttccataccaatttcagtattgttttttctatttctgtgaaggataccattggtattttgatagggattgcatttaatctgtaaatttctttggatagtgaagacattttaacaatattaatatatgtccatgaacatgagaaatctttccatttatttgtgtacccatttctttcatcaatgttttgtagtttttattgtaaagatctgtttttgtgtaaagtctttgaagtttcatatacaaaagatcatgtcatctgtaaacaggaacaatgtgatttcctcctttgcagtttgaaggccctgtatttctttctactgcctaattgttttgactagggcttccagtactatgttgaataaaattagtaaaagtggacatccttgtcttgtgattttagtaaaaatgttttcaacttttctccattcagtatattagatatggctttgtcatatatggtctttattgtgctgaggcagattccttctataccaaatttgttgagagtttttatcatgaagggatgttgcatttcatcaaatgctttttttttgcatctgttgaaatggtcatatgtttttggccttcattctgttgatgtaatgagtaatgtttattgatttgtgaatgttgaactctccttgtatccctggtatgaatcccacttaatcatgatgaatattctttttgatgtgctattggattggatttgctagcattttgttgaggatttttgcctctatgttcatcaggaatactagcctgtagttttcttgtttgttgtgtccttgcctggttttgtatcagggtaatgctcacttcatagactgagttagcaagaattctcttcacttcaattgtttggaatagttcaagaagaattgatattagttcttctttaaatgtttggtagatttcagcagtgaagctgtcaggtcctgagcttttctttgatgggagatttttattactgattcaatcttcttatttgttattggtcagtccaggtttactatttcttcatgttttattcttgataggttgtatgtgtccaggaagtttctctttttatatttaggtctataatctctctagaaatttccctcagctgagggagctccaatttaccacaattacctgccccacctccttcttcataggattaaccttcattcaatgacttctgatgcagggccataagatgtgacctccttgctttgattggaaacagttttgaagggctatcccagctccatatctccccttggaattggctgaagcctctgttgtatttttccttctctccttactttataggggccatctccaataagccttctgcagcaaaatctttcagactctgtttcctggaaccctaacctcatacaatcacaaatatcagaataaatcataacctaatgaatgaggttgtgtgaatagaaattaataagaaatattaaacagccatagtgttatcactgaaagcaagacaaaaaatatgaatagaaactgtcattgtaactgacagccctttagagaaatctttcttaatatatataagaaattaaatgaatatctgcttgcaaacttcagggaagtaaaatattttatttaacaaatcattgcaatgttcatatattcaattttaagaatttactttttgccacaaaaggacacaaatagtatgtaaattgaatctttatttctagattcttctgctaaaggtaagtaatgttattttcccagatcttatttacccacattatactctcctgttcccattctgttccctgctcctatgaactatattcacccaatttaaatagtgtagcctaaattctctgcagaaaaaagcttctgaagattttggctcaagcagtgcatagaaaggtagtagtaatagtatccttgtaattgggattttttttttgcctgatatcaagaaagatcaaaatttcaattaatttaatttgattatcattaattttttgaactttacctgctgcaattgactaaattcttaatattttatttaccttaataatttatttctccttcataaaacccattaaagttgggaagcagaaggtctccagggaactctctggatggacacttaacctgggaatgcctttctgcaatctgggcagcaatgggtaggagggggaaaattgtcattgtgagggctctatccagaagttacacatataacttctgcactccttcatcagccaaagaagtcacatagtcccaaaaacttcaggcttgtggaagtaaaatcatattatgtgcctgggaaaagttttagaactatcttgtgaccagaaaattatagcaatataaagctagacaaaaaaaaaaaaaaaaagaaaacaagaacaaaacaaaacaaaaaaaacacagaattaaatctaagaaggaagcattatctccagaagttctcactttaataataagtgctatttaacttgagagcagaggccataaaaaagatcttagtgatttaaaatgaggttggccaaatatctgggaagtgtcctttagaaaatgatccttcacaaacaactgggcaagacgacctatttcatttttaatttacatgatagtgcaaatgtataagaaaaaaaaggtcctgtcttcatgcaaatgtgttcttttaatttttttaaatgtcaacagacaaagaaatttagaaaacacgtggcactgaaacagattgtttacagacagaatgtttttcagaatttccccaagaggcaccagtggtgcaaagaacctctataaatggaagcatctgagtgtctccagatttgtttcatcagatacccatgacatttttttctccatttggctccttcaaatggcaaaaagttcctaacaactggcataatttgaggaaagcatactaatttgtgctgtgtagtgctggcacattttattctctatgagggtgttgaggagtttgtatgtatagaaggaagggaatttggtaatgtgaaaaagggagataaatatacatccttagagtttaagggttactctgtactaacactttgaataaaatcagattttatgtgcaacttgctcatcctctggaaactgaatgtttagatcagggaagactgggcaaggggaagccagttttgaggatcatcttgttaaaaatatttaaaaatttttaattgttatgggtacacagtggtgtgtatatctatggggtacataagatgaaatattttgatacaggcataaatatataataatcacaacaggataaatgggtacccatcacctcaagcttttatattttatttgtgttacaaacaatccaattatactcttttagttatttttaaatgtacaataagctattattgactgtactcaccctgttgtgctatcaaatactagatcttattcattttctctaactacatttttgtacccattgaccatcctcacttccccacacagaccccttccagcttctgttagccatccttccactttttatctccatggattcaattgttttaatttttagctcccaaaaataagtgacagcatgcaaagtttgtccttcttgacaggtttatttcacttaacataatgtcctccaatttcatccatattgttgaaaaggacaggatatcgttcttttatatggctgactagtacaccattgtgtacatctaccacattttctttttctattcatccgttgatggacacttagactgcttccaaatcctggctattgtgactagtgctgcaataaatgtgggagtgcatgtatctcttcaatatgcttgtttcctttatattttatatatacatacatatatatatatatacacacacatacatatatatacatacatatatatacagacacatacatatatatatatatatatacacacacatacatatatatatatatatatacacacatacatatatatatatatatatatatatacacacatacatatatatatataccaagcagtgggattgctgaatcatgtgatagctctattttttgagaaaactcctgtattagtccattctcacattgctctaaagaactacctgagactgggtaatttataaagaaaagaggatgaactggctcagggttctgctcatggttctacagaaagcatggctgggaggcttcagaaaacttataatcatggtggaagttgaagaagaaggaggcacgtctcgcatggccagatcagaggaaggggcgggggaggtgacacatgctttttaaaccaccagatctcatgagaactcacttactatcatgagaacagcaagggggatgtccaccccccgatccaatcatctcccaccagactcttcctccaacattggggatcacaattcaacatgagatttgtgctgggacacaactcagaccatatcatttcaccctcaccctcccaaatcgcacgtccttctcacattgcaaaatacaatcaacctttctcaacaatctcccaagtcttaaatcatttcagcattaactcaaaagtctacagtccaaagtatcttctgagacaagataagtcccttctgcctatgagtatgtaaaatcaaaaccagttagttacttccaagatacaatgggggtactggcattgggtaaatactcctattctaaaagggaaaaaatcagcccaaacaaaggggctaaaggccccatgcaagtccaaaactcagcagggaagtcattaaatcttaaagctccaaaatgatttcctttgcctccatgtttcacatcctggcaacactgatgaaatgggcagaatcccaaggccttgggtagctctgcccctgtggttctgcaggggacagccaccatggctgctttcatgggctggcattgagtgtgcctgcagcttttccaggggcacggtgcaagctgttggtggatctaccatgctggggtctggaggatggtggctgtcttcaaacagctccactaggcagtgccccagtggggactctgtatgtaggctccaaccctatatttctcctccacactgccctagtagaggttctccatgagggctttggccctgcagcagacttctgcctggacatccaggcctttccatacattccttgaaatctaggcagaggctcctaagcctcaactctcatattctgcacccacaggcttaacaccacatggaagcctccaaggcttacaacttgtaccctctgaaacaacaggctgagctgtatcttgggaactttaagatacagaccttaagatggctgggcctggagtggctatagtgcatggcaccatgtcctgaggctgtacagagcagcaggaccttgggcctggccacaaaaccattctttcttccttggcctccaggcctatgatgggagggactgacatgaagttctctgaaatgtcttcgaggtctttccccattatcttgactatcaacatttggctcctctttacatatgcaaatttctgtagctggcttgaatttctccccggaaaacgggtttttcttttctactacgtggctgggctgcaaattttccaaacttttacactctgcttcccttttagatattagtttcagtttcagaccatttctttgctcatgcatatgaccatatgctgttagaaccagccagcgcatatcttgaatgctttgctgcttagaaatttcttccaccagataccctaaatcatctctctcatgttcaacattctacatattcccagagcagaggcaaaatgcctccagcttctttgctaacatataacaaaactgaccttactccagttctcaataagttccttatctccatctgagaccacctcagcctgacttcattgtctatatcactatcaggattttggtcacaaccattcaagaagtctctaggagttccaaactttccctcatctttctgtcttcttctgagccctccaaactcttctaacctatgcccattactgagtcccaaagctgcttccacattttcaggtatctttatagcaatgccccactcccagtatcaattttctgcattagtccattctcaaattgctataaagaactacctgagactgagtaatttatagataaaagaggtttgattggctcatggttcctcaagctgtacaggaagcatggctgtggaggcctcaggaaacttgcagtcatggtacaaggcaaaggagaaggaggcatgtcttgcatggctggggcaggaggaagagagaaagcggggaggtgccacacacttttaaacaaccagatctcatgagagctcactcattatcatgcgaactacaagggggagtaagccccaatgatccaatcaccccccactaggctcctcctccaacactgggggttacaattcaacatgagatttgggtggggatacaaattcaaaccatatcacctccatactgttctttatagtaactgtactaatttacatttccaccaacagtgtatgagggttcccttttctccacatccctgccagcatttgtcattgcctgtcttttggataaaggccattttaactggggtgagatgatatctcatgtagttttgatttgcgtttctctgatgatcagtgatgtcaagcacttcttcgtatggctgtttgccatttgtatgtcttcttttgaggaatgtcttttaggatcttttgctcatttttaattagagtacttttttttttttactattgtttgagctccttatatatcctggctatgaatcccttgtcagatgggtagtttgcaaatattttctcccatttgtgggttgtttcttcactttgttgattatttcctttgctatacagaagctttttaatgtcatgtgatcccatttgtcaatttttgctttagttccctgtgcttatggagtattactcaagaaatatttgcccagaacaatgtcctggagcatttcctcaatgttttcttttagtagtttcatagttgaggtcttagatttaagtctttcatccattttgatttgatttttgtgtatggcgaaacataggggtctagtttcattcttctccatatggatatccagttttcccagcaccatttattgaagagactgtcccttctccaatgtatgttcttggtaactttgtcagaaatgagtttactgtagatgtatgaatttatttctgcattctctattttgctccatttgtctgttttcatttttgtgccagtatcatgctgttttggttactatagctctgtggtataatttgaagtcaggtaatgtgattcctccagttttgctctttttgctcagggtatctttggctattctaggtcttttatggttccgcacaaatcttggatttttttttaaattctgagaagaatttcgttgtcattttgttagagattgcattgaatccgtacattgctttgggcagtatggacattttaaaaatatttattcttccagaccatgaacatggaatgttgtttcctttttttggtatcctcttcaatttcttgcactaatgttttatagttttcattgtacaaatctttcatttatttggctaagtttattcctgggtattttattttatttttatctcttgtaaatggaattactttcttgatttctttttcaggttgtttgctgttggcatacagaaatgttactgatttttgtatgttgattttgtattctacaactttactaaatttgtttgtcagttctaatagctattttttatgaagtctttaggtttttccaaacataagatcatattatctgcaaacaaggataatttgacttcttcctttccaatctggatgctctctattttattctcatctcattgctctaggtaggagttctagtactatgttgaataacagtggtgaaaatggagagaccatcaaaattaatcagtctgactttgaaagcacagttcaattgctatgatctgaagaaaattacttttcaaaactgtttaaaatttccttaagagaagatatcattcgaaggggttaggacagttacttaatctagcctttctctttgagaggctttctctggatacttggggaagttggcagagaatgcaggtggcaacagggtaaatagcacaaggatgcagcctctcaggaaggaagtctgacctctggctgccctcagtctcaccaggcagattgcgtaacatcagcttaacttattttgatagttttgttaaactgaaatttgctgctggaaataatagccccaggtcttcatgtcaatagctaaactgtttatgttagatcagatatcagagtccattggttattttgaaataagttaaaatatttcaatcaatgtggtgtactatctgtacttaggttcagagaaatggagggtttttctaagtttgattagagcttgcttcttcaagaagttgattgaatgaggttatgcattaacacagaaagatgacaagataatttggattctgaaaattctgtatctcataagaaaatttatcacttaccattttttcaactcatttaagaagtatttccaaatactcaaagtaagtgattgaaaaatatttataatgtttattacaatataatatccttcatatattaaggtcttgccttaaatacctaaggagaatgctataaattctagaacaacctgctttctctagggcctatttctacctgcgatcttccttacaatagaaacatctatgtctgtggtgactacattctgaatcctattaatgtttttcttccaaattatagcagcattgagtttttgcctcctaatgtgtttttacattcttttctgataattatgttattgaaaatctagaaagaagtcttccatagtacttgctttgtgatcactcatcatgtaatgctcaaatccaaatgtactaaatggttggaattggtttgtggtttaaaaaaaaagtctaggccgggcacagtggctcatgcctgtaatcccagcactttcggaggctgaggcgggtggatcatgaggtcaacagatcaagatcatcctggccaacatggggaaaccccgtctctgctgaaaatacaaaaattatcagggtgtggtggcacgcgcctgtagtcccagctacctgggaggctgagacagcagaatcgcttgaacctgggaggcggaggttgcagtgagccgagatagtgctgctgcactccagcctggtgacagagtgagactccgtctcaaaaaaaaaaaaaaaagaagaaaagaaacgtctagtttcaaatattcaagtacttacccctatatatactaggaaaatagtatcatcattcaccatctcaactaaagaaatccatctaaattttttcatttttaagtcatttttcaaataatttacagaaggataaaggcataatagaaaaactgattagaaattttaataaaagttaaacatagcaaaactctttatatcaaataaaaaatttggcacacaaacattataaaagataaaagaatattgtcatatatgcaattagcaaaagaggaaagcccaaattcttgttgcaaaatatggtgtgatacagtctgtcctgtatgaagtactctattttctttattttccatagagacaggttgtttactcattgattcatgaatttgaggaaatttgttaaagtttgtaggaaatcatgatctaaagattcatagtctatttcacttacatgattgattccatcatcagcattagtgtgtaaagtagcactgtccaacagaaatatatttcatgttatacatgtaattaagaagtttctagtagccaaattgaaaattttaaacaggtgaaattaaatttgaataatacattttatttaattttgcatattcaaagtattatttcaacatataattgatataaaatattaataagatatctgatattcccatttattgtactaaagcttcaaaatcagtgtgtattttatacttaaaacacatctcaagtcaaactaaccatattttaagtacctgaatgtcacatgtaattagtggctaccctatgggacagtgctggtctggagagcttgctgtagctctttatatttgttttctgatttgtctaagaattgtgaaatgtctccctctgtcagttttcttctgtttggtcattatagatggaaaaagaaaaaataagtattctaaactgtgttcaatgaagctaaaaacaacatacacatggcgtctcctcttctatactatcttgaaagatgatgcaatacttttggcaacacagtataaaattgaaagattattattaatttcactattgtatttgtctttctagtaggttccattattttttgtttttttctttagtctttttttaagtcatagttgaaaataattgatgaataagaaaaaaataattcctagtataacaaaatagcaaaatgtttaaaatgttagaaaaagaagatcaccaagatctcacaatatgtcttagctttataaaaggctcaatggacttgtgtgataattgcaagatagaataaattttattttaaaataaatatatgttatctttgttctttgtaagactattaagaaataataaaattcacaaaatatcaatttttacagatagaactgctcaaaaaaagaaacaaaactataattgagtccagtgaactcctatggtatatggggggttaaattgcattaattaaacaacatgtcggggaaaatttcagcgacacatttattttttagtcccccttttcttctccataagctttcatctcataggacttttcccaagttttctcctcaaaaattctttgaaaaactttctctggtagccccagtacacaatctcttcatctcaaaagccccaaagaacctgtctaacaagaaggtcgcccagagaaggggcagcagccatcactgcagctccagtctgccattttctcctgtgggtgctggggaggctgggtggtttgggcccaggaggaattccccacagcacagcacagtggctgtggcagatcatgaccagattgcctcttgaggctggacctcgacccatcctttctcactggtcagggcctccttgtgggaatttcagccattctggccaggggtttacggacagagctttgatctccctgggatgaaaccctggggtaaggggatctgcagacttagtctttccccttgctggctctgaggaatccaggcagtctggaggagtgggattcctcccacacagtgcacccgctccaccaaggggccaccagagtgcttcagtaagcaagtctttgatcccatgcctcctgactgggtgagaccctacaacagtggttgccagacacattatacaggagcattcctgctggcatcaggttggtgcccctctgggacagagctcccagaggaagaagtggacagccatctttgctgttctgcagcctcctctggtgacacctccaagtgtgggagggaccctgacaaatagggtctggaagggaccctcagcaaaccatagcaaccctacggaagaggggcctgactgttaaaagaaaaacaggctgggagtggtggctcatgcctgtaatcccaacactttgggaggccacgaggcagacgatcttctgaggtcgggaggtcgagaccagcctgaccagcatggagaaaccccatctctactaaaaatacaagattagccgggcatggtggcgcatgcctgcaatcccagctactcaggaggctgaagcaggagaatcacttgaacccaggaggcagaggttgcggagagctgagatcatgccattgcacttcagcctgggcaacaagagagaaactccatctaaaaaaagaaaaaaaaaatcaaaagaaaagaaaaacaaacaaacagaaaacaacagcgtcaacaaaaagtccccacaaaaaccccatccaaaagtcagcagcctcaaagatcaaaactacataaactcatgctgaaaactcaaaaagccagagtgcctcttctgctccaaatgatcacaacacctctccagcaagggaacagaactgggctgaggctgagatggataaactgacagaagtaggcttcagaaggtgcgtaataatgaactttgctgaactaaaggagcatgttctaacccaatgcaaagaagctaagaaccacaataaaacactataggggctgttaaccagaataaccagtttagagaagaaaataaatgacctgatggagctgaaaaacacaacatgagaacttcacagtgcaaccacaagtatctacagccaaatagaccaggtagagaaaataatttcagagctggaagactatcttgctgaaataagacaggcaaacaagattagagaaaaatgaatgaaaaggaataaacaaaacctctgaggactatgggattatgtaaaaggaccaaacctacaactgattggggtacctgaaagagacggggagaacaaaaccaagttggaaaacattcttcaagatatcatccaggagaacttccccaacctagcatgacacaccaacattcaaagttaggaaatccagagaaccccaataagatactccatgaaaaggtcaaccccaagacacataatcatcagattctccaaggtcaaaatgaaggaaaaaattgttaagggcagccagagagaaaggccatgtcacctacaaagggaagcccatcagactaacagaggacctctcagtgaaaaccttacaagccagaaaagattggggggacaatattcaacattctaaaagaaaagaatttccaaactagaatttcatatccagccaaactaagcttcataagcaaagaggaaataaaatccttttcagacaagcaaatgctgagggaatttgtcaccacaaatcctgctttgcaggagctcctgaaggaagcactaaatatggaaaggaaaatccattaccagccactacaaaaacacactgaagtacaaagaccaatgacactatgaagcaactacattaacaagtctgcaaaataaccagctagcataatggtgacaggatcaaattcacacataacaatattaaccttaaatgtaaataggctaagtgccccaattaaaagacacagaatggcaggctgaataaagagtcaagacccatcagtgtgttgtattcaagagaaccatctcatgtgcaaagacacacataggctcaaaataaaaggatggagaaaaacttaccaagcaaatgcaaagtagaaaaaaacacaaattgcaatcctagtttctttttttctttttttttctggagacagagtctggctctgtcacccaggctggagtgcagtggcatgatctcggctcactgcagtctctgccttctgagttcaagcaattctcctgacttagcctcccgagtagctgggactacaggtgcatgccaccacgcctggctaatttttgtagttttagtagagacagggtttcaccatgttggctaggctggtctcaaactcctgacctcagatgatcagcccacctcagcctcccaaagtgctgggaatacaggcatgagccactgaaactggctgcaatcctagtttctgacaaaacagaccttaagccaacaaagatcaaaaaagacaaagaagggcattacataatggtaaagggtttaattcaacaacaagagctaactatcctaaatatatatgcacccaatgcaggagcacctagattcataaagcaagttcatagataccttcaaagagacttagactcctacacaataatagtgggagactttgagaccacactgtcaatattagacagatcacagatcatagtgacagaacactgacaaagatattcaggacttgaactcagctctgaatccaatggatctgatatgtatctgcagaactctccatgtcaaaactacagaatatacattcttcttcgggtcacatggcacttactctaaaatcagtcacataattggaagtaaaacactcctcagcaaatgaaaacgaactgaaatcataacaaacagtctcccagaccacagcacaatcaaattagaactcaagattaggaaactcactgagaaccacacaactacatgaaaattgaactacctgctcctgaatgactcctgggtaaataataaaattaaggcagaaaacaagaagttctttgaaaccaatgataacaaagaaacagtgtaccagaatctctgggatgcagctacagtagtgttaagagggaaatttccagcactaaatgcccacatcaaaaaagattagaaagatctcaaatcgacatcgtaatacacaaataaaagaactagagaaccaagagcaaataaaccccaaagctagcaaaagacaagaaataaccaaaatcaaagtggaactgaagaagatagagacacaaaaaacccttccaaaaatcaattaatccaggacctgcttttatgaaaaaatgaataaaatcaatagaccaaaagctagactaataaagaagaaaagagagaggaatcaaatagacacaatataaaatgataaaggagatattaccactgaccccacagaatatacaaacaaccatcagagaatactataaacacctctatgcaaataaactagaaaatctagaagaactgggtaagttcctggacatatatatcctcccaagactgaaccaatatgaagttgatatctgaatagaccaattacaagttctgaaattgaggcagtaataaatggcctaccaaccaaaagaagcctaggaccagacagttttatagctaaattctaccagaggtacaaaaaggagctggtaccatttattctgaaactattccaagcaattgaaaaggagagactcctccctatctcattttatgaggccaacattatcctgataccaaaacctggcagagatacaacaaaaaaaactttaggccaatatccctaatgaacattgatgcaaaaatcctcaataaaatactggcaaaccaaatccagcagcacatcaaaaagcttatccactatgatcaagtcagcttcatccccaggatgaagcctggttcaacatatgcaaatcaataaatgtaattcattacataaacagaactaaagacaaaaactacatgattacctcaatagaagcagaaaaggccttcaataaatttcaacatcactttatgttaaaaactctcaataaactaggtattgatggaacatacctcaaaataataagagccatttatgacaaatccacagccaatatcatactgaatgggcaaaagctagaagcattcccttgaaaacaggccaagacgaggatgccctctctcaccactcctattcaacatagtattggaagttttggccagggcaatcaggcaagaaaaggaatagagcatattcaaataggaagggaggaagccaaactgtctctatttgaagatgacatgatcctatatctagaaaattccaccatctcagcctcaaagcttcttaagctgataagcaacttcagcaaaatctcaggatacaaaatcaatatgcaaaaatcacgagcattcctatacacaaatgatagacaagcagagagccaaatcatgaatgaactcctgttcacaattgctagaaagagaataaaacacctgggaatacagctaacaaggggagtgaaggatctcttcaagaagaactacaaactactgcttgaggaaatcagagaggacacaaacaaatggaaaaacattccatgctcacagataggaagaataaatatcgtaaaaatggccatactgtccaaagtaatttatagattcaatgctattcctattaaaataccattgacattcttcacagaactagaaaaaactactttagaattcatacagaaccaaaaaagagcctgtatagccaagacaattctaagcaaacagagcaaagctggaggcattatgctacctgattttaaactatactacaaggctacagtaaccaaaacagcattgtactcgtacaaaaacagatacatagaccaacggaacagaatagagaacccagaaataagactatgaccatctgatctttgacaaacctgacaaaaataagcaatgaggaaaggattccctgtttaataaatggtgctggagaactggctagccatatgcagaaaattgaaactggttgccttccttataccatatacaaaaattagctcaagatggattaaagacttaaatgtaaaacccaaaactataacatcccaaacagaaaatctaggcaataccattcaggacacaggctgtagcaaagatttaatgactaaaacatcaacaacaaaaataaaaaattgacaaatgggatctaattaaactaaagagcttctgcataccaaaagaaactgtcattagagtgaacagacaacctacagaatgggagaaattttttgcaatctattcatctgacaaaggtctaatatccaggatctacaaggaacttaaagaaatgtacaagaaaaaaaaaccattaaaaagtgggcaaaagacatgaacagacacttctcaaaagaagacatttatgtggccaacaaacatatggaaaaaagctcagcatcactgatcattagagaaatgcaaatcaaaaccacaatgaaataccatctcacaccagtcagaatggcaattattaaaaagtcaagaaacaacagatgctggcaatgctatggagaaaaagaaacacttttacactgttcgtgggaatgtaaattagttcaaccattgtggaagacagtgtggcaactcctcaaagacatgtaacaagaaataccatttgacccagcaatcccattactaggtatatacccagaggaatataaatcattctattataaagatatatgcacgcatatgttcattgcagcactattcacaatagcaaagacatggaattaacccaaatgtccatcaatgatagactggataaagaaaatgtggtacatatacaccatggagtactatgcagtcataaaaaggaatgagatcttgtccttcaggaacatggatggagctggaagccattatcctcagcaaactaatgtaggaacagaaaaccaaacaccacatgttctcacttataagtgggagctgaatgatgagaacacatgaacacagggaggggaataacacacactggggcctgcaagggtgagggtggcaggaggaaggagagcatcagggtaaatagctaatgcatgtggggcttaataccgaggtgatgggttgatagatgcagcaaatcaccatggcacacgtttacctgtgcaacaaacctgcacatcctacacatgtaccctggaacttaaaataaaataatacaatttttaaaaaagaaggtcaaggaagagaagagatggaacagatcaattaaaaattctctttagctggcaggggaggatgcaaggctgtgccctccccacttgcatttttgaatttttgctcttagtttatgcataactatgtgcattttctaacaaggagtaaccaggctaggaggtatattcacataaagccaagagtttctggtccttacaatcaactcccagactctctcctaggctgagaactcccagaagctggaccataggaacataaaacctacagcttgatgagagaattttctttttacttgctactgtggaccagccgttatactaagtaaagttcctgaattaccccatttcatcatcacagcaaaccctggagttatcatctcctccatttttatagatgaggaaataggggctcagaataattaaattactgtcttaaagtcacagaaacaataaatataattgagtcaaggacctcgcatcagtcagattcatatttgaaatcaacagaacccatactagttaggattcaagaggggaaagaattattggaaaatattagatatttcagaggttctttaggagagccagagaatcaaccttggaggctacacgcaattatcttgcagattctgaggacaaacctgttactgctgccaccagacctataacctgtcactttccctgaatctgagatattacttctaagtcttctatcactgtagcctctgaaaacagaatgaccctgtccaccaagccagattccacgctgtttggcacctttttcatttcattctcatccacattgaagtttctttttttttttttccagtttccaatacattttttatttccacctgagaatttgtcagccatgccttcactaactatatatatatatatatttttttattatactttaagttttagggtacatgtgcacattgtgcaggttagttacatatgtatacatgtgccatgctggtgcgctgcacccactaactcatcatctagcattaggtatatctcccgatgctatccctcctccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcactttttatggctgcatagtattccatggtgtatatctgccacattttcttaatccagtctatcattgttggacatttgggttggttccaagtctttgctattgggaataatgccgcaataaacatacgtgtgcatgtgtctttacagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatagccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagtttgttgtagattctggatattagccctttgtcagatgagtaggttgcaaaaattttctcccattctgtaggttgcctgttcactctgatggtagtttcttttactgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgtcttggaaatgtgggctcttttttggttccatatgaactttaaagtagttttttccaattctttgaagaaagtcattggtagcttgatggggatggcattgaatctgtaaattaccttgggcagtatggtcattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattttgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcttctgcaaagagggacaatttgacttcctcttttcctaattgaataccgtttatttctttctcctgcctaattgccctggccagaacttccaacactatgttgaataggagtggtgagagagggcatccctgtcttgtcccagttttcaaagggaatgcttccagtttttgcccattcagtatgatattggctgtgggtttgtcatagatagctcttattattttgaaatatgtcccatcaagacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgcttgcctcataaaaagggttagggaggattccctctttttctattgattggaatagtttcagaaggaatggtaccagttcctccttttacctctggtagaattcggctgtgaatccatctggtcctggactctttttggttggtaagctattgatcattgccacaatttcatagcctgttattggtctattcagagattcagcttcttcctggtttagtcttgggagagtgtatgtgtccaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctcagattttagttatttcttgccttctgctagcttttgaatgtgtttgctcttgcttttctagttcttttaattgtgatgttagggtgtcaattttggatctttcctgctttctcttgtgggcatttactgctataaatttccctctacacattgctttgaatgtgtcccagagattctggtatgttgtgtctttgttctcgttggtttcaaagaacatcttcatttctgccttcatttcattatgtacccagtagtcattcaggagcaggttgttcagtttccatgtagttgagcggtttttagtgagattcttaatcctgagttctagtttgattgcactgtggtctgagagatagtttgttataatttctgttcttttacatttgctgaggagagctttacttccaagtatgtggtcagttttggaatagatgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttaacagtggggtgttaaagtctcccattattaatgtgtgggagtctaagtctctttgtaggtcactcaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggtttgcaacccctgcctttttttgttttccatttgcttggtagatcttcctccatccttttattttgagcctatgtgtgactctgcacgtgagatgggtttcctgaatacagcacactgatgagtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtccttacattttggcatgattttgcaacagctggtaccagttgttcctttccatgtttagtgcttctttcaggagctcttgtaaggcaggcctggtggtgacaaaatctctcagcatttgcttgtctgtaaagtattttatttctccttcacttatgaagcttagattggctggatatgaaattctgggttgaaaattctttcctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcttcttccattgctgataccctttctttcagttgatcacatcagctcctgaggcttctgcattcgtcacgtagttctcgagccttggttttcagctccatcagcttctttaagcacttctctgtattggttattctagttacacattcttctaaatttttttcagttttcaacttctttgcctttggtttgaatgtcctcccatagctcagagtaatttgatcgtctgaagccttcttccctcagctcgtcaaagtcattctccatccagctttgttccgttgctggtgaggaactgtgttcctttggaggaggaggaggcgctctgctttttagagtttccagtttttctgttctgttttttccccatctttgtggttttatctacttttgatctttgatgatggtgatgtacagatgggtttttggtgtggatgtcctttctgtttgttagttttccttctaacagagaggaccctcagctgcaggtctgttggaataccctgccgtgtgaggtgtcagtgtgcccctgctggggggtgcctcccagttaggctgcccgggggtcaggggtcagggacccacttgaggaggcagtctgcccgttctcagatctccagctgggtgctgggagaaccactgctctcttcaaagctgtcagacagggacatttaagtctgcagaggttactgctgtctttttgtttgtctgtgccctgcccccaggggtggagcctacagaggcaggcaggcctccttgagctgtggtgggctccacccagttagagcttccgggctgctttgtttacctaatcaagccggggcaatggtgggcgcccctcccccagcctcgctgccgccttgcagtttgatctcagactgctgtgctagcagtcagcgagactctgtgtgcgtaggaccctccgagccaggtgcgggatataatctcgtgatgctccgttttttaagcctgtcggaaaagtgcagtattcgggtgggagtgacccgattttccaggtgccatctgtcacccctttctttgactcagaaagggaactccctgaccccttgcacttcccaagtgaggcaatgcctcgccctgcttcggctcgcgcatggtgtgcgcacccactgacctgcgcccactgtctggcactccctagtgagatgaaaccggtacctcagatggaaatgcagaaatcacccgtcttctgcgtcgctcacgctgggagctgtggaccggagctgttcctattcggccatcttggctcctgcatctccacattgaagtttcatgctggtgtgtctgacttggtggagtctaagtcacataactacaccttggctgcgaagaatgcttgggaaggagctcctggcttttaactttggaagataggatttatgagatgggaaattatccaaacagagaacgacactgggcagtcaaaacagcttgccaaatggccagtgcagaggtcaagttgaatgaggtacaatggtgttctcattttacagatgggaaaactgaggtgcactgagtagctacagttggctgtactatgctctcttctccaatatttttgccatgcctcttagaagcattttgattgcaagaccttaaaagaagtggaaattcacagcaaaagtgagcctttccatctgtcttctgtgccttatagtattagaatgtactatggaaattgttgctaaacttttatctgataggaaaggatgcataacacatttctccttcagatcttggtaaagaatggagtctgtgcaaatgccagtctgggaggtaataaaagggtttctcatgaaaaaggtttctatgaaacttcaatttcaatgaaggatttccttgctaggttttggaaatagcattgttggaatattgaagttcttatcattgtaattaattttttaaattttttaaaaaatttacctatttagaatctaaaactttttagtagaaaaaaattacctccagtctgaacagtgtcaatcataaaacatttgctattaattttacacagtatagcaaaatttatacaacaaaactaattttgaaaagccacaatcaacttgggcaatgaaatgtcatcaattctatcactttactcatgagctgacttgaaagtcctacaggcatgtgcgtttcctaaaacactaaaattcagttggagaatgaaaacatagttggtcaacatgccaaagtactcaaaatctaaactcatgcatgatgagtgagaaaataaataatcctgtcacacaaaaaaagtaccatcttttcaaatggcaaacgtatttgcagtattttatatcccacttaactgaaaatgttatttaaaaacaaatagatttttttttatttagttgttgttgtcgtcattgttgttgagacaggttcttgctctatcatccaagctggagtgcagtggcgtaatctcggctcactgcagcctccacttcccaggcccaagcaatccttcagcctcagcttcccaagtagctgggactgcaggcacacaccaccaccacctgctaattatttttatttttttgcagagacgaggtctcaccatgttgcacaggctgatcttgaactcctgggctcgagagatctgtccatcttagcctcccaaaatgctgggactgcagttgtgagccagcacacccagcctgtaatttatttttgaataaaaattaaaggtgactagcatgtgatattccctctaaacaaggattgcttaatgtgggctacatgaatgatattgagaagagtgcttaaacaccctgaaagcatatacaaaattatgtgcaggtgtgcttactgtatgtgtgtgcaagctgtgcacatactttttttgataagagaattcacagatgttatcaggtgttcaaaggagtctctgttgctcataaatcaaaatgatagagggctattttaggtcacagaacagattctgtaacatatgtaatgtaatatgaacttgaattcaggactcctctagcccagatcctattttgctattaactttaatttaaaccatgcaagatatccatcttttgcaaggtcctttttctcctctgatgctgtttatacaaggtctctaagagcctataaagcaatgttactagagatagacctggaatatttgaaaacagattagaactgcctcttaccaccttctaacatctaccagaatcttcatcaaagaggaaggaacaaagccctaaagcacaaagcagtatattaggagtgagcataaaaacgttaaattaaccaccaaacttgtgacattcttttcatttttacataaacctaatcccaagatttctgtattggagagaaattctaggctgagactcctagtgagcatattaactacgtctgccttgttactccttatttccctgttgcctagtatagtgcctggcaaatagtgagccttcaataaatattttttgaacttaaatgaattgaattgctttgagctgaataagagttggcatgttaagagttttgggtcagccattatttaaagttatttatgaagctatcaaatgtcacatgggcatttctctttaacttccatgccaacaacctttttataaattaaaatctgagtcaacaatttctttccaatacctttttcttttattctatcagtaatgctatagaaatggacaagtagttaaatctttcacagggtgaaaggttgacttttaggaatgtgtttatttctaaaaaaaatagtatcctggaaccttgctaaggcagataagttgatatagaatacaggtgcatcttggactaggtccaggggaattcagggactctagttctggaaaggtcacctgataaaacattcaattcacaatttaacagagatcatttagataggaggtctctatacttagatttcataaaccagtaagaattttcacacccaaaataattagggttagttctcataggactgccaacttttcaatttttttcaagacactaaaacacaataatttccatgtaccaccatcatttgttaaagaaatatcctcttaacaccaaagaaagcagaatgattataatctcagaataaatgacagtcttcaaagtggaatcaatttggcttcatgaaaaattcacaatgttctctttaaaagtttgccttgtccttttgttgctggttggcacaaatgttatcacaaaccaacactgatctatggggtggcatttgggaaccactaatataattaaacccctttgggctgaggtttttttgtttcctcctccctatccactctccacccttcccaactcatcttttcagggaacgctgatctcgctggacatttatttgggttctcttgccctctggcttgatgagttcagcccaagagagacacagacaggagaagaggggatgagaagagagaaggtcaggctatttactccgctggttcatttcccctccccgcttccctccaaccaccaagactgcctagacatagttggccgtggctgtgttcctctcctcaagctttctttctagacttgtcagttttgctcttcccctacctcttcaggtcaagataaggcaaagggcacccgtacttccaggaaatgcttcaccaacctttgttggttcctttaatcttacccacaccttctaaatcatcccttcgtttaactctcctcggtttctgcattggagtagccatctatttcctgctgtcttgatcaatacattcttcatttaaagatgaaaatgttgagacgcagacaaatgaagtagctggtccaaagtcacatggtcacttagaatcaagtcagatatagaccatgccttccagattacaagaagagtgctccttaggttgtgctcatccaggccaccatcctcccagggccaccacctgctcagccatatagatgggcatttcaacaactagttgtagtttgttcacatttctaatttaaacatcttcttaggtgactattgaggcaaacccaaacacagaggaatactgttttcactggagtggattagagccaggaaaattgagtttttaaatatttgcctaagtagaaatgggcaatttagtataagaaactattgcagggccaggcgcggtggctcacgcctgtaatccctgcactttgggaagccgaggcgggtggatcacgaggtcgggagatcgagaccatcctggcttaacacggtgaaaccccgtctctgctaaaaaaatacaaaaaaattagccaggcatggtggcgggcgcctgtagtcccagctactcgggaggctgaggcaggagaatggcatgaacccaggaggcagagcttgcagtgagccgaggttgcgccactgcactccagcctgggctacagagcgagactccgtctcaaaaaaaaaaaaaaaaggaaaaaaaaaaagaaactattgaaaacgctaaacacaaaagaacatgagaatgatgaaattaccactgtgatgtgaattctgatcatgaaaggggagcggggagagatgaaataaatgtgcccagggtgaggggctgaggcatgggtggtaggttggggagaagatgatcagctggggaaagacttgaatctgcatgagaaaatgagtaggttgaagaagggtaaggaagaatagggtgataggtgcctgtcaagcagaaggagagaggaatggacagcagtaatgaatagatatcaaacaggatatttgtaaaatgtgtttatctggcaggaagttactgtaccactgagcaggggctgctgctggaaccctgacatattagaagcctcagattttagagaaactgaattctccaaaactgacctatgtcaaaatgctcttccacaatggtgaaatttgccataaccacacttttatttaaaaatcttgctcttaaataaatgcacatgcacatatttaatacattaactgttcttaattacaaacttgattgaatttcccactgctgtttggtcacttgctgttacaaaagtgtccccatgggtattttcttttacttgggttttaaaataagctagagagtcttaataccaaattattctctttaaaggaattgggataatggaattattaacatttattgagcacttcttctgtcaaagcatttacctgctttacctcattcaattcttaaaacaaccgttccatcactcaacctcgtgaccacattcttgccctcatctgcacatctggcccctgaccatggcaagcagagcttctctgtggctctgatccctgtcaatgtcccaggtcagatgcatgaaaagtattgctcaaagaagtcactgttatagcctctcagcatgaaggactgcctgctctggtacagccaccttccttgactgccgagcctttaatcaatcaacaattatttatcaggctcctacttactgttcagcaaagtcccatctgtcttctgcagacaggaatctttctagataccgcacatgaagttggatcagtcagaaaccttgagccaatccttaagggtcaaagagtttgtacagctgtcattttaggacagagaaataaaggcttaacagcaaggtagaggataatgagaaggtactggaatagattaagaaatcaagaaatataaaattagaaaataatatgcaaattttcttttaaattatccaatgagaaacctttgcaaccaaaatgaagtctactcttacaatgtcatataagatttgttcagttagtaaactatcaacctcaacatccatgcataataatagtcaggtgtctttactgtaatcaaagagtttattgaatttttagtgttatttagtatcattttagattgatcatcttggctacattaggtatctgtatttagataataactttatatttaggtagacaattttaagacaaaaagtagaaattaacaaagagaatttttattaaattgttggaatttaccatttggaaatccatacacaggttcaattcccaaacacctatatattgcctatattttcatcattttgatgtcatataacagactgttgattagtattattcacttgcaactactttaaccactgaaagtattcattttcattattaatacaaattgcatgtgtccacacgtacctggaagtaaaataaaattaattatggaagtcctatctttctgcccttctgccattgcaccttgcaaaactgggacaacaactgaacacatctaacttttttagtctttgaaaccacatatccacctcccagacctctatctttatgtgtttacttatttttgaaattgttcttgacttcatttttgtttgccttttttctgttaatggggttacctcctatttaaaaagtgcttgcttttgtataagctctttcccgtaagggagtgggagaagctgaaaggcaggtcagagagcagggtgtgctcactgcagctggagtgaaggtgtaaaagactgactttgcattctccacagtttgctcaggtctttctctgtcctaaaacagatgacaatttcctaaatttgtctgtatgaaaagtcctatgttatttaataacagtcctcgtttatgcctgtttcatttggctttgacttatattgcttttgtcttatggaaatgtttgttcttcttagccagggaaattttgggtgtttggagaaggcctggagatatggattagacaatcttgctgagtctactcatacaaattttaaaaacttcttcttgagatcaaacattcaacaagaaaattttccctggaaatagcagtctagatcagagattctcaatcttttaaaaatagtttggcctcatgacaattccccatttctgcatataatgtcttacaacatgtattcatctctaagtgtaaatacacaagaattttgtttaaagccttttttttttttttgagaatttttgaacccatttttgaaattactggaaccatcagggatccgaggacaattggttcacttcctagtatcaccattccagcctaagatattcctcccctaatggcaaacttttgagggtgagtatgcacctgtagtggcagaacttgactgtggagccaggctgttggtgacgtagcaatatttttttgcccctcctcccatagaattctgtttatatcagaggccagtggcagagactcaaggttcaatgtatagtatgaacaattacaaaaactgaatgaatgctgtatttttatgcctggtttcatttaccaccagatggctctattgtatcatcaggaaatgcacacatgtaaaatcagtggtctcataagccatagggaaaaaaataaagcagaagttagacctttaaggtatgtaggaatgcagttcattcttttttttttttatttcttgtttcttttttatttatttatttttttattgttatactttaagttttagggtacatgtgcacattgtgcaggttagttacatacgtatacatgtgccatgctggtgtgctgcacccactaactcgtcatctagcattaggtatatctcccaatgctatccctcccccctctccccaccccgcaacagtccccagagtgtgatgttccccttcctgtgtccatgtgatctcattgttcaattcccacctatgagtgagaatatgcggtgtttggttttttgtccttgtgatagtttactgagaatgatggtttccaatttcatccatgtccctacaaaggacatgaactcatcattttttatggctgcatagtattccatggtgtatatgtgccacattttcttaatccagtctgtcattgttgggcatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctggggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggagttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatttgggctcttttttggttccatatgaactttaaagtagttttttccaattctgtgaagaaaggcattggtaggttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcctgtgatttttgcacattgattttgtatcctgagactttgctgaagttgcttatcagcttaaggagattttgggctgagacaatggggttctctagatatacaatcatgtcatctgcaaacagggacaatttgacttacttcctcttttcctaattgaatatcctttatttccttctcctgcctaattgccctggccagaacttccaacactatgttgaataggagtggtgagagagggcatccctgtcttgtcccagttttcaaagggaatgcttccagtttttgcccattcagtaggatattggctgtgggtttgtcatagatagctcttattattttgaaatatgtcccatcaagacctaatttattgagagtttttagcatgaaaggttgttgaattttgtcaaaggccttttctgcatctattgagataatcatgtggtttttgtctttggctctttttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattgttctaaaattctcttttttggttgtgtctctgcccggctttggtatcagaatgatgctggcctcataaaatgagttagggaggattccctctttttctattgattggaatagtttcagaaggaatggtaccagttcctccttttacctatggtagaatttggctgtgaatccatctggtcctggactctttttggttggtaagctattgattattgccacaatttgagatcctgttattggtctattcagagattcaacttcttcctggtttagtcttgggagagtgtatatgtcaaggaatttatccatttcttctagattttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagagttttttgtgtctctatttccttcacttctgctcggattttagttatttcttgccttctgctagcttttgaatgtgtttgctcttgcttttctagttcttttaattgtgatgttagggtgtcaattttgcatctttcctgctttctcttgtgggcatttagtgctataaatttccctctacacactgctttgaatgcatcccagagattctggtatgttgtgtctttgttcacagtggtttcaaagaacatctttatttctgccttcatttcattatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagtgctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttagggtagttagctcttcttgttgaattcatccctttaccattatgtaatggccttctttgtctcttttgatctttgttggtttaaagtctgttttatcagagactaagattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacatcttggcatgattttgcagcagctggtaccagttgttcctttccatgtttagcacttccttcaagagctcttttagggcaggcctggtggtgacaaaatctctcagcatttgcttgtctgtaaagtattttatttctccttcactcatgaagcttagtttggctggatatgaaattctgggttgaaaattcttttctttaagaatgttgaatattggcccccactctcttctggcttgtagggtttctgccgagagatccgctattagtctgatgggcttccctttgagggtaacgtgacctttctctctggctgcccttaacattttttccttcatttcaactttggtgaatctgacaattatgtgtcttggagttgctcttctcgaggagtatctttgtggcgttctctatatttcctgaatctgaacgttggcctgccttgctagactggggaaattctcctggataatatcctgcagagtgttttccaacttggttccattctccccatcactttcaggtacaccaatcagacgtagatttggtcttttcacatagtcccatatttcttggaggctttactcatttctttgtattcttttttctctaaactttccttctcgcttcatttcattcatttcttcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaacgtcctcccgtagctcagagtaatttgatcgtctgaagccttcttccctcagctcatcaaagtcattctccatccagctttgttccgttgctggtgaggagctgcattcctttggaggaggagaggcactctgatttttagtttccagtttttctgctctgttttttccccatctttgtggttttatctacttttggtctttgatgatggtgatgttcagatgggtttttggtgtggatgtcctttctgtttgttagttttccttctaacagacaggaccctcagctgcaggtctgttggagtaccctgccgtgtgaggtgtcagtgtgcccctgctggagggtgcctcccagttaggctgctcgggggtcaggggtcagggacccacttgaggaggcagtctgcccgttctcagatctccagctgtgtactggaagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttagagcttccgggctgctttgtttacctaagcaagcctgggcaatggcgggcgcccctcccccagcctcgctgccgccttgcagtttgatctcagactgctgtgctagcagtcagcgagactccgtgggcgtaggaccctctgagccaggtgcgagatataatctcgtggtgcgccgttttttaagccggttggaaaagtgcggtattcgggtgggagtgacccgattttccaggtgccgttcgtcacccctttctttgactaggaaagggaactccctgaccccttgcgcttcccaagtgaggcaatgcctcgccctgctttgggtcgcgtcggtgtgcgcacccactgacctgcgcccactgtctggcactccctagtgagatgaacccggtacctcagatggaaatgcagaaatcacccgtcttctgcgtcgctcaggctgggagctgtggaccggagctgttcctattcggccatcttggctcctcgcagttcattgtttgtggggttaattggaagcagctgcagcaggagtattcacaagaaaacaggacacacccacagccaagctataggaaggtcatcatcctagcatgtacaaggttttccaacttttcatatttctttctaattattaagtatcacaatagcaaaagagtagttaggaagtgctctaatctcacaaaggcctgtaccttgtgttttcctaccaattttgcatactcttcagcttgtagctgagaaaaagtaactttagaaacattttgagtccaggcgcagtggctcacacctgcaatcccagcactttgggaggctgaggcgggcagatcacgaggtcaggatttcaagactagcctggccaacatggggaatccacgtctctactaaaaatataaaaattatccaggcatggtggcgcgtgcctgtaatctccaggggctgagacaggagaatcgcttgaacccaggaggtggaggttgcagtgagccaagatcgtgcccttgcactcggcctgggcaacaagagcaaaactctgcctggaaaaaaaaaaaaaaaaaagagaaaaaacttgacaggcagagtctacacatctgctaatttaagtcatattagccaggctctggggaagaatgatctgattctaaaacatgtggtatctttgctttaatgacatatgctaagaaggtgaagatgagaggaaacagggtttctctgagttcagttgactctgttcctactgttagatgactgttaaaaacataggcattctaggtgacatcttccatcaggaatgtgaaattttcatcctaaccttttggagtaagaataaaagtttcaaagtagtcaaattccaatgacagttatttaatctaactttctaaagctgttcattgtcatcatttattttttactctttttactttgtatattttaaatgaaactattgttaaaacattttgctgttttatttccatgttaagaaaaggggaggatttgtgtgagtttatcaagcctatcattgataaactcttatggatcttatcaagtccataagattgtttgagatgcactcaaactatccatgtcaaaaagtaatacttgatttttttttttttaaagaaagcgtccctggatactggacagatggcgtttaccttggcccaacttgagtccttggagatttgcctgaaagaagcagaagaaaaggctaaagctttatctgaacaggtaacacctgtcatgggaactggaaacaaatgttcctcagtgtgcagcatggcaagtgtaaatgtaaacacacgttttaacctctccctctactgatacacacacacacacacacacatacacacacacacacacacattgcagtatgcccccccaccccacacacacacagcattccattcattttagacataacagtgcttactttagtctgtatggaccttttcagcgtttaaaacttttttcatctttatattttatttgactttcattcaccacaggccatgagttaggcaaaccttctttaactaagtgatcttcctgaataagcaaagcatatttgcattataaacagataagctcaaagataaaataaagcctattggagccatgcagaagtaattttcttttatttttaggaaactttacttggaagagagtttttcaaatattgacatccctcttgggtttttgaaacttacagaagcaaagcagcaggtgataagtggagcctggtctgccccaggtggcctggacacgttataggtgctttgcatgtacagcagctccatgatttcagagacagtggctgtgggtataagtaaagctcagaccagggctggaacatttcccaataagattatactttgcaaatagtgcagctattgttgcctttccccctggtcagagaggcttggccccaggggacaaactgcttggagtctcggtcccccagtgctctcttttggtgacagtcagtgaagggaaaaggatggaggaggccctgcaatgttagaaatgtttattaatttcttctggattgatacatttagataaaagtatattttagatacattggaaaaaaagaattttaaggtacttttaataaaggtagtctccctgtatagtgaaacctaattgcatcagaattttagcggaaactaaggaggaaaggtgcttgtgttatgagaaaaagtataattaatatataatttagtgatacacacacaaatgcccttcatttctttttcagcttaccaaaaaaggtgcatcccttactttggcatgtatttattgtttactgactaaatgcgattgatgcaagcggtcacagggggcttgtgtcaattaataaaaatgtgttgcccttttggaaaagtttccatctcagcctcaagccatagctctagcctgccaactgttgtttttttttttttctaaaataaacaaaaacaagcctcgaactgtggcaaaattaagaattaccaagaacgtaatgataaacataaggtaccatttcaaagcaaaaaaaaaaaaaactaagaatttcagagtctccaaattgggaaagatttttcaatggataactaaaaaagggcacccatgctgggattaggttacactaagaaggtatataggatttttttttttttggtaatcaaatggcttttaatgatttctcgtttgaatcagtaagattgaattcactcataaaagtacccattcctgcactttgggaggctgaggcgggtggatcacgaggtcaagagatcgagaccatcctggctaacatggcgaaagcccgtttctactaaaagtacaaaaaaattagcccagcgtagtgggtggcacctgtagtcccaggtactcgggaggctgaggcaggagaatggcgtgaacccgggaggcggagcttgcagtgagccgagattgcgccactgcactccagcctgggcgacagagccagactctgtctcaaagaaaaaaaaaaaaagtacacattatttttgttcttgatgaaatatttttatccaatgcaaatgtaaccacccaatcaatgggttcaccttgcccgctgcctagacagaatcgatttatcaagacaggggaattacaacggagaaagagtaaatcacagagccgcagagccggctgtgcaggagaccgggattttattattactcaaatcagtctccctaagcattcagggatcagagtttttaaagataattcgacggggaggggcccgggaagtggggagtgctggttggtcaggttggagatggaatcataggagctcgaagttaggttttcttaatgtcttctgttcctgggtgcgatggcagaactggttggggcagattaccatctgagtggtgtcagctgatccatcgagtgcaggatctgcaaaatatctgaagcactgatcttaagctttacaatagtgatgttatccccaggagcaatttggggaggttcagccacaggctgcatgaaccctaaattgtaatttctaatcttgcagctaatttggtagttctgcaagggcagattggaccccaggcaagaacagggtcttttcgggaaagggctgttatcaattttgtttcagagtcaaaccatgaactgaattccttcccaaagttagttcggcctatgcccaggaatgaacaaggacagcttaagggttagaagcaagatagagttggttaggtcttatttctctcactgtcataatttcctcagttataatttacaaaggtggtttcacaaatagctcctaatatttaagattcttagctggatgatctctttatataacaccaaacaattagatgtatttattttttcagtaatatagcagattaaatatataaaatggaaactggatttcacttaacttttttgtacctaccataagtaaggtgctggttaggtgttttgtgggaaagacatgtaagccagagcttctctacccaagtagctcacagagaatagaaaaattggaagacatggagaatgaaaataggtgtttatatgactccaagataaactgcacaatagcattaagttgcaggatctgtacatgttaattgtactaaaggatagttcttgaagttgccaaatttgcataaccaagtgagtttaattggaagttggccatagtttgaggaaagggagagtatgatgtgtaaaagcacattgcagccattttcaatattatatttttaattaacttgagcattttatgagatctggctgtcttcattgttactgttgagaggggtcaatcaacactgttgtcagaggatttaatcctgagatttttgctttctccaatgtttagtctcttccttgaaaacataaaaactttaagaacagtcctctgtcccctattttaaaatttaagtcaacattaaaaacatatggatgagaggatagggaaaggggagaaactgatatttcctaagaatgttcttgagaatatttcagaatagaacacctgtcacaaacaatcaaacatttgtccactgggtgccactgtcttccttaccaggccatgccactaagggattgcagtaagactgtctttagtgttaaagacaaggattacacacacacacacacacacacacacacacactctctctctctctctctctcaatctgtgtgtatgtgtgtgtgtgtgtgtgtgtttgaaggaatatttttgcctgctgtacacgttaaggctttttctaaatgtcattaatttaggatttgtcacaaggatgttgggaatgctagcttgcctttactggtaacccaaattatgggctagccgggtgaagtagaatgaggtggggagtgtggaagacacgacaagaaccaagatttgtgctggaatgaagcagtggaagcttgcaatattatcaaacaatggatcctgcctttgagaaaagggttaatctcactgttattcaagaccttatctgttagctttgcctctgagaacacagatttaactcagaatggaaagtataggtgcctagtgttgttacctgcattaatcatctgttggtcctgggcctaaatttgtgcaaactgggcatttctaaggtctccttcagcaaggtccactgttacaaagaaaaaaattagaaatagccaacaaataagaaggttgtggccacttcctccgatgaggtcacacagtcaacagaattctttgttgggcttcactttagcttacaattattctttatttctctgcagccaagtcactaatgtcaaaataaaagaaataatgggatcaggataacttgcaattaagacttataatctgggttagtcaaggctttgagaaataactgcaccaattcagccaaagtagagtgagaaagtgtcatttggctccaacttctaacctaggttataatgataaaccactcaacatattaccaagttttgcttaagaaaatactttattgtatttcccataggttaagatcaggtgggaggaaaactaaatgcctggatgttgggtaatagataaaaaaaagggtgaataaaagggagaaaagctgttaggaatgtgaaagaaagatgaaaagtaaaagcatttctagagaagcccataaaaaatagttttttcatgtgtgctggcttctatcaccagtgaatataagaggacaaggaaagggactctggtggactgctgtttatgaccatacacaagcaaatagaccatacagcttttgtgctgagacaaaagatagtgtcaagaaaacccatacttttgcaatgaagtctggatccagatgcatgccaacatagagcttatgaggtaacattccttttggcagcagtgttagcccagagtctctcccatttatcaatggcttctggttcccagctccaggtatcagatcagggagagcccaggctttgttcctgctccactatctgctagctttatggccttgggcaattcactttgtctccccagctacagttgtcttatctaggagggtgtaaacatgctagttacatagggctgttgtgaggctgttattaaatgggataggtatctgtccctctgtccctttgtggttattatggctgaatgtttctgtccccctgccaaaaagaaaaaaaccatatattgaaacctaatccacaatatgatagtatgtggtggtgggatctttggtggatgataagttcttgagggcactgcctcaggaatgggactagtgtccttataaaagagactcaagggatctccctcaccccttccaccatgtgaggacagagcaagaagctgccatctgtgaaccaggaagcagaccctcataagacaccagatctgttggtgccttgatcttggactgctcagcctctagaatttgaagaaagaaagaaattcccattgtttatatgctagccagtttatggtattttgttatagcagcccaaatgaactaagacagtaggttctcaaaaacatctgtttattttcactcctaccagtggtcatagcagaactgtgtagttctctttatgccttcagccacataaattaacgagttccaacctaccacaaaagtctttctttctcacacacacacactgccccgctcgctacccaagctcccttgtcataacttggctggcttttctactatccagttttctcttctactctttctcatctcttcatctggtaaagggattttagttctttaaccttgtctttcctttctgcttcatctcttggagcttctgtctgtttctgtccattatctgattttgtacagactgggagctgttttccttggcaagctggggcagggagggtgtcaggaggtgaatccagtaaggactatgtagtaagaattcatttcatatatcttctgggtaccatacctagcaaaatatagttacatatgagaaaactttttaaagttcatggaaaaatggaattaaacaataaaaataaaaattataaattttatttttcaacataagcttcatcaatttcaagacacttttgaagtgatgataccagccctttagtccaccttaaagaactgagggtcctggggatttaaccattttaatacagtggttttttttttttacatcattaactaaagaaaactgagtgctctttaaaggttttttaagactgggaaacaaaaataaggcagaagcagccaaatcagtactgtaaggaagatgcctaatgatttcccatggaaactcttgcaaagttgccctttttgatgagaggtctgggttagcatctggtactgaagcgagatgaggtaagtttcaaaactttacatttataacaagttcccatctcgctttagtaccagatgctaacccagatcttcaggctgaggttctttttcacccttgtcctgtgttctccaactgcatggctaacacggtgcaaccccatctctactaaaaaatacaaaaaattcgccgggcatggtggcaggctgagatcgcgccactgcactccagcctgggtgacagagcgagattctgtctcaaaaaaaaaaaaaaaaaaaaaaaggaaagttttaggaagattgaaaaataataatgctccaagagccccgtgttatagtttgcagagataatctcagcaagacagaaaaccaagtcttaagttagcagaagatggcaagagctgaactctaagatacccctccttgttggagtcgtatgatgagactcctggaatgtaagaggtggggataaattacccgtaatttgtatttgaagaaagaaaatattatgtgtatgttgtcagaatgaacaagaaagttaaaggaaattcaagaggaggcaaaaacgcaaaagaaacactccgttctgaaaaagacttgtatctattctgactggctccccaacatcctgctccccttcaagcccattctggcttattgcaagaacctaatttggggcatttgtggctttgcacgctgttcaaagtcaagatcaagccaggtttagtttctttgctgttttttctgtttgtttgtttttgttggtcagcactcatttgttcatttaacaattgtttattgaggattcactatatgccaggtactatatctagaagtgggaacacagcagtaaacaagattgataagacccctgactcatggagctgacattctactggaggacacagatagcaaacaaataaacattgaaaatacatggagcttcagatggtgttaaatactttgctgggccacactaaagggtatctgtgggactacgcttaaacttaaatcccactgggaagtctggttcctgagaataaccttgtgggcccttgtccttgagaagctggtgactgtagctctatgtgcatgtgtatgttggagtgtgtgtatgttggagtgtgtgtgttattcctgttgtttttgatatgaaacaataaaacctaaggccaaattattgctctaggttagatcaaggttcttggggctcaggttttctcttcaagatggcattttcaaagaaacgggaggattttaatagtttactttctcttgagagttttaactattttgctaatatttaccctaaattcttcaggtatatttatgtgtattgttataaagcttggactagaaacaaacaacgccccaccaaaaaaactaataagttatgtttgactctaatcagcaagaaattatgaatcattttatgcctaaggccctaacaaaactcccattatttctctcttagtacatcttagtgtccagtctatcttttctttatgtttaggaatagaaggaacaaagataccagcaaatttttgatactgaatttgtgtattgagtggctaaaagtaatctgatgcatactgagattatccaaaaaatgctctgtttttttttcattgtttatatgcaacagtggatcttttgatgtcaagtttatttgaaataaacaatgtgcccttggtaggagtattcatttctgcaaatgctcagaaattatgcttgacatgccaatctgaaatcatgagttttgtgaatgagtttttgttttcagaactattttgaagtgtactttaatgccataaaatcacaagcagtctgtttgacccaaaatgagttccttatcaacatgaagcccagttatcaggaacttcattaaacaatttggctagccagagttctgattgattttacagcagacaagttccctccttattaaaaaacaaaacaaaatccaacaacttctcatttaagcagatgttcatcttcatcttgttactgggttgttggcataaattggtagcctcagagaatgcaaggaaaaaaatagaagctggtgaagagatggtgttgttttgaatagagtcaaacacaatgacaaatcggcttctgtagtatattgttgttgcaggcgggatgtgtggattgttggcctgttacataactaaaaacttccttttgcttgtaaatgtcaagatcaaacagaggtcagttttaaatagctgaccggtgctaataaatgtgactttcttgtcttggaaaaagcaaaaagcctcatgccttaagagtcatggctctgctgttaggaggaggtgtctttgtgtatgggcttaacctgtattttgttcatgagattttctttgagatggtaaatgaactttccctttgcttattgtctacaaataaattagtaagttaggtatatgcttttgttcaattattcattcaataaatattaatcgagtttatactatgagctaggcattctgtttggtacttctgtgaattttagctatgtatttctccaaacagtcctggaaaattgtatatgccattttgcaaatgatgaaagctcttttgtgggtttgcagccctcttgtctgctccttctatagactctccttggtgatctgactttagcatacacaatctgctgaaaagccttaagtcctcactactagtccaggtcttccctgacttcagacctaattatgtatactgaacagctccaccaaggttctcacagacaactcaagctctccatctccatctccaaaattcaacttacctgcttcttgccccaaacctgttccttctcccacattccctaggccagtgatcagtgccaccagccacactgtgctgctttgattctttccttttcctcatgcctcatatgcaatcaattgctgagtactacaggtgatgactcccaaatcactcttgaatccatctttttttctctatctccactatcaccatttttgtccaggctaccttctgcagtgcctctcctgactttaccttcattatggcccttgtttaatgactcctcaacactacaccagaatgaaggttctataacaaagatctcatatttctcaactttaaatcttaaattagcctgatttcactgtcagggtcaaatctgtcctctaacagatcttacaatgccatttatgatccgaccacctgcttgtttctccagctttaccttacaccactccctgtataccactattacaccactttcagttctttaaaggtatcatatcctctctcacctttctaatctagaaaaaacaaaggcctcatttcttagagtcaaattatcattaatacacccctttccctctgcttctgcctagaatttctctgctaactttctctacttcctcttatcgccttactcattatccaaagaaccccaagagacttcttttcagatcctcagttagatgccattccctccaaaatgcacttcttcttccttcaagtttgggttagatgtccttaggtgctttcataatctctctcccacctcccgccgataataattgcttgtctgtgtctcccactataccatataacacatggaagaagctcagacagtaactcctctgaggtcctaagccaaattagaattcattacttgtcccttttctgtcaaagcccatgttttttccattatacatttggagttgacccctacacaaggagggccattgaaggaggcacattctgatctgtgctcaagagagaaaacagtgagggactgagaaggacagatttgagagaccaaagccaggcatatcaatgtgtaggctcttataaaaatccagtttggaaatgataaaggcctaaattattggtggagagaagacagagacaagatatatttatgagttggatttggtgattaattaaatgtagaagttgaagggaaagtaggattcaagacagatcccaagtttcaggtgactacgtaacctgtggttacccaactatcttatgttagaatcattagatgttaaaaatgattcatttcttatggacaactccatgcaggctcaatttaccacttacgctatagattcttcatccaagttttggatgattttaatctccttttttagatcttctgaatcttgcaatccttggatattatgtcagatcctttaactctggggtgtctaatcttttggcttctcttggccacattagaagaagaagaattgtcttggggcacttgtaaaatacattaacactaagaatagctgatgagctaaaaaaaaaaaattcacaaaaaacctcatactgttttaagaaagtttaccaatgtgtattgggccacattccatgccatcctgggccacatgtggcccacgggctgcaggttggacagcttattttaagccatttcctggaaataggttttcttctatttttcagtccctggagcttcagggagaaaattttggaagaccatgtgttttgtgtatgaagatctcatttattagcctcagaaagtgtttaatgttgaagtctggagttacaccaatgcaaatctcttgaggttattgaatgagtgtatagtgacatgcagtggtctagtacagaggtcttcaaaattttgtccagcaggtcccttggaggttcctagcactcttaaatgatctttaaagttaaaagatttggataatagttaaaattatttggataataatactaataggttattattcttttctactatcattcttttatgggtggaggagagtcttccagattctacatggcagaatgtatgcagaagcagatatgaaagtcccaatgtcctttattaaaccagacattaaggaaatatgcaaaatgtaaaacaataccacttttttactgtttcatttttgtttagttttgaaagagttatttttaattaaaatatatttttgtgttaggatatactgagtttatttttaaacaaattaataaaagcacttttaaatttctaagttttactttctgatacaataaatatcagtagatatagcccacattaacaaaaactttttaaagtccccagtaatttttagaggtgtaaaaacgtcctgagcatcaaaagtttacaaactgctgatttatgactctgtagagtgtaattcaaggagcacagcctgtttgggaatatgaatcatgttggaaaccaccattacataaaatagatagtaaattaacataattttattaataaacaaaatagtaaatgctaaacagacttccaaagaggggagcctcatcagtggctggtaattgtaacatttggtcactctatcactgaacagaaaatgtccttcaattagtaggaggatatcaatgaaatgaacatgttccttattcatatttccaaagaccgtgaatgaaaaaggagttgtccatattatggagactcttcgttttcttcctgatccccagtatttgtgcgtctaagctccctgagtctgtttggtttttccctgctcactgaaattcttcctccactgcctgttgtcagcttcttaagcctattttcacaatatgccctatgttaacccatcccactcacttatgccctacgttgacactgcatttctgattctgacgggatgattttaaatttatagcacacccaggcagataaatgcctttttcagaatggtttaagggaggaaagggtaaaggcttctctctggttttgcctaagatggagagcagtcttggtgtcagtggtctgagtctgatctgctcagtcaaggaaaaatacctccagggagtgttctttaacatggtgaacagcagagaggcatttgctgagaatgactgattacacagagtataatatgcaggcaaatataggaaaaaaaagttctagagaggacatataatgggttatgaaatcaatcaatcaaattcaatttcctccctaaggaactggtaaacaaaacaaaacaaaaacctgttacctaatataaataagggagcagttctaaccatttctagattttaatttcaggccatgggacttctgtggattctattctattcttgtcctaccccatccaagatgtctacttcttacttcaaagtccattattatctgtgtatgtactcacgtcctgtgtaaaaaaaaaaaaaaaaaaaaaaaaaagtacgaactctaaagtttcacttactcgaactacctcaaatatgttgtctcaggttgtttcccttagtaacacaatggactgctgcttcatcctgccactttgagtgtgtggtgtccttgtccacccccacttcccatctctattcctctgttctcatcttgagtattctgtgttttctttggaacccacacactctctaaagaagcagtaagctgaattaggattccattctggtgggaacaatcacttcctgctttaaaattcatctgggaacagttgccttcctcattcagagtaggggactctgtatttcctaacctcaaggactttccctgaagttgcctaatttttgtttccaaaagcctaaacccatcaaagagactaataaggccttgagagaaagggagactcctgagacagactcaaagatagcagagtgccttttccccaaactggaaagtagagagtcagctcactgagtcacaccagcatgggaagcctgtaccctgttccatgaaaatgctctgagaatgtgccagttagagggagtgttgtatcctaggaatgtgtcccaggcccctgtgaaatgtcagctaccctgtaggatctaggattccacacaagggtttctggtgggacgagaaagggcattgccagtgccctgaagatatatagggttcccagatgggtaaactaccgtggggagagatcttcgagaacggttgtgtaactacaggtgaggacttaacgttgaaataagatttatagaaagtaaaaaatgtgctattttttgtacacttggatttgtggattgagagctgtctgctttgcagtagctctatttctgtgtaattactttatgtccaatctcatgttgactttaatttcttagaacccaatattattgctttttgacctttacctttaatgattgccctttatatccgagtcaatgattgatcacctcatctttcccatgtcttttcatttctctctggtattctttatctattcttaaggcctagagaacttttttgaagattaaaggaaacttaggaatctctttgcctgcatccctaactttatatttcaattattgattggcctgttggtaaatatttctattttcacttggagtttaaatgagcctttgttaaggcttattaaatgatcctttattaaggataattttccccaaaataacgtgagggtgttatggattaaatcgtatgtcagccccgcaattaatttgttgaagttctaactcccagtaccctagaacatgactttatcttttaaaagggtcattgcacatgtaagtagtaaagataaggtcggcagggtgtggtggctcactcctgtaatcccagcactttgggaggccgaggtgggcggatcacgaggtcaggagtttgagaccagcctggccaacatggtgaaaccctgtctctactaaaaatacaaaaattatccaggcgtggtggcacgtgcctgtaatcccagctactcaggaggctgaggcaggagaatcgcttgaactcaggaggcagaggttgcaatgagccaagatcccaccactgcactccagcctgggtgacagagagagactccatctcaaaaaataaaaaagtaaaaaaaaaataaggtcatactggagtaggatgggcccctaatctaatctgattggtgtccttataaaaaatgaaaatttggtcacactcatatagggagaaagccatgtgaacctgaaagcagagaccagagtgatgcttctgcaagcaaatgaatgccagagattgccagcaaaccgttagaagctaggagaggggctggaatagattctccctcacagccctcagagggagccatccctgctgacactttgatctcagaattgcagcctctggaactgtgagataataaatttttgttgtttaagccacccagtttgtggtactcttttatggcagccatagcagacaaatacaagagattattatgcttctaagtagacccttggaggtctattttatgtgcgtaaacctagaaatgactacaaaagctattaaagccaaaacgtattaataaacataaaagtctcttctgtctagaatggggttaagataaagattttgttgtttgtttaactcctaaaattgaaatgagactaaacccgttctgtgagctaaatctacattcagatatagggcttcctgcccattccacaggtaggacaggtaatttttaaagtgcttgccaatgttatttactgccaggaaatttcctaatttgtgttactaatccagttcagcttgcaaagcatttagcacaagagaacgctttgtttttaaattaagtccctcctttctctgtagcatgagctctacaaggtctggcaagacttaatttgtttttcagtggtttttgagtgacagtggagaactattctgcaatattaattaccgcatgtaaatgtgtgggttgtggaggagaaaattttggagaacagacaataagaagagataaataggaaattcacattacttaatggagtggttttaataattgcaccaagtgatggattgggtgaatggtgagaaaaagagaagtcttttatctttgtggcttaaacgtatgaatggatggtgccatgtattgaaagaaggaagtccggggaaggaacagattgtgaggaattcattttgaacacattaattctgatttgcctggtatacattcaaatgacaatatcaaataggttgttggattttgtgtgtatgtgtgtgtgtgtgtgtgtgtgtgtgtctgaagctgagtggttgtacatttgaaaactgggagtcatcaatatgtgattggcatttaaactgtggtacctaatgagattacttagagaaagagtatagataaagcagagaggagtgcccagaaacaaatcctcagatctcaatatgtagatttgaagaagaggaaaatccagccaatgaaactgagaatctgaaagaaatccagagaattctgtcctagaaacagaaaggggagagtgtttcaaggggcatgaggtgctcaaatgtgtaatattttattgtgaggttgaataaggtgcccagaaaattgtatatggcatttggtaaaatgaggatcagaggaaaccttgacaagttccatttcaataacgtagtcgagggcagaagccagattagaagagtggttgggagaggaatgtaatttaggctgctggcagccctcttcccagttactggaaatttttttccatagtgagagaaagatatagagatagagataaaaacggaaagagggagggaggaagagagagagattgagagagaatgggcaaagagccaatggtagagtgagagatttctaaaactctaatttgagattcaggttctagggatgcctctacttcccagttaaatgaaccaatttattttttattttgtttagagactggaccccactcttttgcccaggctagagtgcagtggcatgatcatagctcagtgtagccttgaatgcctgggttcaaatgaccctcccacctcagcctcccaggtagctgacattacaggtgcaagccaccaaacctagctcagttatctttttaacctaaacatatttgcactgagtttctataatataactgcagtgaccttgacaaatagataaattggtgacatacctgaaactggaatttagtacaatccccccaaaggaattctctgtacctcttttcttggctatggccatggaagtaaaggacaaagaaagctctcagaggtcagaaacagtcaaattgttcagctacctccactcactgcactgccaggacagtgaggcctttctatctcttgactaatagaatgtgcaaatagaatttgtgatggctggtgacaactgtaagtgatttccccttgctcctgattgtcctgtttttctgtatattgggcatattagggatggtacattatttaattttagatgctatatcatgacaattttcatctggatctgatccaggagcgaatgcacatagtttggagatctgaatgtagagctaaaggcagtaacgatataattttggcttgtttccttttgagagggagtgaatgcattattggattaacatagaatagatgcattatattatgcaggaacattttaggaaatgcatattatgtataggtataagggtttaattgtgctgaacacccacggggcaagggtggactataattggcttccgtttttatgcctgctttatttggagaatggctcctttctcactccaatcttttaataattctatggctgtaaatcacagtattcctggctagagggaatgacttttgagcacaatatctaggttctttcaattatattatctcattttcttgaccataaaaattgattcaggacaggttatatgatctaatagagtcttttttcaatttctactggaagatgaagtgccttactactaaggccatgaaactggaagtctataggtgccatttttcctactgtgtgaagatagcttgtctgcactgggaaataacaaggcaaacacataggagcagcactaagaattggaggtaggaagagacagaatactatgaccttgtttgagtttgtggaatctagtttatgtgaaacagtacctatttctgactccttacttatataagccaataatttttatgtgcctttttaaaagagttcaattacaaaaaatgacaacagtatgaggtgattgttttacgaagttttggaaaagaagcaaaagtatgggatgataatggagagggaggcaatggagagttcagtggacacctttcattcatggaaatgtctatgtcatgtttatatgctgaatggaatctttcagaaagagtaaactagaaaatgcagaagtggattggggggtagggtacagaaattacaggagcaaaggctttgtgacaggtaggcgtgataggagtcaaagccaagtgcagtggctggcctttgataagcagaagaatatcatctctatttgttcagtaagaatgctttcctcttcaaataacagaatcccaattaaagtaatgtaataatgttgcaggacttttccttagttcagctaaagatagggtccttgtccaatgaccagcaaggtttaggctcacaggtttgaagggtgaatacagcagggttttattgattgaaaaggaaaaaaaggggaagcagggattctccacgaggccagagttcctgttggtgtggttcccgccttgcgtttgaatcccaggttccacacaggaagaggagaggcaagctcctgcctgctgcaaatggtgtgaactgtgtggcttggcctcagtgcgcatttcttccactgcacaggccagttgaagttttgccaggcaccccttcctacctggctgtttcaataatgccagctatcatcttatataacaatatgtctataggtgggccagtttcacagttggttaattcagtggttcaagaatgtcaccaacggccaggtgcagtggctcacacctgtaatcccagcacttcaggaggccaaggcaggtagatcacttgagatcaggagttcaagaccagcctgacctacatggtgaaatcccatctctactaaaaatacagcattagccaggcgtggtggcgtgcactgtaatcccagctactctggaggctggagcaggagaatcacttgaacctgtgttgggggggtgcggacgttgaggtgagccaagatcacaccactgcattttagcctgggtgacagagtgagactctgtcacaaaaaaaaaaaaaaaaagtcaccaagatcctttgctctaccctcctttgctccaccctctctgtttgttggttgtgtcatacttgcaagatattggcagtaattccaagcaataagcagtcaaaactacatcctgataaaaagagatgtgcttcttcctgtgcatctttttaaaaatctggtaaaaatcctcctcaagctccagggacctctatatattgcatacccgtgtcagaaatgatctcttatactggaaatgaaacaaacatgactgatttagttcaatcatgattcatgtctcagggctggacaaggccaagctctcctgaacacatggatgctagctaatccaagttgggttttagttagcaagagataaagggggaaaaagactcatgggaaatagatgatcagtatctgctacagttaaggtttatagattaactggtgggaaggtgagggaatagctatctggcagcttctgtttttttcagggacttactgaggttgtcatttgggatgggtagaatttttgaagagaggggaagtatgaaatgatatttgaggagaaagttgagggaaataaatagctacctcacagaagagaaaagtcagtttactaggagaaaaatatagtgctatttttatttcagggtattgtggagtacccacctgaggtttgtatttattaatttaaaatgaaaccagtgaatccaattttgtgatgttttttctggtaacattcaatgagtggatgtaatgctaacaattttctaaacctaagaaaatcatttattttctatttttaatggaggtaaaattcacagaacttagaattcatcattttgaaatatacaattctgtcacatttagtgcattcccaatattgtgcaaccaactctttcaagtttcagtgctttttcatcaccccagaagaacactttatgcccattaagtaattactcctcatatcctcttcctctcatcccttgacaatcactaatctgttttctgcctttatggatttatttattctggatatttcagatgaaaggatttatctaatatgaccttttgtatctggctttttgcacttaacaaaatgtttttgaagtttatccaagctacagcaagtataagtactttattcctttttatgcctgaataatattccattgtgtgtacataatgcaatttgtttatccactcatctgttgatggacatttggtttccaacttttagctattatgaataaatatttgtatgccatattttgtgggtgtaagtgttcatttctttttggtatatatgtacaagtagaattgctggatcacatggtaattctaggattaactttttgatcggtcaccaattattttccacattgcctgtaacatattacattcttaccagcaatgtacaagggctattatttctccatatcctcagcaacaccttttattttccatttgaaaaattatagtcataatagtaggtatgaagtagaatctcgctgtggttttgatttgtactaccttaacgactaatgatgttgaacatcttttcatgtgcttcttggccatttgtgtgtcttctttagagaaatgtctactcaagtcctttgcccagttttcaattgggtggtttgtctttttgttgccgaattgtaagttctttatatattctgcatactaaacctttatcatatatgatttgcaaatattttctcacatctcgtaagttgtcttttcattttcttgattatattctttgctacacaagttctcaattttggccaagtcaaatttaactatttttaacattttttgtgtgtttttgctgtcaaagaacccattgcttaattcaagatcatgaagatttaccccagtgttttctgttaacagatttacagtttgtgcttacatatttaggtcgttgatctagtttaacatcatttttgtttatgaagtaacataggggtccaacttcaagttctaacatgttggttatccatttgtgccagcaccatttgttgaagatcctcttctttgcctattaaactgtcttggcaccattgtcaaacatcaattagccatagatttttgggttgatttcggaactctcagttctatttcagtggtctatgtgtcagtccttattccattcagatactatttggattactgtagctttgtagtaagttttgaaattgggaagtgtgagtcttccaacttttcttcttttacaagataccataggctgttctggatcctttgagatttcatatgaattttgaggactgactctcttattctgaaaaaaagaagccatcataattttaatagagattgcattaaatctgtaggttgctttgaggcatattgccatcttcataatattaagacttttaatccatgaacatgagacatctttccatgtatttagtttttctttaatttctttctataacattttgagtttgcattgtaccagtgtttcccttccttggttaaatttattcctaagtagtttattcttctggatcaattgtgaatggaagtattttatttccttttcagattgctcatttctggttgtataaatcatgcctttttttccctgtatttctgatactttgacatctgaggccttggtgaccctggttacactacccctccctcccagggctagccaattcctagaaatagcaaataacttgcctgggagcattcctttcatatggaaagtaaacagtccaaagcccacacccccattacctcctctattgggttctcaagctcagggccacagttcttctgccctaatcaccccaagttctggtaccacacaactagggataagcccctatgttccagagtttgctgaaatttttcaaactagccaatccaatgcttgcctatcttgacttattcatcccttcttaaggaaaccacaacaagggctcttgcccatgttttccccttgctccctctgcctcctgaccaactccagtgcttttctgtgtgccccctgtggtgtagcatgctacctcctcttgggaactgagtgacagactaccttttcagtggcaatcatctcctgatttcttagcgtcatcacacctgaataataataaagcctacactttaaaacactggtgtatagaaacataaactgacttttgtgtgtttatctttgatgtggtttggctgtgtccccacccaaatctcatcttgatttgtagctcccataattcccacatgttgtgggagggacctggtgggagataattgaattatgagggcggttcccccatactgtccttatggcagtgaataaatctcacaagatctgatggttttataaatgggaatttccctgcacaagctctctttttgctggctgccatgtaagatgtccctttgctcttccttcatcttctgccacgattgtgaggcctccccagccatgtggaattgtgagtccatgaaacctcttttcttcataaattacccagtctggggtatgtctttattagcagcatgagtacagactaatacagtaaattgctaccattagtgacttgctgctgtgaagatacccaaaagtttaaaagctactttggaactgggtaatgggcagaggttggaaaagtttggagggctgagaagaagataggaaaatgtgagaaagtttagaacttcctagagacttgttgaatggctttgacaaaaatgctaacaattatatctaggctgaggtggtctcagatggagatgagaaacttgctgggaacttaagcaaagattgctctttttatgctttagcaaagagactggtggcattttgcccctgccctagagacttttggtactttgaacttgagagaaataatttagggtatctagcagaagaaatttctaagcggcaaagtgttaaagaggtggcttgggtgctgttgttaaaagcattcagttttataaggaaagcagagcataaaagttcagaaaatttgcagcctgacaatgcgacagaaaagaaaaacccattttctgagaagaaattcaatcaggctgtagaaatttgcataagtaatgaggagccaaatgttaatcatcaagatgttggagaaaatgtctccagggcatatccaaggtcttcacagcagacccttccatcacacgcatggaggcctgggaggaaaaaatggtttcatggactgggcccatggtccctctgctgtatgcagtatagggacttggtgccctgcattccagccactccagtcatggctaaaaggggccaaggtacagttcaggctgtggcttcagagggtgcaagctccaagccttggcagcttccacatggtgttgagcctgcgcgtgcagagaagtcaagaattgaggtttggaaacttccgcctaggtttcagaggatgtatggaaatgcctggatgtccaggaagaagtttgctgcaggggcagtgccctcatggagaacctctgctaggacagcacagaaggaaaatgtggggtgggagcccccacacagagtcttcactggggcactgcctagtggaactgtgagaagagggccactgtcctccagatccctgagtggtagatccactgacagcttacatcctgtgcctggaaaagccacaaacactcaatgccagcctataaaagcagccatgagggaggctgtatcctgcaaagccacagcggcaaagctacccaagaccatgggagcccacctctttcattagcatgacctggatgtgagacatggattcaaaggggatcattttggagctttaagatttgattgccctgctggatttcagatctgcctgggacttttagcccttctggttgggccaatttctcccatttggaatgggtgtatttatcgaatgcttgtacaccccttgtatctaggaagtaactaacttgcttttgattttacaggctcataggcaagagagactttccttgtctcagatgagactttggactgtggacttttgagttaatgctgaaatgagttaagacttttggggactgttgggaaggcacgattggttttggaatgtgaggacatgagatgtgggaagatccaggggtggaatgatatggtttgactgtgtccccacccaaatctcatcttgaattgtaactcctgtaagtcccacatgttgtgggaggaagccagtggaagataattgaagcataagggccattcccccatactgttcttgtgatagagaataagtcacaagagatctgatggctttataaataagagttctcttgcacaagctctctttttgccagctgccatgtaagacattcctttgctctttcttcatcttctgccatgattatgaggcctctccagccacgtggaactgtgagtacatgaaacctcctttttttttttttacaaattatccagtctcaggtatgtctttattagcagcaggaaaacagactaataaaatcttatactctgcaactttaccaaattcatttattagcttgtgtgtgtgtgtgtgtgtgttgtttggaatttttcttaaaatagaattatgtcattttcaaatacagataggtgaacttctttgtttccaatgtggatgtcttatttgttcatatcatagctctagctaggactttcagtacaaggttgagtaacagtggtgaaagtagacatccttgtcttgttcctgatcttaccagaaaagctttctgtcttccaccattgagtacaatgctagctgtggaatgttcataaatgtcttttatcatgttgaggaagtttccttttcttttcctactttgatgaatatttttatcatggaagagtgttggattttgtcaatttttttgcatctgaattgaccatgtagtatttttcctctattctatcaatgtgatctattgcctcaatccatttttagatattgaaccactcttgtacatctgagattaatcccacttggtcatggagtgtaatatttttactgtgctgttggatccagtttgctagtattgtgttgaggatttctgtatctatattcataaaggatattaggctatagttttcctgtactattttgtctgactttagtattagggtaacatattaggaagaatttccttatcttctgtattttggaggggcttgagtaatattagtgtcagtgttaatcctttttgaaatgtgtaatataccagtgaaaccaactggctctgggcttttctttgttgggagttttgtttcttttcttttcttttcttttttttaaaatggattcaatctctttaattgttgtaggtcaattgacattttctatttcttcttgagtcagttttagtaattcatggtttctaggaatttattcagttcatctaaattatctagtttgttggcactcatttgttcatactagtatcttataatccttttatttctgtaaagttggaagtattgtttccactttcatttctgattctagttatttacatcttatgtctgtttttcttagcaacatagctaaatatttatcaactttgttgattatttcaaggaaccaatatttggttttattgattatctctgtttttttattctctagcttgtcatctctgctttaacctttattatatccttccttttgttggcttgttgatgtgacatctttttcattttgtaatgtaggcattttcagctataaactttcctctgcatcacataagtttttttctatatatatagatacattttatatgtgcatatataaacaaataaacatatatgaggatctatgtaaaaatttttttttgagatggagtcttgctctgtcacccaggctggagtgcagtggtgtgatctcggctcactgcaagctctgcctcccaggtttatgccattcttctgcctcagcctcccaagtagctgggactacaggtgcccgccaccacgcctggctaatttattgtatttttagtagagacggggtttcactgtgttagccgggacagtctcgatctcctgaccctgtgatccacccgcctcagcctcccaaagtgctgggattacaggcatgagccactgcgcctagcctggatctatgtaaaattacataccatcacccaatgcagaacccatgcattaaataagtaagttgtcatcaacctgagactgatgttcaagtagtaacttcttttttcttctcaatctcctttgttctttttttaaaaaatgtttttatttttccataggttattgggggtacagatggtgtttggttacatgagtaagttctttagtggtgatttttgagattttggtgcacccatcactcgagcagtatacactgcaccctatttgtaatcttttatccctcacccccctcccaccctttcccctaagtcgccaaagtccactgtattattcttatacttttgcatcctcatagcttagctcccatgtatcagtgagaacatatgacatttggttttccatttctgagttattcacttagaataatagcctccaatctcatccaggttgctgcaaatgccattaattcattcctttttatggctgagtagtattccatcatatatatctatatttatctatatatacatacacacacatatatatacacacacacatatatacgtatacgcacacacatatatatatatatcacagtttctttatccactcattgattgatgagcatttgggttggttccacaattttgcaattgtgaattgtgctgctataaacaagcatgtccaagtatctttttcgtacaacgacttattttcctctgggtaaatatccagtagtggggtttctggatcaaatggtagaactaaaaagttctacttttagttatttaaagaatcttcacactgttttccatagtggttgtactaatttacattctcaccagcagtgtagaagtgttccctgatcactgcatccatgccaacatctactgtttttttattttttgattatggcaattcttgcaggagtaggatgatgttgcattgtggttttgatttgcattttcctgatcattagtgatgttgagcattttttcatatatttgttggccatttgtatatctcattttcagaatcgtctattcatgtctgtagcccactttttgatgggactgcttgtttttttcttgctgatttgtttgagtttgttgtagattctagatattagtcctttgtcagatgtatagattgtgaagattttctcccactctgtggattgcctgcttactttgctgactgttccttttgccatgcaaaagctctttagtttaattaagtcccagctatttatctttgtttttattgcatttgcttttgggttcttggtcatgaaatccttgcctaggctaatgtctagaagggtttttccaatgttatcttttaaaatttttatagtttcaggaaagcacataagatttaaatccttaatccatcttgagttgatttttgtataaggtaagagatgaagatctagtttcgttctcctacatgtggctagccatttatcccagcaccatttgttaaaaagggtgtcctttccctactttatgtttttgtttgctttgtcaaagatcagttggctgtaagcatttgggtttttttctggactctctattctgttccattggtctatgtgcctatttttatactagtaccatgctattttggtgactatggccttatagtatagtttgaaattaggtaatgtgaagcctccaaatttgttctttttgtttagtcttattttggatatgcaggatcttccttggttctacatgaactttagaattgttttttctaattctgtgaagaatgatggtggtattttgatgggaattgtgttgaatttgtagattgcttttggcaatatggtcattttcacaatattgattctacccatccatgagcatgggatgtgtttccatttttttgtgttgtctatgatttctttcagcagtgttttgtagttttccttgtgcacgtctttcacctccttggttatgtatattcctaagtattccttttttttttttttttgcagctatggtaaaaggggttgagttcgtgatttgattctccacttggttgctgttggtgtatagaagagctactgatttgtgtacactaattttgtatccaggagctttgctgaatgcttttatcaattgtaggagctttctggaggtgtctttagggttttcaaggtaaacaatcatgtcatcagccaacagtgacagtttgactcctctttactgatttagatgccctttatttctttcttttgtctgattgccctggctaggacttccagtactatgctgaagaggagtggtgagaatgggcatccttatctagttccagttctcagagaatatgctttcaacttttcaccatttagtattatgttggctgtgggtttgtcatcttttattacattgaggtgtatcccttgtatgctgattttgctgagagttttaataataaatggattttgtcaaatggtttttatgcatttattgagataatcatgtgatttttgtttttaattctgtttttgtggtgcatcacatttactgatttgcatatgttaaatcatccctggtatgaaatccacttgatcatggtggattatctttttgatatggtgttggatttggttaactagtattttgttaaggattttagcatctatgttcatcagggatatcggtctgtagtttccttttttggatatgtcctttcctggttttggtattagggtgatgttggcatcataggatgacttagggagggtttcctctttctctatcttgttggaatagcgtcaataggatttgtaccaattctttgagtgtctggtaaaattctgctgtaaattcatctggtcctggacttttttttttgttggtaattttaaaatttccatttcaatcttgctgcttgttattggtctgtttagggtatctaattcttcctgatttaagctaggaaggttgtatctttccaggaattcatccatgtcatctaggttttttagtctgtatgtaaagatgtacacaatagccttgaatgatcttttgtatttctgcggtgtcagctgtaatatctcccatttcatttcttattgaggttttttggattttctcttttcttggttaatcttgctaacgatgtatcaattttatttatcttttcaaagaaccagcttttggttaatttctcttttgtattttttgtttgtttcaatttcatttagttctgctctgatctttgttatttcctttcttctgctgggtttgggtttaatttgttcttgttccactagttccttgaggtgtgaccatagattgtcagtttgtgctctgtcagtctttttgatgcagagttttagggctatgaactttcctcctagcatcgcctttgctgtatcttagaggtggggttttttttttttttttaagacggagtttcactctgtcacccaggctggagttcagtggcacgatcttggctcactgcaacctctgcctcctgggttcaagtgattcttctgcctcagcctcctgagtagctggaactacaggcacgtgccaccatgacctgctaatttttgtatttttagtaaagaccatgtttcaccatcttggcaaggatggtctcgaactcctgaccttgtgatccaccctcctcggcctcccaaagtgctgggattacaggcatgagccactgcacccagcatcccagaggttttgataggttgtgtcactattgttgttcactttgaagaattgtttaaatttgcatcttgatttcatttttgatccagtgatcactcaggatcagattatttaatttccatgtatttgcatgattttgaaggtttcttttggagttgattttcagttttattccactgtggtctgagagagtgcttaatatgatttcaatttccttaaatttattaaggctcattttgtggcctattatatggtctatcttggagaaagttccatgagctgttgaatagaatgtgtattctgtggtcgttgggtggaattttgtatatgtatctgttaagtctatttgttccaaggtatagcttaaatccattgtttgttgttgttgttgttgttgactttctgtcttgatgacctgtctagtgctgtcagtggagtattgaagtcccctactactattgtattgctgtctatctcatttcttaggtctataagtaattgttttacaaatttgggagctccagtgttaggtgcatatatatttaggattgtgatactttcctgttggacaaggccttttaccatcatataatgtccctctttgtattttttaactgctgttgctttaaagttcattttgtctcatataagaatagctactcctgctcatttttggtgtccattcatatgaaatacctttttccacccctttaccttaagtttatgagagtccttatgtgttaggagagtctcttgaaggcagaagatggttggtgaatacttatccattctgttgttctgtatcttttaagtggagcaatatggccatttacattcaatgttagtattgagatgtgaggcaccattcaattagaaatcctttaattttctttattttcacacattaaaaatgaaacacactaaaaaaatggttttcatagcagattacacatgggtccattcagacttgctctcaaagtgctgccaatatgacaagtgctgccaatacaacagctgctaattggagagcccatgtcttgatttaaatgcagtagcatgcagccttcagtgtgggaggttcggtcttctctgttcttaaattagggtaaatggcattggtgtccatatttacagacatgaaatgtatctatcctgagcagttccaatgtaaatctgagaccagctgatgggagtcttggtctcagctttaaaaagggaggtacaatggtggcaggctggctgctgtaaacttgagttgtttacattctttccaacatgaactatttgctgtgggacacacagtcagacccttcctggagggttaagccaagtaactgtaggtgtgcttttcaccatcaacttgctccaaatattctttctcaattagaatgtcaatgcatttcttgatcagggacccgggatttgaacctggaggatagctgagtgagggcctcatcaactaactgctggtgtttcaaaaccttcctcatcttcatgattctcatgatggccatctgaatcagtagtttgcagtcttcctcaatatttttgtttgtgttttcttgttcctgcttctgttcagtttcatgggcacattgatgttaacccttaatttctaatttttataaccaagatgtaattttattaaggtatctgtcttcaattccacctcatcagcatttacattttcatcttccaagaccaataacttcaactttaataaaatctgtaggacttatgccaaaatgtccattttaatttgagtgcaatcagtcagctgctgtacagtgtaggcatcttctgtgttgtactgaagcaggattgccgtctggaatgtggatgcctgcaaagtatatctgtttgtaaagcagttagttaccaattctcctttagacaactgatataaccatgtcaattttcagccactgtgacagctggcatagaaagctgtgaattgccgataactacattccaaccctaggggaaggcaaacatacaagactgcttaaagggccaggacccagagctcagcacctgaatgctgaaatcccagtctaggggttctgaatttgtcaggtgatttttgaattgctcattcagatctttgctcacaccagtgtcttgaaacatccactgaagtttagaggtatactcaaaaccacaagcttgctttaacttagagaacatgctggcttcagcattgtcactcactgccttcccttagagttggaacgtagttatcggcaattcacagctttctatgccagccatcacagtggctgaaaattgacatggttactggcatcatcatttgcatcatcactgttctggtagatgagcctcttggccagcatttttgcatagaacttctgaaacacatctttgtcctctatgtacttgaagacaaccattatatgattgagtgtatcttctagttctgcctcatctgtgttcttggaacttttcttcaagaacgagtcatagtattgagccaatgactcatgggagttactggataaataggccatcttggtaaccgcattgttgtttatgaagcaaccacaaccttgtcaagagcagccacaaagccagtgtcattgttaaatgcagacattaccaaggcaatgcattttttatgaaggtcaagcaccttctgtacatacattttggggtcatttaaagcagcttctccacatttttcaatagctaaaagaccctgattatgaatctgtgtctccagcagttttttcaattctcctaggtcattctggattctagatacaagattatacatgtgtcccaaatcttcatttttgtcagcatccaataaattctgaagttctgtgtggaaaatttccaagtgtttttcaatgaggactttctcacatttccttgctaattcatcttgtgtgccttcatgaaggtaaacctgaactcttcattgttcctgaagcacacaagcctctgccttattcatatattcagtaactgggttctgctgcaagaattcagtactctctgtgacataaaatctctctgtgacagaaaaaaaaaagagagagattcaaaggattctttatacactgttaatgtagggccctttgcaaatgcatcatcttccttcagctccaattccatgtaacactgtacaactccactcacagttttgtattgatggtttcaccatttccttcctttttgatcagctttgaaacagaatttcttacctgtttattcagtggcctaaatggtctctccaagtcaccaatgcaagggaatagatttcacatattcctttcgtcctttgtcacattcacggtgaacccagtgtctactgaggtaggcacaaattccattcagcactttgcttgaaaatcagtaatcttcccattgttgagtgtagaatttcagtacactcttgtccatcaaatcttctccatgcttaagaagacttgtcaagtaattattcaaaaattacttaagttgtttgtataattccaggccaatgtactgagctccttcaggtgtctgccccttttttgatgtagaaactctggctcctcatgcttggtttgactggtgtacactagcacactagttatgaacatgagtgtggagctccatgtatctggacctggtcatgctgtgccacatgtacacctgctggatggtggctctgaggtcatccagatctggtctaagccaatctgcttcaggccatgggggttctggctccggatttatgacatcgtgagggatgttctaaagctgtccagtgcagcaatccttattcaaagttcagctagttctccattagataaaaatatgcagtaccattccaaatttattcacagcagtttggaaagaatgtcctttaagtgtagagagtgaaatatattgcaggcaaactcacatctccatggtacccaaaaggctcccctgatgcctccacctggtcaccaggcctagaccttggcaaaacccccatcccaccaatgtctggctgcatccctcagccactgggctgccctgcctggagttgcatgtgacatggcacctacctcctcctcacctgccagcccaggcctcctcctcctgctgccgccacctcgtcccataagtttttgtatgctatgttttgtcttcatttgtttctaaatattttttaatttgccttgtgattttttctttgtcccactggttgtttaagagtgtgttatttctgtgtacgtgaaaatttttcaattttccttctgttattgatttttagctttattctctattgttgtgagagaagatactttaaatgattttattccttctaaatttattgagaattatttttatgaaccaaattatagcctatcctggagaatgcttcatgtgcacttgaaaaaatgtatatttttctgttgttttgtggattgttctatctgtcatactacgtctgttatgtctagttgatttatagtgtaattcaagtctattttcttcttgtttttctgtgtagatattatatccattatgaaactggaatattgcactttgagaggtcaagacaggcagatcacttgaggtgaggagtttgagaccaacctggccaacatggcaaaacctcatcaattctaaaaatacaaaaatttgctgggcatcataatgcatgcctgtaatcccagctacttggaaggctgaggcaggagaacctcttgaacctgggaggtggaggttatagtgagccaagatcacaccacttcactccagcctgggtaacagagtgagacttcacctcagaaaaaaaaaaaaaaaaaaaagggggggactattgaagtctccaactattctcacaaaagtgtctacttcttctgtaaattctatcaatagttgcttcatgtattttgggactccattgtttggtgcatttatgcgtatagttttatatctccttgacaaattgccacttttatcaatatgcaatgtattccttttacttttataaaaatttttgacaacatctatgtgactatgtgactatgaatatagtcacattggctgtttttgggctacaattcacatgcaacatcttttttcattcttttacttccaacctatttgtttctttgagtctaaagtgagtttcttataatcagcatataattggatcacactttaaaatttattctgctagtttctgtctttaattgggagtcaaagtcacttaaattaaaatattactaataataaagaacatacttctgccacattgcttttcattttctatatattttatgtcctttttattcctcaattcctccaatactatcttcttttgtgtttgattgatattttctagtgttccattttgattctgtatcttttgcagttatttgctcctagaatgtatatgttagtatgcttaatagtgtcctgtaggcctcttaggttctgtttatttctcttcattgttttttctttctgctgttcagactgggtaattccaattgctgtattgctatggactgaatatttacacctcctccaattcatatgttgaattcctaatttttaatgtgatggtatttggaaggggtacatttaggaaataattaaggtcgtgaggttggaatcctcatgatggaattattgcccttataagaagagaaggagataagagctctacttttcttcatcatgtgaggatacagcaaaaaaaaggggctgtctgtaaaatagaaagaggggcctcacaagacactgaattttttgtcactttggccttggacttctgagactccagaattgtaagaaatattttttctttaagtcaccaagcctgtgatatttgttatagaagtctgaactgactaaaataaattggtaacaagaagtgggatgctactgtaacatataccttaaaatgagttttgagcttcaggctttaaaaagtagatatttccatgaaggggctgctgaagacaatctggtgaggcctgaccaaaataggagaactggagagaaatcctccctcttattcgagaagacataaataatcatgagcagaatattgatggaaatatgaacagtaaaggccattttgatgaggttttagatggaaaagaggaacatgtcattggaatccagaggaaagcaatccttgttgtaatgtggcaaagaacctggctaaattatctttgcattctagtgttttgcagaagatagaatttgtgagtgataaaagtggatatttagctgaagatgtttctaagcaaagtgttgagaataccaagggtgtggccaagcaactgtttgttaaggagattggtatgggtgtgaaacacggacctaatcagtactccagcaagaacactgccagtctgaactgaaggagatgaaggtgggggaaaatgaagaaagtttctcagacttcttagaggctacaggacaggatgataaagctattcaatagccttgtgctgttctagaagatgggggaaatggccccaaagacagttcagagattatcagggacatcatctcagcttcaacaggccaaatatcctccaactaaagccatgatggtgaggtcacctggagccatgagagcacaaccctacctggaagaaatttgaaaccaagatcctcgtgtggtagagcccttggggtttagcttctctctgacagaaccctgggggagagatcaccattctgcagagcctttgggcataacccccatgcagtagggctgggtgggcacaagccctgctcaacctagccacagcatggatggatctctgccaagctgtgggggtgacatttccactccagtggtcctggagggcagagtatcaaaccaaaaaggattattctagattattcttgagcattaaagtctagtggaatttgccgtgataggttttggatgtatgtgggactcatcaccccttccttctttcatttttctcccttctggaatggaaatatctatcttatgcctgtaccatcctgtattttggggcttggaggccattttgggatatgttttgtactgatatatcatagttgtacatattttgggtacatataatattttgatatatgtatacaatgtgtaatgatcaaatcagggtaatcgggacatccaacactcaaacattatctttttttttgtattggaacattaatatttttcttctagttatattgatacacaataaattattgttaaccataattttcttactgtactaatgagtactagaacttatgtctcctatctaactatttttgtaccgttaaccaacttctcattatcctctcctcttcctttttcttcccagcctctggtaactaccattctactctctacttccataacatccacttttttagctcccagatagaagtgaaaacatattaggcattctgcctaaattcacatttaattatgggatagcaaacaaggcatcaacataaataagaggagattcaagttaacaactgcaagatatcagagctgaatttttaagctctgagaaacttgggcatagcttcctttttattgctttttaaatgtttatttattaataaaaactgcttgtttttacagcatagaaaaagaaagctcaggctaatttagtttcacatatttgcttacaaaaaagaaagtagaaatgcatccattctttaaatgaccaatttctatatattgtaattagccacctttgctgaaatatatagtttacatgatgttggaaagctgatattctacatatgataccttatgaagaccaggactctgtcccctccacctgtggtcctaacaagtttggaaggagaagatcatttaaagagaatggacaacattcatctgaaaaattgtgtacagcaaaataacaattgtcatattataaatttgaagctctgcaaatctactcagaaaattcaactttcaatatttactccaatgtccaataaaagaacactataaagttattgcaatatattaaaagccaaagaaagataaactatatctattgtaccatattgttgcagtcaagaaagggtactgatatattttggaattatatttaagtaacacttaaaataaaatgatttgaacatcacagaagatgacaaaataagaagttctaggaactggtcctgtcacaaaaataactactgaactggcaagaactgtcagaatcaatcatttcagaactctggagtgtagcaggacactttcagcttccagagaaatgcttgatgaggaaagatactggaatacaaggaaattcctgtcaggtcactggccgcagaaatattagaatagagacttcagtaaccatacatgataaggaatatagtctttgcaacattagttgaaaaagtcattaaacaaatggatgattgcagtcttcaacaagcagcaacaacaaaccttggggtaggaggagaatctgatttctagaattatgaaattatatacaatgttaaattctcagcaaaatattataaatcttacaatgtaaagtatggcccattcataagaaaaagaagacactgacagaaaccattcttcaggaagcccagagagcaaattccagacttactggacaaatgaatatgttcaaagaggtgaaagaaaccatgtgcaaagtagtaaggaaaatcaggagaatgatgtatgagcaagttgggaatatacgtaaggagacagagattataagaaggaaccaagtagtgctgggtgtggtggcttatgcctgtaatcccagcactttgggaggccaagtttggtggattgcttgagctcaggaatttgagacaagcctgggcaaaaaagtgagattctgtctgtattagtccattctcacactgctaataaagacatacctgagactgggtaatttataaaggaaagaggtttcattgacttacagttcaacatgactacgaggcctcaggaaacttacaattattgtggaaggggaagcaaacatgtccttcttcatatggcagcagcaaagagatgtgccaagcaaaaggggagaaagtcccttataaaaccatcagatcttgtgagaactcactcactatcatgaaaacagcagtgtaggggtaaccatcccatgattcaattacctcccacagggtgcctccaatgacatgtggattataggaactaaaatttaagatgagatttgggtggggacacaaccaaaccatatcaccatctcatatatatatatatatatatatgtataaaaattagctggatgtggtggtgtgcagctgtagtctcagctacccaggaaggtgagatgggaggatggctcgagcccagtagatagaggttgcaagaagctgagattgtgctgttgcactccagcttgggtgacagagccagaccctatctcaaaaaagaggcagaagcagaaaaggaggagaaggaaaaggagaaggagaaagacaagaaagaggaggaggagaagaggaagaagaagaagaaggaggaggagaagaggaagaagaagaagaaggaggaggaggaggaggagaaggagaataagaatacaaattgtggagttgaaaagcacaatggctaaaagaaaaaaattcactagaagggttcaatagcagatataagctggcagataaaacaatcaccaaacttgaaaatagatgtcttagtcatttcaagctactataacaaaatacagcatagattgggtggctacctattgggtactatgctcactacctgggtgatggaaccattcataccccaaacctcagcatcatgcaatatacccatgtaacaaatatgtacatatactttctgaatctaaaaaaaaagttgaaattatttttaaaatcctatcataggcaccaaggttatagagtcagtgagttgtggaattaagactaaaacatagatatcctgattctaagtcaacatttcttagaattaagctgaacatgagttaaatatatctgagtcaaagagatattcagtaagaaacttgttacaaaaggagaggaaataaggggttagtgtctatataaaaggaagcaagatggtgggttagagagaattctaaggtattagaaaaaagtttcctttaagtatataagttaagaccctgagaaatattgctgaagtccacatggtaagaaaaaaacgtcacaggcctcattgtgacaggcagcctgagttaggatttggatatgatctaaaatcaggaatggaggcagacaaatgagggcccaaatctaacctcttctttttagctttggaatcttacacaagttaattcaccactaaagcattaaagcatttagtttctcaatctttacaatgaagataacaaaaaatataaagaaaattgctgatagggttttgagcaatgatgtaaggtaacatttatatatgtagtacccagcagaatgcctagtatactatatctaccaaatatatgttagtttctgctgtttttcataaacttttcttacttgtggtcaagagcatggaatcttagaaccaaacagcatatccgtagaatacttttggcaacaggtaatagaaaactccttaaacaataaaggaatttattggctcactaagtgcaagttgtaaggtagggtttgcttcaagattggttaataaagcactttaataatgttatcaagaacttaagttttttctattgtttactcttcctttctgagtatgcctgatttcctgatgtctgtgggatagctgtagtagcattcgcgtctggtcggtgacagagggtgcctctccaaatcactctccaattctgtgcagtgtgagtaacccaaattaggtcacatctccttatacgataactgttgctacaggaaagccaggctctgattagtttatgctttgattcctgaaccaatcaacagcaaagaggatagaattgtcatgatgaccagggcctactttggagctggggtcaaatttgggtgtagggagtcaaacctgatgtccactactgaaaacttgaactccagaacttacttgctgtatcctttgataagtcatataattttgttgaaactcaacttctttatctgcaaaatgggagctataatagaatgaaccttcaggatgttttgaagataaattgagatactaaaataaatttgaaaacaaaaggctctgcagactgtctgacatgtagtaagtgcccaagaaatgttaactattattaatattatttattcacctatatagttttgcattatataatagctatttttaaatgatctgactttctggctaaagtatgagttttttgaggctgtgaacaatattgttttcattttttaatctacaaattcttacatataataaatgtccaacttatttctttaacaaatgagtgaataaatgatgtcttttgagtgaatgaataaaggctttcaaacaatagaaggtagatttaaaagaaagacaataaaatggtaacgatggatcacataacaaacaggatatgggaataaaatgggcccaactgagagagattatatttgagaaaaaaataattccagacatagagaggagttttctctgaacattagagtggttataggaaatgaacaaatcaaatatagtttgaattcagggtatgcagctcataaagattatgatgtcttcagatattttgtttttgttttacaatttgataaataggccggacacagtggcttacacctgtaaccccagcactttgggaggccgaggcgggcggatcacttgagctcaggaggtcaagaccagcctgggcaacatggtgaaaactcatctcaaaattacaaagaattagccaggcgtggtggtgtgagcctgtagtcccacttactcaggagactgaggtgggaggaccccttaagccccagaggcgaaggttgcagtgagcagcgattgcgccattgcattccaatttgggtgacaaggtgagactctatctcaaaaaaaaaaaaaaaaaaaaacaatttggtaaatatttagataaaacccagaagaacacctactgtgagctagaagaggtagaagaataattataataagagctgctagatgtttgatatgttccaggcattgttctaagtgtctctgttgtttaaactcatgtaatcctcaaaaccaactgttgagataagtagtattcttttcatccccatcgctatttacagattaaaaaactcaagcccaggtaggtcaagtaacttgctgagatcacacagatagtaaacagcaaaattgagatttttttttttaagacagagtctcactctgttccccaggctggagtgcaatggcgcgattttggctcactgcaacctccgcctcctgggttcaagtgattctcctgcctcagcctccctagtagctgggactacaggcacctgccaccaagcctggctaatttttgtacaaaattgagattttttttaacccaaaggataaagacactagactccttggctttaaccattacactatactgtgtctctaataaaatagaagggtaggcagagaagccagactgcaatcccaaaccaccatgcactcaggagttaaacacatgttggtgatcatgaggagcaccgcaggtctccaaggccaccaagagccaaaaggcatggccagcagttcgtaacatgtgtgttccctctaacccttattttgcactttgttaatctgcggcatataacacaatggctgtggaggaggcaactgaacaaacatttgtccagtgaatgagcgtgtggctggatggttcggtgccagtatgtatgttgtgctcacagtatatatgatatgccagtatatctgatgggccagtatagataatgtgcttatttccttggcagactgacctcttcatgcttccatatttggtagattgtctttaaaaatttaaggacaattaagttttctcaaaatgagacaacttgccttgcaataacattcagagtaatgaaaaagaaatgtagagataatccatgcttcagagaatgccctgggagttgcagtgaatacagaattgtgtgtccctttccagggagtctttcaggactgttgctgacctatagagaaaaagcacaatagctgtcagaatgaaaggagaagctagtacaggcactctctaagggaattagagactaaggactatcaaactaccactttcctcaaaaggaatcaacaaacagtcaaacaaaaacaaagtcattgctaggaatttttttggttgtggcttagcatagatctgcctttgatcagactttaacttgaaattcctgaatataccccagttccatgcaccctgatgcttctatggcgaacattcaaaggagtcagaactcccactctttctagattgctgtagcccaccaagagttaagtttcaaagaccatatataagccagaatacaagtttcagattcagctgtacaaataaagtgcaatcttgaaacacagtgaagatgagtgttgaggtctttgcattcaaaatttctctatttctagtatttctatattctccgttgtaactatgcgatttcatctcttgcttagaaagatcttagttataaacaataaataaaatcaatttttccttctttctctatgctaatttatcatctatgaggaatgctccagaagctattttcatatttagtagatactggtggaagataaattatttgtaagttgaatttttaaaaggagcttttaaaatatcactgtacttacatactcttataaagaaaatatctttagctttcagtctctgaaggaacaaaatcaaaactgcttgaacaagtatcccggctggaggaaaaactggaggctgtggaccacaaggaagccagtgggggaccatatgaaaaaatggttcttgtgaaagaccaggtatgttgtagaacaaagtcatctttattttaaaagttacctaattttatatgaattgacaatcctggaaagccatttcagtctggattaaaagtcgtatttttaagttcataatggtaaataacaatatttgtatttgctaaaagtaattttattccctggcaaatattgagataaaatttattttgctagtagtagttttaaagtttgtttgatatgtaaccctttgaataacattagctgaatattctatttattttataaatggtattgactgtacaaatgtctcttagttgttaatgttggagtgtttctttctgtggagtaaaacgagaggctcataacatttggcatatgttttttaatcaattactttataagaaatgattaatctctgaatatctgagcattaaaatatatatcattatgtaaatttacctcttgttcaatccaaagggtttgcttttggaatatatggatatgatttcatgtgaaggtatatatatatatatatatatatatatatatatatatatatatatatttatttatttatttatttgtaaatatatatatatttatatgatataggggcatttgcattaaccgtagcacatcaagctaacattatcttactcaggcatatcctagttcttaatatatttgtgtgttttttctttgggttctttcatagaatggaagagaaataggaatggggggatgatttctccaatgatggttttcaaaacgtagctgaaataatgctgccattcacgagatttgaaaactgatacacatttatgtctgtaatacgttgagtatgtaaaagaaagagttacatacttagtttctaaacttttctccttttcagtgcatccagaaattgcaagctgaagtaaaagcttcccaggagcaacttatagcccaggtaagtgttttcctccttttttcatccctttatttatgtcattgttagcttggaaatgaacagaacatggaaagaagttataaatgagtttcgtctggagcaaaccaaatcacaaggctaaaaatgagtatttttactgcgtctacacagtttcttttcatacataaaattctgatttttgtggatgaccaaaattccaaactgagctcttatatataatcagatggtctaatcaggtgctatcagaagaagagaactggaaacttaggacagaaagatgaagaagccagtctagttgggtgagtaggtggaagtggagagatgtggtaattattgacccatcagataaaggtctagagcagttcttcttaaactttactgtatgtaagaatcacctgatagcttcttaaaacaaattactcagattctgtttcctgcatgcctaggttggggcctgggaatttgcactttttggtgattctagactcagacaatgctgatgctgccagtcttcaggacacacgttaagtgacattattttttatacattttttatacatacatatatatattacatatatttaatatatattattaacattaatattgattttaggcaagtgaccatataaaccaatcagactacatagttgcccattttctcctgcaagtactcgcctgagagagaccccatgaatttctatggcaaatttcatttgcacactagcctatgtttactctgagaacaacacataagcatctcctgccacaataccctgtgtgtccatgaccataaatctgtcaccctgccactattccttcccaaggatctgaacaacccaaatgccttagacatctcctcaaagacttgattgccatccttttggtcatctttttcatccacatcttggctgctatggaatgacttcttgattaaagatactgaccagtcatgttaatggccaatcttaactacaccaggcccctcagacagacctgagacctatgaggttgccctccaaaagactgcaagataatacattctggtgaccattcctttggggtttggaatgaactgacttgggtaaaatattggtaattgtccccatttttgtgctagagaagagaaaagctaatctgctgtggcagttagcagagcttttaactctaaattcagaatcttttttgggcttgtatgttcaattgtccaatattgaaaatgactaaggcttgcatttgtagcattgtgacatatttagacagaaatatgtctcattagccagtattttgttgcagatgcctttcccctggtctccccctgagggtgccagataatgactattgtcagaggatgtcccgtcacgacatttgatacccacagtcattcacatggaagaagcttttagctcagaattttatatggagggcaaatgtattcactaaagctcagatattagcttccagcatctctttgtgaaaaacagatgaaaaaagccatagttcctggtgccttagggaaattcctatagtgtcttctttcactgcctagttactatggatgctattcctgtaccatgctgttactgcttgagacttgtctgaactagaattgcttccctgtattagggtattgataccagtgactgagatttctcatatgtaattgtccaacattcaggtttcaatacaacagtgtattcatgaaagttttgcttcaatgtgtcaagaaaaacttaaatgaaaacagtattaacgatagtatttattgaaagtggattatgtattttctatgtggaagatatttcacatatctattttaaatctcaacacaacccagcaaggtagtcattaattttcagaaagaaaatggaatcttaaaaagattagatcactcgtcacactctgaaacccatgattttgctattacaacttgctgtctctccaaattatattctctatgtgccatttgaggtatcaaatggtgtttataaaggttctatctccaacctccttttctctttctgttcacttttggtgattcagcagttcataatgcttcaactctcactcccatgcagacaaactgccttctcccacagcaagttccttctatcttaagcctcccctgattagagatctgtagtgttttaatgagcacttcttagaacattgtccctgaaaaaaacattccataggatgctaagaggtattctgaaaaaaaaaaaaaaaaaaaaaaaaacaacaacaacaaaaagtaggaagactgttggaaacaaagttaaatgggtttatttcctgcaagagttatccatgtacaaacaatctccaagaacaggctgttgttggtcatttttccaaaagagtttgattatgaatggtgatttgtaacacacaggtttagagatggctggtacacggcatcaaactgaagtactctggttcttaaatatgacctgaatatcttgctgacacctcaggctaagaatatacaaagccaaatttatcatcttctgttattatctcttaaatatgtttctctattcgtatcccccagccatggtggataatatcacactactgttattttttctagattcaaactacaaagcagttttaaaatcctacctctctctgcctctgtcctactttggttagttgtcaggccctgaatatgtttctacaagttatctcacttccatgtcttctattccattatactgccacttctctagctctttttaatcgtcttatattttaattattgtaactggccccaaattgttaacatatgtgagtgaattcagagccccccacaaccccactccccgttacaaggtagcccacttgctctggcaccatcaagccctattgagagaagagagaggataaaaatctgtgtgtaaagatttggaatgggtgcagaaaaccaaacagagcaaaagtgtaacactcacagggtgagtgtgatctgctggcgtggcagagaagagaaaggggatttaaaaaccagggtggtaggaatggaacactgaagatggggtgagggttcttctggaataagagatgagagttctgaggatgctgaagattaggaaataacttgaagtattaataagagttgcctggcaaaatatgtacttgaacccctttaagtgagagtcccatggaaagtttggaatttctgtttggagtgtgcctccttaatgtaacacctgtgggacctgacctctataagagtctcctggtttccgtgcctccatcctgagtgaagtttccaaagcatagtccctgcccctcatcttctcttctccctcactcccctctctctgccttacactgagcctactactagaatggagctgctatctttctttacatatccagtattatttgatgttctgtgattttgctcacagtattctcttaaactggaatatccttctctcttctcttcattcaaataactcttttctgtccttgcaagactcaagttatgtaccaacttctcccttagtccccagattattttctgtgggtccccacagcctcctttagatacatctatttgagctgttaaagtaaacattgtagacaaattaaatttaacagagttcatgtgagcaaagaatgattcctgaattgggtagaaatcagaaccagaagaggttgagaaagctccatccagcagcatgagtagcaagcttttataggcaaaacacagaagcaaagtaaagacattatctgttggctacctaagttaggtgtttgccttatttgggtgtggttggatcagttgggtgcctgtgattggctgaagctcagctgtttgtgactggctgaaacccaactatttgttacaaaaaatatactcctaagttaggtttcagtttgttaagtaggaactcaaaatagggagagaacctcaggccaatggcctcctgcttatttaacagagctcaatacactacactttgttgacattatctgtttatatatccgttacccactagactctagggacattgaaggcagcactaagaatgtgtctctgaatgcactacacccagtacagggctgggtgcattgtagctactcaatacattttgctgaattgcattgaattttattctgatcatgtcatttccttagttccaaagccttgagtgagacattgcttgtccattatcccagaataaagtctaacctcctgaccatggcatttatcatgttgacaatggggacctgaccccctttcctgcctcatctccatctccatctgcgacccccaagtgcaccctgcatctctgccctagcagctttgcttgtagctccttgctaccctgaatgcctgtccctgccattgagtttgccagactttccccattctttatcaagattgttttttccacgaagttctccctatcagtccagaagtaatctctccttctttggtgcgttcacagcacttctctgtgcctcttttcagtcatttgtcacactatgccccacaagagaatgatctgatgcagcctctttctcaagactgcaagttcctggaggaagtatgtctgtttatctttattcctcccacagtgtctggctcgatgtcttgtacagattttattgaaatgaattgttaaagtggctaaattaaaaataaaattattttggcatttgtaggagcaccctttatatatcagggaaaatcactttatgacaaagaattgtattctgtgaagatgtcaatattacatcaggcattaatttaatgaggctgactctttcaaatataacatgcaagtgacaaaaggtaaggatctcttagagtggaaacagaaggaaaaaaatagcagagaaagaaaacacagttgctggaaattcctatttcacgtgaaataaaaagagtttctaaaggaaacatggtcttaacatgaaaattaacaacgtaatgtcttggcttgcttttattcagagttcactgctctagaactcaatagttgaataatatgattgtttaattaaattgatagctatgaaatggagaggagatgaaagccttaacatttcagagttatcatttgctaatactttgaagattaaattctcaccccattaaatttactgtgcctagtcacaacttagacttctaaagaaattattaagggttacccctcccagtgcacatgtgggcacccaggctgagccatcaccgggctaagctgccctgggcatctttatcactccctcccatgattacttatccgcttaaagacctacatgggataaaacaaatatttgaaatgaatgtttataattacttaaagatatctgttcttgttagggcgatttgagtcaggactaggtatcttaataaaaaattccttttaaaattaatgccttccaaattatggaatccatatgttgcctgtgtttagtattagcgggtataagtgcttagccccatctgttcactccttcgtggatgacctgaatatctgcagtactccagatgtctgcctcccctctttacctccatcccaacggccatcccatctctcagtttccagccacccacaagacctgaccaggaccaaaagctctataatattcaatgggtttatttcaaaatggaaatctgggtaattgggtggtaggcactcaagtgtgatgttattctctatactgtcctgtatgtttgatacatttcataataaactaaacagttaaaaacatccagatgaaggaatccttcaaatgaatcgtacagcatgcttaaaagtgtaggacagatgagtgaattttggaaaccagaagatcctgaaccactgaggcctggaagctcagggtgaggaactcagggcatgggaggcacccaggacgggggtctcccaaaatgctggtttaacttcctttcctcctacaaagaagctataaactgccattttactttctaaattaagaatctgtaagagcggactgctccctcctagaattccaggccctctgctaattgacttgttcttaccataacagaggacatggcctgtttccttgggtttggttctgttttgttttgctgcctaagcatccactgacacacctttggcaataatacccagatattctctacaattgcatctctcccactatgtgcaatcttccagggcctgtcattcaaagaactctgtcagctactagctgaggagtggacatgtgccaactggactctctctccagggactcagcacattaaattcaggtgaggaaagagagaaaaaacagttggagctggtacattctaccagggatacccaggcatcatggtgaagtagcttatgctgcttgaaccagaactgtcctagatcctctccatttctgagtgtgtttcctactgattttaggaggtacccccaaaccctccaataaattctctttttctttaagctagccagaatcagaatcagttgtttataactgagaacccatcattcttcttttatcccagtagttctgaaaatgtggctcctgaaccagaaacattagcatcacctaggactttgaaatgcagattttgaggactcatctcattctgctaaagtctgaaattctgggaaaaggatgcagagttttacaagtcctgtaggtgattgtgatggtggtaaaatctgaggtgtactgcactgtccagtgaagcccctagcacttccagcatagacccttactttctgaccaggacattgtccccgaccagcatttcacagatgaggctggcctcacgggcctcatgctccttgtgctgggatacctctccagcctgattcctagtgcagtgccggggattgagacatggagacatgcagtagcacacaacacatgtctgttcaactggtgagtcaaatgagaacgatcttcctgccctccctctcccagtcccacacttctatgtgctctagaagcatcacttcattcctgatgcttgtcatgactaattctactgtaaagtgacagcagttaatcacaccttagagtcacataacaatatacagcttcctaaatgctcccacccacatcatgtcatttatatttcacaataatcctatgaagtagatatcactccccctccttgatcagcagaagaaagtgagagtcaaagacacaaaaatccctgctcacagcaaatagctggtatgtagcacagcagacttgcgtgtagatgttctgatgtaaagctcctgtttttaaagccgaatttcacttctaagtcagtatttttgctgcatatatatgccaatgcacagatgccagctgtggcaataaattaattttaatgatcttttaactttattttaaaatatcatatggcagactcagaccacatggcagagttaatcagtggttataatagagttctacctgtgccaatgaggaatagggaaattcctttcctgcgggccattctcttagtgccacatgtacattaatctaaatggaacattcctcagtgattatttatgaacagaagcaggtggtactgaatgattgcatgtgagataaatctaggaaatatttttgttgcatgtgttcattatattaaaatgagcccctctctgtatcccaccttctttggttagattatctgcactggatgattatttagcccctcattttaaccctttatgtcattaccccatggctcatctttcccatgctgaatctggaaagattgaatatcatagaagaatagcagaagctttcaaattccattagtgggtcttgctgccaagcttctctgtgcgctcagaagaggaggggttctgagctctcttcacatcagcaggttgctcctaacctagatagaatcagcactctctgaactatgatccactaacagatcctgcccagttagatgtggttaagaagctaatctgtaacgcattgaagcaatattcaaaatgaaactttggagccccaccaggatattatcttttcttttccccaccaaatagccaatgcacaataaattgctctagaagccactaattagttgttggctttactagtgaggacacactgagggacagagacctaatgtttgagttgggttcattacatcacacaaggaccctggctggcacccaggaggcttattttcccctttctgatcagatctaagtcctgtttcctcattttctatagacgatgaataagtttaaactgaacaaccacctgtaccaattcctgccacaccccccaccctaccgcccccagctaccgttgcaggtgtctagtctttgcttagctatttgattggacacagggcgtagacattttttataaatacctattagctaaccacgcatttcttcaaacatgtatttcagtttcttacttaataagcttagacttctcacatcaacattctatcaaaggaatatacagattttagaggttctcatattcaaatacagatcagttacaatccctatttacttgctgaaaaatcggatgggaacaatgtaagacagtctcagctcttccccactctgatcctgagccacatttctctatataaaactccagccattgaggctcacccagaactcatcctttactattactgtaagaatctaatagaaatcatatttttattgttcttaaaaatttaaattactttaagaagactgagaggcatacctctccattatagagagcagaaagatgagctatttatgcgaatcatgaggggttttaaaagtcctctggtcctgcggcctaatccctgccagagaggaagacagcattggggagtgagacactgggctagacctcagctctgataccatctgtggacctggcaaaggttactctacttctgttccttctgtcagtagaaagaagctgacattacttagccccatatagttttttggaggttacgtaaagttgtgaagtgagataattcacatgaagtggttagcagagtgccagaacatagtaagtgttcaataaatctattaacaggttattctaaaattgagttatcccttacagtaactgttccccagtttatgagattatagtttataattctatggaataaggcacctcatgttagctgcctatttattttatagacaatactaggaagtttattaattaaagacaaaattgctttctgaagagaatcctgtcatgtcctgtcaggtcagtactttctcggcacatttctttccatggtcaatgtcttcttaagcctttcccaaagctatctgcttgtcatttaattgtctgtttctttctttatccaccattagattataagcttcttgggggtagagcctgggtctagttcactgtgccttctgagtactagattgtcaattaagtatttgttcagtcaatcagttgttcaatcagtccttcagtcaatcaaaggatgagtggataaatgaatgtgggtagttcttcaattcaagaaatatcaagaaaatcatttccaaaagatttctgttctacccctaacccagctggccatttcaaccagagagctctgtgcttcactccactcctgggctgatcaggagtcgatatttgagctcaatgcttagctttaaaaagcttaggtgaaaagaagcaggactatctaaatatagtccttattttcagatatgtaacttaaaatccttcctgaattaagtgagatcagcagagagccacattcctagacttcagcaaggtgccctagagctactttattgaatggcaggcaggagggggtagtctgatgttcatgacgtactgtgggaggattttataagaaactgccctgtgaagcttattactgtgtttactgtcaggttattattgaggacatttattattctattaggtagtatgccttcctgcaccagtaatgttgctgcttccactgagcgctgggcttgattttattccatggatgcatttttgtttttataaatggttattttgaccatcagaaagactacagccaactttcgccttacctctaacaaatgagtattttatgttagggcatgaattgtgtgaaccttccctcttgccccattttacttctctgcccttaaattctctttatcacatcttttgagttcttattttagtggcttctcacttagtatatctaccttttttttcaagctacactaaatcctttctgaaatgtacagtctcaaagtaaatcaatgaatcctaagggaagtagtcagatccatattgaccctaagtggttcttccagagtcagtttcatggactgtggattcagttacataattctcacttaaaaccctcagtggctgcccataggtctcctgatactctcccgctaccttctactgctagttgacacccagtgatggtgctcgtttgaggacttggaattcactaagaattcctctaggttcaggcctccatccctttgcagagtgagtctttccctctgctccatccactacttactttcaacaactggcactcatctcccctaaagggcaagcctttcttgacttctcagtaagaagccaacctctccttgtgcatattccatggatctcttttttgcctttattctactccattagttgagttccccaggttctgggacttggctttattcatatacagttcttgacacacaggaggtgctcagtaaataccttgttcaatgaatgagaatggagtaagtgagagaatgtataaatgccatatacctggatttaatgttgatttttaaaaatgagcaaagtaacagcagttaagtgtgtctctctatagcaaatcgtccaaaaaagatactaagagatttatttgtaattttatcttattttcaaaaagaaagaaaatcaaataaaaatttgcatctcaaggggatacagcctgttactttatgaatgttaaacttttgctgttctcttgatacaattttacactgtcattaaatattaactataatgtttaatttaaccatatttatttatttatagtctaagttcaaaaaggatctgagattgttaataagatgcaaatgtgtgaaatagttgtatttttaaaaagcacttaaagagccataattgagaatatatatttgaataaaatagaaatatcaggaaaaaaaatagaatacacatatgtgagttctaacttcccatgcaatatagctgaaacataaatatggcttttatctttctaacagccaaaggcagatcaaggaaaatgatcaaataaataattagtgtgttgggggggatgctaccattcatttctgttgagttaagcctaaaatgagattctatgttgaatttcatatagggaatattgaaagacatagtgaggggaacactcatgaacatatcagaccagcaaatgtaataattggttttatttggctgtttctgtaatttccatcaaaagaagccaaggacataacatgtaaatagttaatctttccttattgtaattctaggctagctagtattgcatatagttttaatccccagctatttatgataatccagctggcaaagtctactgcagtcgaaggccaagtaagtaatgtagaagagggaagatggtcagaaccagtcatatgggtctggagggtgcctgactcacataaaaaggagaataaagcccaagatcactaatttttcagacaatgaaaatccagatttttggtgtgaaatcttctcatttgtaaatgttttcaactgatttgaataaaacagattgctctgtgtggcaaacaaaatacatttattcatagcctaaatatgagccttacactggattttacattcaggctgctattttcttacatctgttctacaatttgaaagatgttctccaaaaaaggccaggaataagtgaaggagaattaggtattgtggtggttgtttcagccactttaagtttgctagttagataatgctagcttttgtaacacatagatcccagaatttcagtgcttaccacaatagaagttcatttctttctcattcaaataacagtccattgtgggacttgctggtgggcagactctgcccattcattgttatttagtgtcattctgtgataaaaactgttggagcctctgctgtgctcagcatgtaggatccaaggtcattttggggtcatctctatcccaattggccaaaaaagaagagattgttgaggtgtgggcttggaaaacttctaactggtcatacgtggaagtggtgcattggttagaactcagtcatgagaccacattaattacaaggaatgctaaaaagggtagtctagctgtatacccagaaaggagaggggaatatggatttttgttaagcagccctaacataaaatactcacttgttagaggtaaggcaaaagttggctgtagtctttctgatggtcaaaataatcatttataaaaacaaaagcgcatccatggaataaaatcaagcccagcactcaatggaagcagcaacattactggtgcaggaaggcatactacctaatagaataataaatgtcctcactaataacctgacagtaaacacagtaataagcttcacagggcagtttcttataaaatcaaatctgactcaggctccatgtgtcatgtgttagcagaaagttcagtttcggtcatttgggaggaagggtggtcctctctccctcctgggatttgcagaagtaccccagtaactttacttgccaaaagttggggccactaacttctagtgggttgtgactttccttccctctgctccatgtccatgcctatgggcccattcagagccttgtggctctttttattcagtgctaagctttaacagagggtttatggcagctcctggtctatatacaacactcagcatcaggcctctttacatataattgcctatttcaggtcttattacccaaaggacctgtgtacaagtggagtacgctctctgctgtcttaagaacccccaatacttaatctgctctaaattctgaagcaacttcctccccttaggtttttctacttccttttctttttcaaagcaccaatctccattccctcccttgttggggcattttcaggttgttttattaatgagaccaggtttcccaaccaaaggctttccagatgctcaaactctaccacaaaagttaatttcctctccttgcataggagttgggggtagtgttggtaatgtagtagcagcaattcctctttatgaggaagttaatgttttaaggctgaacttacttgaaacttaagggattttttttagagggttgtgtacttagtaatgcttagataggaaggcttaaacagaaatgcttagacagaaatatgtgcttagatagttgagtcaaaatgtgatatatttttatttattttgttcgcgaatgtgaagaaatactaaaattattaggtaaaataaaatcaaagctgtaagcattagttcttagcactgaaattgactttgcctactctttcacctgttagatatcttttactccccagtgataagtttattatcatcagatttaccaggtggtaacatacataagaggaaatgtgagtacctacaccaataatcatgatacgtgatagagtcattggcaaggtctgagaagaaaagggagactcaataaatgcctgtctctcctctccccagcctttcctcacactatacacaccctccatacacactgctccctgccccagtaaattggatgagttgactaaatatttaagaaattcttgagtataaactgcatgtatagaacattttcccctctgaacattcaagacagactgctttggtttagagcccagctctaccagttactagctgagtgtctgagtagattgcttgatcctgaggcttaatttccacgactgcaaaatggggatactaaatgtatctagctcaccgatttgtcatgagggttaaatgtgttaatttttataaaatccttagactggtacctacaacacaatcaattttatgtaagtgcttgctaaacaataaaacaaaacaaaaaaataaaacaacaaaaccagcatacatttccatgttttgctcagtggtaagttttaaccacattctttgtgagagaatgctctgaatgttcagcatcgtgattatctgtaaaatggaataatggtagaacctacctcaacaggattattgtgagaattaaatgggatgacactggtgaagagctgaaagtggtcctgggatatagccagccctcattaatgttgatggtgattatcagtgcatcggtgctgctgctattgttgccttgtcctgaccctcatttgctacatatgctttgacatttatctaagtgtttaaaagcatatattttttggtaccaaattccattttattgattttaactcttaattatttcactgtcttcaaaaaaaatacatgtccctgttgagcccaagatattactcactcattctttctgtgcacgaggagagcatgtaggagactgttttgtttctgccaaaggaggaattagtacggggcgtttctgctcaccttcacttgagtaagaacacagtgattgctttaggcagaggtcaatgccatggggaatggaaaactactgcctacgagttttgcaactgaaaaagacaatctttgatgtttcaaggcaattctgaccacactctttttcctccacctttgctgccctaacctttactttctcagcttcctggagaatgccctcctacctgtttatctctaactcttgcttgaccccataaccaaatgccccaactgggaatttttatgatgcatatttcctgtgctcagtgctaaatcaaatgcagctgattttaccgtttctttgacatccatttttggatgcatgttcctggagacatttgtgtccctttagagtgggagcccgtgcagggcggagaagggcctgatggcacacacctttccatgaggcccttttgacgttactgttcaccttcctcattgcgggggcccaggatgggacttaaactgtccctatttcattatgttgttctttttctgctttagcctttccactctcaaattctcttgtcaggaattcctctagaagcaccctcaaggaaattgaatgaaaaaactcagaatttttgaaaatttaaacaagtaaatttttgtatagtttcctaaaaatcattgaggatatcaataccctcttttgcaaaataaaaaaggaaattgtttctagctttaaattttatttaaaatttaagtaactgctcatctgcagttttttatcatttgtagtgtttcaaatataaataattctatgttttgcccaatctcttccctttcttttatgtgccatttactgagggctgacataaatcccactgggagactacagagagtaaaaagcgacctggaagagtttgcttgagcctttatgactgaaaagttttgtcatagtctcagaatctgtaacaatactcagtgaccatatttaaaaaaatgattcagacagacttgttcaagcagatgtgatttctgcaaggatagccaggtcagagtccacaaatggtttaaatatgaatcatcttaaaaaacaaagaaaaactaaaatagtaactctacacttcttaaactttttccattaaaaactcatgacaatattgtgttataggaactaagaaggacctgagcttctcatagaaaggataccagtaaatcacaaaatccaagaagaggcaaaggaatgtaaaaccaaaataaatagttattaattattcattcttcaactatttttactgatcctcacaagccagtttctcatccttcaggcttagtgggtgcagggagccttggttgtgaattgctattgtctgtcctcacagaagaactggtttagaggaaggattaaaaggaaaagcaggaggaggtttggagggtcaaacagggaggctgcttcaggagtaggggagaatgcagacggcagtaagggcaggagtgggagcaggaacaatgtgaacagtgagactagaagttcagtagagggaatagtcggaaatcagaataggaggcgttattcttctttgtggaattgctaataagaatacagctaaatgtttgcattaagcattaaaaacaagttatgtccagtttgagcccatgggcatgtttccccctcaatgctctttcccgcataaaacacacttccccagagtgtggagctcaggaggtaaccaaagtaaccaaagaactctgccatggtaacccttgcaaggctgccatgttgagttaaagtgattgttgtggataaaagcttcactgaatggaaatggagggttgagattttagcctaaacagtagcatgtttaatgcttataaatgtgtagtttttagttaattggaatagctaaaagcttagttgggaaaagactcagtaacattttgggagatctttctatgacttctccaaaactgtgttgcccgaggaatttactttgcctttcagccctggatcttagaataagaatttagactttagaatgactttccagcaaagcaatcccttgctggttagtttcaagtctgacatgtttggaaatttgtgccaatgaaattctagctgcacagctcccactgttctcccattcatgtcctacgtacctgtgttgtcttaaacattgttgagggtaaacagttgttttcaacatcttcagtatggcgaatttttaaaaatattttttaattagttttctctgatgggttttttttatttttattttcaagacagtatgtgttgggaaaatttctggcctcaaaatataattctttgcacctctcatgaataaatattatgacagaaggatctctctctttcagcaatgaccatgtgtagccttaaaaatgctcagtagtaagactctaggctggtgtttctctatctgaaactgtaggttcatgggcatattttcagatctgtgtggtgtattaatagactgtgtgacctgggagctattgtacacatcaactttaacatattttagaaagagtcgatggatatttgtgtgccattttctgttgactcccgcatagcagagcaaactaaatctgaggaagatggtgaaacgtcagaacagcaagtaaaattcttcctctctcttgctggatttcatttaggagcaagtgatcaaagagactgaaaacctggaatcttgaggctgggtctgtccattggcacatttggggatgatagggggtggggaaaatcaggttttacatgatttctataaattcacagagttcctgcatggaatctaccttcagcttcacagaaacaatcttctctaagccttccagattgcccacaggagtctaaggagtttctttaaagagagatgtatgggctggctatggcggctcacacctgtaatcccagcactttgggaggctgagacgggtgggtcacgaggtcaggagatcaaaaccatcctggctaacaagtgaaatcccgtctctactaaaaatacaaaaaaattagccaggcatggtggcgggcacctgtagtcccagctcctcaggaggctgaggcaggagaatggcatgaacctgggaggcggagcttgcagtgagagtaggttgcaccattgcactccagcctgggcaacagagcgagactctgtctgaaaaaaaaaataaaaataaaagagagagatgtacaagaaagagaatttgtcaaaatccatgactgattatatttgggatcaggtgttattaaatatacagtatgtatataaaaagtacaaaaatcacatattttgtctctaaaaggtttcatccatcattggttagataaagctattagacaatgtactttaaagaagttgagatacattaatatgtgttagagaaaagtaatgaggaggggaggggcttatgatggacttggcaaagaaatcatgatttggagttagtgttctggagagagtgacttagaaatcaacatactgttgtgtggataaatattttataattagcattaaacattacaaagggttcaaattgcatcagtaaagctttttagagggaatttgctcattgaaccatgaaaaggggggattttctgcaaaggaggcagacagagatttgctaggaccctaaagctaataagcaaatttgggataagcttgtacttagtttagctttagtggggcttctaaggtagagtcctgtgatatcagtcatgttcttgttttacagaaataccagtttaagcagaataggtattaagtgaaggccatggctaactctcactctccaggagagccagagaaccagatttggaaatggaagctgaaacaatggtcaaatcacaccacagaacttccccaggtagcttcccactgctgtatagttctagctggtacctctggctctgtgcactggaagcctccactagaacttttgcttctaaacagggtgtttctgctgtgaacagagggcacatagcagctattcttatctgaattctggcataaatgtttcaagccttgcactgaggatgcgagggaggcttctgctttgagaaagtgaggtctcaaggtggggaaataaccaagcttaggaaaagtgttcaaagatggttggcaggcaaaaagaatgctatagttccatcacacccagtaagtttgtgggtctcagataaaagaaaatcaaggcaagttcaactgtaggctggaaaaatattagagttcttaatgattgacttattccatgctatttgtttctttaaaccttgtccttcaatatatctggatttaaatttgtcaaacaaaggtgataatgtgatattattagttattcatattgttaacatttttcttatgaatcataattgattggatgctgtgatagtctttcttttccacctattaccgggtgcaatgtcacacctgttggcagttggtggcttacaggtacagtgccttggaggaaatagtgacaccctaataaagtgattctcaaatttagtgagtcttaggttcacctgaaagccctatttaaaatacaggtagaagagttaaaatatgacccagcagttctgttcctaggtatatactgcagagaatggaaatatgtccacacaaaagcttgcacaaaaatgttcatggcaacattatttacaatagcaaaaaactggtaacaactcaaatgtccagcaattgatgaatggataaacaaaatgtaaaatattcaactaatggaatattatttatccataaaaaggaattctggttcatactacaacatggacaaacattgaaaatactgtgttaagtgaaagaagccaaaaacaaaactccacatattgtaagattccattgattgaaaatgtccagaataggtactggttgccattggcctgagggggtgagatggataaggagtgagggagtgactgctaatggatatgaatttatttttgtatttatgaaatgttctggactccgtagtgatagttgcacaactttgtgaatatactaatattgctgaattgtacactttaaaaggatgactgctatatctcaataaaaaataaaaatgaaaacagattcttgaattatttcccaaagaatctaaatgcatatctaggatgagggctggaaacatgtatttttatttggatgcagctgatctctgaaccacgcttttagaaacattgcatctagtccttacatgtgtaaatctcctaagctatgacattgtagaagtagtcatacaaatccacaattcttcaaagttcatgaccttgctttagaaaatatccgtaaaaatagtacaaattactatcagaagagtcttcagaataaagtatatgaaaaaacccagcatagctttttcccaaatcactgctctaaaatcaatgggcgtagtgatttttaatcaacatgatatttacatatttttttgcttataacctgcttgcactctggaataaataaattgctacctcttaatgtcacttgataagagtctaaaatacttgaatttgaatatataaatccattaatttagcaaaattttaacatcagtcttatgcattgggttgacatactaaagactgagtctctaggactttgtcatctaatgcagaggttttcaaccttggccaccattgaagtcaactgggaaacattttttttaaaaaacgaatcctgggttctactcctagacatccaaaattctattgatttggagtacaaacaagacatggggacttttaacatttcctcaagtcattctaatgtgcaaccaaagtttggaattactgctatcaagaagagattacatagagaccccatacataggtcttatagcacattatgacaagtggaatgatcgtggctgtcaaaaattactatgagaattcagaggaaccatccctaacccagggtggagctggagactgctccaagaagccatcaggtatgccagtgatacctgagctgagtattaaattagggagaggaactgtccaagggaagatgggggtgggagtgatctaggcagaggaagtagcctgtacaaaggcaaggagagttgaaagagcctggatgttagctaggggaaaggactggtaaggaaaatcccaaaaggcatgtcacatattttatagctggctacagccattggaagtttcctcagaaaccaacttgagttggcaatgctgggactttcaggtcatgacatcttcttgctttgtttcatttgaggaaaggcaacaactccttaataccccacataatggattcatagtagaaaaagaaaacctagcagtgctgggctcttcctgtgagattattaactgttgaaagggatcctagctttcattatttgtaaactgtttcatacatgtctacccatatccatttcaatgtcacttttccggaagtccctgaaacccatggctccagataaagaccccctactgtccctaaattaagccaccattgaaagcaaggagggtacacgctaaggcaactactaggaagcgcgctaacaacgactttccctcaagagatgcctgcttctttcttatccccaaaagaacttcagggcttgggtaggcaccacataattatgtcaacagactctgctctaggttcctgactctgtattcttactctctccccagtcagattgccatacaaatacaggcggttctcaggtagggtaaataaccatgttatttccacaggaatatttgagattgtagggaggttgcctttatctggcagggtggagtcagtgatgtgataatatatgttatcttttttgagtctgggtggtcacttccatcatgtgactttaaagacctaaaatgaaagaagtttacatcttagcaaacatttaatgccacagtgaaagatagcatgggagccaaaccctctgatggttgtttctttttagatgtctttacttctaaaatgaatctattttatagattgcaccatagattctgaaatcctttcatgaagaagtttgctctttctttagaccaccaccacgatccctataaaacaatttacagggagattcaatagcaggtccaaggttagagaatcatctttgtcatactttaggcagaaggaggtttagactcctgctcctctgcacaaatgaatagtccatggtctataaggtgcttgcacttgcacaggcagccttagtttccattctcagggattatctttatccttgtttgttttcacaaagtattttaaagcacacacgcacacacactctctcacacacgtacatctctaatattgaaacttaaccttagcatttcatcttcatactcttactgattgtgttattttaaatgttcttattttgagcagataatgctgtgaattatgtgtgtgagactgaacaaagataatttcccttagaactttttctgtacatctatgacatttcattcttattacatttctaaataggttattctttaaaacaattttactcagcctttgctctgcaaccacaaaatatagccaatgaatatttggccagaaggtcaataatataaaggcatataaattttaaaatgtcggctgggtgtggtggctcacgcctgtaatcccagcactttgggaggccgaggcgggtggatcacctggggtcaggagttcacgaccagcctaaccaacatggagaaacctcgcctctactaaaaatacaaaatgaactgggcatggtggcacatgcctgtaatcccagctactcaggaaggctgaggcaggagaatcgcttgaacccatgatgcagaggttgaggagagctgaaatcacaccactgcactccagcctgggcgacagagtgagactccatctcaaaaaatatatgtatctaaaataaataaattttaaaatgtcttccttctccttcctactttctcactccctatgttaacgatacatactttctacactctataacatagaaaaacacatatatacatgttattttttttaagttgattttttgtttgtttttacaaaaatgtgatcttctctatgtattacttttcaaatatatgtatcatctgtttcctttatcagtttgtcagacatacttacaacatgactttaaatgatataatcgtaaactagtgaaatgtctaccaaggattaatttaatctaaatatattttaatataaaaatgtctcattaagttcgagatctcactttccatcttcccatgctctctggtctccatctagctagtccttttcaaacatcattttttcctcccatccctatagtatccacacactacatgtacacacacacatatacacacacactggaagctcaggcaggcagaattcatagtaacattgagtgatgactaacagctagtggtgtgctggtaaatgtttaacaaccagctttggtggaaggtggatgatttatagtgtttgcctatttctgtggtttaaatgcatcctttcgacatggccttttttgagctactgatgttagatcaaccagttcacatttcctgaaattttaacaactggctttcacaaatctaaatgagctggcttcaggctgccactgacagaggttatgttgtcaacaatagaaggtgctatgatttatataaagtatcctgttgttggtggagaaactcatctaggggacagcctctttttcaggaaatccaaaaagtcatcccagacctctgccttgatccaaagttgacaagagactggagaattcaactttctaaggatcccatgagtcccttttaaatactttagggatctttaatgtagctcccaatctggcaactaagcttttgtgaactttatgcgcttgtctccattttaccaatgttgaagctaagagtttgcccaggcatcctgcaggaagtcttaaagcccagctcagaacctattgtccctggcctctggaattcagagttatagaaaaaaagggaacctgggagatcaagtacctcctcaggtggtccttagacccaatgatgtttgaagaccctttcctagtaggtgactatttcttccatggcagcataactataactgccataaagaccctgagatagaaggtggtacccagaaagtgtgcaacagaagggctaacataacatccagccaactatgaatcttcccacacaactgaattatgaagttaactgtaaatatctcacaagctctattggctaaaaaagttaaatcaagggacaataaagggaagatttaaagaaattaaaatgtaaacacaggttagtaactactgaactctggcattttcctccgctacttttaattagttgtcttcatgctttttgcctaagaaacaggaacttgccactgcaactccagggacaacattctgggcttggtaggtccctgccttagacacgtaatcagaaaacactgaaaactgtttgcccttctcagagcgaagggcctttcacattgtcccttcatacactgctgaggctcaggaccatggctgctttcaggctgtgtcctctgaagaaagccttttctatttctcatcccttttggggttcaatctgcccatgggtcttaggaaacagagagattagaaacagttaacagcattgcttaaaacctcattcattcctttctaaaatatttacaggatgcctatggcaggacatagcagtaagcaaaatagactaaatctctatcctcaaagaacttatgtcctagtggggttaaaaaaaagacaataagcaaataaacttgtaaatatatgaaatatcagatggttaaatggctaaaaagaaaaagaaaaacagactatgaaaagggagaggggttctgggagagggtgtgcaattctttgccatgatgtggtcaggaagtcctcactggtgagtggatgtcagagcagtgatgttcagggagtcaggaagagagctctaggagcaactgtggaaggacgctccctcagaggctccaggaaggacaaagatcattcctttaggggtcctaggaaagatttcagggcacaggtctctgcagtctatgatttccaaaggataacggataaaatggccctcaagcgtgaagtgctgttgctgcagggttggaggctctgcccaagtcctcaggcccctgaggcccagtgagtgacacctagcttcagggttagaccatgtctgccttgtaggctggatatcttcttgtggttccaggtcttaagacaaggtttccagggagagaaagaaccagggccctctcaacgctcctcaagaaacgccccaaatccacaaaaacaccacattactctctgatgaagataaccctgcctatcagctctgcatcgcaagaggtcagcccaggcaaacctgctactccccaaaagcatctctcatggggttttattgatttgtgcttctcctctgagtacttgctgacagcaatagtgcagcgacagtaatctcattgtacaggtgtctctcccacactttgtacgggtcaagtctgtcttttcaaatctgtgggtacaggtgatgttgacagagcctggagctgtttacaactcgcctctttcctctaccatctgcccaggtcttgggtcagagagaatccctctgcttttgattgttgagtgccaggttgatctatttgcccttgagatcatccagaagtctccattatgccacatgagtgggtgtcacattttaatagattcttaacatattcttctctcaccactgattttacttattcaatttcccacactgaagactattttattaatgaactaccctttctccacctatgaattaaaggtggctaaactctactaggccagctttcccctgtgccagccaataaatttctattttcaagccttgttggagtttctgccttatatctaaaaaaccatttaacaggtgggactgttctcattggaaagagctgtcctcaaagcttcattccctctctgacctccagagtcaccctagggtcaccctgagagtccttcttgtaggcctcaaagaggtcaaaggattttccttagtgcctctctacaatcgtgtttcagaagtgttattaaaattggtgaaaggctttctgttccaactgtgcctacacaaaagaatcattattaattggacctttagttgccaactgaccaattttttctttgctgatggaaatcatgggcttttccaaaatgtgcagtcctcatgtcacctagcacaacaggccaaccagaggccacatcagctgtgtgtgcacctccacccaatagcaaggtttctaaccatgaagcacactcagggaagaaatgagagcaaactaatgaaaggccaaaaacttctattactactgcttgcccttagggaaatattaggcctaaaggagcctatcttcaaggacaggatgaaggttaaaagatgtgcttcccttaagaaaacaattagcagctgtgctagggtttccttgagacactaacaataatatcaacaacttctttcttagctgttagaaaggaaagaaaaaggatagtgagaataatgtaacctttagttttgattgagaaaggtaccggaattgctcaatgtcccatgaaatccatttgaatggatcctgtttaagcgtgccagctggaagcaatattatttataaaagcaacaggcaacattcagtaaggaaacagaacctgtgaaataatgtggaaaaattttatttctaaacttccattcttaatgcttttctcactgggggtttatataaattaaacagattttgtttgagtatttccaaaactccccaaatctttcactgaatggagtgctttctgagcactttttgcatggaatttcacagacccaaggatagagatacagctgggaagattttggatatcattaaatttagaaattgcctcatagatcaagaagaagtcagaatctctgtttaaaaatccattgtgattgctggagcatgggagccctgtgggctgtgtaggatgtaggatcacctcagcgtgccttgccttctctcctcaggctcctgagggtcactctgtcttagaaaagagaatattcaggaagtcacagagctccttaggaagtagcctatttttcacctcctgtgctaagataaatggtgacaaatacttgaatccaaacatggttgtttcgagagaagcaatgaaagggattaaaagtttttaatatgggagaagactaggttggtagttgttcaagcacacaaacttcatctttaagataatctggatacctaaactggaatgccacaatagcgctgtcaaacattttgaccagattttgatactcttagaaaacaaaaaactaaggtatcttcatcaagtgttttcttgaagagttttaaggagtattgactaagaatggataatcacttagaaaaggtttgagaatagcatttacttattttctaatctattaaaacacattaatataaaagcacatcatccacaatggcatagagtaacagttcagagaaacagtctagaagctaacaagttgtattagtggtatctgtcttagatcatcaagagtacaacttttgaaatatgacttagagctaaaactctgagtagaaatatctcctcatcagtcataaatggtgactttcaggtcagcaggagccttagagaccattttgttcaaagttgatgcaagactggaacctctcagcagcatcccagtacttcaaggacagcccactctgctccatcaggaatttctccagttcttagaggtttatatccctccattcatggcatgagtggctgaagctgtctcctggacatgacacttgggttttccagaaaggtccacacccctaggtgcttctgggaggttcctcctgacaggtctctaactgctccaaacatatacattcttccttttatttatagccaatgatgtacattttatatacaatctatatacattcactttatggagggccaaagatttttactagttaaatagaagatgaatgattgtagattattaatatttgaggctcatcaactaaacttagccacattgttaaaatttaaggaagaagatattccgtaagaagatattccatatttaatgcaatgcttggcagtactagcaagctacttctatgaacatgaacaagtagttgatttttggtttttaattgttgcattttttgggtttaaattataaatgaatgttactttagctttatcatttttgatttaatttgttgagatttatttggccatttattgagggtcattaggttaaacattatttggatatttggttgatgagtattagcattaatagtataagctcaaactgcaaattgtttatttttttcttctaagttgtcactgggttctttttcaattggaaaggtggaatgaatcagagagatggattagaaccataaaaaatgttccacatcactaatatcagagaaatgcaaattaaaaccacagtgagataccatctcacacgagtcaggatggctatggttaaaaagtcaaagaaacaacagatgctggcgaggctgcaaaggaaaaggaaaacttatactctgttagtgaaaatgtaaattcattcggcctctgtggaaagcagtttggagatttctcaaagaacttaaaacagagctaccatttgacccagcagtgccgttattgggtatacacatccaaaagaaaaccaatctttctactgagaaaacatgtaggttcatcacagcactattcacaatagcaaagacatggaatcaacccatcaacagtggattggataaagaaaatgtgctggaggccattatcctaagtgaattaatgcaggaatagaaaatcaaataccacatgttctcactttgaagtggaggctactagatgggagagggagggaggggggcaagggctgaaaaactattgggtactatgctcagtgatgggatcattcatatcccaaacctcagcatcacgtaatatacccaggtaacaaacctgcacatgtaccccctcaagctaaaataaaagttgaaaaaaataataataaaataaaatatttgttaaaaagaaagaaatcattttactggagaacaagaataaagaccatctctcaagcttctccatctccaatgttctgaccatgccttggtgataagtttaatagagtaattttttaaaagaggaacaatgttttcatcagtgtgcttttctccagatattttgaaatcaaatagtaaaacttgtgtgtatatttatttttaaaatatgacaaatgaagataatatggaaatgctgaatggatcatgatttgtgtagtggatgaattatgtcacctacagaggcctgcgttcccaaatgtggtggaagtgagacatttgtagggctgtctgggccagctctacagaataaaaaaattacacaaagtagggaaaattcccaaaaagccgaacctttttcagagaagtcaatttgtccttcattgatctgaggaagagtaaagggagtaaaggcttctcagtaggcaccaagtacccatttggtctgtcaagatattagatcttggtagcaaacttcaaagggcagtttctagtgcttttttccagcatttgcttttcttgggccacacaaaatatccaccgtgtccttcgggaataaagcctgaaagaaaaagaacagatcccagttgtttagaaaattagcttatttttattattctaatggtgaatgattagccttggaaatgtctgattttaaagatcttgtaatttatactggcatggtttatggtgtctttaaatacggaaccaatctgttcttaaatatttaattagtgtaaaagaattgggcgtggtctgcggaagaacgccttgtgctgtctattgtcattaattcagcagttctcccctgcccagagacagctgtacaatgtgcaagggctgtcctgaaataactggaccaacatataaatgtcaaaacaataaactaatgcttcccttcaacttgatcatttggtcaaatgctaacttccaactcctccggcgcagtctcaccagtacctagacagaaaaatgagaggcatatacctcaactctacccatgtaaaatccttcaccaaggtcagcaatttcctacccattatttgctaagaatttttttttcctttgagactgaggctcactcttgttgcccagactggagtgcagtggcgcgatctctgctcactgcaacctctgcctcccaggttcaagcgattctcctgcctcagcctcctgagtagctgggattacaggcacctgccaccatgcccggctaattttcatatttttagtagagacagggtttcaccatgttggccaggctggtctcaaactcctgaccgcaggtggtctgcccacctcggcttcccaaagtgctgagattataggcatgagccaccacgcctggcaatttgctaagaatttgaagacttgactccacgattcatttttcagtcttcacccaatcatttcaagaaatttaaagcatccttcaagttctatatatgtggtctcgagaaaaggttaagcttctcctgagtaattagaaaccctagggaaaaatgcatcacacctttagagtcatctggtagactactaacaaaaagacaaaagaggttcattagaagtagtatgatctttgtttgccaattactgttttcctgttcatttaataaatacttagtcatcatctgttatgagccaggctctgtgcacacatagtgacaaacaacatgaagatgattgcctgtgtctcttctggtactttcagaccagtggaggacatcattaaattaacagacatttgtaaggcagagtgtagcatgctaagacagggtaaatatgcatctttgtgacaacatctgggaatagcccctaattgagcctgagagtaggtggggaggtctctcagaagaaatgaaatgtaagtggaaatatgaagtgtccataggaatagaggtgagaacatcaaggagaagggtattatatttagtcccttgaaaaggaataagggcatttcttggaacagaaagttgtccagaaataagggtaaggaggtaggcattgccaagagcagttggtagccatcaggtgattttagatatagtcagatttatattatagaaacagactgggagcaatgtggagagaggattggagagcatgggccaaggttagctactgcagcaaacctggttgggggcagatattggctctcctttggaaagaggtaatgaggatagacacggaagccataatgggtgggatggtgagagatgggagatgtctagagggagaacccggtatgctgctccaagagcttgggccagagagtggaaggtggcagcagtcatggagaggggggagtctgttgaggagcaggctggggagtaggctgaatttgattttgaacacactgccttttggaatatctaagtacatgtggtggtcaagagtaagttgaaaatgcagatctgaaaaagaaattgcaaacaggattggaaactgttttaaatacaagtcaaggaaacaaatgggaaatttagatcctcttttatatgttttcctagaattgttttttggtaattataaacatcctttggaatcttcaaaggggaaaatatcatctcccacctttgtctttcaaatatctatgacagcactataatttctaatgagcttgtttatttttaacattattcctgggaatcaaagagaaaagaatagcagggaataaaagaaattgctataggaggagctaggtgaagaacacctacaccatgaaatatagttttaatatacaaaaaatgaaatagttccaatctcataaaatatttgcaaagaaaattagatgcatgaagaagtacaacatcttagtgggcttttattggtctatttttttaaaggttacttaattctcagtttactaatttccagaattagtgtttttgtgtctttgttgatttttatggagtcaattaaatacagctcaaggacgtggcagtatctttccccaactgtagcccccacaactgttactaataacaacacaaacacagacaaaggatctttaacaaatgagaataacataccggtggcttgagtagagtcatgaaggaaaaaatgtactctattttttagtaaattatccattttcccaaaaatttgcattgtgaaatggaatgaaaaataaaacatgaactcatatttagtacctactttatattcattctaaatttattttctaagacttagaactgtttttaaaacagtctacattgtcaggtcatgatacaccttatatagcaaagggggaaaaacagtgcaaggctcacatgcaaaaaatacacagatgcctttcgcagtctcaaaaaaaaaatcaaggattcctgtagcacgtgtgtgtctttttctggttgatttttagtcaagagtttggtagatacattcttgccctgaccaggcttctaagatcagtggtttccatttatttttgtagagactgaagaaaaggaatgactaccttgtgtgttagtctgtgagggctgccataacaacatgccacagactgggtgacttaaacaatggaaatgtatttgcttatcattatgcaagctggaagtccatgatcaagcttccaggagctttggcctctctccttggcttgcaggcttcttgctgcgtccttatatgatcttccctgtgtacatgggcatgtctagtgcctaaatttcctcttcttacaaggacaccagtcagactgggttagggcccactctaaagatctcattttaacttaaatatttctttaaagactttatgtccaaatatggttacattctgaggtacagagggataggacatcaatatgtgaatttgtgaggtgggggacacaatttggcccacaacattctcttgcctcaagttagcatgcaggagatcaagaacaatgctaaaggtttttgagaaaaaaaaaaaaacaggaaagtttccttctacccctgtgactttataatctacaaatgaactaaaaaacgaataaaactactcttctttatgaaaaagtaaaaatttaaatttatctaaacacagaatgttaaaccacatcttaaggacatattttggcaacctatggaaatcctaactgagtatctgttaatgctctgttttcagcaaactcacctagcaagcttagttagaaaagaggcaaacctccagggctggcgagttatttatggttaattctgagggatgacacttctaaatttgtacaagctgcagctcagctcatgttttctgtaaataagtactggagacattctaattccagttgagttaggaggttaagccctaaaaacaaatttttctccttaaaaactgtgtcttctatcttgaagattttgtattcttatcctattaaaaatcaagaaaagctatattttttaagttcataagattttggcattaattgtagtaaaaattaaacatttaaaatcaagtctgtaatcatcagaagaataaattgtgctttaaaatcttcaaaatcttcaaaagtgtgtgtgtgtgcgtgtgtatatgtgtgcgtgtgtgtgtgtgcatctgtgtgtgtgcatgcacatctccagtcattgaattaacaacccatgttgcatattgggcatttttatagtctgagctttctcacattactttcttcccaacaaaattcaatgcctatattgtgtgtgtgtgttttttaagtagttcttattagaaaataatcacataatgccgataaggaaacaacttatggaggtattaatcactggttatgacatacttatttaaagtcttggaaataaacaaaatgaatacataaaggtaatctctaatgatagaaattcaactattatagcatattcaaattcattaatataaacataattaaaaatacacttgaaagtatacatacacacatatgtacacacatactcctgattaacatatgatctttaaatattacaattcacattatgaaaacttagaaaaagtacataataagaatattatgtcaaaaaatcttgtgaaataaaatttaatttgatacaaggaaaatcaaaacattaattgcaagttttttaaaactgtaaataagttaaattgctaatttaaaaatgcaagataaaaatagcatagtaaattcaaataaatagaaggaattaaataattaaaggaatagaaaaaaatatgaaccctggcaaatcaatttttaaaaaagaaaaagaaaaagaacaacccagtagaaaaataaccaaagttatgagaaagcaaaagttacaaataaaactgaatagctagtaaatacatgaaaatatctttaatctcaccagtattcaggaaagcagaaattagtacagtgaggtacaatttcacactcatctgattggataaaatagaagaggcttcaatactagagaagaagtgaaaaataggaagtcttgcaaaatgctggtaagagtttacactggcggaatcactctagagccatgaggcaaactcggattcggatgaaaatgcatgtgtcctctatctgtgcaatcccacttctgtgtatgtaacctgaagaaactcctgcaccagaagaatcgctgcaaaatgatctagacagtataatcgcattaatgtgaaaatttttaaagatatatgataagggcataaaacacgcctgtgataaaggcatatgtaaaagaatcagtggaaaaaaatagagtaacaacttttttcaaaaacacagaaaaaattacaaaattcagaatagtgattgcctctggggggaataaaagggaaaacagaactggggattagaacaaagtagatatcaaacttagtaaataaatatgacacacacacatgcatacatgtatatttaatatataagttaccaataagagctgaaccaaatcaccaaaacccaaactatatatttatatcttgttcatgttcacatctagctaaaaaccaaacaaaataaaaattccctggagcatgggcatctttaaattatgttacatgtgtcagcaagtcctgtctactgtgggttatcttggggcttcaatctcctaaatattgaaactgtagccagaatagctaaccttttcaagcaattataatattctcctctaagccaaagaaaggagttattctgcaggctgatagaatttgagggaaaaatttaatcgtggccacattaaaaggcttagccctcttgtaaaagatgatcttattcttaggttattgtctgtgtagctcttattcagaaaatatagattggagcaaaactcaagtgttaacattcttataactccttctttctcatttcgcagtcctgccttgttctttttcactaatgggttgataatagataatcagctaattaattctcctatggcatataatttatacctctactctatcatttttattgtttgaattattttattaaaattgcatcttgtcagaattattttacatgttcatcactttcaaaattatttaggcttttaattcactgtcctattgtccaatggtgggcacatgcagagctcactaaataaatactgatttgaacttctttgaatgatctcttctggtctctgtttatattacattataaatataaaatagtaaactccttgagagcaaggacattatgttccatgtatcctccttatactacatgccatcatacatatagcaattgcttcatattatttgaatggttgtttaggtagaaggataatatttttgtttgttttctttaccaaagcaaagctgtatttctgttaatattcagggggtacctgtggttgaaagctagtatttctttgcagatgacctgtttgtgctcctagaattaataaacctatgaatagaaaacctatattttctagatttgcaagatcagatcactgcagttagcaataagtgttacagtaagctgtataaaaaacaattcagttaaattttctgtctcagaaaatgtctcaatttttaatcaagacagagaacttgaaaatttctcttctatcatacaccagaaaacgtacacaatgtttaccatgcatccacaattaagtgacaattagagatcagcttaagaaaatggaaatcataatgatgaaaggtaagagaatatgccatcccaaaatatgccactttgacataagaattattttgagctgagggcaattgagctacaaaaaagcctctcttccctcttcctatttgtctaaaagcaggacataaattggtaaaggtgttcttactcccctctctgcccaaataacagaagttaatcaccagagatgtacctagacccttatcagcccagagatggcactagaggaatctacaaaacagattactgaccagcccatatctttcattagttcccccatatattaaccttcccacaatttgttgccctagaaactcaaagtcctttccctttgtctcatcacttgtctaaaaaatgtattgttcttttgttaaactatacaagctgaaattctaaccactcctttgagttactcatcaactgaatactcccatgcacggtgtacagatggacatgtaaataaacttctgcttttctcgttaatctgtctcttgtcagtctaatttatagggccccaaccaatgaacctaagatgagtggaggaaaaataacaaaagcaaaactttaatatcaattatagtgcttagacaaactttagaagacatacaaatgtgttttatagtattacatgcgatattcatagtatctttgcaggcaagaatttcaagttgaaaaataagccaaaattctcaccagcagaattttttaaagggagcaactgttgcgtgcaaacactaatctcccgggcgcagtcaaacaataccttccccaagggtcagctgctaattgttaaactctctagcgaatagtaaaacagctgtgtcttgaatctgcaaaaacattatcatctaatgagtgaagaatatgtgattgtgcaataataaaaagggcccagtgtgttgttaagtgtgccagtagcacaaatgggccagtgtgtatatatatacatatttttttcttttacaaagcagagaaaagcagatttttaagttattagtaaacttgacatgaaaatattaaaatgaaatggttccaaaacattttctttctcttcagccagtctatcaactgtctcagaaagcatatgcaacttgagaaaagaaataaaagtaatgatcatgtctttaaatcctatttaagctaaaaggcaggatgaaaagaaaattatttaaactaaagttctttctatgtggttctatggtatgtgttaggtattgataaactgcatcaaattttacaggaaatttacattctcaaataaatgttatatttattgaaattaaaatattaaggataaaattggttcagtttacacatcaggaaacactccatatggttcagcagtcagcacaaaatctgaaagatttcccaaattcactctgatatttttcacttttctcagcatgttccttttgcccagtttctaaattcctaatcaactttcacagtcttctctgaggatgcacacagtgttttcttcctttgcatgctggatgtctcttttggccctcctcaaatggcactttggtttaatggtgattctggaaatatctctctccctctattagaatgtgcgtaggtttgttttcacactactgtaaagacatactcatcactgggtaatttataaaggaaagaggtttaattgactcacagttctgcatggctggggaggcctcaggaaacttagaatcatggtggaaggggaagcaagcatgtctttcatggtggcaggcaagagagaaagtgtgtgtgaagtgaagagggaagagtcccttataaaaccatcagatcttgtgagaactcactcactatcacaagaatagcatgggagaaaccgcccccatgatcaaatcacctcccaccaggtctcttcctcaacacctggggattacaattcaagatgagatttcggtggagagacaaagcctaaccatatcattccaatcctagcccctcccaaatttcatgtcctcacatttcaaaaccaatcatgccttcccaacagtccctcaaagtcttaactaatttcagcactaagtcaaaagtccaagtctcaagtttcaccttaaataaggcaagtcccttatgcctaagaacctgtaaaatcaaaagcaagttagttacttccaagatacaatagggctacaggcattggataaatgctcccattccaaatgggagaaattggccagaatgaagaggttacatgccccatgcaagtccaaaatccagcagggcagtcaaatcttaaagctccaaaatgatcttctttgactccatgtctcacatccacgccacactgatacaagaggtgggctcccatggcattgggcagctccacccctgtggctttgcagggtacagcttccctgccccagctgctttcataggctggccttgagtgtctgtagcttttccaggtgcatggtgcaagctgtcagtggatctagtgttctggggtctggtggccctcttctcacagctccactaggcagtgccccagtggggactctgtatgggggctccaatcccacatttcccctttgcactgccctagcagagattctccacaaggacttcacccctgaaacagacttctgcctggacatccaggcattttcatacctcctctgaaatctaagcagaagttcccaaaccttaatttttgactgctgtgcacctgcaggctcaacaccatgtgtaagccaccaaggcttggggataggacccactgaagcaatggccttagctgtatgttggccccttttagctacttttgggatgcagggcaccaagtcccaaggctgcatagagcagcagagggcccctggaccaggcccacaaaaccagttttccctcctaggccttgggtctgtgatggcaggggctgctatgaaggtctctgacatgccctggagacattttccccattgccttggtaattaacatttggcttcttgttacttatgcaactttctgcaacttattaaattcctcctcagaaagtgggcttttcttttctactatatggtcatgctgcaaatattctaaacctttatactctgctttccttttaaacataagttccaatttcagatcatctctctcaagttgaaagttccacagatctctaggacaggggtaaaatgccaccagtctctttgctaagcataacaagagtacatttgtttcatttcccattgcctctacatttttgggtatctttatcatagtacactactctctgagataccaaattactgtattagtcctttttcacactgctataaacacatacacaagactggataacttataaagaaaacaggtttaattgactcacagttctacatggctggggaggcctcaggaaacttacaatcatggtggaagaggaagcaggcacatcttatatagtggcaggtgagagagaagtgcaagcagggtaaatgccagatgtttgtaaaaccatcagatgttgtgagaactcactcactatcataagaatagcatggaggaaacgactcccatgatccagtcacctcccactaggtctctccctcaacacctggggattatgattcaatatgagatttagtggggacaaaaagcctaaccatatcagaatgtaaacactttgtgcacagggattacacttcactatggccaagagccacctggaaattggcaccatttgtctccaaacaaatcttcattattttgtactgatgaataagaattagaccagattctggctaattcagtggctcacacctgtaatcccagcactttgggaggtcgaagtgggcagatcatgaggtcgggagatggagaccatcctggccaacatggtgaaacctcatctctagtaaaatacaaaaaattagccaggcatggtggtgcacgcctgtagtcccagctactcaggaggctgaggcaagggaattgcttgaacccaggaggcggaggttgcagtgagctgagattgcaccactgcactccagcactccagcctggtgatagagcaagactccatctcaaaaaaagaaaagaattaggccagattccataacatagattctgaaatgtgaactctctattaagtattggttatgcaaagagacgttatctacccaattctcaaccccgcatgggtaagcaatcctgttcagtcttctttcatctccctgactcctacaatgccttcaaactttgcctcactttgtagcctctgggaaagcaagaagcctagtttctacagcacctagcacaatgtcacatatagttggcgtgagtattaataaggacataacaagaataatgtatttttgtttcacttagagaaaattatagtcatggtcacttaaagagttctaaattgttcaactgaaaatggaaagatgttattaaagacttttaattggtgatactgagaaaataatacctcttcgtcttcaggggacattaattttcaagatgcattttaattatattagtaaacatgtatgtactcaggaaataaaagccacaattgacagtgtttattttctgaaggtggaataggtacagaatgtctttctcaggataggtggatgggttgtcaagaatgtgcagtcttcccatggtctctcttaaaacttccttttcttaggtccactgaaaccttttttaaagactgagttctgctacgatggttacttgtacatttcacctccttgttgccagtactgagaagaggtgaaaaagaaaatgaggctcagaagatcaagagcgctaaaaatgtacacatcagattgcctagaccccaatttccatattcactcttcctgtgtatcccacactctctcctcaacactgtgaaagcagcatcctgtgtgtagtctgtacttcagtggtgtgaccagaactggtaggcagcaaagactgtcgctggggtgactcagcctcaaacacactgacagcctgggcctcttcccgtgagattacatcccctcccaaggaggctgaacaatgccaagtagcagctccacaggaagctgttattctctttaggtaaatggttttcacctgaaccctggatttttcagacacttaagacatacaggtcttcctccatatggaaggtatacactcttaattctcttgataaactgagaaaggcctgataacttaaaaataagtataaacagttcttggaatgctaaggcaataataaggctacctattacaagtgcttaaggtgaaaaactggaaacaaactaagtgttaaattacagtacaactccacaagaggaagtagatgaccattcaaagtcatgttatcacagaacatataatagcaaggggaaatggtcatcattcagtgttaagtgaaaagagaggaatacataaccacatcactacaaatgttatatgtattagtatgctacaaatgttataaagtatgttttaatgtacataagaaaacaaaagccaggaagaaaatataccaaaatgttagcaatagtaatcttagtagaatttcaggtgatttataattctttcttaaattttctatttttaaagtttttataatgaatacaggtcaacttttaaatcacaaaataaaaataatcattggtttttaaaataataaatttgaatatttttataaagatataattatggagaaaagtggcaagtaccattacacaacattgcagggaagtggtcaagggactgggctctggaatgactgtacagcctcgtgaccttaggttaacttctctgagctgtgtatccttgccgattgaatagggatactgtatttcatcacactaagagtctatggattgtaagatatatatatatatatgatccttttatgtacaaataagagtttttaaaaatactgccaatactccatcttaaggcaaattcttatttcagagatttgaaaaaaaatgcatcagagcctcaaagaactatggtaatatttgcacctacttcataaagtttcatgagaattaaataaaacaatctatgtaaagttctcagaagagcatatgacacttaataaacacttaacaaatgtgagccattattgcagactcacttaggatggctagcaaagaccctgagggtgaaggttgatgtttcaatttgagaggtctgagggtggctgtcatgaaaacctgaagccagagtcccctacccttgctggctaggaatgagagccacaagtagaaaatacagccattgttttagaaagcaacattacataggattcttggacttgacattcttaaataactgggtaagaagttaaatgtataaggctgagaaagaaaaagaggaagtgaagaaagtttgaggttggcttaagttttataatcgtcaaattatctctgtatccctaatatttattgagtaaccacaggacacacagagccctgtagttgcatgggtggagtagaaataaagcttcaaagaaaaaaagcacatttgcagtcttttttcttagaacattccaaacaagtaaacaaaataaagacatacatataggaaaacatgcaatgtatgtgcctataatggtatacataaatgtcaatagaacagaataaagacaagtacaaaaatgaaggtgtggtaaaattattttattaaattattaattaatttattaaattgttaaattatttcacatttttttgagctgcagtaagactccaggaagttaagcactttttgaaaaagacctattacgactaaatgtaaaatattcatcattatctaggtttaagagcaagactagtgaaagagaaagagttactagaagcaataaaaagcaatacgtttcatcatattgctcacttaagggttaaatctatcatgtttttaattactcacatataaagtttctaccaaatatttaccatgtgggtttttaagtttgatgaatgtaaaagcactggcacaggcttcagctaggaagtgaagtaaaaatgttgaccaagtgggagaaatctggcaaaacaagtcaaccagaaccctgacctttgagccttttcaggttttgtatagaacaaatcttgtatagaaataagatgtgacctggaaatggtcccaaaaattgaaatactttacagtgccaggaacaacatcatgtcaaacaaagaggaaaaggaactgttagcagaaagacatttcttcagtttgtatgtgcccttaagaggcaaattagtattaggatgtggagcaacagtatagtggagtccgaaatacacttttagcttatggtgaattttgaggctcaagagaacaaagcacataatttcggagtatattataacctggaagagctgagcccttcagatttgtcctctgagttcccaaagtgcattactttctctcaggggaaagattcatcaatgtgcaccagatggggttgaagggaatgactgatgttcaacattttgtgtgggtgttgatttgcaaacaaggagtgattttttaaactagcatctgtgtttgccaatttttttttaatcttggttttcattttagaacacaatctttcaagttttcataaaatggtagatttctttgaatactagaatgaaagaggcttcatctgtctcctagtctgcattattccatgtaacccctctggagcaagaaaggcatgttgaggtcctggagtggggaggccctgtggtccatgctgagctgcttcttaacatatactcacccttgactacactgtcttagaacaaacggagttgtccaacgtgtgtatgggtggctcccatggtcatgagccatgacccaagccttgggtcaccagcccaacgagtgatcagtaagcatgccttggtatgggggcagttttaatgtttggaccagagggaacagctcttgtttctacaggggccaggcaggttgtgtaaatgagttcagtgaagctgcagtgaaaaatccactgagcaagtgcaatgatgaatgttgactattgcttggcctcaatgaggacagaaaagggagtgacagaggctgtgttgacccagagaagacaggctctgttttaaagggggagccaccacttagctcccattgctttttgtaaggaaaatgggcggaggtgccagctcctctgaattttctagcagggctggcttcaagggcatgcattccctgcagtgccccagggccagcactcagaaggacccacacctggtttgatgctctgctatccccatcttgaaattcttttttattattagtatttttaatttttctagagacaggtctcactttgcggcttagcttggagtacagcagtactatcatagctcactgctaactcaacttcctgttttcaagggatcctcctaggagcctcagcctcgaagtagctgggatgacaggtgtgaaccaccatgcccagctaatatttaaattgtttgtaaagatgtggtcttgccatcttccccaggctgatcttgacatcctgggctcaagcaatcctcccaccttggccttccaaagtgctgggattacaggcatgagctactgtgcccggccaaaattcttaataatttttgaacaaaaggtacctggacttttcattttgcactggatttcaaaagcgatgtagccagtcctactttcaaaagcagttatacatgtgtaattttctacaaaatattccaatttttaaatattggcaactaattgaaacttttgaaatgtagtgaatgctacacatctgcaagctaactggtctagagttggccaacatgttcacccctctagattgcctcaatgattatactagaatcttagaactcagagctatgatgtcttagatgcaacctggctaatcccctaattctctggatgaggaaacaatcaaaagaaatgaaaatggaaatagagactgtcacaacttccactatacagggcctgttgggagcagccttcctggacatactgcctatggcgaaaagtgcaaggaattggagtttcatggcatctgtgatagtgtacactttctgcttcatcaccttaatttcctgggctgtattttagtcaagtttttttttttttttttttttttgagatggagtcttgctcagttgcccaggctggagtgcagtggcacgatcttggctcactgcaagctctgcctcctggattctcaccattcttctgcctcagcctcccgagtagctgggattacaggtgcccgccaccatgcccggctaattttttttttgtatttttagtagagacgaggtttcaccatgttaccccggatggtctcgatctcctgacctcgtaatccacccgcctcagcctcccaaagtgctgggattacaggcgtgagccatcgcagccagccaaaagttttttttttaatctcttagtgacttcaattttttgccagggatttaagccgttgttgattttattatcatttacacagtaattatccaagaataactcttttttttttttttgagacggaatcttgctcagtcgcccaggctggagtgcagtggtgtgatcttggcttactacaacctctacctcccgggttcaagtgcttctcctgcctcagcctcccgagtagctggtattacaggcatgcactaccatgcctggctaacttttgtatttttagtaaagacgggatttcctcatattggccgggctggtctcgaactcctgacctcaggtgatccgcctgcctggccctcccaaagtgctagaattataggcatgagccacctcgcccagccccaagaataactcttgacttagccagaggcaagaaatacattaccagatcctacccaaggtctgcaggttttcatgtaggcgatttctttcttttccccttccttcatgccatcagctttgataacattctatgtgatgtaagaagggaaaaaagtagcttaaacaaatgtaaaaccatattctagtttaactgttttaatcttctttatattagcacattagaaaggtgtgcattcctgggttatcagacattatatggaccagctatttttatagattttaatttgtgttgaacccatccctataaaaaacgtaaaataaacaacatcatcccttttcaagagtctgccagtgtatatttctttgcctttatggccccatttttgtgtctttcttcttgccctgttccatggcatctcataagacaggaaaaatcttgcaagccatcagtaattgaatatgtgctttgacagatcctgcagcaggcaatgaatacatttctcatagtgaaaatttatacctgaagctgtgctagcttaatcatttcatccctgtttgcctcaaagtctaattttcaaagtagattaaacttgttaatgaggcaacaggatttagagacaatttagttgaaagatattgtgatgggtaagacaggtgatttcagaaatggatttgacaaagactacaaagccaaccatcacaataacagagctgagtagaatagagcccgagttctagacagattcagggtttggtttaacttaagcaatttttctttggtatgctcacccctgccttgtgagggtgtctgctcctgcccaggtcactctgagcgacccggtgaatctttctcatccagcactaggctggatttccctctagcagagacaaagggtgaggagacagggctgtgtggcggatgagtgagatattttggggacgcagcaggatgtggatggtgtggctgctctttgtgcattcacagtggcagcctgccgagcagcccagccaacagtgccctgtctttgctcttttgttgtttcgtaccatgtggtgccagcaatattctggcagctgacaccgtcagcaggtgtccctaaaataccaagaaaccctgggaagacaggaggaggaaataatgtctgaagcctcacagggccttgtgccaccatttcagcggaattgacttttgttatttgtttattattttttaaaccaaagggcgccacccttctctttgtggttctttgaagatagcaagattgcactgctagtctctgttcttaagaagggtcatgtgtggaagaacaaataaccctgagatactaagaaggagctggatggacttgaaaaagcagcatttggaataaaactagtaaataccaccatctaagaaaagcaagaaagatgcagtttttattttaataaatggctgttattagccaagaagccatgttcttgcctccatgtcagtcatggagactggagctgtctggaggagagtcagggagtgagttgggatgctgctagtaggaatagtgagagtgggccgccctttcaagacatgtggccacgaatgagagcacagggtgagagcttgaggggcatgtgcactaagaaggtggttcttttgttgatttgtttgtatgaaaggaaagtcttaagcatatttatagctgtgaatagtactgaggagagagttgaagtaataggacgaggaaaccacatgggacagacttgaccgagctcagggaggtggcatttgagatcattttgcaagccccttagtgaacaaataagacaagtgaggctcagaggaaaaacaaacaaacaaacacagtttactgatttatctgaaaaatttgtcatcaagcaaatcatttcaaggtatttgctagtttcccatgtgaattttgtcataaatgaagattctattgcgagcaagaccttgggtttaaatagatgatagacagaaacaacagaatgcaattttaaaaaaaaagctataactcttactttagcatgaaaaaattatgctgagtcaagagggacatgtatgtgctatacatattaatggtccctcactgtacccaaggagtaagatatcattcctgtgtatcataaatttgtcctgaaattaatattctaactactttcagtagaatgtaacctttataaaagccagcactttgtctttcctgcaatggtctcccttgaatctagaatagggcctagataagtagcattcaataataaaagaatatttgtttggccgggcttggtggctcactcctgtaatcccagcactttggcaggctgaggcaggtggatcatgaggtcaggagttcgagaccagcctggccaacatggtgaaaccccatctctattaaaaatacaaaaattagccagtggtggtggtgcgtgcctgtagtcccagctactcgggaggctaaggcagaagaattccttgaacccgggaggcggaggttgcagtgagccaagatcgtgccactgcactccagcctgggcgacagagcaagactcggtctcaaaaaaaaaaaaaaaaaattgttaaatgaatgaatacatgaaacaaggctgaatcttctccttgacctcttacaggcatctaaatgttaaaactggacttattttgcacccgttttcaccccacacaccccttacgcccacaaaagcatattatctttctttgtagtgcctattttattttgtttttatttttattttgagaaggagtttcactcttgtcacctaggctggcatgcaatggcaggatttcggctcaccacaacctccacctcccaggttcaagcgattctcatgcctcagcctcccgagcagctgggattacaggcgctcaccaccacgcccggttaatttttgtatttctagtagaaacagggtttcatcatgttggccaggctagtctcgaactcctggcctcaagtgatccacccacctcagcctccaaaactgctgggattactggcgtgagccaccgcgcttggccatagtgcctattttaattaaagatgtttccattcacctagtcaataaagcaaaaaaaaaaaaaaaaaaaaaaaaaacagggaaacatcagtgattcctcccttgtccccatttctagaactaatgggttcccacattctgtcaattctaccttggaaaaaggtcgattaatattttccctgctcagcatttccacagtccccctcttgtgcaggccttcatcatctctcaactggtcccgtgtttattttcatcatcaaaccagtgttatttccaaatgtccatccaatggttaaaagtatgactcatgattttctacagaacaaatttccatggtgctacctttaagagtttgcacaatctaatctcttgctatgctttgtgtttcattactttcccccatgcacttttgcccattcaaggtggacccatactttcacagtctcatgccatttctcatgctgtttcctctgtttagaatatccttgcctcctagccatctgataaaatcaaaattatttttcacatttttcctccattattaactcatcttccaagaagcttcttcccttgaaattcacatagtgaatagtccgttatatttttgctgctgacagtatttcttttaaagaccaatctactttcaaaagatatagaactttatgacagaaggtgaaaacagccaatttaatgtttaaacccagtatgtccatatttaatggacataaaatataaacagataagatgtttgacttccctcataactaaagtaagtcaaaatagctatatgtcattttgtacgtttctgattggcaaaatataaaagttttatttaaaaaacaggactggttcaagatcagcctgaccaacatggtgaaactccgtctctactaaaaatacaaaaattaccaggcgtggtggcaggcacctgtaatcccagctactcagaaggctgaggcaggagaatccacttgaacctggaaggtggaggttgcggtgagccaagtttgcaccactgcactccagcctgggcaacagagtgagactccatcttaaataaataaataaataaataaataaataaatacataaataaatgctcactgcaacctccacctcctggattcaagcgattctactgcctcagcttcccgaacagttgggattactggtgcccaccaccacacccagctaatttttgtattttcagtagagacaggatttcaccatgttggccagcctggtcttcaaactcctgacctcaagtgattcgcctgcctcagcctcccaaagtgctgggattacagtgattttttttttaatctctatgtttggtgaccaaactcctgagtggctacagttttcttatcattactgctcctaagcatggtcctggttctctcttatggttgcagtctgtgaagcatttctgtgtcctcctggagtcagtgccatagtaaacccttcacgtggtcacacaggctcagtctttttattcagagggtcataaaacaacttcacaacaaatggaacacagagggatttagccattgcccaacttgagagtgaacttggaacttcctccttccctgggcctgtttgcatttctgtacttttattttcttggtctgagtttacctgatatccattggctatccaattcctgaccttacttctagccttcatattttcttcctggagagcctgggtaactttccttattgaagccagtccaacaatagcaattaaaagctcaggccggataactcttcagggattcaaaacccatctctgccacttactagatgtgacttctcacctaaactctgccactcaccttggcctatcttctgtgccttagtttcctctactgcaaaataaaaaggctaataagagtctctaccacataaaattcttatcgtgttcttatgagttaatatatgtaaagtgcttagaatagtatctggcatgcagaaagtactgaataagaattagctatcattattacttcagagacacttaggtcgttctggggagaaaaggcagtatccattatttaaatttgaaaagacactagttatgtaaattttacattgaagataaactatataaaaggagcagtttgccacctactcagaaagaaaggcttctgtgtaaactttagaaatcctgtctatatagccaggtgtggtggctcgtacctgtaatcccagcattttgggaggctgaggcgggcagatcacttgaagtcaagagtttgaggccagcctggccaatgtagtgaaaccccatctctactaaaaatacaaaaattagcagggcgtggtgacaggtgcctataatctcagctactcgggaggctgaggtgggagaatcaattgaacccaagaggcagaggttgcagtgagctgaggtcgcatgccactgcactccagcctaggcgaaagagtgagactctgtctcaaaaataaataaataaataaaaggacattgaatttacttgaaattagtaagcctagactgccttattctccccagttctacagccaggattcccacctcctcagcactctcagcttagcagcccacaagccacaggggatagaggctgacttcaactggccactctgatctaggatgatctccagaggtctgtccagcttggctcacctctgttcaagagaatgtctgcaagatagcctcaggaattccagaatatagaaagagttggctctcctgggacaaaagagtgatttcgtcggccctgagagaaccttcctccactgcctacaagtacctaaataccatcattagagattcatatttttggccttaggctcctaaagcctgtaaaaggaaatgaaatgttgccaaatgagtaatttatacttgacttaggttagagatttgtaaggctcataaagaggtggagagagatacaagaccaaggaagcagaaacaaatcttcaacttctcagtaataccttttcctaaagccagtcctgtttcctaaactaaatcaagacttacagctcaggatccagcctgagaaaatttttttgtgaagaagaatctctcaggataggactcagaaaatccaaataagacctttcaagtctttagtgaaaacaagatcaattgcatttattatacctaccagacttctgtacttactcagatccacacttggagaattacaacaacaaaagaaataaaagagggtttatctgctttttctgataacatctgctaactgactgtaaagcaatagtagtttatgcctttaaggctggttgtaaaataaaggccgtagggattatagagcttgggatcagtgctgccgcctgaatctgtcgcttctttgcatgtggtttcatgatcacacttaatccccttatctctggcaggtgtagagccaccaggaacatcgcatatatttggacaagggcacccagctcaggggcaagtggggactaaaattcagctacattctgctggtctaactgagctccttgactcaggaaaggatccccccagagaaagagtaatttttaaaaattctcttaaaggtactcccagggctaatgcactagaatgcatctatctcaatgggcatcttttgctgattctcacaaaggtactccatggtgtgcagtaggcatcttggtggatattttagcttcccagaatttggaaccccttacctataacaaggaaattctccattctataggtcttcaaggaaagcagagcccaccgtataagcaggccaacgtcccttgcagcctggatgaaagaatatgatcagtcagatgtacattccctgcactgagagttgagagtttgagatgcacaggaaagggcagggagaattccttggggcactagcaaatttcggtttccaaagcagcagagggccaggtgcggtggctcaagcctgtaatcccagcaatttgggaggccgaggcaggcaaatcacctgagtttaggagttcaagaccagcttggccaacatggtgaaaccctatatctactaaaaatacaaaaattagccaggcatggtggcaggcgccggtaatcccagccactccggaggctgaggcagaagaatcgcttgaacccgtgaggtggaggttgcggtgagctgaggccacaccactgcactccagcctgggcgacagagagagactccatcttgaaaaacaacaacaacaacaaacaaacaaagcatcagaagcagaggttgcagaagcaacaagaagcacctgtccctggtgccaccatggaggctttgcaatctgggccacctgagactagttctgctgcaggattgggtgcttgtcctggcttctgcaaatctcccttgtctttggcctgttttctgatctcattctccaaatttctcagcagtaaattatttttattaaattggtgtctatgatttacaactaagaaccctgagcagggattaggaaattattctaaaatgttatcagacaggccaattcagcttcctaccaccatgcaaacctgtgtacctacttcttcgagaccaacattcacctagcttttggtcaagtcctctcccactatctcaggaatcttggaatatcaactatttatgatatttaatatcaactattcatatatcaactatccatgtctttcttgtttttttggttattgctgttgttgttttgtttttttgagatggagtctcgctctgtcacccaagctggagtgcagtggcatgatctcagctcactgcaacctccacctcccaggttcaagcgattcttctgcctcagcttcctgagtaggtggaattacaggtgcacgccaccacacctggctaatttttgcatttttagtagagacaggatttcaccatgttggtcaggctggtctcgaactcctgacctcgtgatctgcccgcctcggcctcccaaagtgctgggattacaggcgtgaaccactgtgcctggcctctttcttgtatttttaaatttcccttttaactagattcttcctgtcaacacttgaacatggttacatccctcccagttaagaaaaatgacttacattgagcccacacatctgtctagctattgctctgtctcagagtttaccaactggtttgccagaatactgtgtgttccaagaatgggttgtaggtgttctgtgatatattgagggttgtaaatatttatggtaatgaaaaattaaaccagttttataaccattcaaaatttaacagttaaaattaaatgtgaacactagttttatggtcccctctctgctgaagtcaataattcttattttgtgctcaaaatgttttccacgataccaaccccagagagcaaacactactgcctatcacacgtgcctcctctccttgacttccccttcaattattctcgtcagtctggcttagtcacagttcatcctgttgaaggtatatgtaaaatagtgcttgattttgcatttaattgaatttactcacattttcacaattattttctttacgcataaagcatatgtttgattattaccttgtttttacatgatagacaggagaaaaggtgggtgtagcccttaaggggagtacctgttcagcctgtggaagagaggcctctgcagtgttttctcacatgggggaagtattggctgttatgtgaaacacacagtcacatttacacactctgaggggtcaggatagccttcagagccacaaacttctgtggcattcacccagatatctccatctcacgtttcggggtcccaggttgtcccaaccagagcctcggctgagccctctgttgtctttgaagcttagcaaccctgactataaaactctgagtttgctcctcactgcagctattctcccataacaggagggagagacactttgtaagctactaaagatgcctggtggtcctcacacttagttcttaactgtttggcaactatcatcagttacccattattctctttaggcttcatcacagcaagccagttcattgttttcaaatgctgctatccctggccgggtgcggtggctcacacctgtaatcccagcactctgggaggccgaggcgggcagatggtcaggagatagagaccatcctggctaacacagtgaaaccccgtctctactgaaaaatacaaaaaattagccgggtgtggtggcgggtgcctgtagtcccagctactcaggaggctgaggcaggagaaaggtgtgaacccaggaggcggagcttgcagtgagctgagatcgtgccactgcactccagcctgggcaacagagcaagactgtctcagaaaaaaaaaattctgctatccccatgctgaaagagtctgaatctttgcaccaacccagatgtttactgtccaccagaatattctaccaagttaacaccagtggaagtttcagcaactggactaccacctcattccagggactatctatgccccatatgctacccagaatgggatcctcagtatcccttagaaacattattttccatatgtataataattcaaaaatgttaaaattcttccctttctcaaacacatacccctttctgaaccaagcactcttaacaagttgtctatgcttcctgactacatttgctaaattcagccacctttttttaatttcacaatttttatagataatacattcctagtgtacaacattcaaagcatcaaaagcacctggaggctgggcgtggtggctcatgcctgtaatcccaaaactttgggaggttgattcgggcagatcacctgaagtcaggagtttgatatcagcctggccaacgtggtgaaacactgtctctactaaaaatacaagaattatccgggcgtggtgatgggcacctgtaatcccagctactctggaggttgaggcagaagaattgcttgaacttgggaggcagaggttgcagtgagcctagatcacaccactgcacttcagcctgggtaacagagtgaaactccgtctcaaaaagcaaacaaacaaacaaacaaaaaacaaacaaaaaaaacatctggagtgagaattctccctctcaacccttccctcagccccatagtccttcttagagataaccattgtttccaggtgttgtgtacttccaaagatgtctgcttatgtgtttatgcaccactcgcttttcaccccaccctttcaatgactctattcccagctccccaaaggcaccatggcaccttcatcatgaaaccatttaaatctttattgcatttgaccactcagcagcctgcagcactgttgatcacacccttctagaaacactattcctttgggttccaggtcataacactctcttgattccttcctccaaacccccatccttccattcattctctgtcttagcaggctcatctttcttgatccttcattaaatccttgagttcctcatagctcaatcctacacattttttctcttttcactctctggtgtttccagagacaatctcttcaattaaatgccttcatttacccttatctgcagatgacttcctgatttgtacagtagtacccccttatttacggttgcgccttctgcagtttcggttacccacagtagagtacaataagataattttgagagagtccacagtcacataatttttattacaatatattgttataatttctctattttattattaatagttaatctctcactgtgcctaatttataagtaaaactctatcataggtgtgtatgtatagtataggaaaaatcatactaaaatatctatagcgttcagtttcaggcatccactgggggttttggaaagtatcccctgcaaataaggggtgactcctgcatatctaacctagacctccttgactgagcaccacactcatatagccaaattccaagtcacatacacgcatacctcagagatactgcaggtttgattccataccaccacagtaaagtaaataatgcaataaagtgagtcacagtaatttttttggtttcccagtgcatataaaagttacttttacactattctatcatttattaagtgtacaaaagctttatggctttatgactattacacacttaataaactatagaatagtgtaaacataacttttataacaatgtaaacataacttttcagcctaacttttataacaacctttataacttttataacaaaaacaatgtatataccttaatttaaaaataatttgttgctaaaaaatgttaacaattatccgagccttcagcaagtggtaatctttttgctggtggagggccttgcctcagtgttgatggctgctgattggtcagggtggtggtggtggtggatgtttgctgcactgattgactcttgctttcgtgaaagattctgtagtatgccacactatttaatagcatgtttcccatagcagaacttctttcaaaactggagtcaatcctctcaaaccctgccactgctatatcatctaagtttatgtaatattctaaattctactttgtcatttccacaatgttcacaaaatctttctcatccacaaggagcaactcattcattcaagttttatcatgagattgcaggaattcagtcacatcttcaatctccatttctaattctacttatcttactacttgcaccacatctgcagttacttcctctgttggagtcttgaacccatcaaagtcatccttgagggttggaatcaatttcttccaaactcctgctaatgttgatattttgaccttctcccatgaatcacgagtgttcttaattagtctagaatggtcaagcctttccagaaggccttcaattgactttgcccaatctatcagaagaatcaccatctatggaagctatagtctgacaaaatgtatttcttaaatattaagacttgaaagtcaaaattatttcttgatccatgtactgaagaatggatgttatgtgagtaggcatgagaacaacattaatcttgtgcatctctatcagagctcttgggtgactaggtgcattctcaataagcagtaatattctgaaagggatctttctttctgagcagtgggtctcaacagtattcctaaaatatcaagtaaagcatgctgtaaacagatgaaccagactttgtcgttccatttatagagcacaggcagagtagatttagcataattcttaaggaccctaggatttttggaatgataaatgagaaagttatcagctgcagttagcccttcacaagagagtgagcctgccccttgaagctttgaagccaggcattgatttctcctttctaggtatgaaagtcctagatggcatcttcttccagttgaaggctgtgttgtcaccattgaaaatctgttgtttagtgtagccactttaatcaatgatcttagctagatcttctggataacttcctacagcttctacctcagcaattgctgcttcaccttacactttcatgttatggagacagcttcattccttaaacctcgtgtattaatctttactagcttccaacttttcctctgcagctttcttactctctcagccttcctagaattgaagaacattaggaccttgctttggattagactttggcttaaggaaatgttgtggctggtttggtcttctatctagactactcacattttctccatatcagcaacagggttggtttgcttttttattcatgtgttcactggagtagcactttcagtttccttcaaggacatttcctttgcactcacaacttaggtaactctatggtgcaacaggcctagctttcagcttatcttggctttcaacatgccttcctcactaagcttaatcatttctggcttttgatttaaagcaagagacttgcaactcttcattttacttgaacacttagagccattgtagggttattgattgacctaatttcagtattcttgtgtctcagggaatagggaaatccaaagagatggagagatatgggaaaacagagatggttggttggagcatcagaacatacacactattaccaccaattatgtttggtgtcttatatgggtacagtttgtggtgccccaaaacaataacaatagtaatatcaaagatcactgatcacagatcaccctaacagatatagtaatgatgaaaagtctgaaatattacaagagttaccaagatgtgacaaagttagcacgtgctgctggaaggggcactgatagacttgcttgacatcagattgccacacactttcaatttgtgaaaaatgtgttgtctgagaagagcaataaagtaaagcataataaaacaaaatatgcctgcattctcatggaaatctcaaaagcctctcaaataattcaacattcttcaaatagagctacatctccatgataccaacaataacaccccacctcacatgaacacttttacccaccttacatcagtgatccttacatagggttactcaactcagtgtgtaccattatagtccttccagttgtaagctgagaactgggactcatcctgaatacctccctcaactttcccacccttatccaaaccagcaccaaaccctgttaatgttaactctctagatccatcctcttctgtcagcttctgccatcattactctggtctcatcataacatgactaagctattgaattaatatttcctacctggtgttcctggattcattctgtcctacttaaatttattgtctacattgaaaccagagcgtattagggttctccagagagaaacacaaccaataggatatacatacgtacatattttatatatatgagagagagagaaagatttatgttaaaaaattggctcacatgactgtaggggctggcaagtttgaaagctgtagggctggctggtaaagtgggaatgcaggcaaattagttgatgtagttttcagttctaaatctgcaggatgggccagcaggctggaaactcaggcagggtttcttaggttgctttattgaggcatgattgcttcttcttcagaaatcttcagtctttgcttctaaggccttcaaagaattgcatggagcccatccacattattaagggtaacgtgttgtatataaagtcaacggattataaatgttaatcatacccacaaataccctcacagcacatctatgctagtgtttgaccaaacaactgggcactatagcctggccaatttgacacataaagttaaccgtcatgcagggtgacagctctaagtctccatttgcttatatgtataatgggaatagcaataatatctatttcacaaggctgttgttcgtgtaaatgagttaatatatacgaaacacctagaacaatacttagcccacagcatgcactaaatgttaaccactacaaatattaatattataaatccgatcctattgaccacctgcataaatcattacaatcacctcccattgcttttaacctcacacaccaggcttctgtctgtctttgcagactcccactctctctgcccgaggccctctggatttcatccaggccctggtgctcaccatttctctttccattgcaagacctttacacacagtgtttcctctgccttaatgctcttttctccctgcattacctaattaatgcctcttatccgtaagattcccttcaactgtgaaaatctttcctaacttccttaatgaggtcacttttcttatcataagctctcagaatgccatgtgtcattccctcataatacttgtcacagttggcaactgactgcatctgtgtgattattttaagtctgtttccataactagactctaaataccataaagccagagactatgattgtcttgcttatcccagtattccctgggttgctaagtttgtctgcgataaacaaataatggcttcatacatcgctgcatgaggcatttacccagtcatagcaccaacttacaaagaacaaagagaagcaaggcccagtcactgtgtgaactcatatgaccattgcacagctagaaaaatggaagaaagggacaaaatcaagtacacaatttgcagctgtattcagaaaaaaggagccagctaatatttcataaggcaagaaaaacagtacaataaagtcacattaaatcatcatcaaggggctcaaattatttgacacttttgtgtgcttataaaaaaaaacactgtcacataaaaattgtgttgagtatagatgtactaaattaaaaaatgaatcatgaagctctacctggaacatttgtctgttcacaaacactgccaatgtcctcatggagcttatattcttgtgactactaatgttcccaactgcctttttccttactgtgaagaaagatctatccctttgaggagaaatccattagttattttgtgcctgagatgtttatgtagacaaactctaaattgtagaataagctatgatttatagcttacctttaattcttttcttaaatattaacaaacatgttttgtcagtatttattaaataataaaacatgtttgttaatatttaactcaactttctgagagggtcttctccagtctaatgtctctatggtcagacacaggaatctgtattttaattagttccccttctgattcttatgtgtccttatgttggagaactacttctaggattctggaatctggctgtgcaacagaatcacctaggaagtttctcccaaatacagataacttaagttccacctcagctctggtgaatcaatctctaggaacaggacccaggatgttcattttaaaggtttttttttgtttttaaaccagaactcagtgtaatttttaaatctggggaactgtgccttccttcatttccaaaaatttgcccaccatttttacttcaaaaatagctgctctcccattctctcttctttttctctggaaagcacattagattttatcgaagattcccttctctactccatgtctcttaaatgtccttccatatttttcatctcttcatttctgtggattctcacaattttccccacatcatctaccaatttactaagtctcttgtcggctatgtctattctatggttttacacatatgtatttccattattatagttgtttacattcttacttgattctttttcatgaccaagtctttttgccttctttttatctcatgtggttccttacctagacaatgctatttatcaacctccagttttgtgcgtactggaatgacttcctccttgtacccctttcttcctaacctgcctaacttcttagtacttcaagactcagctcaggtaatatctcctctagtaaaccttccttgaaccccagtctcacctctgcgctcccagatcaccctacataaagcctgtcacaaaacattatattgaaaatttattatatatctatttcccccacaagacaaaagctccaaaagaaagggattatgcttatttccttttgctttatttacccagcatctggcttacagtctggcatatagtacatactccataaatgtttgttgaatagaactaaattattgagaatcgcagaaaaacaagctctttctaatgagctgtatcctctcttaaaattttctctgctttggaaagtttaacccggtgagaaaaacatgcaagtcttaagctaaaaagttttttagtaggttatgtacttggaaaattgggatcagtccaacagaaatgttcaattcttgctaaatgcccacttgacattcccaggttaaataccacttctagtagaactttccttgtttaatttataggttttctcccacttactctatcataaaagatagcaataaaagtcccaccaagaaataaagagagctattgagcaaagtaatagagaagtgactagatgcaatatttctttccttaaaaatatgtacagtgtgatgccagtttgggacagaaagaataaacagaaagcatgcaaataatcaaagtctgtctagtaactatacttcccattaagccttttcagataacacatcaagattccttcttttcatacgttagaataacagaatacttcaagatcccataagactttttcccccataatagacaaaaattaggttagccagccaaaatccctgagatattttataccacaaaaatgaccagttttcgctttcttttatagcatgtgtatttgtgtgttaagtagacacagggattagaaaggatttaaagcattttaagaagcatgggttactttttttttctttttttgtggacagagttttgctcttgctgcccagcctggaatgcaatggcgcaatcttggctcactacaaccttcacctttcgggttcaagcaattctccttcctcagcctcccaagtagctgggattacaggcatgtgccaccatgcccagctaattttgtatttttagtagagatggggtttctccatgttggtcaggctggttttgaactcctgacctcaggtgatccgcctgcctcggcctcccaaagtgctgggattataggcatgagccaccgtgcctggcccatcttgggtagtttttgaaataaaaataaactgtaattttaagctaaaaaaaaaaaaaatgcctggccgggcacagtggctcatgcctgtaatcccagcagttttggaggccgaggtgggcagatcacctgagatcaggagttcgagaccagcccagccaacatagcaaagccccgtctttactgaaaatacaaaaattagccaggcatgatgacaggcgcctgtaatcccagctactcgggaggctgaggcacgagaatttcttgaacctgagaggtggaggttgcggtgagctgagactgtgacactacactccaacctggcgacaaagcgagactccttctcaaaaaaaaatttttttttattctttttattctctctgttccacacctcactttgaacatttgacgctcaaagcatttaaaccatatgagttaattcatgtgtatgtaaaccctgaggtgatttaaaaaatcccatttggcatttggagaaagtgaacatcaaggcacttgcctcagattactctgctgttgatggagttaggaaaaggacttagattttttcctgctagatttctttgaagcctatgaaagtcattgaaataactgaaaaatgtactgagcgtgaaaacaggtatggaaacatttttagttgttttgatctgcaatgagttttaagggagttgtgagtgggaaataagaaccagaaggactgggttttttttctccaagtcagagacagagggagtgctggagcattgaatgacttggtgcagtttgatactttgattactatttcttcatatctacgctaagaaaggaagctgctatactccacaaattccttaactgcactgcaatatttataatttcaaaaacctgcaattcctttgcttcaacaaatctctttctctctcaagctgaaactggccttctacagaaaaatggcaggcatgttacatggaccaagttctcatgggaacctccccatctgcaacattctggagttactgccatctctacttcccccaaaacattcatgctggcctcagtgccctcatggatacaagcatacacatgcccacaaggactctcacagcttttgtggccagcacctggctgttacctaagatactctttcagttgacagttgatctttatagttgtatatatcagaaccaaccagaaagcctaaaagccaaattacagtctcatgcccaaacttccccaaactctgactgagtaggattagagagaatctagagcatgcgtatttttaagaaactcttcagatagatctgatgtgcaaatcccaaactatagaacaataggggaaaccttagcacctctttttcaaaagagtagaagattgaaagaagttcaccacttaattagcttatctgatggtaatttcttttctaacagcccctgaatatttatcataaggtttcctatttcttatactaatgcattgagttttcctatttcttatactaatgctttgagtgatgtctgcttgatgacttcaggcctggctctatctgtcatggaggttttgcatttcccaataaaagcattgtaagtcacagtgacagtagcatagactgttcctttatttaaaaaaaaaaaaaaaaaaaaggaggaaggctctaagtgagacacaaaaggaaagcttaacttacaaatctgtgatagaaattgtactaccagaaccatataataagatctgagatggcttcaaaatgtcttcccactttaaggcctatgtgcctctttggcaacaaaaacaaaaagtaagtatttttgaaaagagagaatgaaatttataattaaaaggtaaaaagtttcagttaatttggaaaaggcaagtattgtaattattgtgctaccatgatcactacctcaagaaatgtcttctgcacagtaaccaagggctggaaacaacccaagtgtttatccatggatgaatgaataaacaatatgtatacataccatggaatagtattcagctttaaacaggaaggaaatgctgacacatagtacaacataaataaagtgctagatttgtaatggagttagagaagatgccttgctggagagtaaattataatgaggacatcatgccaagttaaataagtcaatctcaaaataaatactgtgtgattccacttatatgaggtacctagaagagtcaaatacacagaactagagactagaattttagttgccagaggctggaaggaggaagaaacaggtagttgttgtctatgggtattggacagttttgcaagatgaaaactttctggaaattggttgcacaacaatgtgcctatatgtaatactaccgaactgtacacttagaaacggttaaaattaacatggtacattttatgttatgcactttaaaatcacaattaaaaagaaaaaaaagtcttcgagttgaaaagtcaaattcctttgtgactcagagtaactgacattgttagtttagataaggcactataaaacggaaattagagcaagtagaggtcactttcaactttgacgcataaaaactgagcaaaattaaggagcatattattcatctgtttgttcttttaaacagtcaaaatatatgtatttgttgtgcatctcctgagctttagttttacagaagcttggctggccttgggtcagcctcactcttacctagaaaaaatcagagtcaatccagggtgtaccaaggatgtatttctgggcaccaaacattttcatatctgagtggtcttgtttcaggtcattgtcgctcccactattacaaaggatgatcagaaagtttgagttcaaaacataactgattaaatatgactcacttgagttttctgggtcaggaccatagcaggaaactcaccatttatctacattgggaaatcctcaaactcctctttattaacaactcatatgattattcctaaattttacattctcagactctgggaagttgtgacaccacaagtcactagtgggagatgaggcaagtggttttaagccaaatccacaagttccctccctacctgctatccgtgcatatctcccagaaatgagcatgtgttgatggaaacaggcttagagggctaccagataggatattgagatctacttaaagatccttgcttgggagttcagcttcatgtgctgtcttttctgtgctagatttgtaatggaattagttaagacatcttgctggtgagtaaattaacaagatagtccttgaatccaacaaaaccaaagaataatctgtatgtgatgatttgttttagagcaaggacatttgtttaggcttgttaaaatatgcaatatgaaacttactaatatctccatagtaaaagttcacatcaccaccacacctttccctctctctctgtttacatgctatttacaagtatcaagtgcttcttttattgggtcatgtcttggcaacctaaccttgcatacatataacccaattcacttgcaacatcacactctgaaattaaacttatgttctaaggactattaaaaataactatatataatggctgggcatggtggttcacgcctgtaaccccagcactttgggaggccaaggtgggcggatcacgaggtcaggagattgaggccatcctggctaacatggtgaaaccccgtctctattaaaaatacaaaaaattggccaggcgtggtggcacgtgcctgtagtcccagctacttgggaggctgaggcaggagaattgcttcaacccgggaggcggaggttgcagtgaccggagatcacgacactgcactccagcctgggcgacagagcgagatgccgactcaaattaaaaaaataaataaataactatatataaatctaaatattcttgtctctccacctatgaaacatggcttcataacatgaacaaaaagcttctctaaataggggagaaggataaaacaaaaaaagtaactaaaatcacagctgaaatgttgagtatgagaaattaaacttgatttagagtgcaaatactgcttgaagttcagaccatttccccaggtgctcaactacttccacagagcaggactgacacctttaagtaaagaagttttcagctgtagcagactattgctattttttccatcacctttcaaggtttggggtgtaggttgccctagtggtcaaggacaggtgcttcaggaaagctgaagggagaggttaagctaatgattgtcagactgttagactctaaggttttaactcagaaaaacaaggagtgattttgtttcagtattggaaacatggttttcttatcatcaaatcgacaaagactacagtgtcatccatactagatcagatatcttcagtacacatttataaaattgtatgaatgtggacagaattgggagggactataaaatatgtttgcagtgagacccccaaagtgaccttgtcttgtagctatcaggcaaatgaacttgaaggtagttcagctttgatcactgggttatatctatcgttgtcaagatcacatttgtaatttatttgcagatcaactcctttctttgctttgtgcctatagtaccctgaggaacttggtttctctaaataaagaacaggatagaattgtagtggcatttgctgtcccctctgagcttttttttatataccgtgctccctgtgttacaacagataactgagaagaggaaaatcaagaacagagagctttcagggtaggaataacaaccaaactgttgaacgctatctgcggttctagataaaagtagttgttctcagcatgtgcagaccatttagcatcagttctgcagctcagcaatgctacgtggttatgagtaccccaaggaaaaaaaatctctgcttcatcaacttattctaacttcttacattgcccagtcagtttgatattctagggaatattacctttcaagtaaaagagtcaaaaaggaaaaccacatcttgagctaggagccaagtttgatgctttaatttttggtaatttctccatatgcgtttaaatgcccttagtcaaattaactatcacacattgcttctaatgaagtcagtggaaaattttacattttcttaggaaaaaacttagcttgagattcttgcctctacaaaaccattttttgtttgtttccagacacatactagatgaaagcaatggaaaaattagagaactgactcatttaattgcagctatataatattcaacttacagataatactgtaaagtcatgtgctcacatgattcattgccaacaattactttctcagaagttttacttataaagaataaagattctaaagtattaatatcagtaacattattaactaataccatgcaactcagcaattttcaaaacattcacctacatactcctttgcttttaacacggaaaacatgtttatatgagatcacgtccatttcacattaaacgtagacatttcttctataaatgtctaaattaactctgccacaagaaagctgcagtttttaaaaaaatattgtattttatgggaaaataatacatatcacagaaaacctcccacttggctgttttctctaatttctcctgtacagtgtgtgaagctatttcatgctgttataagcatcatttctcctcttatgataattttccttttctctactttggtttctttatcttttgtaagttgttttaaggccagctcttgtacttcactgaacctgtatcacatgaaatttcactgccttcggggcagagtggggtttgtaaaggagaagaatattcattgggaaagttaatttaattaggttttccttactacaccaaaaactctaaaggtgaattaagtaccttggtacttcaatacctcaattttccggtccttgaacacatgcctgtgctttctgatcccagataagtcacagatggccaatagctattaattttcttctggaagacagcttcagtcaagttcaaagggagtgctggacacagaaaaagcaaagtatctgaccgattataaagttattgctcttcattatttttgtaatcatgttagaagagcttagcagcactttcactaagcaggtatgggaattcttttccaccacttgtaaattcgatcctctctggtttctgtgctcttctacccacgtcacttcttacagatgtttgccaatgatactataccaacaactgtagaggtggggctaagaaactgaaattgcttcatatgtagctttggccctttgggcactttctgtccccaaggggaattggactggaaaacagcttcctgccaggcactgcgaggtgtgacagtgcacttctctgtctgttctcagggtgtgatttgagattgtaagaccaaggagatcttgctttaccagatctcctccttggtctacattttcttttcacatgacctgcttgagctctcagttttttctttgctatgctcagctggtaatatgaaaaattatttattgtatgatagcttctttctttctcaaaaatcttgattatcaacttcattgatgtttactgggtaaaaagatttggcagcattacccaaagaaaagaacctgcaagtagaacctccttaatctcagaaatgggttggaatatggcatatagcataatgctctgtgaaaacaggtttgctagtagacattgatccagcttttctttttcttttttttttttttttcaagttggcgagatcttagttgcctagaccgttctatcaacttcctggacgtttctccctgtctatgtatactacataaaggggccagagcccagtcttccctggctctctgtaaagggggtttaagtgaaggctgcctgccaaaaagtcccgctacttctgatactggaaccttacacttaaaaaatcttaggtcccactgcagattcccatgacgtagccatcccattgctcttcagttcttatggccaaggagcagcataatatggggtcagagaagggggcaataagacaaggaatcagaaaatctggctctgagttttgcttcttggagctttatattaatgaatttggtaaattatttcattttctctgtttctacttctccatcttcaaaacgctggacagtttgtcctctaagagggcatccaattctgtgtcatccaagatttgatgattccatctgactctaattcatactcagtggtgaagtccatgtctataagacttcatggtcagaggttagacactgctttcccttgctttaaaatagatttatagaatctgaaatgccttggccaggtgtgatggctaatgcctgtaatccctgcaattggggaggccaaggcaggcagatcacttgaggtcagaagttcgaaaccagtctggtcaacatgacgaaacccagtctctaccaaaaaatacaaaaatttgctgggcgtggcggtgggcgcccatagtcacagagtgagactctgtcaaaaaaaaaaagagagaatctgaaatgccatcttatcaaaactccccacaatgtaggacactgggtaagacactgaggcatgcacagcatagtgatagaaggcaaaatctggagatagaccgcagagatttaaattgtgactcaccatgtcactttgggcaagatacttaaaacttttctgtgtctcagtatttgcacctaaaaataggatttataatacttctctttcattggcttgctacaaaaatgaaatgaggccgggcacgctggctcatgcctgtaatcgcagcactttgggaggccgaggcaggtggatcatctgaggtcaggagttcgagagcagcctggccaacatggtgaaaccccatctctactaaaaatacaaaaaattagctgtgcctggtggcacgtgcctgtagtcccagctacttgggaggttgaggcaggagaatcacttgaacccgggaggtggaggttgcagcgagctgagattacaccactgcgttccaccctgggcaataagagcaaaactccatctcaaaaaaataaaataaaataaaataagctagtacatataaagttctcagaatgatgcctggcatattgtaggtggccaataactgttagcacctctctggaacactcccagcaatggcctgtctaccacatgcaggggagggaacagtgccatattttagggcaaaacattccaatttttggacaactctactattagaaagttctatcttatcactggaattcatcccaagtgtaaggttatccctttatcttgtattaatttgaagtttctcttaaataaacacttatacaggcatcctggaaagcagaacatctattgtcaaatgccacttctgtatctaataactatttatttatcctacagagggaaaaaactgagactttcctccaactataggcaaactcttcccttatagtgagtcaggttgtttgttgaattactgggatttcattttctttttattataaatcccaaaccttgggtttcaggagtaactaaaatatatttctatagcattttgcaacataaaataagatgagttgggactcagatgggagggctactgcaaagaactgaaaggtgttagctttgatttccaagatctgactctcttggctatcaagcacctaccagtggtcatgtggggtcaggctctgggtcaaggttagggtgattcctaagggtttgtgtatcaactagctccccaaaactttatcaaattaaataagaaaaagctacgtcttgcacttgtgattgtttttcattcgaggcatttgtaagaaaggttcttctgatccattctttgtcactttagatgactcaacagaatggtcacaataacaagaatcaattctggatactccaaggaaagatactaaagggaaagaacaatacctggctcagagtgcccttagctgggttcatcaaatctttcctttatttcctagggtctctaaagatatcttggcaactcatgcaataaatgccatcacacttcaccagcacacttcaatgctaaatttttgtaaccaagctgtcacattgcctttctaggttacctttaagtaacttaaaacaaaaacaaaaacaaaaaaactaatggtgctattgcttagtgcagactgaagttgtcattggaaagaaaaatcaacatctggaaataaaaagaccttggttcaagtccatttagctgtctactcactatacaacaaggattaggtccagctgaactctggcagctcaactttcttgtctacatagagagatactaacacggatgacaggtttcatcaatgggcagtggctgctgaaagtgcgactaaacgattgtgaatccaggggtgcaacacagggttaaaaaatccccaaatcaaaggcctgccatgaactgaaaaagaacatacatgacacatatttgacatccctagactttataatattctcctgagggtatataaatacgaaacatgtaaaattgacttttaaagacaagttgtatccaaattctatcactatttataagtttcattactattattgattggctattagaagagaaatgcaaggaagaacctatgtataccttctgtattcaaaccaaattctcttttatgtcttcaatagcgagcattttgctagtgggccactgaagacaaaacccctttgttatacaggctctctaagtgaaggaggctgggatggacagagtaaatttcagacaaagtgggaggaagctctgccctggcaggcccaagagagagctgccgtgaggagcaagaggcagtgccttggagtgctcctcacatcattacacgcaggcagccactgactttgcctaggcaccgggccagctctggcaggagattgaatcaaggctatttgcatgtctgttttcagaacattaagttttgtctacccatccaaagtgaggagatcaatgtaatcatgcagaaaacttaatttctaaaaaaagaagaagaaatgaaacatcttgctttcaattaagtatgaattttattttctgtaaagtatgataactcccattttattttctgtaacgtttcaattcttcactaaaacactaaagtatacttagagaaagtgcttagaaaagatactttagtgttttagtgaagagttgaaaatttctcttatgtgttttaagagtaatgacaaaaccagaaagacataactactacacggcatagtgtcgggtaatgtcatttctatgttatgtccttggatccccacagtagtcctatgacatgaatctaaggcttagaaatgtcatgtgccaggcaattgggtaattgccacggtttaaagtatgtggaaatacccagaaattttaaacagtgctggcaactttgtgttgacgctcttctatgaatagctccctggttatttctaattctcattaacttggaataatgcaagccattcagcaatatgatacgaatagatatttccttttcaaaacattgcacaaatacatgatttcctccctctttccacccggtaggagaagtaggaaaagagcacggtaataggaatttacctccaagctataaagccttcctatcctttcagtaatcaccaaagagagttcctagttactaaggagaccataatagactgcattagattcaagtatgacatttgggttgcctggctagtgaacgccaaacagcaaggaaaatattattgttgctgaaatcatttgatgtctatgactaataaaaaacatgttggcaaattgaattgtttgaaatgcccaaagggcttggttaaagctatgaattaatagcaaagagcagttctttctggagaaaagaaaaaaaaagatgaagatgttgaactatttttaaatgtatctgagtaatcaaaaggtctcaacagaaatgttagacagccaatctaagtcttttatccaatttttaatttaaatttcattttctcctcccttatagctaaataataaagtgatattttggttcacattatccttgaattctaagggacgcacaggctttgttaaccttcttatctagcttctcacaaataccagaattatctttaaagtataccaactgtaccaaccctggaggctttgagggctgagatgtccatttactcatgtgctgtgcccctcggggagctggagaaagccagaagtggaaagagttgagggaagcccaacttccagtgacctctcaacccaagtcccacaggtcaccaagggcctgcctgaagatgtccatccagtccctgcttgatctttcccagagcaggaggtctttgccaggatgcatcctatcctgttctggatgcagctctgattgtgtggagggctctttctcatgttgtgccaacatctgcctcctcatggtttctacccattgttcttcatgttatcttgagaacaacattgtttgactcagcttcctctccttttgaatagtcccttaggtaactaaagtcaactgcatgactgccctgtatgctgtaatgtcttctccaaactaaatagtctcaatttctttctcagattataaggtaaatatacaaatatataatagtaagaagagacagaacatataatcaccataaaagacagacagcaaagtggtctggtaattgaatatttttttaaaaagagttaaaatttgtacctagaaaggtgaaattcttaactgatattgagaacccctgtgtctgtccactgagttcctgcattctatccatcaaattattccatcaaaatgaaaatgtagcttggtaagactttttcttagtgacagacaccatgccagctcctagtgactgttcattaattctcacctcactgcatttattttttcttgtgtttatttactgtcaatgcatactttgagaaaagtttctggaaaaatacatatctgcatatgaatagttgtgacatgatttgagaatttgaataccatttattaagaattaagggaggggcaatgtaaggaagataaatcttcagttctttctccccctaatatcttataatgaaaaattgcaaacatacaaaaaagttgaaataattatatagtaaacacccatataactcaaaaactagattctatagtgaatattttactatcttcggtttaacacgtatctattgtttctctatcaaactgtcttatttatgcatttcagtgcaacttgctctcatcagcacacctagtccttaacatttcagcacacatattattgttagttctttttggacactttctagcactcccttcacaatctctcttgcctcattttccctcattctctccactttctcaattttcatttctgtgcccttcctcctactctatatctccaaagttctaaattgtaaaaagaaagtgtagaaatttgagcatggaacagtattgaagtggaaaaggtcaatggttaccatccaggacctcacaaggtgctgtcaccacaggcctgggatagatgagatcctcatgaacaagttgatccaaaccaactcaccagagacagaggtatatattaaaatgccaacttaataattgaaaaacacagctgtccagctgtcaaatacccagacatatttcttggtcagcttggtctctcctgaattaatctacatgacaggccaaattatgaaggctttcagtgaatggaggctcagaagaagggaattcattagaaggtcttcatgacttggaggcagagactatcagccttcatgtttcaacagctggccagcatcgtgtctgacacccagaggatgcattctaataattagtgccacctctttacaagtactgccatgaaaaccaggcctctgtgttgtggctcacggtacctctcacctggattgtgctggctgaaccctgcctaattctaccctctaactccccttaaagaagttccatgactaccattctccttcgagtaacacatttcttttagccatgttcatgccattaactaagctttagtgaagtgctgatcttcctgtttggggtctagaagataacctgatctgggtgacctcccaaaggtttagatctcataaatcatccagatgatgtatgtagttgtactggcaacaaagcaaaaagtgaaatgaggggtctttgaaatgagaggcctgtttctatttaagaccatttttgataaattgattttactggtgttactctcaaagaggagagtggttccctactgcctgagtatagtgccttcagaggccagggaagaatatgatcttacctagtgagcaaaaaccatcccttccctatctcaagatttatgtctgataagaaatgttagtagattattttcccggcttcctaattaccagcccacaaagacttggcaaggtgagctcttcagtggaaaggtagctatacaaaagcaacacgaaagcgcaaatgcaacacctttcacaacagacagcttctccaaagttgcagataaatccaattttaatgaatcaaatctactctgaaaccctaaaaggaactttcgagtcatgaagtctcgaggtgaatcctttgattatgtaacaagttcctaatgcagttctcccaaagatttcgatctcataaatcaaattattttagagtaaggcattcctgttcattactgcttaaaaaccattcttatgcttgacgctttcttacccttgacactttccctgtatggatcccatactaaatatcagaaaacaccagcgtttggtggtcgtatcacactttagagtgtatttgaaagcaaaccattatggtgttgagggggaaatgacttagaatcaaggctctatttcatatgagtctacttacagatgggaaaaaaaatctgatactagtaggcattagtacctcggtggcaaatgccaactggcaagtagagttcttctaactgcctctattataagcaacagggttctgacccaggtaaaaactcttcaacagtgtaaaagatactatgatgaagagagtgggcttttttttgttgagggttcaaacactctgacaggagcacatacactgtttcacaaacctcaaacaggactcaatctagataaacagggagtgtttcatctaagcaggcttcaaaggcagtgtttgttcagacatcattcattccttttatttctttgatgcgtctgtccctagtgatggaaactcttattttttttttttttaagaaactaaagcatgaaaagaaagtgaaaaaactacagactgatttggcaacagctaatgccatcacagttctggaactcaatgagaagataaagactctatatgaaggaaagccagcccctagaggtcagtattaccacgtgacagatccacactggcccgtcagctgggtgatgtatgtagttgtattggcaacgaagcaaaaaaaacgaggctacaggcctggtctgacctctgtgtggcaccagtagagacagcacatgaactactaactccaggctggattcactttcaccttgagaggggcagggaatgaataagcggtttgctcgttaagggaaagtctgtgaggctgaagagctagactgaaatagatctgagaagtgtcactgcacaagctgggtggtagcagggggagggcagggcgtaagaaggaaggcaggtgcctgcagggactgagctctggagtgagacagagctgtctgaaagcacaggctgacagactagggcacagggaagagaacagaattttttttttttttttttttttaccaataggcaaatgaaccagaaacaagcagagaaggctggctggagatgaaatgtgggtagttcagaaaattgttaatagccacattggttctgactttttaaaaaaagacttctccagctaacaaattataaacacaccattaggcaacaaacaagcaaacaacaaacaaaaaaactccaaatctcagactgtaattttagcaagaatactagttaacaattaatacagtgctatgggccaggtattttgctaagcattccatgtctatttaattctaagaataacctctaaggtaagtacatttaagaattccctaagaataagcagaggcttagagatgtgtgttaccttgccactgcacaagcaacacttggagagtcaccctctagagcagccgctgaccataccctagtgtgcctttcccagctttgggagactcagggcattccctctgctatgtcacagtaatatcaaacttcactcctgcctggtgaatctcttgcaaagctgtggttcctgggaaaaatgtcttcctttgatgtgtgccactcttgcaaagccaggaacatgccatcgttcttactctggctttctttattactcatgagtaattgtggaaaaagaggagcaatgcagaatcaaatggaggaggaggaagcaggcgatgtggtagtttcagaaagggagacactcccagcacctgactacatggtaaagcttttcatgtgaatttgatattcattttcaatttcgtatagtgctttcccaggattcaaatgccatgtaacattgtgaacttgaaacagttttttctttcaatgaaacaacataaaggcagtttgtaaatttgcttttaccaccatgaaacctaaaagaataaaatccgtcacagaatattatccatttaaaagtccttattctgaggcattagccagattttccactggtttcattagaagaaactgacaatgattgtagagcacattggagaaagttccccagctcgcttacgagaagctttcaacttttcaattgcgttttaaacccggtgcaaaaatatatatatataatcgcaaggtctctaattcttattagtttcatttttttcaatattatttactgtataatgacaattttgtttcttggatattttgatagggcaaaatttaaataatactgagggactagaactctaatggcttgggatagggaagaaaacattaaatcttaccctttttttgcccattattctctttatttttgtggattttttttttaaactacctgtatagaaaaacatgggtatttatgaacagatgcaaatttaaaatttaaataaagccagtcattgtaagatccattatggatcaaaacagtgattttcttttggagctacatgttgcttctcttatttggtggggaaactaagtcagtcgactgacatctagcactaagatcctaaatcaaatatttgcacattcttgctcttccacaggccccttgcagcctcacccacattcaatagtccgggaggttgtcaaggccattgttgtcccagaataatattaactggcattctcagaaatctggtcaccttggcctctgaattcacttcagaataaagtgtgaaaagatgtccagtaactttaatacacaatgacccctatttaatcacaggacaatgagggctggcccacccccccacacacatatttctggacctagaacaccaccactcccctgattatcttgtaaaatgtttgttttgggttctcagacctctgtttgcaaatgaaagatgctccagtcataacagcttaaggagaaagggtgatttaccggcacatgtaaacaaaccaagagagagcattgcactagccttggagtaagatggattccagtctaaagtaccatcaggaaacactgtgtcactcatctctgcttctctctaaagatggattccagtctaaagtaccatcaggaaacggtgtcactcacctctgcttctctctgcattgagacttgattctctcaggctagacttcagaagagaatggaaatatggccacaagcagctatgggctgccctccttatcatataatctccagggaagaaagaaagcatttttccactaactctagttggaaagtgcaagaaagaactcagtcctagcttaggttgggtacccatctgtggatatgaaccaatctttgtggccagggctgaggaaataaggttgaacaaactgtggtcatgtccccaccactgggtggcagggtagagggagtaaatgtggggaaggagaatgctccagctggcagctcctacgaaaagcacagagctggattaggagaaatccactttcttaaaggaatatctcattactggaaaggagtgataggcaaaaccaatatctcctagccaggcatggtgatgcatccctgtaatcccagctacttgggaggctgaggcatgagaattgcttgaacctgggaggcagaggttgcagtgagctgagatcgtgccactgcactccagtcttggtgaaagagcaagactctgtctcaaaaaataaaatgaaattgccttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagtaggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagagcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggctatcattaaaaagtcaggaaacaacaggtgctggagaggatgtggagaaataggaacacatttacactgttggtgggactgtaaactagttcaaccattgtggaagtcagtgtggcgattcctcagggatctagaactggaaataccatcccattactgggtatatacccagccatcccattactgggtatatacccaaaggactataaatcatgctgctataaagacacatgcacacgtatgtttattgcggcattattcacaatagcaaagacttggaaccaacccaaatgttcaacaatgatagactggattaagaaaatgtggcacatatacaccatggaatactatgcagccataaaaagtgatgagttcatgtcctttgtagggacatggatgaaattggaaaccatcattctcagtaaactatcccaagaacaaaaaaccaaacactgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaataaataaataaataaaatgaaaataaattaaaaaaaaaacaaaacatctccaatacaccttcagctggtggtcaagttaaaatatagtataggccaggcacggtggctcacacctgtaatcccagcactttgggaggcagaggtggatggatcgcctgagatcaggagttcgagaccagcctggctaaaatggggaaaccctatctctaccaaaaatacaaaaactagctggatatggtggtgggcacctgtaatcccagctactccagaggctgaggcaggagaatcacttgaacctaggaggcagaggttgcagtgagccgagattgcaccactgcactccagcctgggtgacagagtgagattcgagctcaaaaaataaaataaaatatagatacatacatacagtgtaatacttaatgagcaacccataccatgggtatttgtactttaaaagtcgattcttctcaatgaacaaaagaccttcatgatctaagaaataaatctccagtggtataatttcagaccccataataaatatttcagaccccatgataaatagagagtgaaccactttggaaaaggagtccccttctagccttcagtaagtgatacatggtcacctactctgaaggcttgctttgttgtaacaattatatggcaagaaggggaaaaaagtgttgattctaagtgacatttgttacctagattaatattcagctatttctctgttatagttacaaactgatgcttacagttctaacaagcagattaatgaaatgtttccaaataaattagaactcctttttacctctgtgtgatttttccttgcttggttcattttctaagcagtctataggtcattcaggtctgtcattcaggtcttctgatcagagggatcagagggatgttccaaaatattaggaatatttttaggcatattcatattcaaattaatgaaacagtgtgctaccaaacttctttctttttaaaaacataaacacagtaaactatttcattggcagtgtgcttaaattacctccaaggaaataaacgatttaagtcgatggaaagttcagctgaaaagaaaagcccctttattacaaaactggcacagcaggaaacttacttacagcctgagtgttgtttgttgattttactttgttcaaataatcacaacccaaggcggattccttccatcatttccacacctgaaatgcttacagctctatttagcagaactcagtaaaacacctattgtatcccttcaaagcttgagtccaccttttggtacacttcagtatgcaggaacctaaggttaaattttaaaacaatccttgtgaccggttgtggtggctcacacctgtaatcccagcactttgggaggccaaggtgtctagcctacacatgcatgtccccattatcccaatgaaagtcctggcaactctaaagttacctctttgttttactcccattaaggaggtactcctcaggtagtgctggtacattccagggtagacttatccaagactcaatgtctgaatcgagccagctacacttttgaggggaagcctgtaatgggattgacattttagtgatttttcagtgacacataactttttaaacactacacaacttatcccatttattttaagtatcaaactattgctatcctacattcttgagaaagtccggaaatatatttctttgccgacaccccagagccaattctcattaatattttaaagtgtatcttttatcatgatgcccacccctaggcactcagctcaaacctctctcttgcaatattctttttacctctccacctgtgaaattcctcaggatcaaagttcctatggcaactaggtgttaggaaaagagggatttggaggtgataaaaatgttctggaattagatatagcaatagttgcacggtatttttaatatagtaaagccattgaactgtacactttaaaacggttaacgtggtgaaatttatgttatgtgaactttatctccattagaaaataaaaaaacagtgattaaagcaatcctcactaacactgactaacaaccctgtcaagtgtaagtgtattttaaagaaagtgcgttgggcctaaataaaatcttgagttggcagcattccaagcatttagagagaggtcatgttaatatttattggaataagactaggcgtgaatagttgtccacttgggtgtaggtctgttgaacaatgtcaccttttcctcttctaatttctcccagcctagctctttcaaagctgttattccccagactagcaaccaattatttgaccaagagttctacaggtaaccttctttcaccactgaaaacagatatttgttttaccagtctacctagggttttctaagaaagtaactagtctggtcttggaatttcactgtttgagatgctgggacttcgtcaaaaaccactgctcaccatcatcagactttatggagctcaggttgatatgtagtcaaaagcacagtgtttttgcactctgctccctactctctactatgtccaagggtgctattgccttgacagaaaatgacaagaacttatgaaaacaaaaggcagagatgtctcccccacaggaatcattatcccaccatttgcaggaaggaatttacttttacagcactaccactgaactttcagatacagaagctataccaagatgggatattttacatttagaccaatacacaccagcaattaacagtgggaaaaaataagagagcataggagtgatcagttaaaggtgtactttctaaatatgataaattcctaaggagttttgatatttgccttacagaaatagctcatatttaactaaaaagttaaatgttaaaaaatctataggtctcattcagagattgcctgttagttatctcttcctttgtccactgaaagtattttcctgaaatagagccactatatccctaaaccaaaatcttcttcctgatttcagaacttcccgcaaggataagcatctgtttcaggagtccctgcagagcttagagatttattgcacagaagatctcaggaaatgttacttcttccagctggaggctgtggcctaattcaatatgtacaaatttagtgtgattgtgattttcaaaatgtcattttagagacctgtaggcttaaatagcactgacgtaaaaactaagcattgatcaggactttgttggttgcaagtgacagaaaccaaaatgaaactagttgaagcaggaaagggatgtatgagccgctcaggctggtaaggaggctgaaccgcgggctttctagactcctccgatggcccctccttgcctattgaccccacgtggactactgcaggcacagaaagggaaagggtcccttggctgtccaggcttaacagtctatagtgaacatttgttgtttctactcagaaccacttccccgttctttcagtaacagaggcatgatttctgttactgaaagaagaggctgaggcaggaggatcacaaggtcaggagatccagaccatcctagctaacacggtgaaaccctgcctctactaaaaatacaaaaaattagccaggcgtggtggcgggcgcctgtagtcccagctactcgggaggctgaggcagaagaatggcgtgaacccgggaggcggagcttgcagtgaggcgagattgtgccactgaactccagcctgggcgacagagcaagactccgtctcaaaaaaaaaaaaaaaaaaaaaaaaaaagaagagggaagagactgcatctcaaaaaaaaaaaaatacagaaagctatcttatatcattaccatatattcttttttttccttaggtagttagcactggcttatggtacttgcaatcaaggaacattaattcacacccaactccaggtaacagagcttccacagtctacaaggaaatctcagagaaggaatttgatttccctgctcataccactttctaactccttagatcaattactgcggccaaggcaatgggatattatcctggaccacacctgagtcatgtgccagatgtgaagggctagggagtgttatcagataaaagaagatggggaagctttctggatagaagacaaaatacacctctcactgtgccttctaacctgttttagttaaaccttataaacttggagaagacaaccatccactgttttatcttgtcaggaaagtacaacatttctcttcttttttctccctatcatttttacactacttatttaggtccttcctttgcgagaggtctggaaatctatttattttgtaattaacaaagggcaaaaagatctaccctgaaatttttggttggggtccagtgttttctaactacaccagctgtgggaattcaatgatgtcaaggtcccctccctcctttgtttataagactaattttggaattataccattatcaggaaatggtgttcccttccttctgtccattccttaggaatggtactttttgtttgtttgtttaaaaaaaaaaagtcttcttccctctgtatccagagaggttggatgaagggcaagcaccagctaaatgtcagacaaagcacaagggaattggagcttgatcaatttcaaaggtttcgttcttagctacagagactgctctgattacctgaagggcatgtactgcttgggaatgctgctaaatagctcagactggagctggggaggaagatacttccttccaggatatttgcagaacagtcttgggcactcctttgtcaaacatcagcagatggacatcaatttgtcaacataagctgaattggagactttggggttgcaaacaattggcagccagctgtcagtagtggagcagctgtccctggtataaaccacttgttgacaaagcagaaaaagtgaatggtattctctcctgtagctccccagaaacctcactattattttatttagtaactcagtgtttccttataggaggttaaggatagagattagctacattggtcatatgaatacatttggaggaaagagtagatacttctagggagcttgagcttatcaaatcaaatttagaaaggatgcacaaaaccaaatcctgctggacaagcaggagacttctgtatgaaggcacagcatttatttctggccagtgggataatgttatatgtatctaatatgtatattagatatatacctctgtgcattatggtaatctatgtgtatatggtaatttactatggtattctaaagatacactggcttggaccagattaccctactatgcctctaaattcctcaattaaataaagccataatttgatatttgccaaagaacatatgattaaaaagaagaaatgtaagaggaacagcattcattgctccttagttgcctcgtatgcagttggatcccagaaaaagtgtattattaactcaggcaagcataagaaacaggtctggcaagactgaaaatgttactgctcttctgcacgtgcttttcttaatcccagaaactgtggctataaatgtccccgactccccagttttccactaagacctggaagtcctgccatgccaagctatcatctgaatctgggcacaccaatagagcatctgctccataaagatggtcaagacatgttccggggctacttttttccctggctttcctggtaaataaggaaggagccccattcctattctagagaactttgaatagaacttggcaaacaaaggaaggaggagccctcagtcacagactgaacttgtattattatacagttgacccttgaacaacataggtttgcattgtgctggtccacttatacccagatttccttctgcctctgccacccctgagatgacaagaccacccctcctcttcctcgtcctcctcagatgctgaggatgaagatcttggatccatttatctacttaatggatactaaatatgttttctcttccttatgattttctgaataacattttcttttctctagatgactgtgttataagaatacagtatatgatacatataacacataaaatttgtgttaaccagctgtttatattatcagtaaagcttctagtcaacagcaggctattagtagttcagttcagttttgggggtgtcaaaagttgtatgtgaatttttaactgtgcaggaggtcagaaaccttaacccctgtgttgttcaagggtcaatggtaaattgattgattgtaactcaaaaaggtagattgctgaggccaaggaaatgaaaggatgcaaagagaaatggcaagagaaatagatgtatgcttcaggaatgaaagaaaacaagaattgttaccagtcttcaaaggcagaacaagtacttacaagacagatcaaggggataaaacttagctctatagaatctctatgttataatctatattatcttaactcttaaaaaggctgggtgtggtggctcacacctgtaatcccagcactttgggaggccgaggcaggctgatcacttgaggtagggagtttgagaccagcctggccaacagggggaaaccctgtctctaccaaaaaatacaaaatttaactgggtgtggtggtgcatgcatgtaatcccagctactctggaggctgaggcatgaggatcacttgaacccaggaggtggaggttgcagtgagccgagatcgtgccactgcactccagcctgggtaacagagagagactctgtctcaaaaaaaaaaaaaaaaaaaaatccccaaatgtataaggcaataggatggcaaaattctttatcacactaggctgtctataataggattctgacttcagggaaatgtgtcatcctctaagttgactcacaatacatcaacctatttgaaaaacaatgccttccagtccctttatcccagctgaccagaacaattttgatggctcttcagagtaaataggtttttgtaactttggatgactgccaaaacctctggaaaatttctgacaatatgtagttaatttttatttcatttttgtaaggttttgccacaaccagacattattcattttcattttaaattatgtgtaacattaattaattcataatttttattaactatttttttttttttttgagacagagttttgctctgtcacccaggctggagtgcagtggcacgatctcggctcactgcaagctccacctcctgggttcatgccattctcctgcctcagcctcccaagtagctgggactacaggcgctcaccaccatgcccgactaattttttgtatatttagtagagacagggtttcaccatgttggccaggatggtcttgatctcttgacctcgtgatccacccgcctcggcctcccaaagtgctgggattacaggcacgagccagcgcgcccaaccttatttactattttttaaagattaacaagctttcaacatgagaactcctttaaaatacatatttttaattttcaatttttaataccttatatatgtattgtgatcgtattgttagatctaaaagtcaggacagccgggtgcagtggctcccgcctgtaatcccagcacgttgggaggccaaggtacatagatcacttgaagtcaggggttcgaaaccagcctggcaaacatggtgaaaccccacctctactaaaaatacaaaaattagccagtcatggtggttggtgcctgtagtcccagctactcaggaggctgaggcaggagaatcacttgaacctgggaggcagtggttgcaatgagccgagattgcgccactgcactccagccttgacaacaaagtgagactctggctcaaacaaacaaaaaaaaaagtcaggacatctcttgacataaattctcacgtataaatttacattcatactcaaagatatttgaaatcaggaccatgctcctgaatactagatctagtatcactatacttctaattcatataggattgcaggagaaaatggaaatgccacgtttatttaactgttctcatttatggatgttaaccactaagtgtcatgtagtcatagaagcaaaagttagaattgaacatactaatttttaatagaatgtacttaactccacaaatctaagacactgtcaaagaaattgagggaaatacacagctgactactctgaatgtgagaatcagtgcctagttttattaactgtggcagaagaagacagtatttaaaccagaccttatataatccatctatcttgatgctataaacaaaatttccagatacaaggggctaatcttttctttttcatagccataacttttccttgtaagtcccaagagagagtcaataattgaatttcagaaaagatgaccttcttttgaggttgtttttgatctgaagccaaagggaggtaatttatttagcagaagctgtgggttctaaacaaagatacatatgtggaaataatggcaaacaaaataaagtaccttaatttattcatcaataaagcactaccaagatgctaagaattcacatcagaataaatgctcatgggaatggaaactggtttgaggttttcttttttcctttttcatgagcacatgctgctgaacgcttttacttctattatataaaaaagctttcatcctttgaaaacattcctgaagaaaactgatagatctacaagtcttctgttgcctcaattatatcagctttccttttggttaatttaatctaaggcaataaataagtaaatactcttatcccttttaaatgactgatttctcatgcatatttctttttttttccttttcttttcttttctttctttctttttttttttttgagacagagtcttgcactgtccccaggctggagtgcagtggcaccatctcggctcactgcaacctctgcctgccaggttcaaggaattctcctgcctcagcctccccagtagctgggcttacaggagctcgccaccacgccctgctaatttttgaattttcagtagagatgaggttttaccatgttgaccaggctggtcttgaactcctgacctcaggtgatccacccacctcagcctcccaaagtgctgggattacaggtgtgagccaccatgcccaacctctattctactctttaaattgattggcctccctaccccagttggcacgctgggccagcacctggcccctgtattggcatgcctatcccttcagccactttgaacctgtccattctgcacacctctttctgaactcttcctgacctcctctggccatgccactggtcaacagttttataaattttttttttttttggatccaatattcaaggtaacttttctggttcttactgcattccttaactaatcaatatgtcccctgatggatgtttgcttccatctgttttaggtaataccttgcccaattctggtctagtgcttagcattgtctcctatgtggtctgatgttcccaccaaatggatctggatctcacagatgcgaagatctcttgtccatgtatggtggctcacacttgtaatcccagcactgtggtaggccaagctggaggatggctagagcccaagagtttgagaccagactaggcaggatagtgagaccccatttctacaaaaatttttttaaaaaaatagctgggtgtagtggtgcatgcttgtagtttcagctactcaggaggctgaaatgggaggatcacttgagcctgggtggtcgaggctacagtgagatgtcattttgtgactttcccagttgctcctgtagataagcatcactattgtaaaacctaagattggtgttttgagatgccactacactccagcctggtcaacagaatggcagtgagagaccctgtatttaaaaaaaaaaaaaaaaaggcttaggaatttaaccttcattggtctggctcaagtccactgttgcttaccttcatctagccatctagagcttcgttatctaatctctggtccttcacagatagtctcataatttcttttctttaaccaactcagtgctttacacttaagacaggttaattatgtaggaagacagttttgggaacatcattttcagtcaaaaattctttcatggattcccattgcctgtgaaataaaattaacatattttagcctgacattcagggccctctatgaactggcctcaacacttatttctagatttatttcttaaaactttctttcttatactcatattccctgtctccatcatttgcccgacaaaacatctggtggaagctatctatctctgttctccactgctacctggttggtttcactttgtttgcatggttatagatctcagatgaacacataattttgctcagcaaagcagccatgtttttttccccatagattgctttctcactattctgtaccctcacacttctcttcaaacttctctcttcatcccctctatgtacacccaggagaatgaccttgcttgtttgtttgttttgagacagagtcttgctctgtcgcccaggctggagtgcagtggcgcaatctcggctcactgcaacctcagcctcccgggttcaagcagttctccttgtctcagcctccagagtagctgggattacaggtgcctgccaccgctcctggctaatttttgtattttttagtagagacagggttttgccatgttggccgggctggtcttgaactcctgacctcaggtgatccgcctgccttggcctcccaaagtgctaggattacaggtgtgcaccactgtgcccagccgaaaatgaccttacttatgactcattgagagtacacaagccatccgtgagggattcttatctttcatctttccactaccaaatctaaattcttgcttcttcacttgttttctcctgattgctttttgttagagtggaagaagggtccctcctcccatttaaggtctctcgttccacctagtgctccacactcatcattctcatctttccagtgatgtacttatttgcctcatctcatgcatgcatcatatacttctctttactagctcattactatctgcataggaacatgttggtatttcacatctctgtaaaaacttcctttgatgcctcatttctcagtctctttgtcccactctcaccttggaataaggtcaacatattgaaaagattatctccacacactatcttcacttcttcacctccctctcatttgctgtttaatccaccacattctggttctttctactccatctagatgatggtattcaactgatagtgcttttatgtatggcatttactatcttttaggttacctaacaatttttgtccatttcttcccattggaccacaagctcttcgagggtatatattacatcttcagcatatttgtatcctcccacattacccagtactgctgccttgcataaagacaggcagaagtactgtcttttttttatcagagtactattgggtttttatcagagtactattaacaggaatggaaatgaaagatgttgcgcaaattactaagtctaaaaaaagccaagaagctataaagaatgttggttacaataattatcatttgaagattgttatgtgcttatgtcataatcaaattgtaaattatctgatgctatcatatacttggagcagtggagaaagccctaaaattagagactaaacatcatagaaacacatgatttcaaaagaaaaggtagacaatcctgagataattaaggtgctgttgtttgttgttttgttaccatgtaattctgattacatgacaaagattaactcctggatggaactagcagaacagaaaaatacagatgtagttatttctaaatttatagagaaattggtttagtatctaagatgctgacattagttgagctgtagtgtggattcaaaatgcctttaaaaaatctaaaatgaactcaaaatatgtttccattataatcagaagtgcatatgtacatttcaggtatgtaggtgatgtggaagaaattttaaattttatctttgtgagctctagtagttcacttggcaactggcagtgcagtcctctgacatcattttctcattgttgactagttttatgaagatgtggcattgttctagagagaaattgaataattatgaatttaaataaagtactcagaaatctgtgttatagttggccaaatgtgcaaataaagattttattttatttttaaatgcaagagctggttaaatagaaacacatagctcagggttaggaagagaaacagtgtagagtaggtttgtatgaaaataaaagaacagagaaaataatgctctccattgtctcgagtgacacagaattggcagtaatccaaataccgcaagagacaagattaatattaagtatatctgtcaacatcctgtttgaaaatctcagccaggatcggagatatctgaaaacatccaaagggggtttcgcctaagaatgagtcatagtctccatagcagaaagccctaaaatatcagtatcgggtgttagaagtcaagcagaccttagcgataatcttgtccactcccatgttttacagatgagaaaactggggtccagacaaccctctctccacccagctacactggcaggcaccaggaagtaatgaacagaatatggatttggaactacacagaattaggaccagatcccagctcagtcactcagacaagtcccttactatctctgagcctcaatttcctcaactttaatatgagaatcaaaatagctactttgcaaggtggttgtaagattgggagcaatgcacatataaagcatctgacacacagagaatcaacaaatgctaggtcttattgcccatagtcctgggattagtaaaacagaacaaggacacccactgcagtccaagtgtgttctcactatacctttagagatctccagtccgtagacctcttccaaaaagaggggaaggggaggagttattacactcttctataaacacgtaggcttttgataatctggaaatatcaaatgagccagtatcatataaaatgccaactggaacttactaacttgtccagaacatcaacatgacaaaggatagtttaacataagggacagaaatctgataaacatttataaatacagcccaacaaaacctttctgaattgaatctttcacacttaagtatgtgtggggacggggtgtcaatgttgcatatatatataccaaaccaggctttgtaagttacacaatggcctatttttaaaaattcagcaataatgcattaatttttctaacatttaagacagacctcctgtatctaaaataaaagttgaaattaaagaaaaaaaaatttcattccaaattaaaactaaactttgggaaaaaaaatccaaacctttaaagatggaatgaattatagcaaaaagataaaggaaaattgcttaagcctttgcggtttgtaaaagagttgagacaaagctgaaatgtttatttgttctaattacctatctccattgcaggtgtatatgacatggaaatacaggccctactacttaaaggatagacttaatgactcgtgggcattctgattgctcggatactttagtcctatctaatttttttttttttttttttttttgagacggagtcttgctctgtcacccaggctggagtgcagtggtgtgatcttggctcactgcaagctctgcctcccgggttcatgccattcttctgcctcagcctcccgagtagctgagactacaggcgcctgccaccacgcctggctaattttttgtatttttaatagagacaggtttcaccatgttggccaggatggtctcgatctcctgacctcgtgatccacccgcctcggcctcccaaagtgctaggattacacgcgtgagccaccgcgcctggccaatcctatctaattttaactcatttatataaatatagtcattagccatgacatgttaactttgaatggacaatgtaagtttccacagctagattctactgaataccttctcaggatattccctttgaaaatgaataagaatctaaatctataaaggaatgctaagtaactagcttctccaagttactacttgcattgtttccaggtgcctggagtcaccagtatggtaatataagatctaaatagctgacaaaagtaagaaatctgtaagattttagaactagaaaggttgttaatgaggccacaaattcgcccataggctaaatccagccaaccaaagtgttttaattgttccttaaagtatttgcccatgctatatgttagatactttgcaatagtctcaaccatttaacaatcaagagatttcacattgcaaacaagatttccagcttcctttgaaaagttatataatctggcaactctgggctgaattttttttttccctgcaacttttattttgagttcaggggtacatgtgtaggatgtgcagtttggttacgtaagtaagcgtgtgctgcggtattttgctgcacagatcattccatcacctaggtattaagcccagcatccattagctattcttcctgatggtctccctcccccaccaccttcttctaacagtgggtctgaattcttgcatggcaatccttggttagagctgaacagtggccaccccttaaatgcaatgagttctctccagttgccccatctcctattactcctgatgggattacacaggccgattctgcttactgacattgccttcacagctcctgctctggtccaaattcatattttacagaaaagaaaagccaacgcccagagagatcaaaagattgaagctagctccagaatccagatctcctagccaattatgccttttcccatatcagaaagtcttgaatgattatttgttttaatgagtattccctaagaaatgaataagcacaaaaataaaatctagagcacaatttgcaagatattaaatacttaggtaaaaaatagtagggctgggtgtggtaactcactcctgtaatcccagcactttgggaggccgaggtgggtggatcacttgaggccaggagtttgagaccagcctggccaacatgacaaaaccctgtctctactaaaaatacaaaaattagccaggcacggtggtgcacacctgtagtcccagttactcaggaggctgaggtgggggtatgacttgaagcctgggaggcagatgttgcagtgagctgagatcacgccactgcactctagcctgggtgacagccgtaccctgtctcaaaaaaaaaaaaaagtagtgccacctcagacaaaaatattactgattatcagtggctgcttagcttgttcttagaaggaggactaattattaacaggcaattggtttcgtataattttttaaaatctctaaattggctttatttgaatctttaatgttaacatacataagagtccacttggtggaatttaagtccctaggccctttttgaagagattctgaataagtatgtctgtgttgagatgcaggaatttgcatttttaagtgactatcacaagagattgattgcacttacccatcagactaatacgtcactttcaggtgggtgtggtggctccctcctgcaattccaacactttgagaggtccaggcaggaggatcatttgaggccatgagttagagaccagcctgggcaacatagtgagacccccgtccctacaaataataataataataattttaaacaattaaaagtcactttcacattttcaattctcatcttaagctccagaccttaatcatggtacttggttcccctccattcaaagaatgaaaatttcccacttgtagctcctgattcttttcattttcttcttctttttttttttttcttgagacggagtttcgcttttgttgcctaggctggagtgcaacactgcgaactcggctcaccacaacctctgcctcccgggttcaagggattctcctgcttcagtctcctgagcagctggggctacaggtgtgcaccaccacacctggctaatttgttttttgttttttgtatttttagtagagacgggatttctccatgttggtcaggctggtctcgaactcctgacctcagatgatccacccgcctcggcctccctaagtgttgggattacaggcgtgagccactgtgcccagctgattcttttcattttctgtgtttcctgttttgcggtttattaaagaaaaacccaaagaacatataatgactggtatagcacaaaggaccaatcccataaatataattgctcaatcagaatgtttttataatggtgactaggttactagtatagagtatctcctacagactctactgactttattcttctttctaaataatgctttctttgaattgaaaaatatttcctttatggagcaaatgtaccagaagtttttatagctttcgcttaaaactgcaggtcaacttttgtatttcttctctaatgtctctctctctttttttttttaaaggttttatcatcttctatgccttttaaatagacttttagtataaccagacaagcaaaataaatagctacacagtagtctcctcacatatgactattatttgattccatctaacgaactagatattatatcctacattatatcagaatcactttattttacctaaggcaattttaaagtgaaaatttctatattcagccccccgagaataaaaatcaacaacaaaaaatcagtctcttataggaaagagggatatgccaaaaagggatatgatgtctgtccacaattaattcatactgaaacactgcaaaagtagcaccagataaagggaaaagaaagttcattgaagtatttagctggattcacagtaggatatttttgaaggtgaaagttaaggctctcgggttctaagtgcttatgacagagcaattcttgatgtaaaagcaggcatatgtaaccaggccacttttagaggaagaaataggacctcggaggatttttaatattattcaatggaaaagaatcttgtgtatatatggaataatgcaattttagaaaaagtgcatacatcgtattttgggtttttctttttcatttttcctcttaggaattagcctttagagaggattctcatttttttttcttttaaaattttgcattagaataggtgttctagtttatgaaagcacttttgaaaaagatcatttgagaatgtgaaaatatttaagaatgtttcaacttctcatgtagtttacttcaaaagtaacctttataatattagactataagttatgctgcagaagtaattaattgacctgattctattcattaattaagactctccctggtatcaaatgagaagcttaacatactgggcagtataacagtaatcattgtgaaagtgctcactttggctttatgattaacataggaacttaagaactgcttagcttaaaaacttgctagagtatatttaacggggcctgaaagagacctagtatatttaatggggcctgaaagagaccttaatatggtccagtttttttttttttgagacggagttttactcttgttgcccaggcttgagtgcaatgatgcaatctccattcactgcaacctccacctcctgggttcaagtgattctcctgcctaggcccctcgagtagctgggattataggcacccaccaacacgcatggctaatttctgtatttttaatagagagggagtttcaccatgttggccaggctggtcttgaactcctggcctcaaatgatccgcccacctcagcatccgaaagtgctgggattacaagcgtgagccactgtgcccggcccaaatgtctgttaatagaggagaggagctggtttagttccttgattcagagtttcctatataatagaaagcttgtttgtaggtgtagtaatttttaaataggaaaaagaaaaactgaaatcatgccctacttttagcagtggtcctgttttgcaggtgtgagaaggagggaggaggaagggagaggtggaatacaagagaaggagctgagcatgaacacaacagagcatgcaagaaggttttttgactccatgaaatgctgagatgtggacaaagcagccttccagggagcccgttcccatccctgcatggtacccttcatgctaagcagtgtccttcagtgaagggtggggtgagagagggagggagaaagacagaggttactgtgactgagatggttcaagggtaaatccatagtaattctgtacttaggacaaaagtatggtgttctaagtaacccctgtggctctaaggtacacaagtcatatctaatgaggacagattttcactgtgaacaagggtccctaacctcagttttgccttttctgtggcacctactctggctccagggcagtggttacagcgagagtgggtttctttgagtcagctagctgtttaggaagaaaatacattttatgaatgaggaatgactcacagacacattttgaaatttagtttcatatgttatacaatgctgctaattttaaactccagagcaaaagttaggaattacatctttatttctctgttttgcgtttttggggggagtgaacagggggagcttcttttcaataaagcgaaagaaatgctctaatacagaggagaaaagaggaccaaacagggatcattctctatacagacatttgtctgaggagagaaaggtgttcaagaaaagcagtggaaaggttaagggaccatccaaagagagatccaagccctgctctgaggctgttgaccaagctcctcatcagcctggacaatgcacacattggcaggagaggaaacgtttggagagtttctggaacaacatgtgggctggcttaatcataaagcctcaaggttggcaagccagagggcctgctcctgaacttaaagaacataaacacagcctctcaactgccagccataaaagtaaaccatcgtcacactgcaccaaaaaaaaaaaaaaaaaatttgatttgatgagaaaaaaagatcttaaacagctgtccattcaaacccaatcacccagcagtgaatctgttgattctaagctcgtttgtgggcttggggaagcctcatggagatgcaaacctgatcttaatcttgcaggaccagactcacaattttattgtgttttcaaaatcacagcaagttctcaaaacaacctgcatgtttatcttcgaatatttacccaaataccctgaatgtacagctgtcccataggaatggcaatgggcatcacaaggggacacaggtcctgatttctgtgtgggacctcaggtgtcctctgtggttgcctcaagtttgtttcccctgacgcttaactaataccttcagattcccaaagaaaactgccaagctgattccaaaagtccctgccttcacctgtgtttagcatcatgtgtagatttaaccaccacttatcggacacatgttaacacttactttgaatatctagcattcagaagaaagagtgtagagcggaaagaatcagaaaaactaggatcaaatcccagctttgctaaccctagtatttgggctatgcctcagttttctcattgccttaagaccggaatagcgttacaaaattttgttgaaaaaaaatatggaaatccctagcaccacaggtgctccttccttttcctggaggtgtctgttcctcttagagatgctacagctttaaagcagggtagcatcctaaactcagatgtacatggaaaacggaattgggttgattctattaattacaagcaagtcagtaaggccagtgcagattcaaggatataggatgagattccacctgttaatgggatgtggccagttcacattccgaaaaacatgtgagatgagacatagtactgtggtcttgggaaatacgatctgccatccatggtttgccatataacccacttttgaaggtcagaagctgaaaacaggctgttggtgttttctttgtaataaattccaatttctccttagccagatgcttaaatgaaactagcacaaatgatttttttattcaaaaagacaaaagagaaaagtatattaaacattatagaacatgatcacaaatgcacctctaattaaattaaattgacaatgttcctgagccatgacctcatggatagagtggcttggcttcctaaaggcctaggtaacaagtaagggggatatggcaaactctcctattgaattagcttttcttaaaaattcttttttattaaagcagtactgtataaacgttgctatgttctatcagaatctatttgagtgaaaaataaataaatacagttactgtgtgcctcaggtcttactaaacagtccctcttctgaagaaaagaccaatttgataaaaaaattaacatttgggttcagaataaaacttttttcccctggagaatacatattttggttaaaaaaaagtttaagtctgtataagttgttttttaagcagaaatataaattagtcaaaacagtgggacatgacttaaattataatcaattttatcccatgtaatacaattgggtatctacttacagtaaacaaaaaagatgaactctttctttttatgaagtttatatgatgaaattcattccacattgtttcactgaaatattcttaagaaattaaactgttttgttaaatcatgacattgctaggtaatatcttaaaaaaattattcctaaataataatcatcaatgatttgcagttattttgaatcaacctagggtggaaaaaaagtaatcattaggcagttattaccaaacctctttttcatttgtattttcatttgtatatataagggggaggagcaccttgtaaaaactatattcacatccctacaggattagactggtttagagaagtagaaaaatatagtttaaaaacaaatagagaaattcagagagtcattagatatgaaaagcaaacataattaaaaataaaattaattaaatcatccctgagggatggagagaagagaagatggttatttttgtactcgcttcagggaaagcctaacggaaaagtatggcatccaagaatcttctcttcctgctcccagtcagtcagggcttctttaccattcatctctttccattccacacatgtttgaaggttcatctatattttaaaggctgctggtcctccctgtattttataggctgctgctagtattattttatcctagtttttacagtccaaatactattttgtattctgcaactttattttgtattctgcaactttaataagatcttttaaatttcagtactacagggatcccaaataaatcccaagtaaattgtgatgaataaattgtgtatataagacagtaattgctgaggaacacaaatctttcttctaataataaccacaggccagacatggtggctcacgcctgtaatcccagcactctgggaggctaaggcaggtggatcatctgaggtcaggagttcaagaccagcctggccaacatggtgaaaccctgtctctactaaaaaatacaaaaattagccaggcatagtggtgcatgcctgtaatcccagctacgagggaggctgaggcaggagaatcgcttaaacctgagatggggaggtttcagtgagtcgacatcctgcccctgcactccagcttggcctgggtgatagagtgagactccatctcaaaataataataataataattaaaaaaataagaaccacataatctaggcagaacataacaacaggaagctataaaagtttttttttttttccattcttgaatctgggtcctgacattcacaacatgtttgttaaagaaaacagaacaaaatgaacaaacaaacaaaaaaccaaaaaaacttcctgctctcatttagtttagggaatgctctttaactaacataaacgttccttacttgatcatcacccccggttttcacatacctcctatctgcatgcattcatgagacatatatcatatttggcagtgaaagtcaagagatgaatctgatgttggactagccttcagcctagcattcaacaacttgcatgactataaagtgtgaagtaaatgcctagaaggattgctgcctgccatagctacagaaaatgttctgggttcatgtgcatcatagagtaacctcctgggcaattagcagtggtatttttataaacgatgacaccagttactctgggcagatagagcttgtgaagtaccctagtgcttcagcaatggctttgagagtgtaggtcaaaattcttaattgcctggagttgctctggagcatgtgagcttaactttattgtgtctatcagtcaacactcatgtggttgcaagtgtcaggaacccaaattacactcgcttaaacaaaaaagggaatgtataggcttttttattaaaaatctcaggcacggcaagttccagatgcttggagaggatcaaagggagtcaggaatccatctgtctcccaaccctgatttcctctctaatggttcaactttccggcatgctcttccattgctgtaaagaggcagacaccagcagctccacacttgcagggtacatggttagtaatcccagcaggataagaactcctcttttagaacaatcctgcctaagttctgtaattcattcttttggaggaattttttttttttttttttagatgcagtttttggtcttgtcgcccaggctggagtgcaatggcgcaatctcggcacactgcaacctctgcctcccaggttcacgtgattctcctgcctcagcctcctgagtagctgggattacaggcaaccggcaccacacccagctaatttttgtatttttagtagagacggggttttgccatgttggccaggctggtctcaaactcatgacttcaggtgattcgcccgccttggcctcccaaagtgctgggattacaggggtgggccaccgcgcccagtctttgaggaattttttgaatgaatcattatggctggatgatgaaaagttttggatgggtatgtctggttcatgcaggcatgagtggagcctccaataatgtcaactgctcccaaatcatatagcctgagaacagaaaaggggagatgaccaaacaaaaaatagctgatcattacaaatacaaatgttaaaagcttggtctgaagtccaattttaggtgaccaaaatttgagccaataatttttaaaaagaaataaaatccaaagaaatgaaagcttttattgaaaactgttttgttggaggtggcagccagttattgacattaaatttaaaggagagtgaatttcatcatgacaaaaagtggctgttacaggtaaaataatgaccctcccccaaaagatgtctttacctaaatcctggaacctgtgaatacgttcagggactttgcagatgtggttaggttaaggatcttgagatggggaaattgtccaggtgggcccagtgtaatcacctgagtccttaaaagcagagaacctttcctgcctgtgatcagagagagatgtgatagattatgaagggccagagagatgcagcattactgtctttgaggatagagaaagggagccacgaaccaagaaatatggacagcctctggaaaatgggaaaggcaagaaacagattctatcctaaagcttccaaaaagaagacagccttactgtaaccttgattttagcccggtgaaacctatgtttggacttccaacctccagagctgtaaggtaatgaatgtgtgttgtttaagctgctgtttgtggtcatttgttagagcagcaataataaagtaatacaccagctatttctgcaccttcatacattctgtagcctaaattcttagcacatggtttgtacagaccacttagaactgctcagactgaaaagcctcattttggcagagactttttttttttttttttttttttctgagactgagtctccctctgttgcccaggctggaatgaagtggcatgatctcggctcactgcagcctccacctcctgggttcaagccattctcctgcctcagcccctgagtagccgggattactggcgcttgccaccgcacccaactaatttttgtatttttagtagagaaggggtatcactatgttggccaggctgatctcgaactcctgacctcaggtgatctgcctgcctcagcctcccaaagtgctgggattacaggtgtgagccaccgcacttggcctggcagagacatttaatgctcactgaatacatctgcatcacctgcctttcccagtctctgtgtagttaggtagggttgtgtggtttgctctgaccagtgtactgtgagtttaggtgacagatgtcaccttccaggctcagacaatgaaaagcctctgtgcaaccgtttggcttgttctttccccacctgggcaaattggaagactcatgttgaggtagttgctgctactagatgcaaatatcctgaatccctgggcttttgctgaaaaggagctgcctggaggaccactgggagtacagaagattttgcatgagtaaaaaataaatttttatgtcttaagccactgaagtttacagattgatttgtttctgtagactaacttagtctatcctgatgagttagaataagggctacctcaggagacaaaagtttcaacctatcaagtttaatgtgaaaactaatttctaattcagtctctcttattaatctatgaagttgcgtctttaggcttcggattccctctatgcataataaggagatatgcaattttatatagcacttggaaaaatattgaatattatttaagtgactattccctttatttgtggtgtttacatcatataatgatgaattttaatttagaaaacaaaaagaagttttgcattttattaaaaagtaatactttttctgtcattgactggtaatgctgatgcagataccatgctttcatgtcaagttcacaatttatgtgatgaaaattgccctttttcaaaatatttcacgtttaagacctttgacaagatactaatacactttagcaaaatagcatacttacagctatcaaaaggtgtgactgacatgaaaagtaaactcacagcctatgtttcttttctaagagaattggaatgcaaaaaaaaagtaagccaaaagcatagtctattttaagtaatggcttagtattttccatttaatcatccaaggtgagaatcatagctcaaaaaaaagcagggattacccaatttcactcctttatttgatggatgagaaaactgagaattgcagaaattaactaatttatgccaggtagccaatagggagagagatatcattcctgaggggaaatctaagtgcaggtagaaagcagcaattttgtcaaaggcaagctggatttgcctgatcaaaaatcacttcttttttttataactgtttttttattgtggtaaaatatatacaacatacaattcacattttggccattttcaagtgtacaattcagtgccattaagtacattcacgttgctgtgcaaccatcaccgccaccatccacctccacaacttttccttctctcaaactgaaaccctctgcccactgaaaaataactgctctcccccgcctgcaggtaaccaccattctgctttctgtctccatgaatttcactattctaggtacctcctacaggtggaatcacacaatatttgtccttttgtatctggtttatttcacttaggaaatgttaaggtacatccatgttgtagcatgtatcagaattgcattattttaaagactgaatagttttccattgtatgtatataacacattttgttcaaccaatcatctgacaatggacattagggttgtttctaccttttggctgttgtgaataatattgttatgagcacaggtgtacaaacatctatttgaggctaggtgcagtggctcacacctgtaatcctagcactctgagaggctgaggggggtggatcacttgagcccatgagttcaagaccagcctgggcaacatagggaaacctcaactctacaaaatatacaaaaattagccaggcatggtggcacatgtctgtggtcccagctacttgggaggctgaggcaggaggatcacctgagctcgggagttagaggctgtagtgagccatgaccacaccactgcactgcagcctgggcaacagagtaagatcctgtctccaaaaaaaaccccaacaaaaacaaatatctatttgagttcctcctttcagttcttttgggtacatagctagaagtgaaatttctaggtcacatggttgttctgtttaatttttgaggagctggcacatcatttttcacagctgctgaaccattttacattcttatcagcagtgcaccaggattcaaattttctctacatgtttgctaacaattgatattttgagggttctttggtttttgtttttttgtttggttgggttttttttcacgatagccatcctaacaggtgtgaagtgttagctcattttggttttgaaaaaaaccacatctttatactactgaaaagctctaccactaccttgtttgaatttggaaaaagttacaaggagtcatatctgtgaacaaagtccaagaaacccacaagttagccataattttagtgtctacagagactaaacaaataaataagagcagaacaaaaaataaaataattcatttatataggggtatttttttcaaattttatgttttaaaacaaactgaaatgttttattttacctaatttaaaacttcagatttgggttataaagttatctcaagtaatttacattgaaaacaattttgcatattacaattcttcagttattgtgatccaatattagtatcaattatagtaattttagatataaaaaactattctaattatttatttcctttctcaacagagagactaatataaatagatgttaaagtctgacatctattcaaagttttgcttttaaaataaatgttaaagtctgacatctatttcaaaggttttgctttatcttaatcagctatttcaagtaattaatgatttttgcctcgattttacttcaaaagggtttaaattttcattatatctgtctgttaccagtggctgaaactggtagaagtaatgtagctcacataacaagatttattatttatcaaaaattaagtcatcaaaaatctttggtatgctggtgactcttctctcaaaacaaaacctacaaaaatctttagccggtttgtaaaattagttgaatccatatgaactgaaaatccagatatttaatctgataacccagagcattctgcctatctagaccaaatagaaatggtgcataaactctttaagtcataatcaggttgtaataaacaggcagtgtatttgtgaaggaaggaagattattgcctactcagggttggtactttctaagactacaaccacaatttaatggttttggataaaccattaaagattggcttaatgccattatcgtgctcacctgtagaggacccatctcatctaatgtctcgtcttatacacacacagaccacacacatctcacagcttgttcagcactgggacagctaacttcatgcttttttttgtttccagatagatgattattttggagggggaaatgctcaaaacatactaataatccaaacacatttatttcccctggtcatataatttaacagctctttgatatgggacaaatcagtttctccccttaggaatttagaggtctacaggttcttactcagaactaaatgaaatacaattatatgaacagggtttttctaaatcttaattttcaaagaagtgtaaaggggtattattcttaaagtaatactataagtcattcttttactttcccaaaacagaataaaaacctcaaacaaattagattagaaataaagtttaacatcacttcttcctgctaaaatataatcatgttggcgttgtcacatgctcaagaaaaacttaaaactgttatatttgtacctgagttgaatttttatactggtagaacactaatattttgaaatatcctctgatatgatttatagacttggtaattttattttatttttatttctccctcgcatttccttttgtcattaagtgtaaaccttgtgggaggctgagggttactcctcagggtagggaagagtaaacactgcatagtacaaagaataactgttcaactttggcatccaagttgagatttttaagctctatagggaaataatggttgtgaaaatcaggttttgagaagaaaaaatgattttctcagactctcaaaatcatatcttcataggttgagttgcacaaaatttttaacattcaaccattttttgaccaatgaaatgtaactttattattgttcaatttatagtgtatatcaagaactcaagcttggagaattggccctagattacagcatgaagaagaaagggaggtcatgtgatgtgatataaagaaaatgcttacctttttgttgctagaaggaggagctgaagagagaatagggagaaaggtctgtgaaggcagacacaagatcaacccctgggcgagagcagtggacagggagatacacacccaggtgggtctggggccaatttcactgcctcaccacacagagcctgaggacttttcaaggcccttcacaataccttacgttgactggccacaagtaggagcacttctgtttccaaactgcaaggactgagttaccctaaatgggcaagtttaagttcacttcttccccttgctactatgcaagaatagaagatcaataaaaagaagaaatcaattaaattttgaggtattccatactagatttagataaacgtgttcttcaaaatgggttgcatttaggaagaaaacagacttttcctatttttaacatgtttgctactttttaacttgctacctaatttgcagtcttttgtgtccttagtatacaatagttccaatatcaacagctgtaaagtgacacaattcattcattgtcacattgctagttaatggaaaaaaaaaactagaagcaactttcatattttctgagcttggtccagggcacttcctaatagcattactttatttttaagctttagttataaagtgctaagacaatgatgcactgaagtttactggactaatgataaattcttctttttaaaattttctggtcaaaatagatgaatagaagtgttcaaagcttgacagaatggtttatatatatattttaattcttaagggagaccacaatctcaattcatctctacaatggcttttattgcctcttctatgaaaaggaatcaatacaaggatcaaatttccgtattttcaaaatgtgctcattttaatttggcacagtttcctcatttcctctgtggatgccaagaaaagcacctgtgtgaaaaaggcttatgttaaacttagacaaaacaggccaagtgcctataagaagatgaaaacaatcagaatgtgttgcaaagaaaagttgacctttctgagcctccaaagcctcagatttgcatcttctgcatgaagctagaggctagactcttcctgtcttatttattatctgaaaataatatgtgcctttatggctgtcaagatgatgaatgtaaaatcctctatcaacctttaaacaagatcactgcttggtgggtccttcgaagcttttggcatcttcactaaataaaaattgcaaaagctcaacacacaagaatgggtggcagctctttagactggcttcttaagtaaattaactaatacaaagaattcagatccagataaaaccaatgtggctggctttctcagatctgtgggttagtgcatccatctttactagcaagtgattggtgcaatataaaaggaaacttccagctgtgcttataaatggttgggtgtgtagttagggaaatccatacagccataaactcccagtgttgaattagtgattgttcagaactgaacaaatatgtagaagcgtaaataactgaatgtagcacaattccccaaaaagtcccattgtttccccgctgcagtaaacatggagatttcttttcccatgcaggagccacaggaaaggtggtatccagtagtaagtagaggaccactgactctccagatcacagtatttcacatgaccccatacacaggctaacagcagtgtcctgccaaagtataacccatggggaataggcctttgaggttgtttaaaagtggcagactgtgagagagaagcatatttcctttctgggagcctaatttagctggaaaatgaagataggcagaatgtgagtttcctgtagcttcatgcattgtgtaattttattagacataaaaaaaaaacttcctctgaatgacttatattaaccaactgagatgtttacttttatgtaaaatgtgaccttcaaactttgtaaacaatatcatccaataagaacacaaaatattaatagctacctaaaatgcccatcacggtcagtccaattatcaaatcctgcaatggaaatcgctttctttaatttcacaaggcatgcattgagtcccacaatatgtgtatgtatgtcaacaaatatttgtggaacatccattgtgggtcataaaattgttcaagcccaggggacatgaagacaggtaacacagtgtctctaaccccaaggaattttcatgccagagtgaggaacagacatgtagacaggcaaacactaagattaatgcggggtgttatgatggctgaagagaagctgggagctaaacctgctgttggtatataagtctctgtaatcctcatggctctggagacattaccagttacttgtaatactaatggacaaatcctgcatccttttctttgaagtgatcaaaagaagctgaaaaagcatgtattatattcttctcagcaccataagttcatgcactctataatttagatatatttattgatagatatagatatacaaagagacaatttttccttctaggtccataaaggggtacagtaaacttactaaacaatgtacagtaaacttgaaaaagggagtgacagataatacaacaattctctatcttttgccttataccactttttttttttttttttttttacagacagggtggtgttactctgtcacctaggctggaatgcagtggtgtaatcatagctctctgcagccttgaacttctgggctcaagcaatcctctcacttctgtctcctcagtagctgggactacaggcagcacaccaccatgcccagataattgtttttgggcttttttaagttctttactcacatatctcccacctctcaccaaattttttttttcggatggaattttgctctgtcgcccaggctggagtgctgtggtgcaatctgggctcactgcaacctctgcctcccaggttcaagcagttctcctgcctcagcctcccgagcagctgggactacaagctcacatcaccatgcccagctaatttttttttttttttgtatttttactagagacagggtttcaccatattggccaggctggtctcgaactcctgacctcatgatccacccatctcagcctcctaaagtgctgggattacaggcgtgagcaactgctcccgtcccaaaaaaaatttttgtcaggaaacaaggaaacaacatcaagcaaggaaacgctactgacagtatattcaggctatttttccagtagcctccccttaaagcataaattatgagtcctccttaacagagtacaacaatgggttgtatagctgttttccttatctctagtgagaatagattcctgggtttagcaaaaaaaaaaaaaaaaaaaaatgaagctgtactttacacttctttttttaactgtaatgtttagaggttatactaaagatgtttagagcttactctgggaagccaagggcttctgcacttgcagacatcacaggagaacaccgagcctctgtgatagtgggaggtttctcggcaagggaggcagcctcttatcagaggtggattccttgtggtgataagaaggtgttcattggagctattatatccaaaagatgcaggattacctggggaggaggaactcttcactctctgcttaggtatttgaagcaactggaaatttctgctataggttctttcttccattcaactctcaatgagttccacaacgcttccaatgaaacttcctatggcttgctgtatatactgcaaaaccaggcttatacctaatcatagaataaaacacagtcagttccacattgctctacccttcaccatgttaattagggtgggtgacactgtaggtgtgttctgcactggccctgaccaacacatggtcccatcatcaaaagtcaaactgtccaaaagcttttccatgccctattgacagctagctgtattgtttagccatagaggaaatgttctggtttatatgtgaactttctggagatagcatgattcaaggacaagacaaatggttttggggtcaagcagatatgaacttaagtcccagctccataatttttcagctgtgacctggggtaattctgcaaaagcatgtattatgatgcctagtctacagaccaacaaactaaagcccagagaagctccaggaacacaataagaaaaggaaggtctaggaagaattcaaatgcagatgccactttaccatattttccaaaagattgtgtcttctcctccctggcctttgaatgttccacttgttcagattaccatctgtgataaacctacgtttacctcttcattgttggccaccttagtaactgagtggttctacatcttgaggcctcactgaccaccaaagagaaagaaaatatcctgagtatcctggaaaagggatttttaggttcacttctacctagaccgctgctttttattagaaatggaagtgagatcagatttttaaacccagctgcagttactgtggttaaagctgatgtggaggtcaagtctatttgaaaattttaaaacatatgaaaagacatttagaatccctggagataaagaggaaagagccttagaagaattttctcctggacatctctggagatcttaggagtagttaacaagaataggtcttttagattgggatctgttgtcaacttcctcagataaaaccagatgaactgcctgaagacaagatagttcttccaaccagtagttcatgcataatagcacatgtgctggagttaataagcttggcaagacccaaacatcttgattccttgacttaccccatgtggaggtagatggaaaaaacaataaagaacagggatgaaggaatacatagctatgcctaacaatttgagtttgctttgactggtattttatggtatatttgtatgaatgtgaataaaaatggagaggggggtagaaattaaaataatggggagaaaggcagaattatgataacttggtaaatagtccaaaaccaaaataacttctccttggaaattatagcagagagaatgagtaggaggaaagactgatctagtgataatgaatttcatggagaaaataaggctcacattttttggatgtggagagctgattggttcaggatgtttgtaatggagaaactcacattcttgcttaataaatcttgccttgcagagctacatatgaaaatttcttctatactgtctgccctgaccagtatgtctataatgtcttatctgaagcttgggggccaaatatgtttcagaatgtggactttttaagatgtgaaaagtaacccaggtatggtctgggacaatattctagtatcaaatataataatatttacaccaatgtataaatactataaatagcctcccatcagttcatatcaggttttgctgccaaatgaattgagattaggtcaggtcagattttgccaccagatgacctatgaaaaacttaaattttccagaggatttaaaaaatagaactatgagattgtgaacctgtacaaatggtaacttttacttgactattctactaaacaaaaatatcagttgatttacaggaagatggaagactttgatttgggcaacgtgcttggagatagggtacagtcaataataacagtagttaacatttctagagcaattactatgtcacagcactattctaagagcttaacatgaattaactcacttgagcctcttacaacattatgagatatattgatgtattgatgggccgactgacacatgaataaactgaggcacagaaagtttatgtaactctgccaaatgcatacaacaatcaattggaagggcccaagtttgaacatgaattgattccttccctgactattaatatcataattttatgttctacacaaggaaaataggacttatgtgtcattcaaattacattattcctgacaatagaaaactaagggatatattttacattttcagttagtataatacaggcataactcagagatattgcaggctcagttcccgggaaccagaataaagtgaatattgcaataaagtgagtcacatgatatttttggttttccaatacatataaaagttatgttcacactatactgtagtctaccaagtgtgcaaaaacatgtttaaaaaacaatgcacataccttaattttaaaatactttgtagctaaaaagtgctaacaatcatctgagtcttcagcaagtcctaatctttttgctgatagagcaacctgctgcccgcgggccacatacagcccaggacagttctgaatgcagcccaacaaaacttcataaactttcttttttttgtttttgagatggagcctcgctgtcgcccaggctggaatgcagtggcgcaatctctgctccctgcagcctctgcctcccgggttcaagcaattctcctgcctcagcctcccgagtagctgggactacaggcacgcaccgccatgaccagctaattttttgtattttgagtagagacagggtttcaccatgttggccaggatggtcttgatctcctgacctcgtgatccacccgcctgggcttcccaaagtgctgggattataggcgtgagccactgcgcccagcaatacttcataaactttcttaaaacatcatgagatttcttttgcaattttttttttttagctcatcagctattgttagtgtattttatgtgtggctcaagacaattcttcttccaatgtggcctaaggaggccaaaagattggatccccctatgacagagggtcttacctggaggttgatggctgctgacagataaaggtggtggcggctgaaggtctggggggctgtggcaattttttaaactaagacaacaataaagttagctgcattgattagcttcctttcatgaaagttttctctgtagcatgtgatgctgtttggtagcattttactcacagtagaaactttttcaaaattgaagtcggtcctctcagaacctgccactaatttatcaactaagcttatgaaatattctaaatcatttgttgttatttcaacaaggttcacagcatcttcaccaggaatagcttctatttcaataaaacattttctctgcttatccgcaagaagcaactcctcattcattgaggttttatcatgagattgcatgatacacatctttagtctccatttctaattctagttctcttgttatttccaccatttctgcagttattttctccactgaagtcttaaacccctcaaagacattcatgagggttggaatcaacttcctctatactgttgttaatattgataatttgacttcattccacaaatcacgaatgttctttacggcatctggaatggtgaattatttccagaaagttttcaatttactttgcccagatctatcagaagaatcattattatgaaagttataaccttacaaaatgtatttcttaaataataagacttaaaagtaaaaatcactccttcagccatgggctgaagaatagatgttacattagcagacatgaaaacaacattagtctccttgtacatctctaccaaaacttttgggtgaccaggtacattgtcaatgagcagtaatattttgaaaataatatttttctctgagtagagatcccagtagtaagtttgaaatattcagaaagccatgctataatctgatgtgctgttattcaggctttatttttccatttctagagcacagggagagtagatttagcatcattcttaaggaccctaggattttggaatggtaaatgcacattgtctttaacttaatgttatcagttgtattagctcctaacaagagtcatcctgccctttgaagccaggcattgattctcctctctagctagtcctagatggcatcttcttccaatagaaggctgttttgttgccattgaaaacctgttctttagtgtagcctcctccatttgttaccttagctagatcttctggataacttgctgcagctcctccatcggcactttctgtttcagtttgcacttttgtgttatggaaacagcttctttctttaatcctcatgaaccaacctctgctagcttccagcttttctacttcagcttcctcacctctctcagccttcattgaattgaagagtcagggccttgctctgatctgcctttggcttaaaggaatgttgtggctggtttgtacttctatccagacactaaaactttctccatatcagcaataaggctgttttcttttcttatcatttatgttttcactgaatagcactttcatttcccttcaagaacttttctttgcattcacaacttggctaaccggcgcaaggggcctaacctttggcctaccttggctttcagcatgctttcctcactaagcttaatcttttctagcttttgatttaaagtaaaacaagtgtaactattcctttcacttgaacacttaaaagccatttaagggttattaaatagcctaattttaatattgttgtgtcttaggaaatagagaggccagagaagagggagaaagatggggaaatcgtcagtaagtggagcagtaaaaacccacatactatttatagattaagtttcctgtcttatatgggtgcagttcatggcaccccaaaacaattacaacggtaacatcaaagatcatcgatcacagaacaccataaaagatataataataatgaaagagtttgaaacattatgagaattacctaaatgtgacatagagacacaaagtgagcacgtgctgttgaaaaaatggcactaaaaccgggcatggtggctcacacctgtaatcccagcactttgggaggcttaggcgggtgggtcacttgagcccaggtgttggagactaacctgggcaatatagtgagacctcgtctctacaaaataaaattagctgggtgtggcgataggcacctgtagtcccagctattcaggaggctgaggtgggaggatcacgtgagtccaggaggtctaggctgccatgagctgagatcgcaccactgcattccagtctgggtaacagagcaagaccctgtctcaaaagcaaaaaacaaaacaaaacaaactcaatggcattggtatacttacccaatgcagggttgccagacaccttcaatttgtaaaaaaaaaaaaaaaaaaagtagtatctacaaagtgcaataaagtgaagcccaattaaatgagatatgcccctgtctttcaagatgcttgcttttatcacggagtgtccttttctatttgagaacaactgaagttttgtatcttgaaactgagtaaattaacagattattgacacaaaccatgttagcatgagcaacataagaagaatcaagcatttgcatttctccttgagagtagggactggtttttagtcattgttttatccccaaggcctaacttagaggcttgtatatattacacactctatgggatgaatgaatgtgtcccaacctcaaaaaagccccaaaatgaaggagtcccattcaaacatgctaatttgcattactccatttacacttttctcttggttaatgttaatccattaggttttagtaaatcaaacttttatattggttcatatttatataaaagtgtagcattgatgaggagggggcagtgaacagctttgcgtttggttgaatgtattattttagctggtccctcctgactcctactcatgcttatacgtttgtctgtatatatgcgtgtgtgtatgtgtgtgtgtctctgtatgtctctctgtgtgcatatatgtatgtgcatgtgtgtatatatgtatgtgtacatgtgcatgcatgtgtatgtttatgtttgcatatgtgtgtatatgtgtgtctctgtgtgtatatatgtgtatatatgtgtgtgtctgtgtgtatatgtgtgtgtgcatgtttgtatatgtgtgtatgtatatatgtgtgtgtatgtgtatatatgtgtgtatatatctgtgtgtgtatgtgtgtgtgtatatatgtgtgtgtgtgtgtgtgtgtgtgtgtgtgtacctatgcacatgtaatatgtaacatctccagattagatcaggccttattccagtagctctcggaaaatgatgcagcttatccagtttgactactctggatacttgactgccagagtcaggtgctttcacctggttcccatgactatctctgacaatatctgaagagttctttgactcagaactttgtcaagatgataaaggtgagaatccctttatcataccacaggacaaactacagataattttttaagttaccttgaacaaaatatgtacttatagtattaatgtccaatatttattaattaagaaatctgtggatacgaaaaaaaacttccagaacccatccatattttgcaccactgccatggttctgcaggatccatggctcccagcttctcctgtcctgtctcagtttcagaccgtaatggtagagtcactctcttgtctcagtgcttcggtactcaaagcagattctcagtatcactatctgcagttgtgcaacaggctttcctcagagcacggcattgttctcacagagcttctacagcaaactggattttgctactccataggaaagtgctgagacatcagagtgtcactcttttccaaagcatcctctccaaaatcactggatgactgctccttcctgtagcttttccctctgctattctatctcacaagatatcactctccatctctctctgtgtccctctgtccctctgtgtccctctgtccctctatctgctctgtactacagtggatagatgcactattttgacagagaatgccactttcaggtaaggcaagaccaggtaaaggattgcccattggctagcagccacttactctctgttactttctgtggcacatcattatacttcctctctggttattcttggatctgacagacttatgtctatacatgcagagctacacacacctgcactcctataccatccttgcagagagaagagaatttgagaatttaagatgtcctatttgcttttcacacatttcttacaccagttgttaacatagaaccattttagaaatagttctttttcagttttaattaaaattctaacttgccaacattcttattttacccacttgagagatttgtgctcacacacaaatacataattctgtgatttatcatgaatagataaatagaaaaaaattatctaaaaatataaacccaagaattaacatttcattgatttatcatcatcaatgatgatgatcatcattatgatcatcaatcatcataatttctaggaagctaaaaggaactgaagaggcttttttttttttttttttgagatggagtttttgctctgttgcccaggctggagtgcaatggtgcaatctcgagtcactgcaacctctgccctcctgggttcaagcaattctctgcaaacttgactcctgaatagctgggattacaggtgcttgccaccacacctggctaatttttgtatttttagtagagatgaggtttcaccatgttggccaggctggtctcaaactcttgacctcaggtgatccacccaccttggcctcctaaagtgctaggattacaggcatgagccaccgcgcccggctgctaaagaggtattaataagttatttttgctcacttttggtcctttttctctttaagaaaggactggcggctgggagtggtggcttatgcctgtactcccagcactttgggaggctgaggtgggaggatcacttgagcccaggagtttgagatcagcctggtcaacggggtgaagccctatttctccaaaaagacaaaaattagccaggcatggtggtgtgcacctgtagtcccagctacctgggaggctgaggaaggtgaggctgcagtgagtcatgcttgtaccactacactccagcctgggcatcagagtgagagtctgttggaaaggaaaggaggaaggaggaaggaggaagcaggaaaggaggaaaggaaaagaaaggaaaggaaaggaaaggaaaggagaaaggagaggaaaggacaggagaaaggagaggaaaggaaaggagaaaagaaaagaaaagaaaagaaggaaggaaagagagagagaaagaaagagagtagtggaggaaggaagggaagaaagggaaagaaggaagggtaggaaggtaagaaaagaaaaggaaggaaaggaaaaaagactgacaaggtagttaagtagtttgggggtcatgatgacattagtatactaaataaaccactccaacccatccacctactaaagaagtcactcataatcaccatcattgcctccaatttaactcaacaagaatttagcacttaccatgtacccactatctggcaacatagatgcagagtgagctgttaaacaaggcataagaagcttaaatgtcaacatgtgcattaacaacagaatgcattatgttaagtattaaaatagtctagaataaatgctcagaagtccaaagtccctaatacaatcatagaattgtagagtcagggaagtctttcattaattatatggattaacatttttcttttataaatgaagagactgacacacacggaggggctgatttgtccaaggttttaggaaattactgtagtggccatccatgtgagtgtaggccccgaacctccccttgcttgttttgggagctgccttctctctccatactgggtcaggtaattcattccctggctctcagatggtattaatttgcccgagagtatatcttagaatatataaataattttttaaactttgtgatgtatgtggtagccatgctggaaatgctgacacttctgtcattaaacattgtcgtgcactaaaaagtacatgctactaaaaatatttcttcctattttgtttgatgttaaaagtctcttcaaatgataaatatgaaagccaatttggacctcaacgaattggattctgtgttagttctctagccaaaaaataattgattaaatttccttaatatcaacatgttacaatgaataacttcttaatctttgtcaaaatcaataaactgcatgtgaaacaaccagcttcttattctgcttagaattttgatacagttgtgactttccctagatttttccataagtttgatttttatgatttgcttcattttaagctatcttctagataacattatttaatttattaaaactcttactaagaaaatgactacaaaatgagacttgtaataatggggaggagcctctgtttattatttatttatttatgtattatttcattcactcgtcttcctgatttcctttcatttctgttataaatcgcaatgcttaagtacattgcaatgttgaaagtttaaacatggccaggcatggtggctcatgcctgtaatcccagcactttgggaggccaaggcaggcagatcgcttgagcacaggagctcagaaccagcctaggcaacatggcaaaaccccatctctacataaaaatacaaaaagttagcctggtgtggtggcacacacttgtagtcccagctacccaggaggctgaagtacgaggatcacttgagcccaggaggtagaggctgaagtgagctgggatcacacatcacactactgcactccagcctgggcaatagggtgaaaccctgtcttaaacaaacaaacaaagcaaggaggaaagaaagcttaaacatcaattgcatagctcactcacttattcagagatgagccttgtcatctaaatgaaccaatgggatgtggggagtatttgttgaagctagcaggaaagacaagctgcctgtttttctgtagtaaataaataccggtagaaacattctttgacactagacagaaaagagaattctctctagaagataatggcagccatctgagtaccaaaatagtatcaggcttaggaagaagctggcactgtaaagggagagcaaagagaccaaaagaagccacattttcagttacattattgaggccactagttcaagacttgcctgaagctatctctggagccaatacattttctttattagttaagccagttagaattgggctttcaggttgttgaacaaaaacagtagtaaatgatacactattattgaaatttggtataaagaaaagttttgttcattgtggcagaccctattagtcacctacacaaaagattctgttcttccttgtgaacggaactccaattttactcatagttcattcatacagtattttaggggtcctccctcacccatttcagaatgctaattttcattagtctttttttttttttttcttgagacagagtctcactctgcctcccaggctggagtgcagtggtgccatcttggctcactgcaagctccgcctcccggattcacgccattctcctgcctcagcctcccgagtagctgggactacaggcgcccgccaccatgccctgctaactttttgtatttttagtagagacggggtttcaccgtgttagccaggatggtcttgatcttctgaccttgtgatctgcccacctcggccttccaaagtgctgggattacaggcgtgagcctccgcgcccggccttttcattagtcttaaccaatcatggcattgatttttttttttctttgtcaagggctgctttaggaatatgatggacatacatgcacaaaaatatgaggtaaattctgttgcaagcatcacggaagctttcctaacttttaaaaagatgagacaagacaggactttctcttccaactttcagacaatgccttatgaagaatgcaaccaccttgcagatagaaaggagaaacaaaagaatcccagagaagccaacctggctccccagagctaccaaatgagctaaccctggaattcccccaggtttcaccttaggtacaataataaactttccattgtataagttgctgatagtcacatatcctgttatttggagctggatcactctgaccaatatattcacagacaatattgattctttgaggttaatctcaagtaaaatattaccttacttaattgattaaagctaatctgagtcctaaagaggaaacaagtactttcaccatttttggcacactttatcatttgatggtttaagtggtttgaagaactgaagtgaccaattaatacataatgctgattaaatttaaataatttctatatcttaagcctcagatgaaatggaaagtttgcctgctgaaaacgaatgtgtgccctaagcctttgtttatccaggtggttagaaccagaaaacactgggagggtcatcttgggaagcagccagaacaaatgcccataagtcttaatggtaaccgtgctgccaattcctaagattcttagcatttgctagatcagaaattaataatagatggaaacaaaaaagaatgagacaactggcctgttgttttatcttttaaagccaggaatattccataaacaattgagaagtgattagcatatgacccccaagggtatgttgtgaccccagatcagtaggagatgctaatgggacaagacttccatggacttacatatttacctgacagtagaggcaggatggagtgatgtggttgaaaagtggcctgcatgtttcagacctgtctgaacaatggataggtgctgtgatctatacaaagattctggtggtatcattcataatagtagcaataagaggcaaatatttactctgttccggtgtaattgctgaacaagttcttagtaaaatgacatggagtaggtgctctgtaaatgtttatctttccccactttccttttatccccctctttactcctatctcacaagtacagaggaggaagctatggaaaaaaaatcatagccacagaattttttgacatctctaaaaattatattatttttctattttgatttatgtacaatacatctcaacaaatatataaaacaaaacttatatgcaacaacagaagcattttgctgagtattccatctgtcctcttgacaattttttatgcctctctaaagtgccttggatttgagtctaacctgaaaataactctattaccattagctttaataatgttctcaaggaatataacttacctgataaagtaggtaactattggaaaaaacacctatgaaaattaatgtttataatagaatatcagaagatttcctaaactaaaaaatcttgtttgagtcccctcttggagaatttctctataacttttgaattatcttttgtaatttcaagatgaaattgtatcttgatatgaaaaaaataaaatcaagctgataaaattggaatggcattccacaaggaggaggaattgaaagacgagtattccacaagctgtcctcaagaacggggcatttttatgctgccaagttagcttagcagacacatccctgtccctcagcccatccttgagtcaatttctcactgttgttttattacagtaaaatttaaactaaaagcaagtagcacaaagtaaaagcaagtagcacaaaaaaagttgataaaaataaagttagatatgattgttcatcttggagaagattgataagcagtcattgcttttgtaagttcttcctctcaagtgtgcaagggccctcccacgtcgacattatttttacccacttcaactctgctattgcttctcgttcgcttaaaccactttcatggctgtctctctaaaacctactttccccttggcatcttctgaactgaaccctgtagtttcaaacaataaatgtccaagtgctcaggcatgtcactacaaagcccatttgtattatcttaatacaagaaaagcttcagccaaattaaatttaaaggcatttaattgagcaatgaatgattagcaaatcaggcagcccccagaatcacagcagattcacagagactccagttcagccacgtggtggaagatttatagacaaaaaaagggaaatggggcgtgcagaaatttgaagtgaggtacagaacagcaggattggttacagctccgcctttgccttatttgaacacagtttgaacactcagcaatgtatgagtcattgaagttctgccgctgcaattggccaagactcagctattgttacaggtgcatactcctaagttaggttttcaatttttgtctatctattaagctaggttgcagtttgtccacaaggactcaaacatagaagtatggagtcctcaggccacatttagttcactttaacaatctgataagtgactcctcatcagcttgttacttccttatggctattatgtctcctaaagtgacttaaaccgaggaggaaacatggggtttggacatgtccttgataaactagtaccccatagagattgagaacgtattttgtgaaagagaattataaggatgtggaggtgaaggaagttgcaggagcatgttgcatgacctaacgggggtggagataataagacaaacttaaaaggtatttagaagtctaaatcaacagaactttgtgaaaagacggatgaaagagcatgggggtaaaggagaaactgggtatgagataagcttcagaggttagataatgagttgagtttttggcatattatatctgaggtgcttataagatatctcagtaggagttcagagtctagagctcaggtccgacctagagttgtaaatttggcattattcataccaatatattgcaaccaaggccacaggagggaatgaaatgacctatagagagggaaaagaaagtttaagaccaggagtttaagaatctccatgcagtaattactctgaggaaaagctcacaggggaccaaaggagtaggcagaaagtttggagaaaaagagtgtcctgttaccaaaatgaaggggagagtgctctgaggaagactgtcaacagggcaaatgtttagaggtcaagtagatgaacttgaagcaaatccattggatttggtggcattggtaacctcagtaagaccaagtttagtaaggtccttttgaaaacaaaaattagattgtaatacgttgacatgagaaaaatacagccgttcccttttatgcatggttttgctttcttcagtttcggttaccagaagtaaaccatggtctgaaaataggtgagtatagtacaataagatattgagagagagagagatcatgttcacataactcttattacagtatgttgttataactgttctattttactattagttatttttgttaatctcttattgtgcctaatttataaattaaactttttcataagtatgtgtgtacaggaggaaaacatagtatatatgaggtttggtactatctgtggttgcaggcatccacggggggtcttggaactatcccccgagaatgagtagggactactgtagaggaaagagggtgagtacagacaactcatccaagagctttgactgcgaaggcaagaagagtgacagagtaatagctgaaaaggcattaagtagcttaagaattttatttcctatttaaaatggtagcaattaaatgtttaaatgttcatggcttggagccagtagaaagattaacatttacaaagaagagggaactataatggtttaagattccagaggaggcaggagggtctgtaatccagatctctctggatgtctggaaaccctcagttgcccttagttgcaatccaagtccactggtgacattgcactaaatgagatttctggctctcctataatggatagattttcttcattattcagatgttctttggttttttttcccttctctattcatttcctgttgctgctatgacaaattatagtataacagtagcttaaaatgacacaaacttgtgatcttatagttctttttttttttttttttttttgagacggagtctcactctgagtgaagtggcccaatcttggctcactgcagcctccacctcccagattcaagtgattctcctgcctcagcctcctgagtgcctgggattacaggcacccaccactatgcctggctaatttctgtatgtttagtagagatggggttttaccatgttggccaagctggtctcgaactcaggtaatccgcctgcctcagcctcccaaagtgctgggattacaggcctgagcgaccacgcctggctggtgatcttttatagttcttatagatggaggtcaaaagtccaacaggtgtcacctgactaaaatcaaggtgtcaacaggactgtgttctttttataagttctagaggaacatatctttctttgtcttttccatcttctttaggccacttacattccttggcttgtagcccctgtctctgtgttcagagccagcattgtgacattttcagatatttttctctgactctgaccccctacttcccttttatcatccttgtgattacattgggtccacccagataatccaagacaatcttcccatctcaaaattcttaatcacatctgcaaagtctcttcagtcatataaagcaacatattcaaaggtttcggggatatcttaggggcgtattattctggacatctttgtggacaggcagtcattattctgcctaccacacttccctgtttctaaagtactcttccaagcttgctgagaattatggatggagcttcccatgctctacattttatataagtgaaaatctcaataacaaattttagccatgttattctttttttttttttaagacggagtctcgctctgttgcccaggctggagtgcagtggcatgatcttggctcactgcaacctctgcctcccagcttcaagcaattctcctgcctcagcctcctgagtagctgggactacaggcaccttgccaccacgcccagctagtttttgtatttttagtagaaacacggtttcaccaggctggccaggctggtcttgaactcctgacctcatgatccacccacctcagcctcccaaagtgttgggattacaggcatgagccaccatgcccggactcagccatgttattcttaaacgatagaggggccaccactcagagaatatgttctgagaattatgtgatgatcccacttggctggtactggtagcattttatttcatcatttttagtattcagaacaaaataaatgaacgacaaaaataagttctgtgtgaacctgccgctgctgtagtatcttttgcagtttattatgtcttatgcacacatttttaagctctggccaaaagacactgacttcagacctagcaccatatctagggggctaggaaaagagagactcctctgcagaccagtagtgctatctcactgtcatcccaaggctgatcaaaagaaagaaaatgagggatggggtgaaattttaaaaagagaaggggctgtgtgtagagatgtatagttgcacatgtcagtcaaaatttggtacaataaaagattgcattcaagtgtcctgtcatcaggaacatttaatagcaatgtcaagtcagctaaatcaaaataacttgtacctcctctgtacaacgcccattcctctgcacagtttaaacaagtaaaatcctgataaacaatagcaatggatcctttatcccatctttctcaaaaatttttttcagtcattatcaaagaatagccctaacaatactattattactacaacattgttttgtttctcagtgctacacaacactagaaactgtcatatctttttaaaattaaggcaaacaaattatctaagtaggcattccttatttcataaggaggtatccttaacaaacccttgtgcaccaccaggaagaaaaacttgaaaaagtcccacatttgacactagtgcaacatgcagtccaaaagatggaaaatggccaggcgcagtgactcacacctgtaatcccaacactttaggaggccaaggcaggcaaatcacttgaggttaggagttcaagaccagcctgactgacatgataaaatcccatctctactaaaaatacaaagttagccaggtgtggtggcgcatgcccataatcccagctactctggaggctgatgcaggagaatcgcttgatccctggaggcggaggttacagtgagccgagattgtgccacttgcacttcagcctgggtgatagagtgagacttcttctcaaattaaactaaactaaactaaactaaagtaaactaaactaaactaaactaaaataaaaagatgtaaaatcatctttacttttgtaccttcaattgactttgagtccatactgattcattttcagataagcatagaagcagtgcttcatctattgtcttctatctttcttccattcattcaatctcatggactctccctcctggaatttcctaacctcccaccagtgtccatttttaccttgtggcttctggccaggctgctggtcactgcattccatccattattctcttcaaagccagagttgtgggaggagacttcaggtcctactcataggaggaagtaagagagattccagaaaccctttcttctgctcagattgacttcctcttggtataactcaggtacatggttatgctaacagtcttctcaaccttaccaagaaccccttctgtaaaatattctgatgtggcctgagaccctgcagtgggtgggaaggaactctgccccagaaaggaactgatgagctaagtaagttagcctaggttatcctaccctcaatcctaatggagcactttgtgctactggagagtagatagaagatgggatacacactgcactctgctcaccagccaatgtctggccactggggcctacccccaccttccacaagcctatattcattttgtggcgtcatctttgagacatcatcacttgcttttccgcacaaacgaccaacaccctgccagcctttcctgtgctagcaaagatgtgtatgcaaacatctttctgtgatactgttcttatcagtcttcttggacatatgtgctgactccagcaagctccaggaataagggcctggattcagattctcaggagtgggggattcacttcctccctgcatggtggtggtaactgttaaacttctgtggaagctggggagtcactgtgcttccaacccaaagtccaatctcttccttcctctccctctggctcatcctctctttcccacccctacccataggaaggaaaagagagtctaaggaaatagatctattcatccactgaaacagaaatggaagcaaaaacagaaacaaacccctgaacactcatcattttttctgtatgttctggagataatttagccaaattggaactggcaagatattgttgggatgtaagctaattaaagcagcggggctgggttgcaaggaccatggatgcattcaatcagctagtaacatttaaaggcaaagctttgtcaagtagccagcacaatagatgtgctctccctcctccagctgtgcatattgcagccttgtcaagaataggcttgcctggtgatttctggcctacctgttaggatttagccaaatcttggttcaccataaatcttgcaggtcagcagaaattcacttgtagaaacctggctgatcatcagatttccttgggaagctctgtaaaaatatagattcccaggcacccttctagagtcactcaagcagaatttcaaggatgagatcttggattctccatattaacagagatttcccagtgccagacttggggaacaatttttacagcttatagaaatctaaatcctagattgggaagacatctaggggatcaatttttctaactttctgttttctatcaaaaaagaaagtaggctgggcacggtggctcacacctgtaatcccagcactttgggaggccgaggcaggtggatcacgaggtcaggagatcgagaccatcctggccaacatggcgaaaccctgtttctactaaaatacaaaaaaaaaattagccgggagtggtggtgcgcacctgtagtcccacctacttgggaggctgaggcaggggaatcgcttgaacctgggaggcagaggttgcagtgatccgagatcgtgccactgcgctccagcctgggcaacagagtgagactccgtctcaaaaaaaaaaaaaaaaagtaaactcagtgatattacatgcaatgacaacagtttgttgtgggttttttgagacaaagtttcactcttgttgcacaggctggagtgcaatggcacgatcttggctcactgcaacctctgcctttcaagttcaagtgatactcccacctcagcctcccaactagctgggactacaggcatgcgccaccacgcccggctaattttgtatttttagtagagacagggtttctccatgttggtcaggctggtctcgaactcccaacttcaggtgatcctcccacttcggcctcctaaagtgctgggattacaggcatgagccaccatgcccggccaccagtttattttttctaatgcagtagtgaaagcattatttgaagaaaaaaatactcctggggagggaatctaggatattgttgtatccaccctaaagatacagcaattgtaaccttcgggctgatgctttcttaggtgatttgtgttatatatgcacttaactttcatttatttattcacttgacaaatgaccatcactacaatccatgcactattttgggcacaggggatacagtactgaacaaaacaataaaaaagctctgctttcatggagctttcattccacgaggggagagtgactgcaaacaagataaaaaccagatctagaatagtcagatacagcatgtcagtaaaaacaaggcagaaaacatggatgtgaagtgttcagcaatggggcttgggttgaaattgtaggtaagatggccagggaaggcttcactgtgtgaaggtgactttggagggttgaagacctgaaggaactgagagagctagccatgtatgcctcaggtatacaattgtgcaggcagaggaaatagtaaatgcaaagtccctgggataagaacatgccaggcctggtagaacagcagtgagaattgtggaaatgtagcagaggaaatgttgcatttactctggagaggaggaaggaggaataggttacgtgctatcgaagtaaagaggtcccagatcacatagggccttgaagatcagtgtgagactttggtctgcatgagacgaaaagtcgctggaggattgtaggcgagagtgtcaagacctgacttatattttgatgggacctctctgtgcagagttgaaaccagcctaaagtagcagaagcagggtgaccagagaagaagctattgcgatacttaaatactaggcgagagggaattaccacttaaataaatgatgagcatgggcactggagtgagtatatgcctcagactgagcataagaagtaagataggaatctgtatttctcttggtctgcttaactcccacacacctctcaccgtgagagcatctaattgccacatgagtgatgcgagtggttagagacaagtgtttttcattcattctacgtgttcactaaaccataaacaagtcctagaagtgtcttcatcagccaggcccctcactctggtctggagactggtggagtactagggtctgaatgtttgtggtcctccaaaatatgtatgttgacatccaatccccagtgggttgctattaaaaggtaaggtctttaggaggtgacaaggtcatgagggcagagccctcatgaatgggagtaatgctttataaaagaatcttgagggagcctattggcttttccaccatataaggacacagctgggaggcaccatctatgaggaatgggtccttactagacaatgaacgtgccggcactttgatcgtcaacttcccagtctccagaactatgagaaataaaattctgttgtttataaactaaggcatcctaagcagactgagatatgcaggcaccacaacttctcaaggcccagatgagcagtaggcaacaactgcttcctacatggtctctcttgcctcttgttttccttttcactgggtgttctacaggctctctgatccactgctctcaggagcactaccccatgtcattcaggctgcagcccttccatcatgatctcaactaagtatttgttcccttctaagtcacttactaaaacagacagatcttcttaaactctcaggtttgggcctgttgctaggtgaaaacatatattctctccactgtgccattacatctcgaatttttcctctaaaatataactattataagactgatcttcattatattatcaaaagtttctagctaattttatatactacattttaattctttttagtgaccaaacctctttgccaaccaattgtattcttataatgctgcttgttttttccaaatcaattaacacgtgcctacttcagatggatcctaaatgttgacagctttagtggaaggaaattgaagtacctttgaagtcagtcacttggcactatagattggtctctttacaagtaaaaacattaaaaggggaggacagatgaaacttcaagacataggactaatttgattttcaaaaagaaaaatatttgtactacaatacaaaaaaaataagtgaatcatttatttcagagaatagccatttgcaaacgttcactgtaaaaatctagaggatagaaaacctaaaaagttttgtttaggtttgtcaatttaagtgggagggatatatttctaaagaatatgtcctaaagctgtgccaagtatgtgcaagtccaagtatggcaagagatgaccctggactctgtggtggttgcagacaaataatacataactttcaaaaccagccccatagtgagtcagagtagtgggcatttgtacagaggaggaagctgacattgtcttttaatccaaacagcaatcctgggtggctctggtggaatgaggtatttaatcacctcaccggtgatccttgttgggtctttcttgttgagtaaatacttggcagccttagtcattagcttgaaaggcagagggaaaagtaaaccttcatgagtgagtacccagctgaggtgtttgtttaggctaatcccaaatgccctttagggcctaactcagtgctgcccctcccctacttcactgtgaagctgcagctgtggagccaacattttatcttatttattctctatgtgcaggttcccaaacataattattggatgaatgaatgaacaagaagatgactatggaggatacttgggatctggctagcaacaagtatatttcccattgttagaggtagttgggtcagaaattagatcagtgcttctcagcatttctctgttcaatgcatactttttggtggcacccataaagaaatcaaaaggggaatatccctttttagcaagaagtatttagaaaatctaaaagaactcttcctcctattcattgggtcacttttcagccctgcatcactgtttacagaaaagtgttaacatcttggactcgtgaagcaatgttttcacacattctaggtatgttgacctaatatgaaaccactccttcttgctctgattagcaacaagtgatgccccactgttttcccagtctatgtatggcagtgttccctctgtcaggtctctctgtgacagtgtacagctgcagtgatcacaaaattcagatttttaactcattgattacaattggcagccaacctctgaagagctggagggacaccagtgactgagagccacttgcttagaaaattatcaaagagaggccaggcacggtggctcatacctgtaatcacagcactttgggaggccgaggcaggtggatcacctgaggttgggagttcgagaccaccctggtcaacatggagaaatcccgtctctactaaaaatacaaaattatccgagtgtggtggctcatgcctgtaatcccagctactcaagaggctgaggcaggagaatcgcttgaacccgggaggcagaggttgtggtgagccaagatcgcaccatcgcactccagcctgggcaacaagagcgaaactccgtttcaaaaaaagaaaagaaaagaaaaaaaattatcaaagagatgttacagaaataattcctatactggtagcagatgaggctagatcaccccaaaaatgtagtcaacgctcagtcttttaaggtactccttcaactacagtcacctctattgttatctatttagttattattagtcatttttgatgtaactttcacatgtcacttttctcagagcataaaggttttgagggtatgaagaacaggaagctggaaatggccaaaggcaaggtcatattttcttctgggcctttggtctttcaaggctgacatagaaaagtgagtacagcctgggtcagccgaaggcagaatgctgggactgcctctcctctcactaaatctttctaaccctgcccaattcccaccggccatcccctatagtctttttgcgagaactgtacaccatcattctcagtcctgacttacatctattttaagtcatagaagaaagagggaaaatgatgaagaatgatgtatgactgtaaaaaccccttcagtagtggcgaaagtgatgagtttataccctcactgttgctaatcaggtttttcctccgtctcacatagaagagcctttcttgttgcaatctctgggtttcctggatcctgtgggtgtggggttaaggctgagaaaatctggtcagataacagcacctccaggcttccgggagacccgccttggcaagactgagctgccagcagaagcctatgagggaccacaggtgtgtgaagtgtgggacatgtagagctgtcaggactttggggacacacatcacttcctgttacagatgagggagactagatggggggagaggagtgagatggttagtggtagattctagaaaactcactggggtggccttgggcactttccaatacaaataggacttgaggctcttgaagtcccccactttgctaaagagttttaaacacttttgttagttgtaatgtatttagaaatggaacaaaatatttgtgttttatatgtgtaaagagactagtagtaaaatatacttgtatgagaatttttttaattttagtatgtctttaggttgtctattagtattttcatttaatacatgagaacagtacaatgggaatcctcatgccatctctctttttttcagcatctactctaccccttttctgactgtcctcttcttgtgctatggactgaattatgtctccatcaaaattcctgtgttgaagccctagcccccgactagatggcatttggagatggggcctgtgggaaataattaggcttggatgggttcatgagagtgggcctttcatgatgcagccagtgcccttataagaagagatatgagagaggttttggtctctctctttctgccatgtgaggacgcagcataaaggtggccaggaagagagtcctcaccagaacctgaccatcctgacaccctgatctgagacttccagcccccagaactataaaaaagtttcttgtttaagccaccccatctgtagtactttgtgatagcagcccaagctgcctagacacttgcttctcctctcattttctttccaccttctccctgtaatactctcttccagaagggcgatgtggtcctagtgaccgtgactgcctatgcaatgccgcttcgccgcatttttgctgctgtatcattagagctgggtgaactctacctatactgcattgtctaaaaacgttttgaccagtttgaccaggggtgacactaaactcctttcttcattgtacaaatccgttgaaaataactcattctaaaagcagaggaaaaactgaggagagaaaagatggaaggagaagtcaaagaggaagaagacgtcagacaggcacagtgaggttccaatgcacccccctccacccctgccccctgctgaggccctgcatcccccactgttcactgctcctctcctcagcatcttccctggccactttgctgccattttccttctcctactcctgatgaaactcacttcgacccacctgaatcagtttcttatgtagtttaaggagtagcttagggactgagagaaacattactgtcagtcacggatacaaaagcctgctacctgggtacctacacacctgcttaaggtggggcagctttgctgtggtagtgcattcaggcaagaaatcacccattccccagcaaataaaattaattggcagtcatcactttttgccaaactttgatttccatgactccatcctctggggtaacagaaaaataatctgtgtgccaatgcttgaggaccagagatcctccctctcaaacaatatctgtgcaggttaactagagccatctccaggtaacacatccacctgggtttcagagagagctcatctggaaggaaatgctagcccagcattatccaacagaaatataatgggagccacaaatgcaagccatgtattttaaattttctaggagccacatttttaaaaacataaaaataagtcagttaaattattttaaaaatacattttctttaacacaatgtattctaaatattatcattttaatgcataagcaatatagaaaatttgaagtatttaacattttttaaactaaatctcccagtcaaatgtgtattttacattaaagcacatttttattcagactagccacattccattgcttaatggtcacatgtgactagtgactactgtattggacagcacagctccagccaaatgaaaggaaaggtgagaccctggcacatcaggagatgaggaaggcctcctgccatatggactccctctcctgggctggaaagcacaggcatgaaaggaaaggtgagagcttggcacaccaggagatgaggaaggcctcctgccatatggactctctctcctgggctggaaagcacaggcttatcgcagaggcaatgaactaaatgcttttttgaaatttgagctgttttcccgttgcttgttaacttatgaaaggcactcaaaccaacatctttttttttttttttttttttttttgagatggagtctcactctgtcgcccaggctggaatgctgtggcacaatctcagctcaatgcaacctgcaactcccaggttgaagtgattctcgagcctcagcctcccgagtagctgggattacaggtgtgcaccaccacacctggctaatatttgtatttttagtagagatgaggtttcaccatttggccaggctggtcttaaactcctgacctcaagtaatccacctgcttcagcctcccaaagtgctgggattacaggcgtgagccaccgtgccccaccttcaaaccaacatcttaaatattattgttataatattaaacattctaacaaattcagagcaaaaatttccccatggattcttaaatgttagtaaagagctaataatttctaagagcagagaatagcctgttgtctcctcttatcacttttatgaagccaaaaacaccctgcccactgtgcaatatgctgccaaagattttaccccttgatcccttgggaatgtgatgactgccaattaattttatttgttgagaaacgggttatttttatgtttttttttttttttgcctgcgcgcactactacagcaaagctggtccattttcagcaggtgtataggtacctaatagcagcaggcttttgtatctgagactgacagtaatgtttctctcaggtgaagctgtgagatttgttttcactgggaatctcataaatgtgggacctcaattgtaacaatctaccgtggagaccacgcatcaggttcattcatacatgccataagctccattagtgctgaaatgatacccaagcccttgatatctcttcctacttatacctaagtctgccttttatatagctccgagacatttaatgctggaaattttgagagtggtggggtactgctaaaggctagtaagatggacttgagtttaaggtgctgcattttttgatgggctagagaggtgtgttttcaaggactccttatggccactcatcttttatctctttgtggaacctctctctgtcctttctgactcaggcctttatcctcatctgagtggttaactgatagaaattgataaaggataagctttcatgtccaagaggtatctgtgattttattaagaagtgccaaaaagacttcaggcctaaaagaaatgaatctgtatgggaaataccatgctaatagagttttcctggatcacctcaaattgcatccttgccgactctaaagctgacttgggttaagaaactagtctttcctcattatcactttccccagaaagggcaatggcaaccttttcgttatttatttatttatttatttatttatacacagagtctcgctctgtcgcccaggctggagtgcagtagcatgatctcggctcactgcaacctctgcctcctgggttcacgccattctcctgcctcagcctcccgagtagctgggactacaggcgcctgccaccacgcccggctaattttttgtatttttagtagggatcgggtttcaccgtgttagccaggatggtctcgatctcctgacctcgtgatccgtccacctcagcctcccaaagcgctgggattacaggcatgagccaccgcgtccggccctcattttttattttcaattgaattagaattcaaatcaaagcataattctacttgattatagctcttgtgaaagattcttagggaaaagaataacatgaacgttaggatggcctttgtttgtagattggattttcatgaattattcccatggttaactgaaagttaaatgcatataaacaagagttggcaagggctgatgctgtacactctcaagaggctcccaagttttgttttgtttcttttttcatgagcacccagaatctttcctctcactggatccagattttattctcagggtatctaaccagatgatgcaacatctgtgctctcttttaagaacgtgagaaatgaagctttttcatttttccttgctttgacttctgggaaatctaatcaaaactgctcagactttccttttcttgtttgctttagaagacagcttgctggaagggttctgtggaggtctcccacctgtggaagaaggtgatagaaaaattagcctgataatggaactgtcaacccaggtttcccttcagactgagagaattactcagctgaaagaagttttggaggaaaaggaaaggaagattcagcagctggaagctgagcggagtccccatcctccccaagaggtcaaggaccctccaggatgtttaccagaagccccagttttctctactcatgacatcccacctgtggtctctgatgagaatttgtagattcccaataagaaaacaataaaagtttattaagtgtcatccaggtaaagtctgataccaaatagtctcctaggtgacaaactcaagttcaagttcatgtgtttgaatgtatactatcatgttcgtattggaaggaaacaaaaaaaaggaaatgttcaagagcaaacactgaatgtttcccctttggacagtaatagtcacgtaaaccacgcagctgtagaatactatgtttttagacattcctggtagcagtgggggagggaagaaaacaaaactagacagatggtgaaagaacttagcattatcctcttagcagagatttgtcacactgcaagggaggggtggcaccaaccccgtttagtatgcagctctattgtgaacagaaagctgtcgcggagggccagcttcaaactcgtgaatgcgcgggtactaaagagcaggagctaaagagcaggagccgtcagcagagtaaatagccatgaggtctgtcctttcatgtcctcaggagtttatttctttatggcatgcattttattaacattagcaaggatagaaaggaaataaaactaaagcaataaaaaaaattaaaaatgggtgaatcaaagctgcattcctttgggaaaagtgtcctggtacagcatctccctgggaaaacacacaacactgatttttcccttaggaacaagactaaaaccaaagcaaaatacaatcttctgttatgattgtaccaatgagctgtgaacagtgcaaaacactggcaggaataatggagaatgggcaacggaaacctgccctgtaattaatggaataaaagaaatcggatcatattcctcttccactcaaccccttcaaataaactattttccactcaaagggagcagctaggcactaactgtgaggaagacttcggtccttagttcttcctgttctggtacagcatgactcaggcaaacagctctagtttcatgagtatgactgtaatgctagttctcaatttaattcaaccagttcaacaaatcctcatcaaatactcttctatctggaaggcacaactgtagatgttagaaatcacagcaaacatgagaatcaccattttcaccatccagaagttcatagacacacaaggatctccttaaagtaaggctgattgtattgagagatgggaaatgggagaagggaagtgggtgaaagtggggtaaacctgatcagcattgtttcagcagaggttctcagatatactgagcatgagtaatcagcaagaatgtatattcctggcctctagtttagggcccaggaatatgcattttaataaacacatgtggtattcctgatgaatttattccagaaactacatttaggccacattggcttagggatggcttcaagcagacctattatacttttgctcccagactaatagacaatccccagaaggagatttctccttgaaatctggggtgagtcttctacactatttacctattgcataatctgattatggatcccaactatctacaaaacacagtttccaaatgtgatttttcaaaaacaaaaaaggaattaattgagttcttgactcacataagatgacttgttgatattgactccagagtttcactaccccaccaccaaagaaacccaaaaaacgtgggtactatcggtagcctctgttttcaaccacagcaagaaatttcccatatttgtatttaacctcagttttgcctacaatggctacaagtatgtacaggtgcggttctatatcagaaatgaaaccaactcactgatcatgaatatacactaccccagaaagtagttaaaagtacctctttatcttttccataaggtgcacttcagtccctacagaatccacttcagaaatcccttctcgctggtccctcctttttctcacctcccccaaatccatgatttccctgatcttttctatttctctggcctaggtgtccctgttgcagtcatgaagggcccattgcctctgacactatagtgagactgagggttggcatgttcttactgtgtatttgtaggagaaagctttaaatccttctctttgttaagagtggaccatctgcaagacaaactgtcatctccacgattttgctgtgttattatgcttaccgagtttccatctctttattttaccaaagattgttttaatctcatgggatattgggaatgagatatcccagtctcactataggaaagtagagagagagagagacaaaaattttcatcacattccagatagcagtgtgtcaacttctagatcagtttcccctggctaataccctgagtagccctcagtatgaaagcagccttacagtggagataaagtaacaggcagagcaggagctgctattaataattaattgagcctatcacctctaaacatccgaggaccagccaccgaagaagaaagcatcaggggtcatattaccccgcaaaaccatctttacaagaagctgatcttgactcaggtctaggttactgccaaattagaagtggggaggaaatgtgtcccaaaggtacgaatagactaatctctgttagggacatcttagtaacaagaaatttttaagtgtccagggttggaggagaggggatgggaggagtattattggcctctgagaaatttattcttttcctttatttgtttattaatttaatatcttttagagacagggtctcactccgtggcccagactagagtgcagtggcacgatgatagctcactgcagcctcaacctcctgggttcaggcaatcttcctgtctcagcctccggagtagctggggccacaggcatgagccaccacactcagctaattgttttagtttattatagagactgggtcttggaatgttacccaggctggtctcgaattcctggcctcaagcatcctcctgccttggccttcctaagctctagaattacaggtatgagccaccatgcccaacctgagaaattctgaagtggaaaaattcaccttcccagccgaatctctttgtgattgtatgccccaaagttcatttctatgtcctgccaaacctctagagaattgagtagtaaacttcaaattgtgctaaataccgggttcagatgaactgaaaatcagattatagcctacactgtaaacacaaatctcattttcttagagcaaatcgggttgctgaagcagttcacactgaccattaaaatattgcgtataaatataacaaagcaattaatatgctaatgatcctattttttaatgaaaattcagcaaatcatcaggtaatatatctgattcaaaaataactgaaaatccaggaaataaggtacttaacaagagtaacacaagccattctctaatagtataaaaacatttacagaactatatacatagttttaattctcctttttcacctggcatgaaattttctcagacagaaagttaaatatgtaacatttctaaccaatttaggtaaatgttggatttaacaatttagtttcattgttatattagtggacttccaaatactttcatgcaaagctgaaatcatagcaataaacttgttaaaaattagcagaaaagcaagccattggagtaactggcccagggattgctctagtattcagtccagcaaaaggagataaattatagtactttctaagtgcatttctggaaaagaatgaatctaatccaattctaattatctcctatactctctctgcttattcaaaatccaatcattttcttctatattacactgaaataaataatttttggtttaatgcaataaaaagagaattgttggtaaatgttatagggttaagtaaaaataatgtttatttggcaattatcgagtataggaactgcaaagacaaaactattctaaaaggtttttttaaacattttaaaaagacttaggaaaccaaatgtttgagattcaaagcttgattctcataatttgaaattagacaacaaaaaagaacagacaaattataaagaaataattattatttctccatggttttacaacaaaattttttattaagatttcccacacgcaagagaactttcctgctaaaacaggagaattgagttcaagtaggaaataacctttttaaaatagaagaacaagtacactgggacaaagttcacagcaaaagacaggcctcgccatgaaatttcccacacctaatgaaattaggacttttatggtaaaacaaaacaaaacaaaacaaaaaacagttcttattttcagtttcccaaagaaatcattttcaaagccagacactctccctctccccaccctccaccctcaagtaagccttggtgtctgttgttcccttctttgtgttcacatggactcaaggtttagctcccacttataagtgagtttagctcacttataagtgagaacaagtatttggttttcttttccctgacattaatctgcttacgattatggcctccagcttcatctatgttgctgcaaaggaaatgagctcattcttttctatggctatagtattccatggtatatatgtactatattttctttatccagtctaccattgatgggtatttaggttgattccatgactttgctattgtgaatagtgctgcaatgaacatatgtgtgcatgtgtcttgtggcagaatgatttatgttcctttgggtatatgctcaataacgggattgctaggtcaaatggtactctgttttaagtcctttgagaaatcgccacactgctttccacaatggctgaactaatttacatgaccaccagcagcatataagcattcccttttctctgcaaccttaccagcatgtcttcttttttttttgactcttttttgttttcttttttttgagacggagtctcgctctgtcacccaggcggaagtgcagtggcgccatctcggcaagctctgccgcctgggttcatgccattctcctgcctcagcctcccgagtggctgtgattacaggcgctcgccaccacgcccagctaattttttgtatttcttagtagagacggggtttcaccatgttagccaggatggtctcgatctcctaaccttgtgatccacccacctcagcctcccaaagtgctgggattacaggcatgagccaccatgcccggctttttttgactttttaataatagccattctgactgacgtgagattgtatattattgtgatttggatttgcatttctctaatgattagagatgttgagcattttttcatgtttgttggccacatgtatatcttcttttgaaaagtgtctgttcatcccctttgcccactttttaatggagttgtttgttgttttcttggtaatttgtttaagttccttataaattctggatattagacctttataggatgcatatttggccaattttttctcctcttctgtaggttgtctgtttattctgctgatagtttcttttgctgtgcagaagctctttagtttaatttggtcccatttgtcaatttttgtctttgttggaattgcttttggtgtctttgtcacgaaatctttgccccgacctgtatccagaatggtgttttctaggttatcttccagggtttttatagttttaggtcttaacatttaagtctttaatccatcttgagttgatttttgtatatggtgtaaggacagggtccggtttcaatctgctgcatatggctacctagttatcccacccagacattttttgaatatagctagtgtcccaccattttttgagtacagcttccttttcccgttgcttgttttgtaaactttgtcaaagggcagatagttgtaggtttgtggcagtatttccaggctctctattctgttccattggtctatgtgtccgtttttgtaccagtatcatgctattttcattactgtagccttgtagcatagtttgaagtcaggtaatgtgatgtctccagctttgttctttttgcttagaattgccttatctatttgagctcttttttggttctgtatgaattttaaaatagtttttatttctaatttcatgaagaatatcattggtagtttaataggattagcaatgattctctaaattgctttgggcagtatggttattttagcaatattgattcttcctattcatgagcatgggatgtttttccatttgtttgtgttatctctgatttctttgaacagtgttttataattctcattgtagaaatctttcatccctctgtatctagctgtattcctagatattttattccttttttggctattgtgaatgggattgtgttcttgatttggctctcagtttggatgttgttggtgtatagaaatgcacaaatgatttttgtacattgattttgtatcctgaaactttgctgaagttgtttagcggatctagaagcttttgccgagactatggggttttctacatatagaatcacatcatctgcaaacagagatagttcgacttcttctcttcctatttggatgccttttctttctttccctggactgagtgctctggctaggatttccagtactatgttgaataggagtggtgacagagtacatccttgtgttgttccagttttctaggggaatgcttcctgcttttgcctattcagcatggtgttgtacattttcaataatatgagcttgtggcaggatgacatttaattatctgaccatttccatctctatggtttattattgttttttgtttaacaaagaatgacccttagtgcacaattccagtagtacccaatctttctgttcttggatgggaaaatcacatggcatgtggtctaataactttttaatccattttcctaaatgtcacaaataagcttcaccaacagttcattatctgatatcacccttttcatatagcatgatgatatcacaggcaatggatgatagcagaatggaagagaaagaactagccctaaaccagccctttgtcatatgaggtccaagcaatgataacagtgagttatcattaaaagaaaaatgctgataatataatatttggccttgcaataaaaaagtgtgccttattgcctagctcctattgaaatacagttggtgtggtgatagtgaaaggaacaacaaatacccatcatggatgcccactatcttgttccggacctgcatttactaaccatcagctatatatatatataggaatgtaactaatatttacacagcaatttacagttatttaaaacatttcaaatagattattttatttgatcatcatgagaaggttttagctagataactagtcctaaagttataaaaagaaaatgccagaaccaggatctgtagcccccaggccagtatacatttcatcactcaccactcctgtgcagttagacaaaaaagatatgtatttcttataccccctttctcaagtcagcctccatcccatttataagaaaaacagctttccatgggtatcttctttctcatgcttgctccactatagggggtccaaaaagtggtccagattcaactgaccgactgtttggtttggcacagaacagtgttttgttttttgtttgctcattttgttttattttgttttgttttaaagtaaattcttttaagaagggtaggggctcactctacagtttgctccaggttccaccatttcctattgttttatgcagggctgcttaaggcatttgtcttgcctgcctggtcttataggtgtgtaaacccttcctgaaatactctcaattgtgtataccaggtctgatttggtatgctatggttgtgaacttctgatttatagtctaaaataaacgttcaaaatgagtgcattacatcctacatttaacattaatacatatttccaaatgtataataaagaaggaaaagaaaatctaaaggaagttactaatgaggcccactgcctcattctcatgacttcaagacagcttataaatctttctttttcaatctgtttcgtatgcagtggggaattctgatagcaaaatgtcattttatccacatcacgagcataggtaaataggtaagtgattactaccagaaccagcattttctgaaggcaggagacccacatatagacattcttctcacttgatcttcaaacttgcctttaaggtcagtggcctgatcgcatggacttcaactatatgtcctagaacctgggttattcaagcctaaatgacaccctctgtgggataccagaagtcctataaaaatctatatttaggaggaaatgttctcaatacacactactttacagactgcttagtatctcaatctgtgcatctgcactcagatatatggtgacttccatctcaagaagtaggtatttgcattctcataattaaatgaccatttttgtgactttctaatataaaggaaggcatctccaaagatgaattaaagtcataactctagaaatccagctgctgataactcatatgaaaattttgtatgtcttttttgtttgtttgtttgttttttgtttgtttgtttgttttgagacaggatctcactctgtcacccaggctggagggcagtggtacaagcatagctcactgcaaccttgaacctctggcctcaagcaatcctcccacttcagcctccctggtagctaggaccacaggcacatgccatcacacctggctaattttttaattttttgcagagacggggtttcaatttattgcctagcctggtcttgaactcccggcctgaagcaatccttttgccttggcctccccaaagcactgggattacagctatgagccaccaagcctggattcatatgggagtgtttaagctaaaacaaagtctctttctctgccataccatcctctactaatcaaagacttacagagcagtaccactataagctgaagtataaatcttctcaccacactgtcatttttgttaaaattttctattttttaaaaatagattaacagccagagtatatattcactcgttcactcaagaaagttactgaatacttattctgatcttgtacatatcatatgctctagcaatcatgtcagatatctagatttagcccaaatttatacatagaataatatagtttcttattattgcctcagagatgtttactataccttttaagtttattaaatagtaggttcaagaaatggctggtaaaaagaaatcaggagaaggtttcctatgccatagtttctcttacaaatatatttgaaattgattagaaggaacttttttttttttttaattctccatgctctggaccttctggagaggatgaatgctactttgtaggggcagatagtcttcagagagccaggtgatttagcatctgcagtagactgcagattcaggcactcagatgaaggtctagggcttcagtctgcagattcagatttctgaaggaaggtctagggatagagaagagccgtggcttcctttcttctctacctgacctccagcgtagcaaagatgccaagaatttaaattaatccgattatcctctgggagttacccaatcatattattttgccatagaaacttagacccattccgtgaggttgttctctagattgctggttgctatatactttaataaactgagactctgaagacagaatattttttttccttcttggtgtttgctctgcagttgtgaaatatagcagttatctcgtaaagatgtcagagtgcctgtgagtcaggagctcaggctgtggaagggctaactataatgtagggagttgtttcaagcatcagagcatagtgacgcttgcctgagaccccatccaatactgaaattcaataggcccctagagtgatgtataatttgagagagcttattcccatctgctactttttcagcaagaactagagaactcaatctttactgagaaaaaggaactaaatttttaaaagagagcctgtgtctataagtaaatttcctttttagtaattaaaattggaaaatgaaatagttgcattacaaaccaaatgcatggaaaatatcttccagggaatcaacc

SEQ ID NO: 315 - DNA, 121062 bp, Homo sapiens
tgaggagggagacacagcctttctcagtctgttttctactgctctagcaatacctgaggctgagtaatttataacaaatagaaatgtatttagttcatgattctggaggcttggaagtccaggagtgaggggccacatctggtgagggtcttcttactgcatcatcatatggaagagaggaaaagagagtgagaagttagcaagagagggctgaacttgctcttctaacaaatccactcccacaataataaaatcaatccattacaagggcagagcctccatgacctaatcacctcttaaaggtctacctcccaactctgatatattgagaattaagtttccgacacttgcctttctgggggaaacactcaaaccttagcattctacccgtggccccccaaactcatgtctttttcacatgtaaaatacattcattccatcccagtagccctaaaaagtcttaacttgtactactatcaacccaaaagtcaaaagtccaaaatctcctctaagtcaggtatagatgagatcaaagcatgattcatcctgaggcaaatttttctctacctgtcagtctttgaaattaaacaagttatctacttctaaaatacagtggtgaaagagacataggacagacattcccattctaaaagggagaaatagtcaagaagaaaggccccacagtcctagggtcttggacgttaccccactcccatggcttcactaggcattgaccaagtttaggctttccaaagtagctctatccctgcaacaggtctctgcctgggcctccaggctgttcatgacatcctttgaaatccaggtggagggtgccgtgcctgcagctctcgcattctgcatgcctgtagtgtcagcaccatgtggacaatgccaagatttatggcttatgccttccagagttggcaggtcgaggtgaacctgggtaggcttaagccatggctaaggtggacaaggggcactatgctgtaatttggggaacagagccccaaaacagtgcaggacagcaaatgctgaagttctacagatgcctctctgaaaactttgctcttatggtcctgctctgggcctgtgatgagggtgaaagcttcaaagatctctgaaatgcctttggggtctttctctcattgcgttgataaacagcacttggcttccttctatccatcttaattgctttagcaaatggtcacttggccatacccttggtttgttctcctaaatatgcctttttactcgttttgttttgttttgtgatgagtctcattctgcacacaggctggagttcagtggcacaatcttggctcactgcaacctctgcctcccggattcaagcgattctcctgcctcagcctcccgagtagctggaattacaggcaagtgccaccatgcccagctaatttttgtatttttagtagagacggggtttcgccatgttggtcaggctggtcttgaactcctgacctcatgatctgcctgtctcagcctcccaaagtgctgggattataggcatgagccaccaagcccggccaccttttcactctttacatggccagactttggattttccaaccctttctgctctgcttcccttttccttaaaattctgtctttaaatcattttgcttctcttgcatcttaccatgtgcgtttagaagtagccatgcaggtccttcaatattttacttggaaatttcttcctccagttatcctagttcatcactctgaaattctgcctttgataaagtccttgggcatggatacaatttggccaggttatttgccacctcataacaaggagggcctttacaccaatttccaataagatattcctcttttccatctgaaacctcatcagaatggcctttactgcccatatttctaccaacatgctgatcacagccacttaagtaatctctaagaagattctggctttcctgaggtcttttcttcttctgcaaccacaccagaattgctcattatggtccattcacagcaatctagcctttttctaacctgcttctccaaattcttccagcttctgctcattatccagttccaaagctgctttcacatttacagacatttgttgtagaaacagccccaattctcagtaccaatgctcctagtctgttttctgctcctataatagagtacttgaactaggtaatttataataaacggattcatttggctcatagttttggagctgggaaatccaagagccagggagcacctggtgaggaccttcttgctgcatcatcccgtggcacaatgtcaaagaaatagggaaaatgaggaagagagggctggaatcacttttataacacacctactcccatgatatcatgccagattcaagtcagcttagttatactaatcctgaccagggctgagaggtttcaccatgactcagtggccaattaaatacttttaaattcatggttcattgtgaggctttcacacaaggacaactatgcaaatatattcaacacatacgcaggcagtgataagagagagaggaacaaaccatagggagagaccagtacattgatagatgaactggggggtgggggttgggggtggggcagagctggaggcctcagggttctcatgagaagagctgcttctgcaggtatctcaccatggttagtttctttgctgtttttatggccctctgaaggtacatccatgatcattatctcagctgtgttttggcttcacttttccccctagtggaccaagcctaaccctctaaaatcagggctaattaaactgggcttgatcagatgtgagtagtgagtatgattagcgacgaaccccacagatctacctccactggtccagatacgcctacctgaccactccttagtgtagtataaagacttatctacttcttgaatggagaaaagtggttataggccatttttctctctgcttggagccccctctcccctctttgctgccctctcaggtccttgcttcccatctctttcatctatatccatctttatagaatctagggccactgcagtggcagtccgtgagcagcacctacctggagttgtgtagtgtacaacccatgcagctgaatgcagcagccctgatagactcccggattcagggctaaaagggatcacagaagggctagagcatattccctcaacttaaaaatgaggaaattgccaggcacagtggctcacacctgtaatcccagcaccttgggaggccaaggtgggtggatcacctgaggtcaggagttcaagaccagcctggccaacatggtgaaaccctgtctctactaaaaatacaaaacttagctaggcatggtggcgagtgcctgtaattccagctactcagaaagctgaggcaggagaatcgcttaaacccgggaggcggaggttgcagagagccaagatcataccactgcattccagcctgggtgagagcaaaactctgtctcaaaaaaaaaaaaaaaaaaaaaaaaaaaaaaggggaaattgaggctccaggtgtagaggagacttttccaaggtcatgccacagtgatttaatgacatggctgggatgtgaacctgcagctcttggcttctcaggcagcaccattgtttatccactccctccttttttgttgttgttattgttgaccgagtctcgctctgtttcccaggctggagtgcagtggcatgatctcagctctctgcctcccaggttcaactgattctcctccctcagcctgccgagtagctaggactacaggtgcgtgccaccacaccaggctaatttttttgtatttttagtagagacagggtttcactgtgttagacaggaaggcctcgatctcctgaccttgtgatccgcctgcctccgcctcccaaagtgctgggattacaggcatgagccactgcgcccagcctccactccctcctcctaaggctatctaaatattccctactccctttctttaccctgcaatgtattttgtgatctctgtcctggtttcgcacccatattcagacttagtacatgccatgccttggggtcttcctaagtaagacatacaaccaagctgtgccgccagtcatgggtccaccccagagtggggacgccctgaggcttggggccttacaaaagttagtaacagcgtaaaatgcaatgacaggggtggaaagacccccatgcttaccctggcagagtaaaaagtgcagatgtcagacactcttgagtagacattgcagctccacttcacattatgagcttgacctcaggcagtttgcttcacctttctgggctccaggattttccaactacaaaaagagattaaaaaaataaccctcacgtccccccgccccatcccagcttgcaatttagtgagaattaaatcatgtgatgtacgcgtaatgggcccagcttagcaccaggcacgcgggcccacgctgtggctgcacctgcccctctgagatactctttcctccccgaagacttccttagcctgcgttctgcatatgcgttatggctctgccctgtggaagcccttttaaggcaggaactgttcctgggaaaagataaaatccttggcacagacaagccattaccagaaatatttaaccagcctgtgttcacaggcgggaggacacgcatgaaagcgttttatcttcctagccacaaagggagagcgggagccccgcaccaggctgagatgaaggcttgatttttttaagtagtcatttaggattctactgatgctttgctaactcccagtcaaatcacaacatcatggaaagaaaaactccattttctgcaaagatgttgaaatggccctttccaattaggcaatgggctctgggagggggatctcagacaggcagctgaaagccgtctctgctcatctgtgcattcagggatctgtgagcccagggcaccaaagaagtagccactccaagtggactctgcatgtcctaaggcagggaagaggcctccgaatgacatcttgccctctgcctcccaccaggttgttctgggatgtccctggagagtataagtgtctcgttaattactagtcagttatgtgttttacatatattgattagtctgagcgtctaccttgattagcaaagaccatgactctcataaaattgcccacaagtcatatgtgcaaacaccaccatttacttggaatcctgccctcccagtcactgctctactttttatgtattaactcatttaatctttacctgtggtggcttcaagaatggccacaaattctttatactcctgccatggagaggtgggggtctcagtcatctcgccttgaatccaagcaagctctgggtctgctttgaccagtagaatgtggcaggaatgatgctttggcccacgccttaaaagatgttgccactcccatctcctggcatgctctctttgggagccctgggatactacataaaaagcctgtcggccaggcagggtggctcacgcctgtaattccagcactttgggaggccgaggcaggcaaattgcaaggtcaggagttcaagaccaccctggccaacatggcgaaaccccgtgtctactaaaaatacaaaaattatccaggtgtggtggcaggcacctgtaattccagctactcaggaggttgaggcaggagaattgctttaacctgggaggtggagattgtagtaagccgagatcgcaccaccgcactccagcctgggcgacagaacaagacgccatctcaaaataaataaataaataaataaaagccctgtgagcactctagttgaccatcccagctggacccagcctttcagtcaccccagttgagatgccagatgtgtgagtgaagccttttgggaccctccaggccagctgaacaccatcgagtgacaacagctgacagaatgtggagcagatgcactgagtggcagacctagcctgagcgactgacccaggacagcgtgaaatataataaaatggctggctttatgcagcaatagataagcagaataaccaccttctgaggtaggcacaacagggcaccatgttaccaatgagaagacttagacacagagatgttaagtagtttacccaaggtcacacagctgttagtggtagagtcagaatttgaaactcaggtagcctgggcccaaagcccatgctctcacctcctcctctgaaccttgtactgactactcctttagctgttctaacacctcttgaaggtacctattggtaaatcttctccattactacatgcaaaggctgttggaaggcaggcaccaattcccagttatctttataaccctattcctggctcagaagaaaagcactgaatgtttgttaagagagtgcagtagagtcggtgggtggagggaggaagaggtggatggatggatgaatggacagatagacagattgatggacttgggtgggatagagcctgagaaatgtggaggagctagaagtgtttgggatatatgcatattagaggcccctgtaaggacaagtatgagggcacctgaaggtgaggagagccacacacacactgcgcatggggacaaagtccctcttactaattctatggggagtgcctttcttctccagagcttcaagaaaagtcactatttgaggatagaagttgattttgaaaaactattctattttactattatatattgcctctgttttttagcacaatctcaaaaaaaaaaaaaaaaaaaaaaaaaaaaaagaccaaaaaagaactacaaagaaatagacacatagggaacacggaatgtctagtcactagctgaacactagttttactcctgaatgtcttggtagtccaggcaataatgaaaatatattgtagttaagagttctgatttgggggaggttggttggtctcttagagccagaaccagcaatgcccaatacctgtatgtgaaaagggttgccccccattcctcaggtgggtagcccctctgtcctcagtctccagacacatgcacctcacattttcaccactggtccaccttggatgcaatggtgcctattcacatcatttcccctgtggttctcaactggacattgatctgacttcattcatctctcaaacgtggatcctcagtcctggagatcttatgtttctttctagaagagtcaataccctcaagatcttccaaaccttctggaaaaattgaagtccctgggctttttctgacaatacttttctgtttaagattctaggaaaacaaaattatttttaccatcttgtccaatagtatttttccaggaagaatgatcactcacaacctcaatggaaatttccactgggcccattctgttttctgtagcccattacacagacctacattaaacgtataggatgcaattccaaagatgccaatggttaggttatatagtttgtggtagcagataaaaggaggcaaacaagcttatctggagagatgaaatttctactgcaaggtgggtagtctctgttcagagttcaaaaagagcaatttgtcattccaagagggagttattgcagagatgctcttacaaaggatgttggataacgtaacaggcaatccagagatgttcactgtctcatgaaatccacaagagtggcctggactgcagattctgaactgtcctagagagaatgatggaacatccctacacagccatcccccacccagccccacctcccaccaggctctatcacctggtcttgctcaaggtagatctggggaaaatgcttaatcccaggccagattcactcagccaggcctcctccctaccacccaccacctcccccgctccatagacacacactcaatttcaccagtctctgtgctcagggaaataattcactttactatcaccctgagtaaaatgtgaatcattgagcaaaaaactatcagacacacaccaaagctgaagataaattatttttggaaagctgtcatcttgaagcccccaaatgctggcttctccagggttggagaggatgtgaaagaagacagccatactgggccactcactcttccccgaacacacccgcttctctgccacccttgcacttgttcttcctccacctggaaacatcctctctgacctcatctcttcctagcataatgtcatctatccctcaaggcccagaccttcctgatgtctctataccagcgtaagctccccgaggacatctctcattttgagacagagcagggttccctcttagaggcctgctgcccaccccaccaagcatggaaataaaatcttgagttccttcaaggaaaatcccaggcacctagctagacttgagaagtaaatgaacaacttgaaaagcaagaaggcaatggtagcttaaaacaattgtcacccaagtaagttagagccacaagatatttggttccctatagaaactaaagataacttcttgacctgtgtccctgagttgttcttcagaaacctggacccccaccagttggaacatactgaccactgtcttgtagatttcagataagggggaagtgaggactgaatttcgactgccaatctttttacaaatttcttcctgagtagcctagagacagtcacgctcacaggccaaaccataacattcctttctgatgaccccaaggttttaggcaaaaccttgcttccttaaccagttgcaaattaaagaatgtctgaatccacctataacctgtaagccctttgctgtaagatgtcccaccattttgggacaagccaaagccaaagtataatcttcatgtattgatgtattactttgcctataacctctgccgccccacctttaaaaactcttacaggtggccgggtgcagtggctcacacctgtaatcccaacactttgggaggccaaggcgggtgaaaaacgaggtcaagagatcgagaccatcctggccaacatggtgaaacctcgtctctactaaaaatacgcaaaattagctgggcgtggtggcacatgcctgtagtcccagatactcaggaggctgaggcaggagaatcactcgaacccgtgaggtggaggctgcagtgagctgagatcgtgccactgcactccagcctggcaacagagtgagactccatctcaaaaaaacaaaaagaaaaacaaacaaactcttacgtgtgagccattgagaagtttgggtcttaagcatgaggtgtgtctgattctccttgcttggcactctgcagtaagtgcctcactttctctctctgaagatcccaatgtcagtgtttagcttgctaggctgggcaggtagactcaagtttggtttgaaaacaatctaaaaggttttctttaacagtgcaggctctagagcctatggcccatctcttctacctataagatctccttaccaactattggaagctctgatgaagcttctagggtcaagctttgtctgctaagctttaaaatattttttcagatgacatgcaactgcaagcatcctcaattcctagcacaataccaagagcaagaatgtgctcagtaaataaaggttgaatgcattaataaatcaataaagtatgtgtgtgtaggtgagaggatggaaggaaagctgcattgatgatgaaattttagacatcctatgaggaaaggacacggagagaggatttgtgtgagccacagctttggggaacacaggagcaggaggccaggaacctctcttccctgtggcagccttgagatggtgggtctgccccggaattacgtattacaaggaggagcagagggagcagttcatcttccaataacagctaggcccagcggcctgctctcatctccttattattcttagaggggtgatcttgcctggcagagagagaaaggagggggtgagctggtgggggagggagccaacctccgcaggtcaccttcaagaaaatgagatgtcagctggaaggaatgaattaatgaaaagaagtagaccctgttgacctggccccattctctgtaaatcctgggtttgggaagtttttccatggcctccacttctcaggggaatgctgggaggttagacgtggaggagtgaatgggtttgtaagttgtgaggctgggatgagaaattttagtcacctggtccccggctcttctgaatgttgcttgcttataaaaaggatatcctggctgtttcccagacaccttttcctggggaggctcagaggcaagttgaggacaatccaggccttcctagaacctcaggcaccggcagctgggagcatgcttgatacttgcaaggtttcccaacccctcaagatgctgagaatcacctgcataattgttaaacaacacaaactctgagccagaggttctcttactttagcgtgcatcagaattgcctggagggcttgttaaccctggggttcagattcagcaggtctagtgtgggcatagccccacaaatccccagtgctgctgctgctgctcctggggctacactttgagaaccacagccctaggctggctcactgaccagagtctccagggaaggctccagaagctatgctctttataacttcccaggcgattctagcatcaagacagttaaggagctagtaaaatgtgagggccacctgcagcagaagcacctggtttctttattaaaattcagatttccaggccttgccttggctcttagggcccaaatttctggtgggttgatccaggaattagcatttgcctagttcttcaggagtttttaagttaattacagtttgaaagccatgcccctatataccctcctatattacaagggaataaactgaagcccggagaggtgagcttgctggcaaagacttcaccactaattagcaaccaagctgaaacctcaaagagctgtttgtgctctttgtggaagtacaattcagggtcagggtgagctcaagttgctctgagaattccaaagccaggcagattggccagagccccccgaatgctggagtttcctcttcaggtacaggagccactgtgcaccattttccctcaagccaccctcccttacatggtagtgactttgtacaacctgtagaacactctcccctcctcctggagtatttcacatttcagctttcatgctagtccctctgggaaactcctgtggccctcagtggccaaacacactctcctctgaaacattcactaaccttgtccgtttgtccactgctgctctcattgctgtgacaaggaccaacttaggaaaggatcacagccgtccccaccttccaaggggtttgtgctgcttagggagttacctctgtggtactggtcttgggtgacaggttgggaaaggacattgggacagctgcagcagtagaagcattagggagaccacagagaccagctgggctggaagttctggaaacaacagacacatctggagagcattttctggaaggaagaggagggtaaaaaggatgttaaagaagttttgctctctgctgtgaaatgtaattcccacttcattcctttcacctccagaaaacctttagcaaagctgcccattattttcaaaagcttttagagccaagttttctgttatttttattgtgacattgtgctaatatgtgccttaggtggaaccaagaagggccattttcgctggggtgctggtattccgtaccaccattgtatttgttatttattgctgtgtaatgaatcactctaaaactcagtggctgaaaacaacaatcaatattttctctcttggtttttggatcaggcttttggatgcagcttagctggatggttctagcttggggtctgtcctgaggttgcagttgagatgtggggcaggggtggatcacctgaggtttgatctgggctggaggagccctttccaaggtggctccctcacatggctggccacttgatgctggctattggtgggatgccacagttctccctcatgtcaccttcttccaaggtggcatgggtgtcctcacaacatactatctgacttcccccaccgtgatcaattcaagagacaagaagatggaagcagtaatgtccttatgacccagcttgggaagtcacacatggtcacacccaccacactttctctggactacaaaaaaatctctaggtccagcccacattcaagggaattaggctcattcaaggaatttatgaagggaagaatattaactattatgcagacagattttaaaatgccacagtctcaaagtatgtgtcttgtcttgggaaatggggtgcactaccctgaagggaggacctgcactcattctctcctctctgaatcctcatggctaggccagtgtctggtatgcagtagatgcttcataaatgtctgttgaaccgaactgacagctcacctctacccaatgccactctgaagctgcaaggggacaggaaatagcccctgccttgggagcggcactgtccctggacctctggctgcaaattcctgctcttgggctctggcttatttggaacacatgtagcaggcttcactggcctggtctctgaccagcagtgtcctcctgttccgtatacacctctgacctcagcctcctgcttgtttcccctacagggcttggccataggccctctaggcctcctccctgggcttgctctactctgcctactctacaaaggcctgaatgggcagccactaccacttggagtttgcttcaaggcctggattccttctacgggggaactattttattcctttgtgacagggtaggggcaggtcaagggggtggaatcaacttacctccaactctgccgcaagagaaatattcatcacaccatgtcagtttcctcaaagtcttcacatgtgcatttcagcctccaagactttgctgatgttttccccaccaagagcgcccttccttctcctttctgctctgctaggttctatgcactggggagataacatggcatagtggaaaggacacaggccttagaatcaaaagatgtgaactcaaggcacggcttcatcataaagtacttgggcaacttggacaagtctgtgccataacctttctgagtctcaatttttctcatttataagaatggggatatcatatcacctgagggtcttgtttcaaagcacaaatgagaaaatagatgggagagtattttctgtacggtatgaaatactacatgtaagtaagaaattcttcattatccttcccatcttcttgcatccagctcaagttctgagtctcccaggaaactcttcacatctatgaactcttctagcaattacatctcagcctcacagctctgtatttaactcaacatcctcaaatttttattcccattgatgtaggctagtttctggcactagagtgaaagtacagcaggatttgtctctgtctccaccacagcacaggacacagtgctgggtccccagggatgcttagagcatctgagtggcagaccataggacaggcgtgctgatctttgggggcttgaaaagaaattgatctctactttttattctgccgcctgtgaccccgctaagccccctttaatggagactatggttccttgactcagatccctttggatctctctagtagttctgtgtacttagcctccagcttctactctgtttctaatgacccacacctggaaatctcattaacgacctgcctgtgggttcctggaactccttgttccacacttgcagtcagtaggaagatgcctgggaatttacacctcttccagcagtctgcaaacagtgactgtctagtgccagagtctgaaagcccaactcctttgcctggcaaatgctgaggtgtaaactgaacccctgaattcctggcaggatcagattgaggttgggatagtgtctaaactcatgcctcacctggctttctctcctttgctgtcctggttcctccacccctttccagctttctgaataagtcatttgcacatgaattctcagctcaggatctgcttctggggagccagcccaataaatcaccatccagggtcccatcagaaatgatcaaggtggcattgacgagccaaaacgcaccaagatccacagaaagaagaggtagggatgaacaccatatccctttttcttttctggtcgcttccagattttccaccaacaccatgactgggacgaaaaaaaaagtgattcattttcagtttatcttttctttaacataaccaacttccgcttcttgaggcttaattggatctattcttggatgtgacaaaaagttagtgggaaatgaaaggggcatatcaaggaaaaaaacatttcaagtgaataatttaagatcacatccataattaatggcatttggcatgcttcccctggaagcctaatcagagcatggaatgtgctaattagagcggtttggtgcaaatcagcccgtgcaggtgtggggaagccgcttctgttcttttcagcaccggtggcagcagcagctcaggagtctcttaggttgggcggggcttgaatcaatgatgaggctctattctgaaacaccttttggtgtgaagcgggcttctcttctttttgaagatgtgggcgtgcgtctgtgtgtttgatggcgggacacagagggttggagctggggaaacacttcaggtgagctgtcctctgctgtggggaacgtaagagaatcaaacagggcaagagctgggaggagggggttgaggagaggagctgactactcccagtaccttcactcagctcacagtggctagacaaggtcacctgtcacacagccagctgcaccttgtaaaagctaaggcaacgggacaacttctgttcagtgtcccctgtgtattaccacccttctccaacctgtcgtctgccccagcaggctggaaccatgccctcaatccaaggactccctcgatgtctgacttctggttgatttagcacatagggaacccctgaaagagattggtgggaaggagtgaagtgagttactttcccatctttctgagggctccctgtggtctgcaggtcggctgtcttcctagatctaagattccagttcttttctagtaaccctctactctgtctcagagtcttagggacccgggcttcaggctgaggggtgttccaacccacccccatcagcctggactacagcagccccctcttgtggtttcccaatccacctccacctttgtaaataacccctttattaaactctcctcagatgatcctcattggagggtgacatctcttaacagctgtcaggatcctgatggagatagttagaactgttccataagagcgacactctttttaagtaattggagatttctcccttaaaaaccagggttttggcaaatcatctcttctttttgaagggaaatctttataaaatgcatctcctatttctctaccatcttaaccagaactacacatgattttaaaactgctcttgataacacttcataagcaggaattgttgtatcatgctgggcactgcacaccttgggggctgttatggacctgagttgtgtccccttaaaatcgtatgttgcagccctaacccccaatgtgactgtatttgggcctttaaggagatagttaagtgagatcataaggatgggaccctaatctgataggactgatgcccttataagagaggaagataccagagctcaggtgtgtgtgtgcacgtgtaatgtgtatgcacagaagagaggccgatagggtgagaggtcaatgtctgcaagctaggaagaggtcccttgccagaaaccaactgtgatgattaacactgagtgtcaacttgattggattaaaggatgaaaagtattgttcctgatgcgtctgtgagggtgttgccaaaggagattaacatatgactcagtggactggaaaggcagacccacccttaatctgtctgggcacaatctaatcagctaccagcattgccagaataaatgcaggcagaagaatatgaaaagaccagactggcttagcctcccaggctacatctttctcctgtgctggatgcttcctgccctcgaacatcagactccaagttcttcagctttgggacttggactggcttccttgctcctcagtttgcagatggcctattgtgggacctattactccttaataaattcccctttatatatacatctatcctattagttatgtccctctaaggaaccctgactaatacatcaactctgctagcttctggacttccaagaaccagaactgtaagaaaataaatgtctattgtttaagccaaccagtctctggcactttgttatggcacccaagtagactaatacagagacccaagagcctaaaactgtttgcccttgcctgaaaaagttccaaatttcagtgccctctcaccctcgttttacagtttctttgccttagctctgccagttattacctcttgctgctgacagggttgctaccattagcagagccatcccttacctacttcaatcttacccattatttactagtactaaagtgttatgtcagaccagaaaaatcaagttcactagtattgtatataaagcaagagttaataggttctgagtgacagtctgaattgttcttccttaaatagacttttttaggattttaatgcatagacattatcatgaggactttgtaaatgcccagaagccattttttcttatactagaatccttgtcatattcttggacagctgaggtcaaataagtgccataagcaaattgtggttggtaatgcagtaatttctctgttttcttttgtgatctaaactggttagaacacaatgaaactctggctttaccctcaggatcttctggcttgaaattattggaaatatggcttcggggtcccctattatatgtccacaggtaggagagaggactcaattcatttgttctaatgggttcccagggaatttgattagtgatcaggccctgcattggccaccctttttcctggcctacatggcactgcagccagtcaataggtaccaattttattaggtgctgctcgtgtaatggtgcacaaggcgcccctccaacctccttggcttgtaatgctcattggcagagacagctaatcgatagttgctcctcaccagccccatagatatcgattcagggctcaggaagactttataaggagtcattggggggattctttcagttcaaattgaattgtgggccattaaatctctttagcaaaagactgcgcctcatatcacatgccaatgctccttctgaatttttaaccagtgcccacctctggagaacatcctgcctttgctaaagccatctcagcgggtcccaggtttttctttcccctggcagatctggttaattgttatggatcttccagcaggtaaaagcaggctttgttttccttgcaaaagaaaaccaattcaggtggtcctgcccataaactggaaggaaggagtaggggaagaaagaaaggaaaaacaagaggagagtcagacatgggatgcctgctgtcaagttagtctcagagaactaaacattgatcagataccacacatgtgcatacacacacacacacacatcttgacccacataagcagacacaaacaggtacatacacataaacacacatgtaaataggcacactcacacatgttcatgtgcatgtatacaaacacggtcatgcatgcacacacaatcacaaatgcacacacaaacgtgcatgcacatgtacaaacacacttatgtgtgcacacttacacaaacatgcacacttcttcctgctacccatgttcattcttagggaccccttgagggagtttccaggagagaataaagattctcttcccacctggccagtggtaacaggggagaaagcctattacaatggaaaggctgactccccagctccatcattgccaactctgtgacattacgcaagttatgtgatttctccaaaatttgatgtctccatctataaaacaggagttaatcatcatataacagggtcatagtgcagaattagttcattggagaaaatgctctagcacatagcaggtagtaaatatctgttccccgtgctgcaatctttgatgagttctccctggaatcagagaagggaatggctgttgaaactctcacgttggctgggtgtggtggcttgtgcctgtcatcccaacactttgggaggccgagacaggaaatccaaggaacagaactgttagaaaattaatgtctaccatttaagccacccagtctctggcaaatttgttatgagagctcaagtagactaatcactttagcccaggagcttgagaccagcctgagcaacatagagagacctctgtctctaccaaaaattaaaataaacaattagcccagcatggtggtgtgcacctgtggtcccagctacttgggaggctgaggtacgaggattgcttgagtccaggaagttcaggatgcagtgagctgtgatcacatgactgtataccagcctgggtgacagaacgagaccctgtctcaaaaaaaaggtcctaatttcatcaatgaggacatcaaggcccagagagaggatggaccttttccgaagtcactgacggagttagtaacagactgggattggattcctggtccacttccttccagtcctttttttctattgtgctgccttcatcaaggaggactgagaggctccactggccccatcaccaaccccagcaagattaattgtttttgttagagactaacattcttgtagaagtttactcttttcacagagcaaaggctaattagaaattgcagtcttaagggaggctgccctgggcctcttattggtacctatgcccagggtgaaacgaaaagaagccagagagtaggctgtgtgtgatatgaagatgtcacccctggcttggacaggtttctttagagcgcagagtctcctgaaaattgtctcaggagaccctgcctagcaacaatcattgatttaaacaacaacaaaaagcagctcattatggggcaggtgccagcctaggctggaaaccgggcaccagggtctagggatgcacattcagtgataaaacatgctgccaggatggatgaagagccagggtcaggaatccctgggtcagagccaggacaagaattcaattcagtaaatacttgccacagcctgtccaggaacagttaatagcacacatagggtggaggctgaaaatgcccctgaaactgtagcagggctcatggttaataacatttgagcattcaccacgtgccaggtgctattgtaaggctttccatgtagtcactcattagtcttcataatgactctatggggtaatgcctgtctttatacccattttacaagtgaagacactgaaacaaagagagcttaagtaagcagtccaaggtctaagaggcacaaatagaatttgaatctacacatttaacaatgatgcccctgtcttcaatcttaagaggtctgagttaaggacttgagcaccagtagcttatttgggggatctcgggaaacacgggaaagggagaggggaagtgggatagagaaaagaatgaagccaatacagggtgcattagaaaacagattgacaactagagcttaatcctgcttgccaggactaggagccagggcagagcatgcaccttggttttatatgcctcttaggggtgagagagctggggtatttctacaccaagccccatcaatcacgggttgagagctgctcttgggctgatagttcctcagcaattccagcctgccatgaacaggcaatgaaggatttagaggacaaggaaagccctcaaaaaatatatagataataaaaataaacaaaaaaaccactcaggtgcaaggaggcatttgaagttggctggtgtgcaactgaggagatatgggtgaggctctggcagtgttcagtatggaaaccccaacctcctaaatgacagaagagaacagagatcctcacttctggcttagaaatcaaaacaactagacccagagtggtaagcaatgaaagatctgaaatacctggaacaagtggtgatgtcccctctaccccttgtccctgggcatgcagatcagcccctgtagactcatttcatgcatatcctcaatcccaacacagaacacatgttgtcaggcctgaatgtgcatgatttaagttcaaagatgagacaaagacctcacctgactggatggcttcacttgcctggccccttacccacccctggctttgagcagtacaacagacatcggtgagttaagtcttatgtccatcctgcctgactgggggacttgagaacaaggaactgccacaaggcagggtgtggaggcaggagaaggaagggcccaaatacctcacctgtaaagagatgcttgcctcagaggttgagccctgacaggctacagcggcacccctgcttggggagcagggaggtgatggcgatgaatatgtctgaatatgtatgtccttgttttcttggaattggtgtaactgggctgttctgcaggttaggtattgaaaattgccaatggaacatgaagaaaagtcaatagacatatgtaaaatgaaatcattacatagaaaatgatttcccctgaaggcctcgggaaactgtcgctatcaaggaaagaaatgtgcctctgtcgagcctggaaatgcatgtgggcttaggaagctgtgcggtcccgcggtgctttcctccttcatctgctcagcaatggtgtgtcaggccttgccttagggagcagtgccgccagagaaggtggacatggaaccagcacggtagtggtgactggctgcccccaggaagggtcactcttctttctcaactaccagaatttaatattttctttattctaaccactctgggcaacacagagattccaaaaactgtttttgctctcctggaggttacggtttcctcacctgtaggttgaatataataatgtttcccacaattgttataaggaataatgtctgtaaagcatatgaaacagcacaatgcctggctgagtgtgagcctaaccacttactgtttaaatgtgtccgttgtctgtcttctggtctagaatgtgagccccttgaggcaaggattctgttggctgcctcgccatgcaggtgacagtacttggcaaattgcaggtgctgaggaagtagtgaatgaatggatgaatggaaacaactccaggtacatagtaacttctagcttgttggcataagagtttaacctcagatgaggtaaagcatcctgtcctttttccttgtaacacccaccataatcacactgactgatattctgtgtaatcatttaatagctgtctcctctattagaataaaagtcccatgaggttcggatcctgtctatccttcttcactgtgatttccccagagctaagcactgtcacaaagttggtgcatgataattgatgaaaggagggaggggaggaaggaagtgagagagggaaagagcaaatgaacacagatagtagcactgagtcatggaaaaccccagggcatgaactctgggtcccagaaggctcttgcatctctgatgataggtggggtccttggattgtgggggacagtctgacctgcaggagtgagcccttgggaggggtgggcagggtggctgcagtggctggggctctgtgagctcccccatgttcctgtccccagcctgatgctgttcctgctgaagcctctgtgctttcccagggagaagggttgtagttgtggatcagtgatatttgttaatgaacctgacctgcagagggatttcatttccctcctgcaaaggtcattctcctccccaggctactctgtcagcctacgggggatggagagaccagaggtctcctgacacagtcctcagggaagccccacccaccccagctccctagaagcctgtgacagctttgcacatcctccgttgcacttggaaaagatataaaacgtccccgtttgtctcttagtaaaaaagcagtggtttctaccttgtaattaggattactctgcctgcagtgtgatgttccttttaatcaccaaagggtaagccagcagttagcataatacaacatgttcatcctaatacacacaggcattggtggggagagcaaagcaagcagggaggagcaggccctgattcagccacagcagtgggaggcagatgccaggagagaggcgtgctgaacaggaagacggcggtgtgatcatccagggcagaaagggactgcagcatggccaggcgggtcgggagccagaatgggacacctgctggagacaggaatagagaagttcacaacacctgtactcagggagccccagtctgaagggagacgcagtcccatcctcagggatccccagtctgaggggaatcataccccttactcagggagccccagtctgaggggagacacagccccggccttgggtggtcccagtctgagggagacacagccctgtccttagggagccccagtctgagagcagacagtcccgtcctcgggaagccccagtttgatacaggaaagaaagcttctggtctcagcaagcctcctgtaagaggcagaggtgattcctgctctgagcagttcacagggtgatggtggagctcccagcttgatggcagaaggacactgctcctgctctcagaacactctccatctgatagaggtgacacagcccttgctctcaacaagctttcagtctgatgagaaagacagatcccttagtctcaggaggtccccaaactgatggcagaaggaagtgaattaaactccattgagcttctactgtataccaagctgcatggtagaggcacctagctactcatttaaccctctgtggtgtacccagggtcacatgttgcttgactccaaggggcatcattcatatgggacaccatgagggtggtgtccctgaaggtgcacacgtaagagagggcccagtctgagggagacacagctccatcctctaggagccccagtctgaggggagaaacagccccatcctcagggttccccagtaacgggccccagaagggcccaagtaagcatacctactcccaacttacagaggagacaaatggagcacagagaggctgagcccaagggctcatagctgagaagcagcagaatcagacctgaagctgggttttctgagctcagtcaagtgctcctaggatagtttcttatctgtgaggggaaataaaacagaaagagagaaaagcctcctacacatcctggtctggagttgccctataagtagagtctgaaacagaggctacctcctggtggcatttagctgggaagtgatctcagggaacaggaggggagtagaaggaaaactaaacagggaaggcaggaaagcccatccaagcttgcattatcagattggccattcctgcaggcaactggtgtgtgatctctctgggacctctctggagctttgtgtaatatgtctcagcaccatgtgcccaaggggatgaaagggagaaaaagttaccccttggctgtcacctcctattggccacgggtgacctgcacttcctggttacaggtgcctgagcatgaaacaggtaccaatgggaatgaattggtatcagagaaaccctgggcaggaagtgagagaggcagggcacaggcagaggtgagttctgttgggttgcatctgcacaaggctggttgaagcagggactgaagggaggggcagagatgaggagattatacaattgatatggtttggctgtgtccccacccaaatcctatattgaattgtgactctcataatccccacgtgttgtgggagggacctggtgggaggtaattaaatcatgggggtgggtttttcccattctgttctcatgatagtgaaaaagtcttatgagatctgatggctttataaagggtggagctcctgcacccactctctggcctgctgccatataagacatgcctttgctactccttggcctcctgccatgactgtgaggcctccccagccatgtggaactttgagtcattaaacctctttcctttataaattacccagtctcaggtatgtctttatcagcagtgtgagaacagactaatacagtaaattggtaccagtagagagcagtgctgctgtaaagatacccaaaatgtggaagcaactttggaactgggtaacaggcagaggctggaacagtttgaagggctcagaagaagataggaagatgtgggaaagtttgcaacttcctagaggtttgttgaatggctttgaccaaaatgctaacagtgatatgaacaataaagtccaggctgaggtggtctcaggtggagatgaggaactcattaggaactggagtaaaggtcactcttgccacacaaagaaactggtggcattttgccccaccctagagatctgtggaactttgaacttaaaaaagatgatttagggtatctggcagaagaaatttcgaagtggcaaactgttcaagaggaagaacagcataaaaatttggaaaatctgcagcctgacaatgccatggaaaagagaaacccattttctggggataaattcaggccagctgcagaaattttaataagtaatgaggagccaatattaatcagcaagacaatggggaaaatgtctccaggccatgtcagagaccttcacggcagtcccttccatcacgggccccaggctcagaggcctaggagggaaaagtggtttcctgggctgagtcctgggcccccctgctgtgtgcagcctagggacttggtaccctgcatcccagccactccagctgtggctaaaaggggcccaggtaaagctcaggctgtggcttcaaaggatgcaagtcccaagccttgacagcttacatctgatgttgagcctgaggatgcacagaagtcaagaattaaggtttgggaacctccacttagatttcagaggatatgtggaaatgcgtggatgtccaggcaaaagttggcagccagggcagaaccctcatggagagcttccaccaaggcagtgtagaagggaaatgtggggtggaagcccccacactgagtccccactggggcactgcctagtggagctgtgagaagagggtcactgtcctccagaccctagaatgttagatccaccgacagcttacatcgtgcacctggaaaagccgcagacactcaacaccagcccatgaaagcagccggggtgggctgggggtgggggggctgtaccctgcaaatccacagaggtggagctgcccaaagccgtgggagcatcagcgtgacctggatgtgagacatggagtcaaaggagatcattttggaactttaagatttgactgctccactggatttgggacttgcatggggtctgtagccccttcattttggccaattgctcccattgggaatgggtgtatttactcaatgtctgcatccccattgtatctaggaagtaactaacttgcttttgattttacaggctcatattcagaaggaacttgccttgtctcagatgagactttggactgtggacttttgagttaatcctgaaatgagttaagactttgggggactgctgggaaggcataattgcttttgaaatgtgagaacttgagatttgggaggggccagggatagaacaacatggtgtggctctgtgtccccacccaaatctcatcttgaattatagctcctataattctcacgtgtcatgggaggaacccggtgggaagtaattgaatcatgggggcgggttcttcctgtgctgtccttgtgatagtgaataggtctcatgagatctgatgagtttataaagggcagttcccctgtacatgttctcttgcttgctgccatgtaagacgtatctttgcattctgccatgattataaggcctccccagtcatgtggaactgtgagtcattaaacctctttcctttataaattacccagtctcaggtatgtctttattagcagtctgagaacagactaatacaacaatgaaggacctacagcgtcggctgcctcccaccccaacccccagctggttgtactctctgggaagtagaagctaaagtggaattgggaatgcaaaagtttttttgagaagtatcagttgagaaggaaaaagggagaaagatcggtcaagggagtcagctttgagatgtcatccctttaaggacccagtcttctagtccctaacaagaatctgagattctgtgatggaggccatctaacagagcccccttggcccaaaacaaatgcagtaatggaaattcctagctcaggattctgccatccttggccatgaagtgttctgatttgtggcagagactgctagatgtcctcaatctctctttcttccatcttccttggtgaaagtatccctcaatttttaactgggctcatgaactcctgaaataaagtctataatcccattctatcttgcaggtgggtgtggtcctctgactaaattctagccaataggacataagctaaagttagaaaagtgttaaggacacttaggaagtgtctttaaagagaagaatgtccttttctttctcatttccttcatttctcattttgctggctggaatgtggatgagatggctggtgctccagcatccatcttggatcacacagtagaagctatgtgctgaggaaggtggagaaacaagataggcacatgggtctcagatgagtattgagctgccataccagccgcaggctgcctacttctgaaattgattaatatgaagtagtaataaccttctgtgtttcgtcagtgactgttatttatcttgggttttctgtaattatctgtatatatgtctatcttcttattgctggggactcagggagggcaaggacctgacaaggcttatttatctttgtgtctcttgcacccagcaaggaggctgtcatacagtaggtgtttagtgtttgttgaatgaatgaatgacataccttcattgccacttgacctgtggaaaggtaacctaaaggctgggtgcggtggctcacacctgtaatcccagcactttgggaggctgaggcgggcagatcacgaggtcaggagattgagaccaccctgactaatacagtgaaaccctgtctctactaaaaatacaaaaaaaaaaaaaaattagccgggcatggtggcaggtgcctgtagtcccagctactcgggaggctgaggcaggagaatggcgtgaacctgggaagcagtgcttgcagtgagccaagatcgcaccactgcactccagcctgggtgacagagtgagactccatctcaaaaaaaaaaaaaaaaaaaaaaaaagaaagttaacctgagagcctcccttttggtctcatcttgaatggaatcctaaactggaggcccaggatctaagcacctacttgggccactccctgtgctgctcaaatctggtaccctggaggcctcaggcaaggtgggagccatggccatagggggagccctccagaggtagatgccccagggagcagtggcttctgcaattggctgagggagagttttccaggatgacttgcagctcccaaacctgccatactctctcttgcctcctggcctttgcataagctttcctgtcctggcatgcccttccctctctccagcatccccatatggttttactggaccacttctcccaggtttcaacaaagaagacacttcttcctggaaacctttcttgtagctccatcccttatgagtgctcaccaggcctcctgcttttcctacctagaagctctttccacattagatagtaccctccatgaggtcaggggctgcgtcccctctgttgcatagcctggcacaggtgggctcagggaaggcttgttgacttttctctgggcagggcttgggagacaggggtggctttcagaggatcggagagctcagtaccagccacagtggcctgccctgtgcctccagcctatgccaggcctcaaccgtcttcagctctccctgccctcaccctcgctccctctgcaatgccctggcaggactgagcattttctgctctcagtgacctgtgaccaaagccacagcagctaattaacaccctgctgtgtgcttgatccctgccctggctggcactccactccggaccattcccatttaatgggctcagcgcctgcctggcaacctccatcctctctcccttcacatgatttagcttccagcctgaggtttgcttgcttgcttcacttagtaattaacgctttcttctgactgttctcttccctcctccactgactgtatgtgtgatctgggactgggtctcccagacaggctgaggcaggtgtggaccctgccccaggggatcctgcagtggagctgacacactgacatagagaggcaagtatagggcacagggatgacaagggaaggaccgcagatagcatgtggtccaatgtctacctactgtgcaggagggaagactgaagcccagagacagtgagcaggctgtccaaggtcacccagaaacctaagctgtcctagtctgggttccccaccaaaagtctgaaaagtctgaaacaccattttagatgcagatagtatattttgggaggggacagaaataggggctggaagaatgaagtaggaaggagagtaagccagcacaagcgtgccctaccaagctgggttctgctgtgagcagtgcaggttccatcacatgatgggcttgctgagggcttcagaagggtccactccagaggggaaagaggggaccatttatccttcggtttctggccaccattgggcaatggttgccccctgccattggggtgctgacatcctcgcacctctggcgttgtgcctatgtctgtatagctggctgtgcagcttcctgggggcagtcactgccgaggtgtagagagaagtggtgctgctgaggcagggtgctgtgagaggacaccgcatgtggctgattctgcagcaatggccacaatgaaaggttcggctgagaggctgtgaggtagggcacatgagtgtcagattcacaatgcagtcgtaacagaacaagaaagcacagccagcaaggactgtgctcagcagcaaccatcagaatacccaactccactgcccacaaaagagaggcttatttttctcctataagaagaaatatagaaataggcagctgctggcagaggttcaaggatgtcaataccaaaatctgagattgttagtctttcccttgtgagtgcagcatggctgctgcagttccagccatcatatatacacttccagcagaaagaaggtggaagcatggtggaggtgggggcaggggagcacctttatcaggtcagccaaagctgtctccaggaacactccagtgaacttccactacaatgtattggccagaatagtcataaagcagcatatctaaggaagagggcagaatgaggacagtggggtgagggatgggcagtgggcagccagcagtctgccacacagacatagcctcattttctttttcctttgtagaggagctgacttctgcccctgctcacactacacattctttgttgttcctaactcatggctggcctgagtggccctggtctttgggaccgtttagggtgaatgttgggcttctccgctgagaccagatggatgaagagggatggaaaacaatcaggagctttcccattttattccctccactaatctctcctttgaaagaagtctctcttgcaggtgaagcaggcattatctgatttcatcagtgctgagtgccatgcataatgagaatgatgtattttgatgtgtttgtttccctctcctggccagtgggcaatttcactgggtgatgggcctgcagaagggtgccaaggagagaaatggaatccaaggctcccgcagctgccctgtgtctgtgtgggacactgggaagtcagcagccaggagttcctgctgtctgcatgtcctgacctagcctccacccatcccaatttggttaggttcacagtgcctacctgtcattcagtgcctctccaatttccccaggcaggaagaggcacatcttcccagtcttaccagatggcccagctgtcattcatggtcaccatcttagtctgaactccctgaaaaactgactctgagtcaaggatttgagtgaagatgggggaggtgggaagcaaggcaaggaagggcaggaatcttccgcactggagtcctatcctaggttccactgtgagcaactgtggctcagtcccactgcaggcctttggaagaccatgtgggacatgcctcagagtggaccctgaagcaacagggagctggggcacttatacaccaactccatcagctgttggttgagggctgcgcccaggggctgtaatcccccagtgttctggatgccacatggcaggcagaacaggattcaattgccagaaaaaggccccaggcacagacatgcaggcagtgcccaaggagagttaacctgagagtggctacaatggtgagaccaggggcatgcgagtggagctccaacagtgattaccacagacacaaggactgtcccagctggaggaattagaagggaccatcccaatggggtgctatcagcattggttggaatgaatttccttgtgtgggacaatagccctttgcagtatgttggcatccctggtcccacccactcaatgcccatcatacctcctagtcactatgacaaacaaaagtgcccccatacatttctaaacacctcctgtctccagttaagaacccccaatacaaccaatcccttcattttccagataaaggactgtcactcatccagcaactcacagctagttgtgagaggccaagctaagtctgaaatgcgagtttccttagttgttataattgctttctcaaaaaaaaaaaaaaattgggatggcttagtactcattcattcattcatttatcacaatttattcagatgtcctgtctgagctctatacccttgtctcccctcgctcatgtctaacctggcaccttcctgctatggcctcaggcctgtccccaaggattttggcagcattggtaccctgttgccaatgagctctgtgtgaggggagggctggtggctgcaaagtggcctagcacaggctgtggctagatgggaacttcactcttcaagaaggctgccctaatgcctctcctgtagctgatgaaggctgcacagccgcagtgatggtaatgaggccctaagtccctaacatcatgctcccgggagggagacgctacccagcagccctctccttgccgcctccacaccatccatctgccgcccacttgcagcacctgcagccaggcctggggccactctccaccctccaggcccaggcttctctgtgactggcagtccattcaggcctggcacaaactactggcatcaggcgcagcatgagtgccatgccagccttggaaattatggagcatctctggctgccaccccaggggcctggttaccccacccacctccagccataatccacctggctccctctgctctgtgctaagggctgggaccagatggcgaatgattggggctgatttacagtgacagctaagtcggctgaggatgaggtgtggatgtcaaaaggcactgagtaaggggcctgctaggtgggggtggggtagggatggggacagaagcagggaaaggaggggtgatcccgaaacagaaagtgatgcaaagaggaaagaaaaagcccagggccatgagaggagagaggagagggagaacagaggctgggagaaggggaagagggaggaaatgagtgtagctgccattaattgagctcttaccatatgccaagcatggatgttctcagggccctgtccaatatgatagccactagccacatgtggcattttaaattcaattaaaattaattataataactataattacaaatgcagttcctcggtcacgttaatcacatttcgagggcttgataggcacaagtggctagtgcactggaccgtacagatagagagcctttccatcatcctagaatgtgctagcgggtgggcggtaaaggggaggcagatattaagtaacaacagtgcatgttgctgatatgcacatatatctctatccatctatatatctctacatgcatatatatcaggcactgttctaagaactctacatagatttatccacttatatcagctgtagatgacaggtttttctatcagaggtcagcaaacattttctgtaaagaaccagatagtgcatattttaggctttgtgggccatataatctctgtcaccactgctcacctccgccattgcagtgtgaaagcagctgtagacaaaacgtaaatgaacgggcatggctgtgccccagtaaaactttatgggcaccatgaaatttaattttcatgtgtcacaaagtatttttcttttgattttccaaccaattaaaaatgtaaaaacctttcttaacttgagggtagaacaaaacaggcatcgggctggatttggctcatgggccattgtgtgccgacccctgattgacatcatccccatctcacaaatgtggaaagtaggacacagacagaccagataggtcactggaggtcccatagccacaaatagcgaagctgagatttgtacccaggtgcttgggctccagaatccaggccctcagcctccccacacaacaatgaacaatgtaatttctggtagtgatcattactttgaagaaactaagagtgtgatatggtagcaagcatgagagacatgtcgtctagatcaggtgaacaggaatactgtactgatgagggaggctttggcctaagacggagtgacaagaaggatgcagccatggcatgacccagggcacgacatctcaggcacgaaggagacagcaggtgccatactctgcagcagggtcatgggtcagcatggccggggaatggagtgaaggccaatggctgactccaaggacagggggttggacatggagtgaggctcatgaactctgataaaacaggcaccattttaagtttgatgggtagtcactggggcattttagcaggagaatgactgatacaattcatggtaaaaccaaacctcatcctggatgcataagagaagaggcaggaagctagttaggaagctgctacaatcggtcacacaagcaatggtggcagtgtggagtggggcagaggctgtggagatgtagatatgagaacagatttgagttatcttttgaattggagccaacatgatttatttttcatttggatgtgaaatgtgaaggacaaggaaaaagtggaatgactcctagtttgggggacttgagcaatgggtggaaggcaatgccatatagagactgggaggacaaggagaagtacaggtctagggtggggaaatcaagatttctgctttgggacatgctaagtctgagatgtcattggacatccaagcaatgatggcaagtggatggttctatattggaatctggagaccactgaagaagccagggctagagatataaatttggggagcagcagcaggtagggggttgttaaaatcattgaatcaaaggaaggtacaggtagggaagaatagagggtctcggaactgcacccagcattggaggaagggccaaggtggaggctccagcaaaggacagtgaaaagacgctgaagtcaagctgagagaagagaagctgcacgcagataaagctgcatgcagataaagactcagataaaacatttatactatatttaacaaaatattgacatttgtaatgtagggtttttataaataattataaaggcaagtctatagaaaataagtgaagaatatgaacaggcaatttatagaaaaataaaaaggctaatgtttcagccaagacccaggcagaacacagaatttacaccctgatggttcaaatgatggcaattaaataaagcatcagcttgtaaagaaatgcacagagttaaaggaataggcaagggatgatgaagtgcccaaggctggcagcagcaggaagctgttacctctcctatggctaaagaggcagaaggggctaaagaggtagaagttgaaagaggggccaccccatgggagctgtagttttagaacaatgccaataccagaggcatggggctggagcaggaaaagaacaccttgacctctctcttctctcctcccacccttcaacctcctgtcccccagcattccaggaatctatttcatagacaaacacacatacatacaaaatatcagcagaaaaatcttcacactagcattgtttagaatggaaaaaactgggaacaatattaacatctatcaataatattgatgatgatgttgataaagattatgaaagccaataggtatatgatgtgtgtgcatgtatgtgtgtgcatgtgcacttactatatgtcaggcttaattctaagcaatttccatgcatcatcttgtttaacaataatcctatgtggcaggtactattattttagtttacattgagtaaatcaaacatcaataaggttctagtgaaatcatggtatgggcatactatggaacactgtgcagccatttaaaaaaggaaataggtccagatatatgaatctggaaagaaacacattgttaagaaaaaagtcgcagaagtatttgtatagtgtgattccttttatatttttaaaatagcaactctgtgtgtatttctatgtgtacagaaaagatctggaaggatacactcaacaaataatggtggtcacttaagcagagagggttggaccaatgggagttgaagaggagtggcatttttattttacatataatcagtatatactgacatattacttatggatgaaaaaataaaaggatcaactgaagaagtaaaagaaaacagaggacaagaacaagtcccactgttgaaactgggatttcaaccaagcaggctcctgtcccagtactgctgcattttagctgtaagttcctgggtaaacacattgcttctccaagctcggtttctccatccatgaaaggcgaatattaatcatggtacccacctcctcaagctggcatgagatgcacatgagagacgtgtgagagagtgtacatgagtcatgcagcctggtgaagaacgccctacagacgctcaacagggcatgctcagcatgtgctgtgcttccagcccctgggaggcttgaggaaagtgaaggtggcaagtggagaggggatggagggcccacttctgtgattctgtggccaggactctagtccctagagtttacagggcactttcttccctgctcacacagagctcaaaacccagcactcggggttgactccacctgcatgcagccagcacatcctctctgtttggcaggaagcaaatcatgttcagtggctctgcagccacatcccctaatccgaactgggaatggaggccacagtcattcagtagaaaagtgagttagagaatcacacacgtacgcctctttgaccttctaggaattaataccaatgttttataaagtgttgccaagccactttgagggccttttaaagtaaagctcatttgcaattcacacattgaggttgatatggaactaagtggtgccaagagaaagagttgtgtctacacactccccaataagcttcttcagagggttatctccacctaatgctcactgacatggaactaagctttacagccccaagaactgtattggtgaaacaaaagtctggaaagataaataccaaacttataccagtagttaactctagggtgtgtgtgtgtgtgtgtgtctgtgtgtttatgagggggtgagacattcctattttccttccagtattgatacagtgcttggctctgttgtgatgaagattgttttcagatattttacgtgaaaaaaattaataaaataagaaaaaagaaaggcaccaaatgggattgttctgtggaatacacaatattatagacgtatgaagaaggacctgcacttcctacacatgaaagtagttacgatttatagagccctgatttggtcccaggtgctgtgttacaagtgctaagctactgagtcatgcagatgactccacaaggtaagcattattcaccccatttgcagaagaggaaagtcggggcaggggtagaaccacaccctaagtcatcagtgcatgcattcgcagattagtgtgaaatcacagagcaatgagaaatggatttcctcctcccggacagagtcaaagaacctcaccaggaggctctccctccctccctacctaagagtcttcagagaaaaccttacagcatctgttcacatgatatcaaggagcaaaacgccagcgaaattagaaaccccaccattccgccttgctggaaggagccagggaagataatcaatcttcaagatgaggctgcgaagcagagcaagccaggcttggcccttttcagaaaagaccccaaacagggggtctgggctgttatctcctggacgctggtcctgtagccagcttccaggggataacaggggcggcagcccgagagggtccccttctctccagagggggcaggcagcaggctcacagctgccctctcccaacattaagacaaatttataggagtgccagcaaggcgtaaaacacacgaagataggctgttcctcactccagcctggctattcaaccccctcactccttctccaattctgcttcctcacctgcttcccgtagctgaaggcagaagaatgccttaaagacccttcagtcaccgacagaacaagcctggcctggagccgctctcttggtggccacgcccaccgcagccccaggacccctggaccctgtgcagggggctgtgtgcccttccctggctcggcttctccagatgttccttgtggctctccctccccttcctcgcacctcactggtggcaaagagccaaagcccccgcacacagtcaagctggcaacccaactacatgggattcctatggctgcagatggcctgagacgactctcaaccttgacaggatctagggctgggggcttgagatagtcaaccaacgcccagcccctggacggggttagagtcactcctccacctcgtggtcattgttggaactacaccctgggaaagcctgtcctgagaggcacttactccaagggatgatggaggaggtttgatgatgatggtgatggtgatgatgtgatgataatggtgatgatgtgatgataatgatgatgggtcatgagtgtaatcacttacctcttgccactttctgctcacatcacctcctcaaaagggcttttccctgaccaccctgtgtaaaatagcaccaccactctccttaaccctgccttattttttgtagcacttatcatctaaaatattattagtttgcttatttgttgttcgtgtaagctccaggaaagcaggagctgtgttttttttcactgatgtatcctgtgtagctaggattacctcacagttagcaagtgttcaataaatatttgtgaagtgaaggggttggtaaatgactcctcaatctctccctgtgcccagcagtcctcccagctcctggcaaggccacagatccctctcccgcagactgagtttgcctgtaatactgggaacaatccccatgctcgtctgggagatgtaaggaccctgtgttagtctgttttgcattactaaaggaacacctgaagcttggtaatttataaataaaggagatttatttagctcatggttctgcaggctgtacaagaatggcacaggcatctgctcagcttctggtgaggtctcaggaagcttttactcatggcagaaggcaaaggaggagcaggtgtgtcacatggagagagagggagcaagacagaggggaggaggtgccagcctccttttgacaaccagctcttggagtgaactaataaagtgggaactcattcattactgcaaggatgacaccaagccattcataatggatcctcccctatgacccaaacacctcccactaggtcccatcacttttcaacatgagatttggaggggacacacatccaaactatatcagactccaggtctcaaatctgctggtttggcccccaccggcctgtggtggtcttgcccttggtggtcaagaccctgcccttggtcctcgcctttagcatctgcatcccatggtgtcattccttgcatctgcgtcctccctgcctcatcccagtgtccatgcatgttgccctcccactgattgccaggccctgggctgggtgttttgtgttcactacctctgatcttcatggcaccctgcaaggtgggcattgattatcctcatttttagatgagaaatgagttcagagagatggcacaactttgcacatgtgatttatgccacccctgtgttttccagagatggtcccaatgatgctaatgggtgaaacaaataaagaaaaatacacataaaataaagtttccatggtgagaaatttcagaaaacactgggttcagcaaagcagaattttttctatcaggacttcttagactctttaaaatgaccatgtgcatggcagcccccagtggggaggggtatatgcagggcacaacatttcccaaacctatctgaatttggaaccacttatccaaggagcatctcacaggacatggcttggataacaaatgcaaaatcggtttcaatcctcctggtcaggaattaagatcagtggatcaagatcggtttcaatcctcctggtcaggaatcaagatcagtggatcaagatttgtttcaattctcctggtcaggagtcaagatcagcggatcaagatcgatttcaatccttctggtcaggaatcaagatcagtgcatcaagattggtttcaatccttctggtcaggaatcaagatcagtggatccagattggtttcaatcctcctggtcaggagtcaagatcagtggatcaagatttgtttcaatcctcctggtcaggagtcaagatcagcggatcaagatcgatttcaatccttctggtcaggaatcaagatcagtgcatcaagattggtttcaatccttctggtcaggaatgccaggggtgtaagtgggtgaaagtcaggccactcctgcgtgtatcttatttgatctccgcaacagctccatgaagaaggaatccttatcctcactttccagatggggaagctgaggctcaggaaactaaagtaatttttctatgttgcccgtaaatatttgaagctagtggagtgtgactattcaccgggtgctcttgaatgatggcgagagggaaaaggattaagacagttcaccgggaaccaggagacatggtagtagacatgggatctacatgaaaggagttcagggaggaggatgtgactgtgtccagtctcagggagtcaccccagccctgacacacgatgactgccaccataacttccacgctcctcggtccaagttctcaggatgctcctgcagttttaattaaacgctgtgtatggtggctcattaaggagaaaacagttgttctgtatctaagtagcctcaggtctcttcaccacttttactgctcaaacaacatcgcagataattttatagtgtttggacttggtattgcctctaagcctggcaggacctccaggccagagctgtgtggcaaatcactctgctccaaggacaccgccctcatttcaacaaggattcctggtcaggccctacctcctttctctcttcagaccccctcccaccccagggaggggctccgcctgccctaatgttggtgccaggatccatgatgatgggaggtaggcaggctttggaggggttagactgtgtgtaccagttcccacgactggaaggttgtctcgcttctgagctctgatacaccatttggcaacttggtcccttattaggttatttcataggaaaggattaggagcctattaacaatattagtttaccctcccacagcccttgccacaagccaggcattgttctgagctctttacctatagtaacttgccaaattcttacaataactctataggataggtatggttgttatcgcatttaatagatggggtaactgaggcaaagagagttttaagtttcttgcccaagattataaactattaattggtgaagccaggattcaaacacaggctctctggccctgagtctctggtcttgaccactgtgttataccatctgctaaaaacccgactttcagccttggccttgctcttcgtcagctcccctgagtagggactgtaattctgccactgattcccagctcagggatgacagcttgattgactacttatctaggtctccaaccatcacttgatcctggattggcatcacctttagcaaattgtgttttccaaagatggtacagcaagatctttagaacgttcacactccctctctgaatctggacagatctttgtgactgcctttcccagaaaatgtagccagagtgacaaaatgtagcttctgacgctaatacaagtgtcatgcactcctgcctttctctttgggaacttggccgctatgttgtgaggaagcccagttagcctttggagagacccatgtggagataaactgagggcccatcaagttccaagctgacagccagcaatgacttggcagtcaagtgagtcactttgaacgtgatcttccagccccaagttgagtcactcagctaatgctatgtaaagcagaggcaagctgtccccaccaactcctgcccaaactgcagattcctgaacaaaataaatgattattgttgttttaagcccctatgatttggggtggcttctcacatagcagtagataagcagaacaccagctgtgtctgctggtgtgattctgggtcatcttctctgacatacccttattttattgctgggctctatctgccaggccagacctctcccaacttctctgtccccacaatacctgcccctcgctgatacagaaagaagaatggctggtgcttttccatctgcccatctccctgcatgtcacaaggcgctgctggcctgggcccagctgccagccatcctcccagcaacactcagcctccagactgactctgaattccagggaccagtttcctaggcagtggggccaattccaagctatcttccagctcacatatttttgcttcaccaagaaagctattatttctccttttcattgagtgtattacatcaattattttttgttataaaacttatagttagttcttttgcaaattatccagtccatttttattgtttttcatagatctgacacactttgagtccccttttaattttaaaacatataaaacatactactttcatactactttcggtgtgatggttaaatttatgcatcaacttgactgggttaagggctgcccagatagcgggtaaacattctttctttctgtgtctgtgagggtgtttccagaatagattagcccttgaatctatagacggagtaaagaagatctgccctcaccattttgcaggggcatcatttaatccattgaaggcccaaaatagaacaaaaaggtggaggaaaggcaaactccccccaggctacccctgcttcatgagctgagacatccatcttctgctcatggacattggagctcctggttctgcttctttagactcaaggactaacacccgtcctccccatcccaccccatcctgagttcttcagccttgtagtaaattacattacctccttcctggttctccagcttgcagacgtctttgtagggctccttggcctccacaatcacatcagtcaattctcataataaatctcctcttgtatatctatatatatccttttggttttgtttctctaaataaccctaatatgctgggtaacaaactattacaatgcttcctattttttaaacattttttgttactcttactcatggtggcttgtttccctgtgggtttggggattttaaactgtgagcttgtgccctgtcagcattttatctgtgaaaattctttgagatctgcctttagagtatattcctcagaaaagatttgtgtttgcttctgcaaggctcctggtgacatcatcaaggcagaatcactggcaaatttcacatgggtttattagattaaatatgaatctttaaggacatgccaccatggccagcatagatttttttccagttcccctgaagcccacttttcctttcctttactattgcaagtattttaggaccccatctctacaaaaaattttaaaaagtagctagctaagcatgatggcatgtgcctgtagccctagctacttgggaggctggggtgggaggatcacttgagctcaggagttctaggctgcagagagctatgattgtgccattgcattccagcctgggcaacagaattagaccttatcgaaaagaaaaaagaaaaaaacaaaacgattttgtaagaagcatttgctctatattctactctggttccagtgttccaatgtgtaaaagtttgccacattttaacctaagttagttttcttaactaccttcttttttatgcgaggtaccccaagcagccttaaaagagtgggcacctgtgttcaaagagggaggtaaataaatgaaaggaaacaaaaaaattttcataaaaaaagaaaaattgtgcctgggtttgtacctgttggcaagaaaaatattccatatgactaacaactaaagttctttctaaaccatttagtaactctcagtgctatctccataagcaaattacaagtttattttatcttttttcttaaagtaagtatgttcctcaacctgaaaatggcttaacatctaccttaagttattgtaggccttaagaagcaattctccaaaaatctgtttcctggaaataatgaactcagctttctcagtagttcagcattcttttctacctggttagtttgcaaatgtgtggtttgacaatctctacattagagctgttgtatttgctatctattgtcacaataatgctatctaagaaaccatcccaaaactcagtggctttaaaccatgaacatttacacagtaggtcagtgatttaggtgaggcttagctgtatggttcttctgatcccagccaggtttgctcatatgcctggagcctggaggtgggctagcaatcggctgctgcaagctacccttggccagcgggactgagaaacttggctctgctccatgttctctcatccaccaacaggctgtactgggcatattctcatggcaaggtcagtggttcaagaaagcaccttttcaagcctcagttgtattttacccacaaatatctccttggccaaagccagtcacatggcaaacccagagtcgagagatggagtatatcaccccaccaggtgacataatggtggcaaagttacacagcaaagggcatgagtaccaggagaagcaaataattggagccaagtgatgtaatccataacagctggtgtccgggcagccctctcacaggagccatgccaggcagctggtctaatcatccattagggtgtcccttggtgaccagagcaggaatgaacagaaccctccttcctcaatcctatttgggccttagcgtcagagtcaatgtgtctgactccctctcgcgctcctcacctgccctggattaaaactgctagtaacacaattttatagttttcagggaccacctaggaaggcagcagtcaagcagggctgatctccctgcatccaacacatccacttccaagctcaggccagagtggctgcttaggtatctgggcatgctaccgaaaataaaatgtggctggagttcaatcacttgaaaacagaacaccatttctttcctgaattacctgagggcatgttaatagatggctgtagagaatctttcaaatcttccattcatcaataccatgccaaggaaggaagcataaatcagaaagcagttataagaaattgtacacggatgcagcaaagctcaaggtcagtgcccaggccatgcacctgccttccatacacccagagcccacaacagggctgggtgcacacctgctgtgtgcctaatatgtgacccctggcctctacttcataagcagagagctgttacacctgtagcttgagaaaggcgaggagaatacctgcgagggctttggtttaaaccctccgtataggatatatttgtcagaactgtcatgggagcagctgacagaaatctaactcaaggtagcttaaatagaatgagagatttactgtctcgtgaaaccaaataacgatgaaggccagcaaagaataccgggagccacagacacaactgtcagaagctttgcctctttccctctctctcctctacttcccagcttttccctgtgtgaagtctcatctcaccatttttctccacattgtaggtagacgggtcggagttgttgagaaactgatcaatgaccagttctgaacacacatccgtctggaaactttctggccaggcagaagagggctctctcttctgagctcatgcttgaaaattctagggaaagggtctaattcgccaggcctgcatcatgtgagccatcctgggctgatcactgtggctggagttggggtatggaacaggggtggggcaccagtggttagcagctctcatcagaaccacgtgcatttaggaagatgaggaatactgttctgggcagaatgaaccatgcacgtccaccacagagggctgattgttctagcacagggacagctttgaaggtcctcaccatgaggttcctcacctacagagcctcaccagcttatgggtgatgagcacagatatagattttaagccacccttttcttgaggagaggctgggcttggtcaagtgaaatatgaatggagaaggaaagtagacagggactatcgttttcttaagtgtgccaggtactgtcgaaggcactcaacaaggcttgtctcccctgttgatcacctgagagatattaatcttttttgttgttgtttgacacagagtctcgctctgtgacccaggttggagtgcagtggcacaatctcagcttactgcagcctcaagctcctggactcaagcaattctcccgcctcagcctcccaagtagctggaaactacatgcaagcaccatcacacccagctaacttttgtatttttagtacagacagagttttgccatgtttgccagtctggtctcaaactcctaggttcaagtgatccacctgacttgccctcccaaagtgctgttattacaggcacaagccaccacacacagccaagagatagattcttagacccattttactagtgaagaatactaaggctcagaaagggaaagtgagttacccaaggttacacagtgttggagtgggcacttgaaataagccttcctgaccactccgtatcagctcagctctatagataatctaaccacactgttaaaccatttctgagcgtcagcaactccactgctgtgtatttactctaaagaaatgatggcttatggccatggaaaaacatgcatgagaatgttcacaccaactttattcctaatggccccagactggaaacaagtcaatatctatccacgatagaatgaataaataatttgtggcatattcatacatggaataccacacagcaaggaaaaagaacacactattttgggaggcagaggtgggtggatcacctgaggtcaggagttcgagaccatgcctggccaacatggcaaaaccctgtctctactaaaaatacaaaaattagctgagtgtgatggtgcttgcatgtagttccagctactcgggaggctgagatgagagaattgcttgactctgggagcttgaggctgcagtaagctgagactatgccactgcactccaacctgggtcacagagcgagaccctgtctcaaacaataacaagtgtgctggtgtgtgcctgtaatcccagctactcgggaggctgaggcaggagaattgcttgaacctgggagacagaggttgcagtgagccaaggtcatgccattgcactccagcctgggagacaaaagcgaaattccatctcaaaaaaaaaaaaaaaaaaaaaagaatggactatttttacctgcaacagcatggatgaatctcacagatattttgttgagtaaaagaagccaggcacaaaaaagaacatactatgtacactcacttatatgaagttcaagaagagggaaagctaatgttggtgacggggaccagactagtggttatctctggggtgggtagagactggaaaggagcatcaggaagcctgggaggctcaaaaactagatatcttgataggggtggtgattttgcaggtctctacacagataagaattcatcaagttgtacatttatgttccgtatactttatgtatatcatacctcaattaaaaaaattcattcacaagtttgatagacaaaagttctaagcccttcaagtctatgctattctttattaattaatttctgttttccaaagagaacccgaggattcccctacctgaggtttgaggtagaggctcccattcatttctccgcgtatctctgcacgggtgctttagctagaccttaactgagagaccactctgggggctctcctctccccttactccacctcccagattccaacaagggaaatccccaggttccaaagggacttcctccttttctgagctccaccatcaggataagttggggctggggatggccgctttcagcacaccttcctcccgagccaggtggctcttgtgtggccagaaggaaacaaagctcccaggggcactgagctggggagtggatgcctggcacagcaccatcagtaggaacatcttcatggaaggtgatggaaccagacacaggacccacgtctacagtggccaaaacacagtaggaaagggctctgttttgcacttgcttcgcaggtcgctagttccttccttatctaccgaattaccttgatcctgcccatatctatcttctcaccagtaaaatggacccagaatacctaatcacagagttatcttgagatagaatttcaaaaggagactttacagaagagcccatctagcttatacattgcctttgtgtagatgagaaaaaagaaacccttcctcaggacatttcattgccatccattgactagttatcctaatgtcctgatttctctagaataagacacattagagccacctgccataaaatggccatattaaactttcaaatctacaacatctcttatgtgactggtaaccactagggttgtgcagcacacaacctgaacaaccatacacatggccctgttttcaggatatgatgcactatgcacaaataaggaacctgccctgttattgtggtcaggagccttaggtaaatccctttgttcttgcagggcattgtccttgagttggactgaattgtgctccccttccaaaattcatatgcagaagccataacccccattgtgatggtatttggagataggaccttagggaaattagatttagatgatgtcatgagggtggggtcctcatgatgggattagtgcccttatgagaagaggaaaagacaccagaactctctctctctctctctactttgtgagcacataggaagaagacttcaactgcaagccaggaagagaccccttgctaaactctgaccatgttgacatcctgatctcagatttccaacctccagaacagtggtaaaataaatccctggtgttcaaaccactcagtctatggtattttcttatggcagcttaagccaagacagttctcatcatctgttaatgtaactttccatgaagaatttattgataattacttaagttgttatctctctcagggacgtctgaattctacagtctattcatatccaggtaccaaagagtgaagtgctaatgacaggccttggaacagcattatagtcagtggggagagatggattcaagggaaatggagggtgttggcactctttgaaacagcctccatccttcaatcacactgtaggcaacagcctcttctgcccatgcctgaagatggccacggatctgccctgctctatggggaaggagcctgatcctgcaagatacaaggggattaaagtccccaaggcaggagttttccatccttgcagcctccttctggctataaaattagacttgccaattccaaaggagccatctggcaggtgggaagagtagagagtgggccctgaccctccagggacacctggcttacagacaatgaagaaagtcatctagtgagcttccacgtgcctccttcccccacagtttctgttttagcattttgggaggaaaaaggcattctggtgatgaaagtgggtcctgctcggaggagaagatggctgtcattgtagagtgctgcatccctggggaatccacagtcctctgagctctgtgagctttcctagctagggctcaagctgagcctcatgcagttccttgtccagttggcatctcccatgtgacctccactgtgtgggcactggggagacaaagatgtgcaggaatccccccacccaccctgggggaccacagcccgccgtgggagtttggctcttagacaaatcattaccgaaggtgtgagaagtcctgtgggagaaatagggaaaatgtagggctgggagaacacagaggagaaagtaaggaagccctctgggtggggcactcagagagggggtccccgaggaggtcacacttgagctgcatcttgccagataggccataggtcaccaggcagagggtagtgtgggaccagccaagggtcatgggggaggacttggaaatggacagacccggtgtccagggaggggcaaggtcctaaaggacatgtgactggactgagctgtctggactttatccacagtaggcatgggagccatagaggattttaaacaaaggcagggataccttccccagtggggaacagcatgttcttacctgaaaccttggatctcccaggaagaagcagcatgagtctgggccctcggaccatcctccttggggcctgccttgctgctggcatctgaagcccactcctgggctctatgctgtatgagctgaggcccatttttgctatagattctcacaagtctttctggaaacctgcagtgcagcttctcctatcacagctgaggtataggatatttcacctcagttgggaagggagactgtgggcccaggacagggaaaaagacccagccaccagcaggggagaagggaagagagggagggaggagggcaggaccagatacatctctgggcataggttcaaagtagaggaaagtgttagaagcctggtaaaggtcagtgttcactatctgggaccaaacaggggtgtgggcatagctccagggtaatggcccttgattctctgtttataagtaaacagagatacagataaatcttgggagtcgatttaggtttactgggatatgattggaggcgttagtgcctgttgggaccacaccctccatcctcaaggggaaggagtaaggtttctcctaaagagaatgtccttacatccttttcagtcatacctagaagagtagagtccttggttagagacctggaatgctgaaggcagttcctagacagccagaagtaacatcagtctatctccaggtcttgtcctcctgggtctcagtcacaaaagggctcttgcccatgcaggagttctctgcagtaggaatcaaagtggtgcccacaccacgaggcaggcagggagtggggatggaaaggggccagaccaccccagaggaggagagccttgtgaaccaaatgggccagttgcatgagattctctgtatttcttttcttcctattatatccctgagtttcctgcaaggtcttagctaactgtcccatggtaattactgggagaccctcaagggaaggtgactgtggggacaaaggtaagcactccagctctcactgcactacctttctagcgattcaacccccatccccacgcccgccgccgccggtgggtgactttgaaggatccaagttgtcttaatgggagatgatggtcgttttgtgattgtaacatttgggaatccaggaataggtgacctttgaaagaagaaactgttagttcatattgagaaagtagcagaacttcctactcactgcccatcaggctgggggcagggccagaactgggtcctgggttgggcagggatggaagcggggaggctgaagggtcccagccatgactgtaccaagtcagggtctcaggctctggaacaagacatttgtattcctctttctctcctaaaaatgtctatgcaaaaatacacatgtactcgcatgaatgaacccaggcaggcacgcacacaacacatgtttttaaccaaggaaacatcccccgctccgttcccaacagacagagctacaggaagggactctgacttccgaataatcttgcaaacaaatagcttgactttaactccattaccagggctaatctgtcccgactcccacctgatctgcacaagaaatgggctcattcataatggatggtgtgtgcactttgcaaagtcccccagaggtatcagttaagcagtctgcagcggcagtttccttaagcaaagggaagaggctgagacaagtctcccaggataaggtcaggcccggagggaaaatgggtacaatgactcctcccctccccctcacccattgggctgccctgtgcctttcagtgctccactcagctggctctgcaccgcgctcacagccttcagcacgtctcccctgggcagctccacagccgctccggccgggtccctccatctcgatttacaggcaggaggacagggagtctgaggaaatgattttagagggcaatagttcttctaggactgtggttctcaagcttcagggtctatcagaatccactggagggcttgacaaaactcaagctgctcccccaccccctccccaccattctagagcttctgacttagagttccaggtgggcctgagaatttcatttctagcaaagcttccaggtgcagctgctgctggtccgaggaccacactttgagaaccactggtctagctcctgacttggcaccagaatccctctgccaccttcctcacaggtaaagtcagaaattgcatgtgcttcctcttattagatgcctcttcctaccagtccccactctctcttgtgctttgttttcttgtctgtctgtccttccagaatgtaagtccctagaaaacaggatatgtcttagtctcctgtgtgttcccaggactgtaaacataccaggaaaagcttcagcaagaggtatataccactaggggaacagtggttacccacccccaggaagaagcaggatcagggtgggatgtcactactgaagaattgttactttttaatactctaatctgctatatcgtttggattttaaaaatgagaatgatccatgtgttaatgggtgattaaaaagtaatggaagaaaaccgaatttattgactaaagcatcctctctgaaggtactaactctgctgtcccacactcccacggagtctcaaatgtgttcagctaaatagcattactgccaggtgctgctgaaagagctttaaatatacagacttatttagtacttacaacagccacatgaggtgaggactatgtcttatccctgttccttatatgaggaagctgaggcccagagacgctagttagcttacccaaggccaggtgtctcatttgcagtagagttgacattcacccctcaacaggctagttctgggagttgtgatcttgacccctggtggagctgtaccacctagaagttgaggttcagcaaaagatggaatcctatttatttacacctaacccactttgctctaaagaggattcgaggggactgctatctgatttagttatccaaagcttatattgcctagaaatgttacctttaattaaaaaaaagccatcaaagcagacatgatcagtggcctctgagattttctgttcctattgttttttcaccaatatactggcaagcatgcagcagcaggtgccaaaaggagagaaaaatttatagggggaggactttaaatacagaacattctattcattaacttgatttcttttgtgcactgaaaaaaagagctgcatgattcaattttagtggaggaaacccttgaccttgctctgggaacccctgagttccctagcggcagagcttagagcgtctggcctggggaatattttgtaatcatctgaggtgctcagcccccatccagcctaaggagtgaatttctgcagggactgggaggggtggtgtctggcattgctatgtttaaacaaatcacctctggtgattgtaatgcacagtcagggttgagagccactgagaagatcccttacaattttaaagttttgatcctcactctaagatctcagttttctaatattttatgattgtatccctctcccccagcccagagtcccggccctgactttccaatggaagttgctggggtggtttggaatttaatcacctccttggaagcagagcccagctccccagggggctgcttgttcaccctgtgtgaggccagcaggtttatttacggtttctgattttatttattgccccacctcagagctgctcttctgcatacagagaactcaggctgtctgctgcctgtgctgctggggccgccataagctgggcttggatggatgtgcagctttagtccaccgagttggctgagaagctggtcgccttcctgggggtgatttttgtgatgcagcgaagccctacctgttccaaaacatctcccccaaagcttccccagcacaggggttatgaatggatgaggcaacacaggccttgcctgcgggaagttctagaaaaattctgttctcacttggagggctcaactctgcctatcttaccatttgccttgggacccacccaggagggcagcagctagatcttgccctgatgcatgtttattgccctccatggccaagggccgatgtggaggacacagccctttggaaggtgagtgcaggtggtggagatcacaaaggctgggtaggaaggagaccaccgatggtatctgatttctgtttttcatattctctgcctcagttagcatccactctctctcctcttgttccttccctctcccccaccagggtcttgccatgtagatggtacagcagtcagggtctaaacaggaaaacagaaatcaagttaatggcaggacatgacagaaggaaggtaatgcagtgacctggttataggtgttggaggggccaagagccaagtgggacagtgaagaaacttcaaaatcagcaacctcaagaagctcctgccagctcgagggctggtggcaggggagtggtgttgacagtgcctgggagccagggccacccatgagagctggaaccatgccagcctacaggtcaggagctgaggccactgccagaggagcctccccagaaaggagagcaggaaagacacctgcagcttctcccccaaaccctaaactcccccaagggaaacagaacccaacaggcatagagtctggagttgcagaggagggtgggtggttgtatgtttcgaggaagggccttgaggacaaacaggcaggagaccaataccagggaatttccagaccactgtgtactgagattgtgaagcaacttcttcaggatcccgcagcctggttagggacctggttggggacctggtttgggacctggctagggatgcagccaaggattttaccctgactgcccatcctgggtaggatctctctggctttctgtcccagccctcctctgtaggaccaagagctgctttgcagacaggtggctgaggaaaaaggtgtggtccctggctgctggaatcagtcagtgtgaagcgagggaggggttgtgggtaacagcgcctctgcttcctctccacctctttcaccctgttcccacatttcttttcatcttcttcaccttctgggaacccctcctaccatgttcttaaacctatatcttggaggtaatggccactcccgaccttttctctctgggatccagccacttgagttgctatggcagagacaatgctctgtgttcacctccccatttcctctgtctgagcacgtggcaaggttatatctcccagcctcccttgaggtgaagttaacccatccatgtgacccgttctggccaatgggctgtgggcagtggatcccctctggtccaaggcacttaaaaccaggtgtgagttctccaagttctccttttcctgctacagtaagctgaagcccactcatgttgacatgacatcagtggacagaagggatcctcaaggagaggacagctgccttggagaatcagacatcctacactggactttacatgtgcaaaaagtaaatttttattgtattaagataccaagattcagaggttaattttaaaaacacacaaacaacaacaacaacaataaaaacacatcatagcctggtattaccaaaacacagttgctatatgctataatgatttctcccagaaacagagtgagacccctcttatattcttccacaggcccctgagtggcccttgtccagtttaaggctgcaatctccatggaggcatccccaagcctggcacagtagctggcacaaaagaaaaactgagtaaatagttgttgactaaatgaacaagtgagtgaactaatgaataacccaggaccagctaagaacatcttagaatgagatcatggtttatcctggagcaccagaaggaaaacacccagtccaagagggcggaaatagaattcagggaaaccttgacagattagaaaaatgatccattcaggatgggtgaaatacaaggcaaggcttgtagaaattcaacacaagcctcatcaatccagggggaggtgaggagaaacccaacgggacccaggatcataggggactgggagtctaataacatccttagggaaggaccagcctcttccatgctgggacaggacccaggaaggaggaatcggcacatgccaggcagggtgtgatcatcccactgcacttggccttctcccggcatctaattttagctgtcacatttaagaaggatttggaagctctggagcacagccagagccaataggagaaatgatgaaaggttgaaaaaaatagaacctgtaggaaaagtccaggagaggtgggagttaaatgggtctgggagaggcagctgtatgcaaatgagcagctctttagtttgaggagggtggggaagccagaactgggggacattgatttatacagcagcaagaaaggtttaagttagactccaggaagtgaaacttgatgaaggcttctggtgaactaagtacttcccttggctgcccccctgctcaggaggccctggtagacccctcccttgtcccacaaggggccaggcatgaggatgactggaaatgtgaagtcctagagggctgtaaaggcaggaactatctgatactgtccctgggtcatatgacaagcaaggaaagagtgtgagcagggtctgtctgctctggtttctgggcctgatgcaggggctggagcagatgacttctgtgggtggggattcctcacatggcatgaggaaacagtgatgtttcaggaattggatacttttcacatttcctctaggttatctcccatatggctatatccctaggaaatgtctcacatcagttaaggcagttgatgcattctaactatgaccctgggatcagctttaggaaaggggtcgccaaggattgacggagcctaatgcatcccaggatgtcagaactaaaaggattgtggcagattatccaatccaacctcccaaccctttgcaagtgaagacactgagctctggggagctttcagaaattagaacatcagtggtgaaatcagcagcatacccaggtccctggatgtctgacccagtgttcctccaaccagctcatgtttgactctcaaagtgagagccacgaggccagggaagaggtcaggatgaacacagaaggatagaggcctggaaaggggtgatggggccagaaatggggaaggggcaggaaggaaaagagaaaagaaagctttccctctcttgggctgggtggtgagaggagccaggcaagattttctgttgttttagagagagctaagggtagagggctggtgtgggaggcagggctgctgaggggggcctctcatggggggctcctttggggtcagcactttcctagctggctggcttcatccacccaccttccctagatttccccacttcctacattctcacctgccccttccgccagttaatctctgaaaccacaggaagagtggggttctgggggcagatagaggaggtactgtgaacggggtgtgatgtcctagagatgtcacctggaaacagatgtgtataccccagaggatgcctgagccccctccaggtccctcaccaacatctcaaagcacaaaatggtatccagtgtgctgaagacctactcacggtaagggctggagcagagaggaggatcaagaggcttccaagtatgcgttccctgccggagaaagccggtctggtttccctcgctggagggcctctcgattctcaggcttccatcaatgtgtgagcaggagccttgcaccaatgtccctctcccaggtcacacacctctaggacctctgcgtccatcctcctgcctaagcatttccctgacgcacctccaagtggcgtcctcctctccacaagggagcagtctctgggcttcctccaacttttctcatgcttttaagctaagccacagcccctcactgggatctatggaagaaggaccactcctagctgtgctggggaaactgccaatgcagtgatctccccactcctctacttgttcctagagaccctcctctatcttatctagctcaccggcccacctgtcctctcctccctttcttccgtaaggatgctgcagccacccctgcacctggccgcaagagggcaccatgccctcactgccaccccagctctccagcccactcctacctctgccttccttatagtcctgccagatcgcacttggcagaaaggagccaactaggaaatcccaggataatctaagaggtttatgtcaaaaggtttacaagggaaaaggtaggtaaaaataagtgcctggcactctgccagctgctggggattcaaaggtgaataagacccctacctgcccacttcttagtctcaaagaggagacaggtaattactgtgcagtaggtgagcccaggagggtagagaaatgcagcctgctgatgtaacagccaagaggggctccctgcccccaacttcaccaggggctcagggaagattcctagaggattcctgaaaggtgagtaggaagcagcaggtgagggagacaagggcaaatcaggaggcaggaacagcaagcccgggagtgggatcagcatgagcagaggttgggaggcatgaaagatttagagtggaacatagggtaagttgactttgtcatattccaggcaccaggttctgttcctctcctttcctggtctgaggaatgcccaactgtgggagctttcagtgctaccctaagaagcctagcagagttcccaggccctcctgcagccctgccctcctccttttctctggggaggagcggagtgtccgggcttgggcgaaggtgctatcactcagtcctcatggtgttccctggatggtgacctcctgattcaggttgttattattcccattttgctgatgagaaaccaggggctcaggaagatggaggaacctgcgcaggactgcgtggcagagctaagcccctcagccagggcttctgcccccagcccctgtggcctgtgctgcttagaagggaccgtatggaaatccctctctccccatgtggtccagaaggctgacactagccatttgaagcagatttttttttaatggaggctttccaattacaaaagtaataaatactcattattttaaaaatcaaacaatatagaaattcacaatattcacaatattgaaagtaaaagtatcttataatcccacctctctctccccaaggtaactactcttaacagtttgatatgtatttttctagactttcccatgggtttgcaaatatgattgtacatttttaaaaaatgaaattatgctttgctgcaatttgctttcttcaacttaacagtcagtcttgaactgttcacatgcatgcatactgatctataaagtggggcttcttgtgattcccacttattgctgaggaagccaggcttcctcagggaaggtaagcttccccaaccacacagctcaggagggacagacttaccagcccagcctgtcaagatctggggcagccagtggggagctacacccacccactcactgctttttctcccagcagccttctcactgtcctcagctgctaggaatttttaggaatggatttctgtgtcatttctaatagatcaggaatatcctagcaagacagattgtcagagcctgttgggtggtaaatccaggctcatccctcttgtatgcagatcattccttttccccaggaaggaagctctgggtagcagctccctgggggtgggaggtgggggcggaatgaagcagcacagggccgctgacccaccagcctcctgaaatagccaaatatccgggctggtgaaggcaagtgccacgaaattcagccagtagcatcccttcacctcttgatcctcaatgtgtggtctcaggagtagcagccctggcatccctggggagctggttagaaatgcaaaatctcagcccacaggccagacccactgaatcagaatcagcattttaacaagatccctgggggagtcctatgcatagtaaagtatgagtagctggggttaggcagtattctggttcctataaagccagcccatggcttctttccagaagtttagttgatgaatttggtattagaaacttaataagagctagcagttacatgtaagtttctatgtgccaagcaacattgcaagtgtcttacttatatgaactcatttaatccttacaaggatgctatgagttgaggtattatgattatcctgcttttacagatgaagaaactgaggtgcagaaaatttgcttaatttgcctgaggtcacatgctaaccagagggtgatctggggcttaaactcaggtcctccaggatcttaaccaccacagcacactgccctgcaagtagatgcacccatctggcatggagcagttttgacaggtatctccaaggtggcatttctaagtagagcttgccaacacatcttgcttttctcccccaccgtcttcccccttcctaaagactggtcaccttggagaagctgccagagctcaacaggaacctcgccactgcttttgtggtgatgccaaggccaagaagtaatagcagcttattatatctgcaaaaccctttatcatctattatgtctctttattctccaagaaccaagtgagatgaggcaggtgttactatccccaccggaagaacaggaaaggagcctagagacacccggtgacttaatcaaggtcatgcagaatggaggctagtagccaggcctcctgacttctggagcatgttcctttcatctctctaggatgccctcttttctggaagactctatagcagtcctctccaccctgaaggcagccagcatctcctctcagtgcttctgcagctctgcaggggaaactgggtccctgatgaagcttcagcctctctcccaggctgcctcctgcctgaagcaattataaatcacggcattttcctttcattcagacctgatgtttaattcatcgctattctggctgctttaatgcagagaacatttattcagtggaatagctttgttttgcttccaaagctttattctcctgtttagaataccattgctattgcagagggggcttcctattagccagttcagagaccctccccctcctgctccccaagagtggcccagccctgccatctatgtggacccacccccgggctgagagtgagcttcacctcctgagaaggaggagtccaggcttttctgtccttggtctaagcacctgacaatttcaatttgctcaccacctgcctttctcccagccacgtgcctggtgtgatgagctgcctggctcctagatagggctgctactgcccaggacacaagaagttggaagggcctggagtggggtgggggtagcacagctgtcgtacttccttcttggagctcctgccttgtggcattgaccacatcttcaacttcttgcagtctagataagtctagaaccttggactccaatccctgaatgctgcaccacctcctgacgataaacctcctgggtgatcatttccattgtcctggatctcagactgctaagtgtctacaaaatacccattcctcctctattttgtatcaacaaaaccctcaactgagcaccaggcttgaaacccagtttacatataaaactacattacccagcctctcttgtagctaggtgtgttcatatgactaggttctagccactgacagctaagtggaagtgttgtgtgagacttctgtgaagccttcctaaacaagagaaggcacaactttcttaatttattttctgttacttattagctgaaatgtagatttaaagactggaactctagcagccattttgaaccatgaggtggaagccacatactgggtctaggagaggcacaagacagaagaagccaggtccctgacaccaaggattcatctttctgagtggttggctcatctctgaatttcttttacaatagaaataagcttctatcttgttttagctacttttgttgtgtgtctttcagatataggtagccaaattagttcctaactgatgaagacacagccatttactgctttcttgatctccatgatggaagctgcttgtttgccaagctcactgcctgaaccagtttctgatacaagatttaagaatgtagcacctaatagaaatgaaggacagaagagctgcagaggagggaagtgcagtctaggacacagagtgaagaatgagtggacttaattcaacctgcttgcagtacagatgggaagactgcgttttggaaataattagtcattagcccatagccccagagctaataagtggcaaattcaggattcgataccagaatttttttactccaaccaccactccattaccacttagagagagcttgggacaacatgagggaagacgtgccacatcttccaatcttgccatggtctggcgctctctgtgagaattggagcttgtccccacagagctctgttcctttctccttctcttgtgaggtgcatgtatttataaagcaacagacttcttattatcatacaaagcagatgcaagggaaggaatcagctctttgtggggcaaagctacctagtaagaggtgagcttcctctaccccatctcaggctgcaggagggtggcttccatttttccataccctgcttcccaccctgtagggagagagcaatggttaagctcaggctttgaaaccaggctgctccggattgaatcctaaccccatcactgatggactctgtggccttgcccccccatgcctcagtttcctcaccgataaaagaggtgataattatacccaccttatagggttgctgcgaagattgaaataataagggcatggggtgttagctattactattttccagaattactatcttctagatcgagatccccttgcagtagatggttgacattttaaagttttgcttgtttttcatgttataatatggtcataagttccttgatagcagggagcatattagtctttgttcctcaatacttaagactggtacctagcacatagtagatacccaataagaacgtgctgaatagagccagacagagctgaattctttcctcttctgaggagcatcttccattctctctcccatctccctctctcccttcttccctctctttgtctgacactctctctgtctgtctttccctccaccacctctctctctaattattatactccctcttactctttctttcaaccattttccccactctcttcggggcttcacactgacatgtgcgcccctttccctggctgccccatctccagagcacgctcctattctgctccaaatttgcctccaggctcagtcctcctgggaggcctcccatggctcagctttgaggacactgaagcatcagggctggatgggagcttcactacctgttctattccagtctgctcacttttcagatgaagatgccaaggtccaaagtaccaagaaggctgcttcacggtcatgtggccaacttgtcccagagctaggattagaacctgggctttcccactcttggcccaatgctctttacattacggcattcacagaggcagtggcagaaacatagtaggagaccactgaatgcttgttagataaatgaatgaatgaatgaatgaatgctattggaagaggagagctactcagacaacactacttgtttttctgcagctccttttgacctgctctacccctgccccaccctccacatgcctggggtccccagaggaggtctttggcactgttagtcttgcctgtgacccttccaccacccctggggagtcagcggcctttctccctcctctcactcctgtgtgcataaaggccatttttattgttctctgtggaaatatctttagaggaccgagggcattctctgagaacaaagcctcttcctggggagtgttggccagggctcttgtcattgcggcttgctgtctgctcagagccttgtgttttgacaagaacaaagtgattccgattggaaccctgtagcttgttgctggctctgcctgttttcctgcagatgtgtagccccattctggcctcctctcctctcaaggaaaggggagttgtcttcaactgatggcccctccccaaagcctagccccctccttctccatgcctttctcctgtatcccacctggcacctcccaaacactatctgccgctgcagttccttgttgaactgttctggttttaattccattccctgcaattggagcctgaataatgagttatttcacaggaagattgatctgggtattagggcatcatttagtttgccattacaacagccaattttggttacatgctcagctgtgaaggggaaatgggccagcctgctggagctttctaaagcatggagctggtgagtagggggatggggtactgggctgaggggcagaggtggcagatgggcaggaggaggggttctggcttgcttcagcaaaaatgtctttatgctcacaacatgacactgtgaaagaaattgtaaggattgaaaatggacattacccttcctcaaagggacaagaagagcagagttttcaggctgtagatgccaggagtggaaaggtctctcttaaataactgagtgagtgagccccaaattaaagagcattccagactcaccaatatttcaggatgacaaaatagtggtgcatccttactcgccactcccataccagacccagctgcagaaatttcagtggctcccccatttatttccctcatagcacttctcacaacccaacacttccctttccatttactttaagtgaaatctcgcctatctcttcctcaactagattgaaaactacatgagggcaagaaccatgtctatgctgctcatctgtttccccagggcctgagacagtgcctggcacttcatgacactcaatagacattcgttgaatgaagtgaatgagcatcagagggcactggtttcatggatctgggtgtgggggacaaggcataccatgcgcagtggtctctgactcccctgcacacgcacggtggtctctgactcccctcatgctcacggtggtctctgactcctctgcatgtgcacagtggtctctgactcccccgcacgtgcacggtggtctctgactccgctgcgccccttttgagcatcttgggaaagcagtagaccctctccccgggaggaagtgtacacacatctgcaatgcggtattttgcaaataaattctaatagttaacagaaacttctgcagaagctgaagttttctttagaagattggttaagaactcctagtatagaactacacagggaacattgaatttggagtcagtagacttgaagtcttccctgtggagaagtcactgaacatttctgaagttgttttttcttgcctgtttcacaaacatcccatacaatgtttgtgaaaatgccttgttatctgccagttgtaattaatagcgtcattggccatttcaagcctgtctatgacaaaatgagttttctaaaaagaaactaaggaagggcatcctatggggaggcacagctttgtaatcagtcttggccctagccacagaggggccatcccctgccaaccccccaccccccacaacaaaggccctacaatattccaactatctgcaagctttaagcctggcctgttagagaaataatcagatgacctggtcatgatttgcctgaagcatttgggtaacagtagcaacagaagttgaacagactttagctacattaccaaagctattaaagttaaaaaccactaaacaaccacagcttgcttccaatcatccaccccacaggcattcagaacaaaaccaacaagaatgtgttagaataaaatggacactgaatcttattaatgtcttgagtttggagctttaaaagcaaacccctggcactgaggacatcaaccagtaggcattgttgagcagcacggggtccttccaggagcatccttacacccccaccctagacacctctaggtcctaggctaattttcaggatccatgatgagaaggcatttgtgaacacagatgtgacttgggggatagtgggtggggaatacctctggcatgggaggtcagtgagtcagagctgaagaccctggggcaggcagagcaaccagaaggatgggggcaccaagtgggagctaagatatgggaccaagggaagccctacatgtatgagcaagggcattgactgtgagtcagtcttgggggcagaagtagccaacagcttcagagtctgccaacagccctccttctgcattggcaggctctacaaacagagggaggttctgcaaacagcgcaagtgcattaagtagcttcagatcctctaaccagcagcttgctctatacacagagaacggtgcagtcttcagggatctggtgagcagacggctacaggatttgtaccccaggattaaagccagaaaccaaaagaccatctgccggtacccacaggagggaggatgcaggtcattttcatgtgcagtgacatcgtaggtaggttcattttctcacaagacttgaggccttgacacctctgtgtggctcttgctgccctcccctgagaggatcagagagtgggcaagttcctgattccttcctgcagcacagcataacaagcttctcattgggaatcgctgggtgtctggctgtggtgggtgtggaccatgcattattaagagagaggctaggcgccctgcagaaggctgaagccaggggccattgcattgtgtgacatggctcagcctttccagtttacagtccatttggacatccattatttatggcagccgagtggctgtgaacaagctgagactcaattaaggtaacgtcccccacacagaagccatggttaatgctgagaagttattccaactcccaccttaccatcacagagctggagacacaaagagaccaagaagtggaattagagaaacgcagagatggaggcagagaacagagaaatgaaaagagaggcagacacccccatccccccaccacaacccctgcacacaaagccagaggcttttcccatgggccatcttagcactctcctggctctgctggagtcccctgcaccctgtcttagaggagaagagccctgtgttctggctcttggaggcccgaaattgattatcccagtctccactgtccccatctcttccttccctcttagtgtccatcctgtgctgtgcttgaggacatggaagagattggatatatcctcagaggactgtggatggtgactgcaaggggaactgggtgccagagacaagctgctggcagttctagagtccatggagctggaggacaagagagggaggcgagaggtgtgaccaggcaggagctctgggaaaggcattgctggggagggctggagatgaggttttggtgtggaaatggagaggacagtaggtggcagagaagtggctgagaaggggaaagacaccggcagagagggaagaaactaggggaagaagggtccaggatgctgacatgggataaatgcaggggacgtgggagagagggaggtgaaggaagagagagacagaagaggggaacggtggaggtgggggtggcaagggtagagagaggcagagtgtttcagagctggcagagcacatgaggacaggcatggtgcttaggtgggaggcccttggggagactgactgacagtggctgtctgagcatcgcggagaatggcaaccgagtttcctgagtgtcctgggccctgagtcctagattcctgtgttggggcagtctgctggccatctgctctgttccctgctcaggaggctggccaggtgcaggagaacctgggagggttgctctgcaggcagcaggagtggctgtgtccactgcagggtccagacctgactcaggacgggaagagcaggcggcagacctgactgtcttctgtccctctcgtggctgcatctctgccatgctcacttctcctccttttcatttccctactggaaccctgcaggtggcctggggcagggttctgctgagttctttcttgttgatgataagtcatgtccatctaccacctcctgctctgcccactcttccttctaattgagatacagtttcatgattgttattgttattattattttcatcatctttattaccgttaccttttagaagcttgtaagctccctgagggcaggagtcttctctcatttacctctgtgtgtgcacacatatacaaccacactaactcacaaacaccccttagctattgacaaagaccccatgcttacttcagggagtgctataccagtcagggtgtttgcaaatctactctggctagcttaagcagaaaatgaagatattaaatctttgtgggagacagactcagactttgggagcagctgcccagtcaggaataacgcccaaaccaaccccagcctcttctcctacagacctcagggctgccatggtctggcacaattctcagagctctcactgctgatacagggtcctggatcctggtgcctccatctctgctgcctccaaagccagatgcctctgcccctgcctttaccaggaaatagatactgcatggcattggccactgcttgcctgtctcaggctgaagcctctactggtgggtcccattggcagactccatgtccatgccctcgtcacagctacaagagacactgggaaagatgagtctctggtttctcactccaagaggcaggactcagagtggccagaaagcttgctggtgttctctaggcagtgaggggcacctgcctgtaggactgcattaatggtggtggatgtggaggtgtctatatcactggcagctgccatggagggcatgttgtctcccttgtggggagctgggggcttctgtatccaggcagggtgaaggcaggcattgaggatgaggtggctgaatccaggcacagcagagccccgttggtaagcaggtgagatatacccttggcattttcccaccttcagcccaccttttgccagggaactgtgcagaactgctggaggagggctaacggagctggggggacagcaggaacgccctttccaggtgtgtctgctgattaaaaagggatgcaaagtgaggaaatgaaattggatctgaaggcgtgaggcagggcagcctggctgtgcagatgttccgacccacctgctcaccgagggtatttctgttcacccgctgcctgtgttcccatcctgccaaggccataaagacaaaaacacttcctagaagtgaaaaatactcgtgctgaaatttcaagcacctgttggggaatgggggtttgagggtaaggcgacccccttgccttgtcctgggctgggctgtcagtcatttgttccaccccagcatcacagaggtggggcccacctcccccgcaccaccacccacagccccctactctagacccttccccacacatgcccaggcaacctcctggtgagaattgcacccgaattcaattatctttgtggcttttggctaaagggatccacacacagcaggcaggttcacgggcctaatcgggcctgatgcatatctaaccagacagggagtgtgtgtctggatttgtcgcctgacaggtacagatgtcggaggctctcatccatgagatggaatcactcttagagattgagaggcttaggcggtgtcagtcagagacgggccacacatctcaagccgggacagaggctgccagcaaagccctcttcaacccactggagtcagcaggcccagtgcttcataaaccaagttatgagagcagagctgagaatttctaaggagcctcctttttaaagcctttcacttcacctgctctccaacagctggtgagtctttccagggcagcacaggtaaagggatgaacaaagtctcagaaatagagaacctgggttgaaaccacctccactatctactagctgaagggccttgggcaagtcacttacctgctcctggtcccacgtaatgcttgtcatctgtgggcttgctgtaagcagtgaatgggattccctaggcagccgctccgtctctcatgttcctgtagcacttcattcctccctattaggtagaaactgtctagcactggacatattatttaacctctctgagactcatttagtgcctgtctacaatgcagaactgtgacagtgcctacttggtcgggctgtcaagagggttaatacctgcaaagcctcctgacagcctggtgcatggcgagccctcaggaaatggtagtggtggtttttggtgctggtggtggtggtggggcggatactccagcatccccctttttgggcagaaagtttcctgcttgcttgtcttgcttcccttgccagccagggaatgggtcaggggcagggtctctatccagcctgcatcctggcaaggagccaacattccataaatctatgtttgataaattagtgaaagagacgataccatgcaaagataacacaccaccgcaatgctgcatagtgactctgggtatctgcaagacccctgtggcctctcgtccactgtgaggacttgggcaagcgactgcacctctctgagcccagttttcccatctgtgatgtgaagatatatgatattgagatatagtagaaatatatatatatatacaggtcttatccctagtttcttggcatgcagctcctaaaacccatgggatcttcagaagtgatatgtctttttgtatgataatgaaatgactggtgtctgggggctcctggatagcctggagattgggggactggttgccaggggaaccaaccacatgatcagagggttgaaatgttcagcctcactccccagaaggggagaagggctggagattgatttaatcaccaatggccaatgaggtgatcaatcatgcccacataatggagcaaaacacccaaaaagatgaggtttggagagcttccaggttgtgaacacatcgaggtgctgggagcatgtgtgccccaccccacccacataccttgccctgtgcatctcttccttctggctgttcctgagttgtgtccttttataataaactggtggtgaaataagtaagctgctttcctgagttctgtgagctgttctagcaaatcactgaacatgaggagagggtctcaggaacctctgatttatagccatttggtcagaagcacagatggcagcctggacttgtgattggagtctggagtgggggcagtcttgtgggactgagccttttaagctgtgaagtctgcactaactctaggaagttagcgtcagaatggagttaaattgcaggacaccaaatcattgttcactgaaaattagagaattacttggtgtggtgaaaaacactccctacatatttggtggccagaagtattggtgcagttggtgttgagaaagaaagagtttgtttttcttattcaggataatagccccacctcggagaatgggtttagatgatgtgtccgaatcatccagtacaattctgggcttatggtggatgcttaaaaagtggtggctggcagctgtcccatggaagccagcctggaaaactggtgaccttggccaagaatctcccacctctccttgcctaggtcccacctccccttcctgctgccctgctgtagtccaaaatcaccatcgcccacccccaacccccgagagcctcagtcagctagagtcctgtgagggtggctgtaaataaattagttcccacgaggtgtgattcgtagggtctacctttcctaggaccacttgcacgtataagaaagaagtttggagatggcattattcgcaagttagcaagctagaaccatagggagtgatgaggactggaaagaattcgagaacagtgtattcggaattgttaaacagtacgttggcaaaacaaaacatttggttatgggtccccagtttgccacctccaagacaaaagtgggctggaagggtgaaactctgagctgagggttaatcagaaccagggtagccacacttccctttcagataattccagggcggctctgagtctctaaaacctgtgagaaatgccacagctgggagactttcctttcctcattgattcaaggaagtccaagagccagggatggtgcccctcacactgccaggaaggcctgacactacccctccccatggcgcaagctgaggccaatccgctccttatttagaaagagctgggacttaaatgtcagtggatgatacgggagcagcatgacaattaccagcttaaactgaaataaaggaaagaaggattaaaaaacacccagcacccatcaagccaggccagaagaggagagcaaagccctctgtttctacgttaactcttcatctgccaggcgcaggtcagaagggtgactggggaggaagctggggaggagaggttgggtggggggctgaaggaaggtcagaggtggtgctgacttgggctcccagactctcaagaagggggcccagaaggcaccctgctccttttggcagtacactcagtggttggacctgtggctccaaactaggcagactgagttcaaatcccagctcctccactaactagctctgtgatggctggcaacttcctcaacctctctgagtttcagtttcctcatttagaccagtgggatgatgataattcctcttaagattaaatggggtagtgcctgtttgtcactgggcaggcagcaatactcagcaaatgatgcctctgccaattggatgcagtcaggagctaagagccaggtacagcacagttcacgcctaattccattacccccagtcattgagcagcagacagtctcttttattttaatctttctgtagggggaatgtgtggtgctcagatgtaggtccggcaggaacttggcacctttgcagcagcctcagcctctcctttctcttgggtgcagggctcagctgggcaggcatgccaggaccaagatcagggccctcacctcagagcccctctgggttgctgcagcatctcctcttttcagggtgaactgctctgggggctgggagatagtggagatgcaccccacagggccaaggcagcctgggcactttccccaggaaattcttgacactctgcacttttccagctggcctcctttaaaggggctgctcatctgtcctcccctgcatgtactagaattggccccacaggctgacccagctggaccccaggctctaggtgagctgtggcctggatttgtttacccatctccttcaactatctgcaggggagcagcccttggtttctgcatgagggcagatctaggtcacctttgaaaggacctgctgggatttctgcaatgctcccctccagcgtccacagcgggtcactgaagcccagctgatggtctgtccctgcctaccccgagagcctctgaccctgaagcttgcagtttttcctcagccacatcacatcctcatcacagacaccagtgtcagagtcttccttggcctctgaatcaggcccaggcccctcctttgttcagcccagcatccacctgtcccagccgtgtcctatatgtcaatcagcattctgtgtagaaagtagaaacacccaaagtatccagcagaaagagatttaataagggaaatagcgacttacagagggatcagagggcctagacaaaagaagtttaggaccacccaccgctaggcttttggcttaaggttgcatccccacagctgtgattctgagaccaggagacagctgctgcccctgcaaggaaggaccactagtgtggctccagctgccccgaattcaggaagctggtgacaagaccatggatataccagttgctgcaaatcctcacattggcaggagcccgtggaccatccagcacactgcagtggagcacctctgcctctctgccactgtccagagctcatggaaatgcctcttcttggcaaaactgaaactgcagccagatccaaacagcaagaaactctgggaaatgtcacttttgtcctgctagaccctgtaatacagagggaacataaagggtatgaaacaatgctaagtgctggtagacaatacccagcacagcccagaacccactcagaccccagctggcccgcagtcctggcctgctgtagccccacccaagtctatggctggcgctgactcctgcctctgctgcatcgccccacacagcctctgtcccttcgcccgatggaggaccagccccctccattccccagcccacacccagctccttcagctgaggtcctcctaaccccagcatatagttcccaggccttcctggggcttttctgggatggaaccaatccaaaggctggctccactggaggctggtttgggactcagatgcctgtgctctagctgtaaacacagaatgtctctgagccacattcccagagcacattcacctaggggtcttgtccagctgtgaggttctgagatttctaagtgtctttctttataagcagagtggacatggacacacacacacacacacacacacacacacacacacacacacacacagtcctcagggagctgcagctttgctgagtcaacccagagtcactgtccaactctcctctggaaacgtgggcagagataggtgctgagggaggacgggtgactgaagcagaaggcaggaaaggccaggagctgcccgcctgcccagcgcatccccaaccactgacttctggcttgagtgggctgggaaaacccgcagagggcaggcttggggaggacagaggaggctggggcgagagacgtggtaagggcagaagtgaagcactcaggccacacgagaggaaaagccactgtctgtgctgagctggacctaggggctcagaccccagcctctctgctgtcccctccttagcactgcctcaactagacctctcccaaagcaaagctatagccatgccgatgaccttgagctgcacattcagcttaatccacaacagtgtcagtgtgaaggccttgctgtcagtccaggatatttataacctgcttgccaggtcccactaactggcagccgccaggaaactaggccacaggagccacagaggaggcaagccctccccgcatcccaacgccagcctcagatggctcctccgtggctgttggcacccgcccggctgtgtgcctcctccccatgtccctgctccctgctggcgatcaaaacccaccagagttcccaatgcctgggggcatgtccacaggcctgagtacaatgtccatggcttccacttaccattgttttccctgcctgttccctgtggtggtgtggtgtggtcatgaaggttccgcctgcctggggtcaggtgcaggttccactgttctctgtgttgacctcgataatcttgtgtgacttttctgtgtctcagttttcttatctgtaaaatggaattaataatgaagactgcatgaataaaaggctcagaacggtgcctgacacataataagggctcagtgtttgctagcttatctagaaaggtctatcagatagcagcagaagctccagggccaggctgttcaggttcaaatcctggtttggccactcactggctatgtgaccttgtgcccattaattatggtttggatgtttgccccctccatatctcatgtcaaaatgtgatccccagtgttggcggtggggcctggtgggaggtgtttggatcatggggacggatctctcatgaatggcctggtgcccttcttgtggtaatgagtgagttctcgctctgagtgcatgcgagatctggttgtttaaaagtgtgtgggacctcccccttctctctctcgccccctccctcaccatgtgtcgcacctgttcctgcttcatcttccaccaagagtaaaagctccctgaggcctcaccaggagcagatactgggtcgtgcttcctgtgtagcctgcagaaccgtgagcagattaaacttttttttttttaataaattactcagtctcaggtattccttcttagcaacacaaaaaccatgtaaaattggaaatgataatagtatctacctgtggaattgtaaggattaaataagctaatctgtaaagctctgagaatggtgcctggcgcacagtagatggtcaattagtattagctctgataatgataatgattaccatcatcatcatcatcatcatcatcatttattctggaaagattttctcccagccaggctgccctctcttcttcctgcctccacacttgagctgacgcaaacattctccttacacacactctctcttcttccctcccaattcaaatgttgcatttctttcaagcctcacctcctccatgcagccttccttgaccattttggtgagctttgcactgtctgccttacccaaaccaccttagacctgatcccccacatgattcccttgagtaaacttagactccagaccctgaaggcagaggctctgccaagcccacttctccttcctgccttatgctgggccaacagcggtgaggtcaaagatgtcctggatcagatgtgtccttgctgagtgtccagggccctctgctctaggcaggggtctgattcctgggatgagggtgcagtgtgacctggtcctcaatagacagctgtgtgtatgggcgcgcacacacacacacacacacacacacacacttgcaccctgtaaagtaaaacctagttgtttccccagaaataatcccacattctggccactaacaaccaaaatgcattttttcccaagcccagtcattttctggattttctcagtttgagagaggaccaggcctgtatgctgtgtcctaggggtggaccggaaacctttccccaccagaaaagggcaggcaggaaaatgtcttcctcggacacccaggcacagcaaagcccagggacacagggctcaacacgggggagggtgggggaggccaaggatctggctcaaacaccacagtcctttccttgaggaagaaagcaccaccctagtgtcactgtgttccctctgttgaaggcctgacaaacagcaggtcagcccagcaggtcagtggttctgacctggcactctcagcctcagctagtcagaggcttgctgacactaaccccctcctcccctcctcccctcctccccacaggcctgtcactgcggagagctctcctccagcctcctccactgactccccagcaacttcctctcctctcctctcgggagtggccaggatcaacgttgctcagcccacaggggctgcctttggtgggagctcccctttttcctgtgtgctgggggaaggggcaggggataagaaaggggctcagcagggttggggaggggcccttcttctgtactcattgtcccctctgggggttgagggcggttacaaaatggatgaggatgggaagaggccctcctgctgaggcccctgtgcttggccctcaggccgtccccttacccatctcccctgctctagtctaagagcacctaagaaagagactcactctagctctcatgacccacaactgaaaattaatcccctccacgtcctttctaagttatcccagagaataatgccatgtcaaagggacatttgtctaatggaaggagcccaggccaggggagaggggtatgggggagagaagccttaaaaaatccagccaagcatctgtggtttgtgctccatgtaaagtgaaatctgggtatttcttccactaaacagcatgggaataagtgtagtgatactagctggcatttacacagcacactacagttacaagatactacaagatccttgccacaccctctcagttttttactcttctgcattgcaatagagcaagggaaggccattgaaccccctttgacgtggaaggaaacagagcctcagagcagctaggaaggggggatcagaggctgttggtgtcccacccagatgtcctttaccagctggggactcactccaagctgctacagtgttggctgctaatagctcataactgtacccttctcctccacattgccttagccagcaggagccacttccctgggagacgctttggaggttaagccctctaccatagcccctcccctgggaatagcctttagctaaggtctgactgctgtagggacagaaaagccaccctcttgtcttcaggtataacaaactccatgtgccgtacacgccccaaagcccctgtgggtttgggccctgctaggcctcccatgaattggcatctttgcctggacccttctgctgctccatcatgccccacaatccctcccagcttctcctgcaagcactcactcaacaaaccacacgctggaatctcctctcaaaccctgcttctagggaaccagacagagggctagtacacagggcttcagatcctgaatcccgatgttcctgagacaatctggttcccaggcatcctgtcggggtctgttgtggtgagaaccttgctttcttccaggacctcagctccctccctctcctcctcccagggaagaagctggttcttaagactttgactgtgaactgagggatgaagctgcccagagccccggcacctcccacaccccgctgaaagctccctctctccccctcccaccccggctgtggcagccaacaccatgactcaggccccatccccacagccctccacaggcccccagattgctacccagtgccctggcatgttaagcagtacagatggcaattaactgcgtgacaggaaaatatcccaagactaattatttcagggacaagaccggggaccattaataagtgatgaaggaatctttccagaggctccttggctggctcctgcaccagcctgcagaaggctggagatggaaggggacccttccccacgcagagctcagtggtgtgagtgggtgggtggtgagacaggtggcagtgcctttccaggggaagtcaagccgctcttcccagcagttaaatcgacagctgttaagggtgcagtcctcatctttcagacaggcagaaagcaaacaacagtggttccctggatcttctctgatgaataattgattgtagaatgcaatctcatgaatgaattccgggagaatccccagtcacccccttctacattctcacatctgcctccccttccctggctcaatccaagtggcaggcacaatttccattttcctgaaacgaatctgtttcctctgtgcctgcttctaacgtggcccccgggacaactcccacaaggagcagcagtcagaggccaggaacaaagggtggcgtgcccagatggagggctgaaccacaccgggtcagccctgtgcttggacagtgtctcactccagcagcatatcacagcaaggccgggagaggagaaaagcatcgtgcattcataaaccctttcatgtgccagagtgaatgcaaatgcacacactctcacattcacatgtacacactgacacacacccactctcgtacccacactgacacacacacatgcacagacacattcaacacacacacactgacacactcactctcacacatacacacagacacactcttgcatacacactggcacactcacacatgcacactgacacacttacacacatatgcactgacacacacatacacactcatacacatgacacactgacaattgctcttgcatacacatgcacactgatacatatgcactgacacactctcacatacccagacacacacacacgcccacacacattgatgcacacccacacatacactgacacacatgtaaagtgacatacatatatacacactgacacacacactgacaaactcctacactgacacacaaatattcactgacacacacagatacacacattcacttacatacactgacacactaacacaaacacatgcacattgacacacgtgcactgacacacacatacacactcacatagtgacacacatacacgctgatacacaaatatgcactgacacatgctcacattcacatagcctcacacatacacatacactgatacatacacactgacacacaccacacaactgacacattctttctcacacaccctctcacactcagatgcacacactgacacacacaggcacacaaacacacactgacacacatatgcatatgcactgacacatgctgacacacacacatacacactgacacacacacacacacccatggatacacactcccacacatacatgcatactgacacactctcattctctctcacacacattcacatacactctcacaatgaccatacactcacactcacacattctcacacacacactctcacacttacacacatgtacacactgacacacaagccctttctctctcacacacacatactcacacccagttgaacagacaggggcttccatactttaagagcctaaataggttgggcgcggtggctcactcctgtaatcccagcactttgagaggccgaggtgggtgaatcatgaggtcaagagatcgagaccgtcttagccaacatggtgaaaccctgtctctactaaaaatacaaaaattagctgggggtggtggtttgcacctatagtcccagctactcgggaggctaaggcaggagaatcgcttgaacccgggaggcggaggttgtagtgagctgagatcgcgccactgcactccagcctggatgatagagcgagactccatctcaaaaaaattaaaaaaaaaaaaagagcctaaacatgaaggagatatttatgggggaagagatatttgcttcgcaaaaggatttgcaacagggcttctttcagtaataagaaaccaaagtgcattgaaaatggaatttgatttacaaaaatgtgatttatctgcaaattttcagaagcccatgccttgtagggtatggatgtgtgcttgcaaatatgcagaacttgtcagtgcctctctccatgtagttggggagaggggcagggatgtcagatggaaatcctcgccaagtctgctgactacacactcaagggtctgatggcaatctagcttggatggccacaaataccatctccttccgcacctccagcttgcaaaggggaaactgaacactttatcctcaaggctaccacgatccaaaaattcaaggtgtattgtcctcaaaaggtcctcatctccaaattctttccttttatcccctaactcactaaccagctcagcctccaatggatgttttgagtggggttaactaggaaagatcttatcaattatctcagctgacttcttcattgatgactgatgaaaaaaatgaggcaggagcctgccccaaaccagcacctactagaccctgtgccgtccagccttcatcctcaccaggcatccccatatagttgtacaaggccaaagccaagagaaaaggctctgggcagcacagtcccactgtcctgtctcttccagccccatgcctccctccctctccctgcttcactccccttctttccctgctggaagtgaacagatgagtcatttgaactttagcttcctagactgctcttctggatgagtttggaactcactctttttggttaaggacaccatccactaattaacacccccaacccttaggagacaactcctgtgctggacactaaactagggtctcaaaggattgtcttggtaacgccttaaaggaacggacacctagggacttgaagacacaccagggagtaaaattcaggtctctgataatttccagaacttgttccagcagacaaacggactcttcttcaaatgtaagctcctttcttgtaataacaagaaggctgatcaaaatagcaaatacttatttaaagaaaaccacagcagatgtatatgccagctattgtgctaagccctttacatatgtgaacacattccatcatcgccataatgctctctaaaggaagtactatcattacccctcagaggcccagagaggttcggtaactccctcaaggtcacacagctagtaagtgacacaggagggaattgagttctgactccctgagccctgcagacatctctatttctgacctcagatcctaccaatcttcccccaccacccccaccctcttctctccagctacaaacacaccaagcccattctccacaaggcttctgactttgctgtttcctctgcccggaaggctccacctccagctcatcctgtctcctcagtggggccttgcctgacaatcccatctaaagtagcgactgtggtcacccccaccctcacctacccttcatttactaggcatctatctgctgtaattccatcagcattcctcactacctcaaatgatcttatctgttggtttactgattccaccacaacgaaaactgcaatgtgtgcagcgattcttccccctccttcactactgtgcactttcatctataacaccttggcttggcacaaagtgggcatgcaataaagactgatcaaggagtgctctattcacaaaccaacatgcacacacactcacatgcacacacactgcacgctggcgtgtgcatgggaatgcattcacattagaccacaggcagatgtcaagtcagtgatacagtcctctgcagtgtaacaccgatagaagtggtgaggccagactgacataaatgggctttctagcagccgatgctaagaaacagaattcctctgaggacagatccataattacctggcctggaagactgcaaacagaaaatagagcctctgtgtaggagccccagcatctccaccacctggtccaggccttttgtgttggttgcctggagaaatggaagatgattaaaaggtgtgagaaactggccccttcagagtccttggaaggggagggcgctagaccagttgctctagttactgaattgagcttgctaaatatagctgggtcacacatggggcactgaggaggcaggtctgaaatcagatggggtggagggagcttcccagttccctgccccatgccttataccaccaccccaggcccagtttgtagtgagggggtgcccttgacatggaggtggagaaagagggagaagcagatgcctaagcttatggttgttctgatccagtgcctgcccagagctgggcattccattctgaatggcagatatctgaggtcaaggtacagccaaactctagcagataggacacttgttctatgatactcaggcttgatcaatttcaatgctgctcaaagccttcgtgtgtgcatttgtgagtgtggttcatacagtaggaggggcaagaaggtcaatatgtaaatatgatatctttatagagcagaagcatgtgggtgttggtgagagcaaaactctggagctgtcactagtggcatagagctggatggggactacctctgcagcccagcagattcccaaagctcctccttccacagaagaagattcctagaatcatgtagtaggtggaaagggctgagaaaagctctccatagcagagggcctgtggagcccaagccctctgagacatttggcaagccagggtgcatgcctctggaatcaccacactgcaaggtgcccaacatgcccctcccccttgtcctcttgggcaatcccagcctttggagctcttggttccaaaagctcttccctagccccaggtgatgttcccctggactcttagccagaaagccttggaatggtcctgagagcacccactgtggtggtctgagattctccttctcagctcatgaataaccatcctacccaggccttctaccagcccagagaccttgtctgtaaaatgggaactacaatgacctcttcagaggttattctgagggtgaaatgagaaatggcagtaaaacgtgtacaagtccagtagcaaagatggcattagaatgtttgctatattttctttctctcttctctttgtgtctctttggattttgtatttcctacaggaaggagatgtggccaaactgtgatgttgcttcctacctccttaaactaccctaagaagcttccttctccacccctacctctagtgaaagccctcaccacttcccatgttgttgcatatggcaggatttccttctttgctaaggctgaattctactccgttacatgtatattccacttttctttaaccgctccttcgttaatgaacaccaaggttgcctccacatcttggctgttgtggataatgcaatcaacatggaagtgcatgtctgagaacctgattttaattcttttggatgaatacccaggagtaggattgctggatttcacttatatggagtatctaaaatagtcaaactcccagaagcagagagtggaatggtggttgccagggactgggaggagggggagatggagagttgttattcaataggtacacagtttcagtcatgcaaggtgaatacattctagaaatctgctgtacaatgttgttgtacattgttgtagttaacaatagcttattgtacacttaaaaacttgttaagggaggagatctcaagtgaagtgttctcaatacaataaaaaaatcatcaaaatcacaatgccccattctgctggtttctgtgagggaggctgattgatcttgctgcctagttggggacagtaagccgggctatacctgacactatattgcatctgtgttgctcttcctgctgctgcctttgttccagatgtctcctgactttcttgttctttcacaagaatcaaagcctgtgattattggtcaagcaagaatacagggcaggagaccacctcacccatccaaagaaatgcatgcagaaaagccatgttttctaattgtggggagccaccacctgaccctacccaggctccctccttcctgtcttataccatctgagccccaggtacctgtagagggatctgctcataggacctggggcctaagtttctgcccctccaccaccagtgtctagtctccaacttcagtggagagggagagctagggcacctagagaaaagccccatcgctgcctcctttctcagggtgaggttctcatgactgctcactgggaaggactgggatgtgagctggaatcccagtatgaggagaaagtgtgcccccatactccttgctccttcttttcctttccttcccttcctgaagctcagctgtgaccctccatttacgtccatggggggaagctctttacctgggcaggccccctgtttctcagccaagtgtcccagtactgccagccctgtcttgaagttgaccccagaacatcttctcccatggttcaaagggcctgggcagccactcttgttccaacagagccacccttgcatcagggtggggagaacagggttcttgaatgaaggttttatattgtatttcttactgcttgaagttgtacttgggggtgaagtggattaagacaagagtttattgttactttccactacaaccaggtggactgtacctgagagagaagcgggatgagaataaaagggagggactcccatctcccctagaggagcgatggcctcctgttaccctgcaggctccctagagcagagctgtgatttgctgggagtggggaccatcttcttatgcataattatgttttgcagagggggttctagaacactaaggaatggcttcttcaccactggcacactgggcaaggctggggagagctatggggtatggtttccctgctgtggtttattggtaattgtaccaagaatagtggaaaggatgactcttgggtcacagatgactgtggcagcagtgccatcttcatgtgggtggggaggtgactcccagggaattgggaccctgtgcttatgtcgtttatgtctgaagttatatcaagggctcttggatgcctttcagttcacatttgggacagtgaggctcaatttcctgctgggcctgggggaagtaagcagctggccccacctccttagaaattttctccagtctaagccctgactcatagctggtttttcctttcaaatgatgaccacagcccactctggatgccaaatctgtcggttctcagggatctaggagggcaagagtggatctggtcaacctggggaagactcatgggggacaggcaggatttcccactctcccaggccctggatgaactctgatattcaacatgcccagtattactgaggaaaatattggtactccttagcacaaatatctcacagagaattctaacctcagataaggaagaccaggctggatggcctctgaaatacttgctgtgccagttcagtgattctagaacccaatatgcccaatgttatcattaatatgctgccattgattacaatgtgctcagtgatgcatataattaatataatggaggccgttagcacttccacttctccaagtctgtgttatgcatttaattactttagcacttcacagtttatcagtataccatcccctgagctagatatttctccaatgccattttacaaattaaggaattttacaaattaaggtcatagaataaaaccccaccttcctcactcacgaagagacaagcagcttccccctatctaggctgctgaaggaccttcttgttcttcccaggccaccaccctatagcccacactgtttgccctcccccacaagctcacacaaccacatccccgaaactccaaaggagtttgctccctcaggcctccttggtcctcagaaaaaacagtcattcttttttttttttttgaaggtgtctcgctttgttgcccaggctggagtgcagtggcgcaatctctgctaactgcaacctccgcctccgggttcaggcgattcttctccctcagactcctgagtagctgggatgacaggcgcgtgccaccacgcccagctaatttttgtatttttagtgagatggggtttcaccatattggccaggctggtcttgaactcctgacctcgtgatcctcccgcctcatcctcccaaagtgctgggattacaggcgtgagccactgcgccaggccacaacagtcattcctaactggatggaaagctaatttcttccccttcaaggcattagttgagcttcaataaatgagacaagcaggtctgagaaccactaagagcacccgtgaattcttctggctgtaagaactaccttggactgagtgattttctggccaatccatccttgcccaggcggtgtgttcctcagagtcacaggtacctggtaaatttgtgaaaacatgcctgtctgtcagctcgagaagctagttcttcagggaggcttgtaaagacctcaaagtcatggggctatgttctttcatttctcacaacatggggaagactgtctagcattcagcaagttactaaatgtgagttgttttgatttctacgtctccctcacattgctgctgggctctgtgttctaaagttcatggcccatgtgttaggatccgtgacttgggacattaaagacttttctgggttttatactggggtaggagaatatatttactgaaggcttactcagccctgtcccttactaggactgtgaccttggatgtctcttgtttaacttttttatatcttagcttgttcatctaaaacatgaatctttgtgtcatgggcttagtgaggattagttatcatagcacatatgaggtgcttagcagaagttgcgtaaagaaataccagtttctccctttcctacccataaagccccatctacattgctaagaaccttgctttttgtggagccttacaatagtcaagtgagattagcaggagccccacctcctgggcttcaatctttcatcacaggtgccattgcttggtccatccgtgtccttgaaacatttggtaaagccacatcttagagcatctcctctgctcccctcccctaggctgaacaaatctaactcccttgagatccagctttatcccagccccaccctcctcccctgcctgtgtcatggctgactcagggaccatgccaggttctagaaggccagtggctcattatccctaccctctgcactttggccccatgggccagctttagctcctcatttgaggaggcctgggtggggtgatgggcagggccaagccatgggatatttacagagggttctggagtcgggttccctgatgtgacagctgctgtgtcctcaagagcatgtgcacccccatacctactgatcctgggctaaaaaggcaacaggtaaaagtgaggttgtcaggagtcctgaggtgcccacaggtggtatatgacccctaggcaggaagaaagagcaccctgaggccagaatataggcttcccttcctcagagtcctagtccctgctttttgttgttgttgttgatgccacatttactgccactgctactcctctcttgcattctctggtggctggaatgtgagaagggagagaaagtaaagaacactatcaggggtgcccccaggctctgagtttcaagagtctccttgtccactgcttcagccagaaccagaggttttcttctgcatctcattgtcggcactgtgcggctcactcctgggtttcaggtcatgctgagttctgctcaagagattccagaggaaaaagtgtgcacaactcaacaccagttttgtggtacttggaatcctggctgttttcacccatctacttgctggtatttactgttcggatcattcaattagctccaccatgccctctatcaaggttgtatcgtcagtgggagagagaggctgccatgtgtttacttcatcttacctggaacagaacacagtaaaatggtaaagccctatcaagtccttctcctccctccagaaggaaggagtcaagccctggcttattgtcacattgtcccgtatccctgtaaaaacacaatcacacctattcacttattcattcatgtaacaaatatttcttgagcactgattctgtgctaggccccttctagacactgggtatacagcaatgaaaaaacagacaaaactactgtcaggcaaggcagtaacaatataaacaagtaatatcatatataatatgtgggtaataagtaccattgtgaaaaattcaggaaggtaaaaggataggaatgctttttgataaaggtggacaggcaggacctctttgaataggtaatgacatctgaagagaaggtaaaaaaaaaaaagtgacctctccaaatacctgaggcattcctggaatggaaattgccatcactctctaagagatgagggcgtgttcctggcaggtgtgagggaaagccaggagcctgtgagcaggactgcaggtggcaaggaatgcagttgaggatgaaattggagatgggcaggagaggcagcaggtcacatggaccgtgtaggctgtgattaggactttggcttttactctgagtgagatggggcatcaatgtggagcttgatgcagggtggtattatctaatttataattcaacaggatccatctgactgctattgaaaatagattgggataggggagtggggccagaaggaagcagaaaagtcatctaaaaggctattaaagtaattcaggagagagaaaattgtttattgatccagggtgattgaggtggaggaagttagaaaggcttgggttctgaatatatgtcgaaggtagaatggacaagatttcttgacagagtaagcttggatagtgagagaaggtgaatggtcaacttggcattggcacggagaccatctggtaattcctgctgacccaggaatctcctacccaacacccctgacatcatgatgtccagccacttaatgaagaaataagactccctgggagaaagacttcattacctcacacaacagccttttgcggtcctctgacattctttcctatgctcactcaaaatccatgtccctatgtctttctctcaccgctcctaaagcaatacaaagcagaccttgaccacctcccacaggacagtcctccagattcctccaaggttatccttgaaactgaaccttccatagttgatgttccccattaatgctgttttcaggaggaagtaactctgggttttctactaagtagaagaatcaggaactgattgctctctgagctccttctaggacatcattcatgaattttgatatgtgattcacattgaggccatgaatctaaaattggcaaatgcactcatctccatcctgtttctcaggtgggagattggagagttagcttagcacatgtttccctaccattaaggaaaccacagcaattagaagagcccttccttagacatccacctccatgtctcccccattatgaccattatggtaaatgaactagccacattcctatttaaaagccatttctccactgttctactacatccccttccttcatacatgtttaagaaattgatgtctctaacaggtgaaaggcaccatggaatagagctaatatttttttaaatgaaatacaagcactctttatagaaataagaggaaacctaaatttatggaagggccaatgtgcctggaaaaattgactgagaataattaattctgagacatagcctatacaactattagactattaaagagagaaaaaaaaacaatacttatggcctccacacacaacaaccataatatctagaaaggtatgaaaattatataagcctcacaatattcaagaaaaacctgcaaagcaaggcaagagtggaacattattttcaagtaatcaaagaaaagaaaatgaactgtgagccacgggctttattgcagcaaaaccatcattcaattattaagactatagaaaaacaaatgatttattcaaggaatgagagaactttgtacacatgaacccttcttggataatctgctaaacggaaacattggcaaaataatgatggtgagcatgtggtatatttactgcagatctaagatttaaataagaatcagggacaaggatggaaaataatttataagtattgtatgttctaacaaggtagaaagaatacaacttaaaatttgagctgagaataaagacagaaagaggaaagtagaataagatcattgttgcatagaaaacaggcagatgtcaaattataccatgtagaatgaacaatccacatagtaaaaggttaagtaagaaaaaagatgaataaagatattttaaaagacaccaacgcaaaggtaactactgagcaaaatcgtacattttttttaaatctcaagggaaatcttttaaaaagatcaaggaagacatatcatataaagaaagaaacacactaaacataacaatacatagaaaaattataggataaattgacacaggaactttacacctaatataatagtcatatcagtatatgagaatgagcttaagttgcctactaaaagaaatggattttcaaaataacttacaaagcaatagactgtggcatattccgcatataggagaaacattgaaaacaaagtgatccaaaggctttaattttaatgaaaaagagaatgtaaagaagaagatgggaaaagtcatgctagctcaatgggaataactctaaagcaggagtagctactctaatatcacccaatgcagaatttagaacaaaatgctattaaacaagaaaattaatagcattataatgcaaaaaccaacgacctacaataaaatatattatttattaaataatatctatgtaagagattatacaaaacccatctgtatgtaaaataaaaattacagcaatgctaggataaatagacagaaacaataatgataagatagttttacacattactttcaggacaagagaagtcatgtgaacaaaaaataaatatggatagagaagacttaaccaatgtcaatgataaattagatttcataaatatgtatcaaacgctgtaccctttaataaagaatattttcccttctcaagcagaagtgaaaaatttattgaaattcctcctatattagatcacaaaggaaatataagtaagttccatagtaggaatattataaacagaattatctaatcacaatgcagtaaaagtagaaacaaaaggcaaaaatttaaaatgcccttccaaagataaaggaaaagagactaacttcactctccagcctcaaacaacaaaaacatctgaaggaaacatttaaaacaatgatttttaagatactggacatcaaaccatgaaagacagtgatcctgaagaactggaagacaaatgagatagttctacaatttcaccagctaagccccttgagtggatttccaggcctcagtgcagaaaaggggagcccaggtagacacactgacttgaggaactggaagtctgagaagatcaggatggccatagttcacagggcagagtactggagagaagagagcggcagagggtctccctcaagtattcagtggaatgcagatcagtagatacatgcaaggaactactcaaagccacacaaagacttacctgaaaggattagaggaaacattgccaggtacgtttacagggccaagaatcgtgtctattccgaatagctgagctggaaaatctcataattcacgcagaattgtgtcaagtactcatgaagatcttacctcagaatgctctagactaaatgctgctatcattccacctaactaatcttaaaagcaagacatgaaaggattaactgtttccaagtaacttaacagcactccaaaacaaaactcaagagtatttatagggaatatataaataaccaacacccaataaattaaaattcataatgtctggcatccaataaaaaattgccaaggatggaaagaggcaggaaaatacaacccataatgaggagaaaaatcaatcaattaaaaccaaccagaacaggacacgtgttataattagcaggcaaggacgttgaaacagttatgattgtaatccatatgttcaaaaaagttggtatagagacatacaagatgtctaaaagttctaaattgaacatctacagctgaaaactactatgttttacatgaaaaatacattgaatgggattaatggcagattagacattagaaaaaagaaagatgactgaacttaaagatagcaacagaatcaatctaaaataaaacacagagaatgtctctaatgtctgaaacaataaaaatcaaaataaaagcagcatcagtaagttataggacaatttcatgctgcctatcatacctgtaattggagtctccaaagaaaagacaagaaagagacagaaaaaaaatttgaagaaaagtagtagcctaaaataatctgaatttgataaaaactattaatgcacagacccaagaagctcaaaagccccaaacacaagaaacacagtgaaaactgtgctaagccaaatcataaaattactcaaaactagtgataaacagaaaaccttaaaagcaacagagaaaaagacaacttacataaagagcaacaaagataaggatgatagcagcttctagtcagaaacaatgagagcaaggagacagtgtagtaacatctttaaggtactaaaagaagtaaactgtcaatgtagaattcaaaaatgaaggcaaataaagaattctttagacatgcaaaagctgaaagcattcatgccagcagagtcacactacaagatatgttaaagaaggtctttcaggcagaggggaaaataatagcagactgaaatacaaatctacccaaagaaatgaaagcacaggaaatggtatccaggtggataaatatagagatgttccttgatgtacgatggagtgcatctccataaacctattgtaagttgaaaatatcttaagtcaaaaatgcatttcatacacctaaactactgaacatcatagcttagtttaccctaccttaaacatgctccaaacacttaacattagcctacagttgggcaaaatcatctggcaacacaatacactgtaggagtattggttgtttatctgcctgactgtgtggctgactgggagctgtggcttgctactgctgctcagccacataggagagtggagctttctactgaatgcatatagtttttgtacaaccataaaatccaaaaatcatgagttgaaccatcattaactcagagaccatctgtataggattttcttatttaagtctctttaaaagataattgcatttagaataaaaataactgtagtgtataatttatgatatatgttaaagtaaaatatatgacagaaacagtttaaaggccagagggagataaatggaatacactattaaaaggctcttatactaggtataaagtagtataaatttacttgaaggtatattgtcataagttgaagtatgctgcaaaccctaaagcaaccactgaaatagcaaaacaaagtattatagatcataagccaacaaagaaaagaacatggagttaacaaaaaaaaaaaatgctcaatgaattcaaaagaaagcaaaaaaaaagaggaaatcgaaaataaagaacatatgggacaaatagaaaacaggttgtaagccaatgtacttaaacctaatcatatcaatagtcacattgcatgtaaatgcatgtggccacactgcatgaatctaaacaccccaattaaaaggcagaaattattaaagttgagaaaaaaagcaagcatcactattgctgctgacataaaactcactttaaatataaagacacaaataaaacaaaggaataggaaaaggtatacaacgctaaaactaattctttaaaaactggagtggtttgttaacatcaaacaaagtcgatctcagaacaaagaatattaccaaggataaagaaagtaatttagtaagtttcaaatgataaatgataactaatcagttgtaaggacataaactcctaaatgtccacgtgcctaacaacagagtttcaaaatacattaaacaaagactggatagatgaatccacaattatagctgaaagtcttaatacccttccctcaataactgatacaacaaatagaaaatcagtaaaaatacagaggatttgaacagcacaatcaaacaagttgaactaattgacgtgtatagaacactgcatccaaaaaacaacagaatatgcattcttctcaagtgaaaccaagatattctgagccaaaacaaattttaatacatttaagataattcatatcatggaaagtatgttatttacattgttattttacattagtttataacacaatggaattaatgtagaaatcagtaacaaaaagattattgaaattcccatatatttgtgaaccaaataacatatttctaaataagccaggagtcaaaagagaaatttaaaagaaaattataaagtattttgaactggataaaaatgagaacaaaaaattatcaaactttgtgggatgctgctaaggtattactcagagggaaatttatagcactagacacctaattagaaaagaataatagtctcacataaataaagcactatcagaaaaaaattagagaaaacacaaattccaataccaaagctaagagaggtgatatcactattgattctatggacattaaaaggataataaaaacatatttttgaacaattttataataaatttaacaacttagatcaaatgagtaaattcattgaaagacataaactcccaaactttatgtaagaagaaatagataacctgaacagtcctatgtctacaaaagaaatttaacttgtaatcataaaccttcaaaacaggaaaacttcagacccaggcaacttcactgatgaattctatcaaacatttaagaaagccttaataccaatgcaacaccaactcttccagatgttaagagaagggagtacttgcaaagtcatttgataagacaactgtcaccttgatatcgaaaccagacaaagatattataagcaaagaaaactaaagaccaatatccctcataaatacagatataaatattcttaacaaaattttagcaaatcaatacaacaaaatattaaaagaataatatgtcaagacaagtgagatttatcccaggaattcaaggttggttcaacatttttaaaacttgatcaataaagtttaccatattaggaaacaaaaagcatgtgatcatctttgcagacacagagaaagcattttaaaaattgaatatcaatttctgataaaaaaaaaaactttcaggaaactaggaatggaaggaaacttcctcaatctcatagtgtcttttaaaagcctacaaataatatcatacttaatgatgaaagactgaatgctttcccccaagaagaggaacaaataaggaggtctgctgttactatttctattcaatatttactgcaagttgtagctagagccataaggctaggaaataaaatataaagcatccaggtttgaaaggaagaagtaaaactgtctttattcacagaagacatgattgtctatatagaaaatccaatggaatagagtggattcctatggaatccacaataagaattactagaagtaatacatgattttagcaatgttgtgtaatacaaggtcatattcaaaaatcaattgtatttctgtgtattagtaaaaaatgataggaaattgaaatttttaaaatgccatttctaattgcatcagaaatatgaactatttatgaataaatctgacaaaagatgtgcaagatctgaaaattgaaatatataaattattgatgagataacttaaaatagacataaatagaccatatttataattaagactcaatattattaagctgtaaattcccaaatttacaattagatttaatgcaaccccaatcaaaatttcagcaggcttttttttttttttaatggcaagctgatcttaaaatcaatatggaaatcaaaggacctagaacagccaaaataactttgaaaaagcagaacaaatttggaggattaatgttacttgatttcaagacttaatataaagttagtgtgttagtctgttctcacattgctataaagaaatacccaagactgggtaatttataaaggaaagaggtttaattgactcacagttccacatggctgggaagacctcaggaaacttgcaatcatggcagaaggggaagcaaggcaccttcttcacagcatggcaggaaggagaaatgcccagtgaagggggaaggggccctcataaaatcattagatctcatgataactcactatcatgagaacagcatgggggaactgcctccgtgattcaattacctccacctggtccctcccttgacacatggggattatgggaattacagggattacaattcaagatgagatttgggtggagacacaaagcctaaccatctagagtaatcaagacagtgtgaaattagcataaaaatgggcaaataaatcaatgaaataaataagaagtctagaaataggccctcacagatatggacaactggcttttgacaaaggttcaatgataatttagtggagaagagatacagctttcaacaaatggttctgtaacaaattacaaaatatgatactaacataaaaactgacatatagcccagtgaaacaaaatagagcccagaaatacatccattcatggtcataaagctacaacttccttcttttgcatgtggatatctaccttttccaacagaatgtgcaaaaaaaattccatccataccttgtaccatatacaaaaattaactcaaaatatattgcagatctaggctgggcagagtggctcacacctgtaatcccagctttttgggaggctgaggtgggcaggtcaattgaggccagaagtttgagaccagcctggccaacatggtgaaaccccatctctactaaaaaatacaaaaattagctgggcaaggtggtgcacacctgtagtcccagctactcaggaggctgaggcaagagaatcacttgaacccgggaggcagaggttgcagtaagcaaagatcgtaccgctgcactccagcctgggtgacagaaaaaaaaaaagtatatatacgtatataattttgatctgctatatatatgtgtgtgtgtgtttatatttatttatatatatatagagagagacagagagagagcagatctaaatgatctaaatgtagaatctgaaagcataaaacttcttaagaaaaaacatttacaactgtggagatcaggcaaagatttcttagggatgataccaaaatcatgacccatataaaagaacaaattggtaaattgggattcatcaaaattaaaaacttcttttcttcaaaatacactctttttcctgtatattaattatcatgtatttgaataccatttttaaaacctgtaaatctgtacaaacatacattttgcaaccttgatcaaactattttattttattgttgaaagaacacttaacatgcgatctatcctctgaacaaatttttaagtgtacaacacgttgttgctgattataggaacaatgtgataaagcagatctctacagcttatttatcttgcttgactgaaactttattcctggtgattagtaactctccatttcctcctcctcctattctctggcaaccaccagagagctcatataagtggaatcatgcagtctttctgtgactggctgcattagtccattttcacagtactataaaaaaaatacctgagactagataatttataaaaggaggaggtttaattgactcacagttccacatggctggggaggcctcaagaaacttaaaatcatggcagaaggtgaaggggaagcaaggatcttcttcacatggtgacaggagagagaagtgtgagcaagagcagggaaaactgccttatagccatcagatctcatgaaaactcactcactctcacgagaatagcatgggggaaactgcccccaggatccaatcacttccgaccaggtctgtccctagacatgtggggattatggggattacaattcaagatgagatttgggtggggacacagccaaatcatatcactggtttatttcacttagcataatgtcctcaagattcatctatgttgtcacacattacataatttccttcctttttaaggctgaatattattccatcatatgtatataccatgttttctttattcatctatccgtctatggacatttaggttgcttccacatgttggcttttgtgaataatgctgtaatgagtagaggaatgctaatacctctttgatatcctgattttaattctcttggataaatacccagaaatggaatagctagatcatatgataatcctactatttatttttttgaggatcttcttctatactgttttctatagcagctgcaacattttgcattctcaccaacaatgtacaaggattccagtttttccacatcctcttcaacactttggtttttctgataatagccatcctgagaagtgtgagatgttagctcattgtggttttgacttacatttccttgatgtttattgatgttgaacgttgatgtttagtaacctaactatcaggttaatagtttgttttttgcctattgagttgtaggagttccttacatattttggagattaaccccttatcagatataaagcttgcaaatattttcttctgttttgtagtttgtcttttcactttatcaatgacttcctgtgcagaagcttcttagtctaatgtagtctcacttatttatttttgtttttattgcctgtgcttttctgtcatatccataaaatcattgccaagactaagtcatgaagcttttcttctatgctttttgtaggtgttttacaacttcagtcttacaattaaatctttaatcaattttggtttttgtgggtggtgtaagataagggtccagttttatttctttgcatgtgaatatccagttttccataatcatttcttgaagagattctttcacccattgtgtagttttggcactcctttgtggatgatcagttgagcatttatgagcggacttatttctgggctcgctattttgtttcattggtctatatgtctgtttttatgctggcattatattgttttgattatcataactttgtaatgtaaaatattttgaaatcagccatttttattatacaagtcttttacctccttggttatgtttattcctaggtatttttattctttgtggtgttattgtgcatgggattgttttcctaatttcctcttcagatagtttgtttttggtatatagaaacacaattgatttttgttgttatttttgtattctacaactttactgaatctatttattagttcagcctcccaaagtgctgggattacaggtgtgagccactgtggctggccagttctcatagtttttttaatggagtctttagagttttctatatataagattaagccatctgcaagagggataattttatgtcttgctttccaaattggataccttttctttctttttcttgcctaattgctttgggtagcacatccaatactatgttgaatagaagtggcaagagtgggcatctttgccttggtgctaatcttacaggaaaagtttttagtttttcaccattgagtatggtgttagctgtgaagttttcatatatgacctctattatggtgacgtagtttccttctatttctagtttgttgagaatttttatcatgacagagtgttgaactttgccaaacacttttcccacatctattgtgacaatcatgtaattttaatcttttattctcttaatgtggtatatcacattaatttttgtatgttgaatcacctttcatttcaggataaataccacttggtcataatgtatgatttttataatatgctattggattcagtttgctgatagtatattgaggatttttgcatatatatccctcagggatactggatactggcctgtagttttcttttcttgtggtctctttgtctggttttagtatcaggataatgctggcatcttaaaatgagtttggaagtattccccactcttcaacttcttgaaagagtttgagaaggtttagtgttagtttttctttaaatgtttggtagaattcaccagttaagtcatctggtcttgagcttttctttgttaggaggtttttgatgactaattcaatcgctgtactacttacaggtctgtgcaggctttcagtttctttatgatttaatcatggtaggttgtatgtttctaggaatgtatccatttcttctgggctatccagtgtgttggtatataattgttcccagaagtctcttatgatctttttaaatttctgtggcactagttctaatgacccttctttcatttatgacgttattttagtttttatctgtttttcttattctaagctattgtccatttgtaaacattttgcttatcgttccaaaaatacagatcttagttttgttgacgtttttctattgcttttatattttctgtttcatttatttctgctctaatcattgttgtttccttccttctgctaactttgggcttagtttgttgttctttctctgattccttgaggaataaagttaggttgtttatttgagatctgttttcttttttaatgtagatgtttcttcctatgaaattccttctaagtacggcttttgctgcgtctctaagttttatatgtttttttcatttttgtttttctcaaggtattttataatgttcttttcaatttttttccttgactcaatgattgttcaagaatgtatttaatttatatacatttgtgcatttttcagttttctttctgctattggtttctagcttcatgccattgtggtcagaaaagatatctgatataattttaaccctattaaaatagttaagacttgttttgcaacctactatgtgatctatcttgatgaaagatccctatgctgctattgggtgaaatattcagtatatgtctgttagctccatttggtttatagtgttattcaagttctctgtttccttactaatcttctctctggatgttgtgtccactattgaaagtggggtgttggagcctcctactattattgcattgctatatatttctccctttagttctgttaatgtttactttatatatttaggagctctaatgttgggtgcatatatatttataattgttataatattccttgtggattgactcttttatcattatataataatcttctttgtctcttaagagaatgagaatacaagctaaaggctaggagaaaatatttgcaaaatacatatatctaacaaaggacttgtatgtaacacatataaaaactttcaaaactcaataagtaaatagcaatacaaaccaataagaaaatgggcaaaagatttgaatgtatagtttaccagagaaattgtacaggtagcaataagcacatgaaaaaacactcaacattcatagtcattagaaaaatgcaaactaaaaccacaatgagataccactacacacatttcagaatgacttaaatttagaaaactaactttgtcaaatattgataaggatttggaggaactaaaaactctcacatattgctcttgagaattaaagtgtacaatcactttggaaaacaatttggtagtttctttccttttttctttttttttttttgagatggggtcttgctatgttactcaagctggcctcaaactcttgggctcaaggggaccctcttcagcaccttgagtagctgagattacagtagtgcaccactgcacctggctggtagtttctaaaaagttaaacatacacttatcatatgatagagtcattcaactcctaaatatttatccaagggaataaaagcatatgttcatacaaatgtcctccaagtttcctagcagctttatttgtattagctaaacattggaaacaacagaaatgtcatcatcaggtgactagataaacaaattattgtatatccatatgatagaattctattcaacaataaaaagaaattaacactaaaattcttgtttaaatctcaaaactattatgctgagtgaaataattcataaaaaattgagtacatactgtatgattccatttatattaaattctatgcagtgcaaactaacccacagtgacaaagcaggtgagtggttgcttgtggggaacaaggttgagagctagattacaatgggacacaaatttttttttggtatgttcattatcttgatcatgatgatgatttcattggtttttataaatgtcggaattcatcaaattgtacatcttgaatatatgaagtttattatatgccaattatatctcattaaaactgttaagagaagatttttgcatcaaaaaatattttaaaagatgcctttccaattggaactttaaaacaatctattgttaaacaattgagtgataattaagatacaaacaagaattaaaggattctgaaaaaaagacaattaaaccactagatatcctatctataagatatgtttaaaacagtaatcagaggacaatatatggctagaaacattgtatctctaaacagtgaggaatgaaactaacttaattcaaaaatatataatgttcccctaaaaagtacaagaaagaagatataacaactatacattatatgtacctaacaacagagccccaaatatatgaaataacagctgttaagttggagggagaaacagacaattcaacaataatacttggatacctcagtatatcacttttaataatggctgcaataactagacaggagatgatcaaggaaatagaaggcttgaacaacactataaaataactggacctaatagacatctataaaacactcaattgaacagtatatgttcttctgaaatccacatggaacattgtccagtacagaccataagtttggcaacaaaagaagtctcagtaagcataaaaaataaaattatataaagtatcttcttcaatcacaacggaataaaattagaaatcaataatgagaggaaatttggaaagtcacaaatgtgtagaaatcaaacaaattcttaaccaatccaatggctcaaataataaatcatgagacacttgaaaattctccgatataaatcaaaacaaaacaaaagcataccaaaatgtatggatacaacaaaagcagtatttagatgaaaatttttcattggaaacatccacattaaaaaaaaaaaatatctcaaatcaataacctaagtatataataaactagaaaaaagaaaaagctaaattcaaagcaaacataataaaggaaataataaagcgtaaagtgtacataaatgacatagagaaaagaaaaacaatagagaaaatgaacaagcacaaaaattggttatttaaaaaaaataaacaaaattaacaaaatcaaaactttagacttaccaagagaaaaaagaggactcaaattactaaaatcagtaatgaaagagaggacattacattgactttacagaaataaatggggttataaagaaatcatatgagcaattatataccaacaaattagataacctaaatgaaatagacaaattcctaggaagacacgaactaccaactgacttatgaatacatacaagcatagaaacatagctcaatggaatcaaatttagggtccagaaataaactcatatacttatggttaattgattttctccaaaggtctcaagaccattcagtagagaaagaattctattttcaacaaattgtgctgggagacagctggaaaagcacatataaaagaatcaatttggacctccactcacaacatgtacaaaaattaattaaaactcataaaagaccaaacgttaagtgctaaaactataactcttatttaagaaaacaaatcttcataatcttggatttggcaatagatccttagataggataccaaaaacacaagcaacaaaaggaaaaataataaattgggcttcgtcaaaattgaaaccttagtgcattgaacactatcaagtggaaaaataaccaacaaactgagggaaattatttgctaatcatatatcctgtgagaaacttcctatgaactaaatacttcccccaaattcacgaggcagagcccttatgaatgggattagcacccttataaaagaggcctgagagaacttccttgttacttccaccacataacctaagtatatactttaataaagtatataggacatactgcaagatggccatgtatgaaccaggaagtaggccttcactagacactgaatctgctggcaccttgatcttttaacttcccagtcaccaaaattgtgagaaataaatttctgttgtttctaagccatccagtctatgacactttgttacagcatcacaaatagacaaagccaggtctaggactgtgaatatataaagaactcttaaaatttgacaacaaaccaaaattcagtaacaagccaaaaagatacagaaatcattttttttaaattgtcaaaggactagaacagatatttctcttaaaagatgtaccaagaaaatataaccaataaatacataaaaggatattcagaatctttagtaataagggaaatgcaaatcaaaaccataatgagataacacttcacacctactaggatagctagaatttaacaatcacaacaaaaagaaaacaagtgttgacaaggatgtggagagatcagaacccttatgtattgctggtagaaacacaaaatggttcagccactgtgggaagcattttggcagttcctcaaaaatctaaatataggattaccacatgaccccgcaattctactcctaggtacatatccagcagaactggaaacatgtccaaacaaaaacaggtgtacacaatgtccacagcagaattattcctaacagtcaaaaagtagaaacaatccaaatgtccatcaattggatacacaatatatggtatattcatgcagtggaatataaaccttaccaataatgaagaactggcacaggctatgatactcatgagccttgaaaatattatgctaattgaaagaagccaaacacaaaaggttacctattgtatgactccgtttacatgaaatgcccagaacgggcaaatgcattgaaacagaaagccaatcagaggatgaagggagggcagaacggggagtggctgcttaatgaatgcgttagtctgttctatcactgctataaagaaatacttgagactgggtgatttataaagaagtttctgctgcactccagcctgggtgacagaatgagaccttgtttcaaaaacaaacaaacaaaaaaaggtttaattggctcacagttccacaggctgtacagaaagcatacatagcagtttctgcttctggggaggcctcaggacacttccagtcatggtagaaggcaaagggggagaaagcacttcctatggccagagcaggagaaagagagggaggagggaggtgccacacacttttaaacaaccagatatcaggagaattcattattgccatgacagcatcaaggaggatggtattaaaccataagaagtcacccctatgatccaatcacctcccactaggccccacctccaacagtggagattattatttgacaagagatttgggcaggacacagatctaaaccataccagtgtgtatggagcttcttttgagggtgataaaaatattctgcaatagggttagtgataatgattgcacaattttatgattgaactgaaagccactaaattgtacactaaatactgttaattctatgctacattaattttatatcaattttttaaaaagggatatgggaggctcaaatataatggtacatttgaacttttcagaacaaggtctttcaaaacacttgcccaataaatataaatatatgggcatcccccaattggcctttaaggcattctcttccattggccaagagcattctcatctgctcagcaactttctcccattggccggacccttgatgctgaggctttgaagcagagcctgggttttccaggcactgctgattagccgggggaagaaaagtagggtgttgtagcaaaccctccagttaggactttgggtccctaggagctgactgagtctgttcaagcattttctctctagtgccaggcctttggttggtgggaaaaagtcataggatggcactgggggggtctatttgcagtcgtactcttaactcttgtgagacctcaaaacaagtgccttctgggtggtgctttccactggggtaaaatgaaaagactccaggatcacaggcacccagggttcaaaggcctgttaagtagagagcaggagacagtaccagcacagccctaactctgtcgggcctgtcctctcagaagccaggccatggcccacctaaattctggaaggccccacctcccttagccccaacaggcagtgctcatcatcaacgactttcctccaagcccccgccctctgcatactgcatggactccaggagtcccctgcccccactcccacccaggaaagctggtctaggaccaatcagaggctgtggaactttctggaaggcccagggcttctccctgggtggggcagggcctctgattggaggaggcctgccagaagggtggggcgatgggcgtggctaacgggataactgccagagcagaagacagttggcagttatttcgcaaccttcatctgttcctggaagatacccgtagcctgccttccttcttgacaggctgatttaggggtgctccccaagaagatcaggactgctgaaagaatgaagaagaacttacttggcctaggatgtggctagagaacggagcgcactttcacttacctggcaaggtggttttggaagtttccacggaagccttcccagggccgctgctgcccgtcctcgcctaggtgtggagcttcccgaccggctggggagggaatgtcctgcgggagccgccgaggaccctctttagcctcttccctggcttggctgcagctgcagtctggtactcgcccattctgctcttcttcacctccgtattttctctctcacggaagaagaattccattctcccatcccaggaaggagagtgccctgcgtgccacgaaagagcccaggacccacaggacaaatacgtcactggcagacctgccttcgccagcgccagcccatctctgaaacctccagcatttgtgccccggtccggcccctcccaggcctgactctttccgtgtgggtattttcctcctgggctcgctgccgcctcgctcccatttctcccttccctccctatggtaactgatgaagggttggggctggtggaacccagatctggggtcagaagttccccttgtcaagtcccaagtcttccatctaagctgtgtgatcatgggaaagacactttaccctttgtgggcatgcccgctcaactggaaagtgacacaatcataatgccctaatccagaattcttgtgagaatgggagtaattatgtaaatatctttggaaaacagatgtgctgccaattacattttgtgattttaactttgtcttatttctctgctgttttgtcttcctatgtatcaagtttcttctgatttttttttttcttttataggaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcattcttttttgcttgggctgattggtgtgctgattcagaagaccttgatattttattctttcccccaaaccagctcaattggtgtttgtgctagagggagatggaccatggggagggctgttataagggatatccttggccctcccacttccccctttgaaggatgcccttgttatcttaggcagggacctgataccggttggttcagtagatatctggcagtttactctgagcatttaccttatattagggcaagaactaaaggaacaaatatatccacctcaatgtcaggtcaaatgggaggatgtggatgggagtaaagagtgattagtattgaggtcgtggaattttattggttactatttttataactttggtcttcgagtccttgaatgaaggtaaacggagacttattagggaacaaattactagtggcagggtggtggtgtcctggtgtcctgcttagaatgtgaagagagtgccccatcattggcctatgctgtgcatctgggaggtggtaggccacagtcctgaactgcacaactggtagtgaaattcagagcagaatgcaacatttatttaatggggcctcacagttggccagtgtccctgtggcctttccccttcttccttccactctgtgtcatggagacccgacttgatttggcaagagaacaacgtacacctaagatttcccgaatatttcccagcaaggaccctggctggctatgtttctacttcagtggtgaccacagcagatactggcagttttctgttatggctctggggtcttttaaggagcaggaacgtggaatatgtacaaacctggagccacagtcaagtactaagctccttgaagcacaaggcatgagaatatcatgttttcttttccttagaggatttatgaattaaaactaaggaataatttgtaatcagaataacaccacctggcagggatgttgatgagctgaggaaggcttatttggagatttctggtattttccagctctgagactccagacctaatatccatgtaatggccattaatgtcttgtaatttataacagttttatcagtgatccattacattaatcatcatgagttggtgacttatcaagtcctacaggttatttgttatttgtataactatatagagctatttaatttacaaacacaatactcttttgaggtagataccagaaccattttacatttgaggatattgaagctaggaaaaagactcagctcttgaaggaatggacatggggtgcccttgccttccttggggagagagccacctaatctgtgcagctgtagttagggcctgccaccttattcctcctctccatccagcccctacattttggaaacaaaaaggcagcagtgatctgggaattatttaatgcttagtttgacaggacaaattttaaggaccttaagagcaaccttttatttcttaccatatgaggcactgggacaggcacagagaagtcaatattatttgcccagtgcatttcttcatggcttctgctttttaatcttaggctcacttttttaacctcattgctcacatgttatgattccttccagaaagttcactgaaattctaatgtcccttgctgttccttaggtaacttaggagtaactttccagctcttcccctaactagttgtgtgacgtgcagcaggctgcttaacttctgtgtgtctcagttttctcaactgtaaaatgaatgatccaacccctgtgtcagaaggatgggtgaggctcatgaggaataacacataagaaatatgggatgcttaccacagtgtttggtaaataacatgagtttcctcttccctctttgaacagtcctttgtattctgctgagagctttcctgttcatgctgcctcacaaccaaaaggggaaagaatcctgagtcctgtgctcatgatttctccctttgctagctggttcaaggccaatccagataccatggtattttctgaaagagtcccacccttctgtgcaaaagccttcctcccagggagacttgatatgactgattaacaatccaattaacactctggaacaatctagaagggctgtggctcattaccctcagcaattttccacccatttagtctccaagccattccctggaagagacaagtggatctgatgagtggggctgtgccatgagacctccagtatttatggagaagccagtcctttcttccttcgccaggcctcaagatttcccaatgtgcctctattcttacatggcggatgggattctttgccttcatacaggaaggaactggaacctcaaggcagacaggacaaatacaaatcttgaaaatgaccatgactcctagttggtccctacttgcctcctggtttcactaagtagagggtcactccaggtagagccctatccagcacactgctccttcccccacctttagatgtggacagtgggtggactgggcccatagcctggacctggacagctgtgtcctcccaaccagactcttctgattctgctgcgcctcactctttcctacttatccttgcctagatccctcttactccatctttcctgctcaggtcacaatggacaataatctctgacccctgccccagctagactggcactggagagctgagagagcctcctgtccatggagaattctggcagagctgctatcttcagccccgtctcaactctccagggtcctgtgccctttgtctacctctcccaggcctgactctcctcccacttgcatggacattgtctttcctagctctgggctgccttctcagcctcatgttttgccctttttcctgctgtgggagccagccatcactgtaatgcatgagtgcggggatgtggtgtgaagggaactccagttctggggtcagaagatttaaagtttgagacctacttctgtcccataagcactataaaaactaagccaaataaacaactttgatcctcagtttggaaacttttgtaatgtgaagaaattagacttttgataaagaatggaagaaatggtcatccatgctaaagaaatgtttggaatgttgagatgctatagaatctttctgacagtgctgctgactttgtatacctctacatataaatgtctccagttttgtttcttttccaccattctgcagacaaagctgaatgcaggcagggaaggaaccctcactgttgagccctggaatcaggcactcttgtctgagccccttcatctttggtttggggtagaaagcacaggtggcaccctttctctagttttctcacttctggcacaaactttcatttactgtaacctaagaaaggatggaagaccttgagcctcaagaaaaaagccccaagaaaattccatgcctctgcttccctcacaaatcaaagctgagctaatccagagcagtttgcatgattccttagaagaaggaacctcaccaggactcttaaaagcagggagaccaaggaagaattgggcttctgcacttaatcactgttgaggtcctccctgcctgctcccagacctctggagtgacccacagtcttctctatttaccttaaaaacagaatccaacctcttcatgtaggtgagtcaccccatctgcagttatatgtcctggcgcaccccagctctccccaaacaaactgtgaagcatcagccctacccaaggaacctgtccagccatgcacacttcaaccaaccctctctgaccttaggatgaaaccgtttctctaacattttttttcactcacattgggaccagtgtgttgattcagaagaccaaattgggaactaattttaatctccctacctcaagcaaatggatggtcttcggactagagggggcccaggtattaaagggtgtcagagagggctggtcaatgggctaccatcccaccaccccttgggaagagctcacctcccttctcaagtggagagcctctggcccactctcagccctctgatcagagccaggctctcactgagtgatttttctggcacctggcagtcttcccatcctagaaggggaacagtgggaggtttttggtggcagcatttgtgtcattccagaatactggatgttagattttggctgttgggaaaatcctggaacaaagatgaaaggtgagaaggattagggaaccaatgagtgaggggcaggatggccatcctcagcccagcagtgaagtctacagttttccaggtgcttccatctactattggggctgttgtgtatgtcagaacattcagggcatcagggagtacagaggttaccatgtgctctctgccacttccctgcctcctttcttctctcaaaatcatagagaccagtgctgatttggcagggaatatcgaacctcttgagatttttccagctggaaccctggctctgtacctagttttttaacactattttgaccatagcagtctttgggagctgcttgatgtctgggctctggatttcccatgaagtcaagaatgatggattcacaagggcccaccgggaatatggagccatggtctgattagagcacagagagctacttcctgccttgggtaaatcctgaaattcatcatgcatgattttccttttaataagattaaggagagcttgtatagatattgaacaggggatcctgatagccattgagggaggctggagtagatgacctctgatagcttttgccagctttgagagtctatgaacttaacatatgtaatattatcattaatatgctataatttatgttactttaaatgatgcatatcattaataataatgactgttattacgctgccttttccgatccaatatgtgatctgtgtaactacatagtactacagaagcatacttactgaagtcgatacttaccattgatatcttaccaaaaaagaaactgtggccaagaaacagcctctcaacccagaacccccaaactaaacagcctctttctctcaggaggaactgaacctgccttggtttactcagttctctgcaactacccttcttccagacctgctttgttccctccaccacacctcctctcaagctcctgggacagctagagatgcctccctcaacccctgcttgtccaggcacaggatcccagtccttaatgtgcccctgttagacccaaagccagtcacttttccataccaggtcttaatttcctcttctgtaaagtgactcaagattttgaaacttaaaatctggtgaattcttccaagcacaggtgccatcttatgttgtatggcctttggccaatccatctgtccatcttttcttggatagtagttttgccagatctataagttatcttgaaattagtgaaaacagaccaatctttgataaccagagatctaaagcatcagcttatggccctgtccttcagggtaatgtgtaaggccctcaaagccatgcacagtgtctttcactttgacttttatctctctcaataccatgcacagtgctaggcacacagcaggtcagcaagagcatgctgaatgagcacaaacagatttcaccatctctcccactttttctgctggactcagtcttctgaaagtcaaggcacatatgccaggattcaggccttcgacatgaaacccagacagctctgcatttttacatcctctgcagctctgtaagaaacttcagagcaaatccatctcttgagtgtttacccaactttgtgcctcaatagctgtgtgaccttgggcaagttatttaactcttctctacctgagcttccccaatagagatattaataataatacttatttcattgtgttgttttgatgataaattgagataatctatatatagctcttagaccagtacacggcacataggaaactctcaataaatgtcaggtatgattatcaacttacttttgcagttcaatattcacctgaaaaatgccaacctaatgttctcctaatgaaagtataagaacttttccataattagtctgggtaggtaaggcaatcaccccatctttggtagacaggaaggaccatgtcttccaagagatccccacaggaatgggtgggaagagcataacaggaaacccaagatgaaagccttcaggattaatagctgcaactgagggcttaaatcccttcttcttggcagcagtactcctcaaatggtgagcaagttacctgctagttgccaggacatgccaagtccatgacagaggggacaggtgtagtgcactgaggtttttacttcacaacaaagtggaaacaatgtcagataggtcagctaacacaggtctccatggtttggaaaatgggatatcttggatgtagcctaggagattcaagggaaagaaaactcatccttgcaaagtatataaatgttagtgctgctgtggggtatgccagggagcaccactgaacacatgttacagaggaggtgcaggagaagagggggtgtgctcatcaccaactaaccagatggacagcctggacggatgggctggggctgtgggaggttggtcagtgggctgactggctgtggaccagatgggtttggggatcccatggagatgggtgaaattccagctccattctctcatcagtaggaaaccgagcatgtgactgttgacatcttggaaaggactagaccatgagatcttccttgctccaatcccagacagactccggcatgagatagtggaggagaattctggctccaggagcatattcagctgatggctaaagggaccagaagatcaattatcccaacaataataggaaaataaccagggaagagcctgtaatctgggcctacttcctcagaataggtgagcaaaagaaagatgtcacacattatacaaaatgagaacatggagaaagatcactgaacctgtcagaagttcctaaatagctatgataggggtcacaggatagccttagaggtaaaagctagcttctctctttggtctggggaaaacatgccaatttctctctgatagaagcttcagggaagggaaaccacgagccttgtaaacattgactgactgtgaggtacagaaccttaattgagatgatggaagctacaacctttggtttaagggctgaaagcacaaatagatatttttaaactgtgaaagtgacagggttccttttagatattggggcagtaacctggatgggcctgattctattatgcaaaggtagaaacctcaggtatttacctgtgagaagcctccttgtcacaacaaattcttcttgctgccaactgcatcacatggaaaggctaggtttgataatctaggtgggatctttaaaacggtgtatgcaggttttgagtgctgcctgccaatagtctcttcttttgaataagtgtgtctatttttctggcagcagtttgcagaaatcccactggttgtaagaacagagaaagccccacccagcttgctgaagccctgagaccttcactgcaggcacactgagaacagaagatacagaagtactcaggctgtacttatgaaaaatcaatactcacagacttttaaagaaaagttactttgcatttgggaagggggaatcctgagacagtgactgttgcctagcctggctgacaattatatcccttaacaaaaaagtgttcctgaggtcttttcgaatttcaacactgtaatggtgaaaaaatagaaaattctcttgagggaaacctgagggatatgtcattatcgagaatgtggggaaaggggtcaaactgtttttccagaaagcttaataatcaactaggcaaatattgtatcagctatctcacctctgcaaaagattgaagagctggaggcttctgtatatcaggaaagaggatctgggtaggtatcttacctgatagggacaggggtattaaaatagaaagaggcgagaagatgggttttgtctctgaagcaagctgttgtcaggctttttatcttagggggaagaagttataggctcctggggcagagcagcccagacaagactggagatggaaggctcattcaacaagcaacctcctagaggtcaccaagagggaagaaggggtgaccacagggtgggctgggcagtgcagtctgaatcctgaggaattttcctggccaggggagggaacgtgtttcaaggcaaggagggccagaaaggccggtgtacggtcagaaggaactgcttcaccaaggtgctcttgcctggaattaacactctgaggtttctcgcagatcttaggctagtcaagggtttcctgattaggctacaaatgtgaatcattcagtcagtataaaatacaatctataacaggttgacgggaagaagaaaggatgggaaggcagtgtgatgtcatgggaagaactaaggctttgcagccagacttaactgtgtgaccttgggcaagttacttaacccctctgagcttcagtcccttcatttataatatgggcataatactatctacctaaaaaggttttagtgatgattcagtgagaaacatatttgaagcaacaagcacagtaactggaagctgtaggtactcaataattgtcagtttccttcctcttctaaaagctgtgctttcaagtcaattgtatgtctagagtcgcactgtctggtacagtggccagtactagccacatatggctctcaagtactttaaagagggctagtctgaattgatatgtgtcatacatgtaaaatactttaaagagggctcatctgaattgatatatgccatacatgtaaaatacaaatcagatttctaaaactttgtaccaaaaaataccataaaataacttactaataatttgagtgattacatgttacaataatattttggatatattgagttaaaatataagattaaaattaattccacctgtttctttatatttgattcaacatggctactggaaaatttaaaattacaatgcggcttacattttattctattggacagtgctgatctagatactagaaaagacaaggttgggaagctgtgttccagaagcatgtttgtttctataccttgagtttgggttttggtttgttctcccatggtttcccagtaaaagacccttttgaaaaaaataccatccagggctcaaccaaaacgggtagaagatacctacatgcccctagtagtcaggtgttgtggtgaccacagtccaggaaaaagtaggtagggctggtatatcagagaatggagatgtcaggtaggacagtcaggacagctggggatggactgttcttttcttagcctgaagcttctcttcagatttctctacctttctttactctgggaagatgatcccattttctattatttcagaagattcccccaccttatacatgaacttggcaagaagcaggctcccaccaggcagtaacaaacacaggtgcaagagaaaatgccacttcaaagccatctttagaaaaccccagagtttccagagaaatgaacagcagacattcacagacataagaatgttttttttttcccccgcccaaggagtgtggttagtggttgtttttaaaactgtacattttactgtacattttttttctagcaaaggagaagattggcatttatattctgaccacagggatgctgctttccaaaactccaagtcagaaacatgacaaacacaagagcaagtacatatcatgtcacgatagaactcggaaccgctgatgagaatagacagtcagttggttccttccactgttcaccaccttccctctgtgtgtctgaatccaaaggccaaaaagaaagctggtgtttgagaccacttccacaatggctatagtttgaaaggatgaatgagaaagatgaggagggagaaaagagaagaggaaaaaacaggaagggaaaagagaaagggtggaagagatttcctttcaagttgcccaattctgtgggtgcttctgtgaccatagaaaggatgtgcttcagccctgggactggcctcgaaaattattataacttgaggtctcaggagggactggcctgatctgttaatgaccttgtcaggaccagaaagggactgggaaaggcagagagtaaaaggagaaaaaaaaagaaggatgaagagaagagaggggagggaggagagtgaggaaggaggaaggcctgggatttggaggctctgggactagagccgaaggtaattcttcatagacagttgcaaatccctccttgtgtgttccagagtggggttgggggccagcagctcgggtccaggtctgaggccattggaactttttggtccagaatggtcttgcctgtatgctttgtaggctgcgtggttggcaagtggaagaaggaagaacaaaagagagaaaatagaggtctatggaaggagttgggagaggaaagaatgagttggagagactgagggagaggtagtgaattgctgatgagtagacatgggacagggatgccggggaaagtcattccaatctgtctacagcaggttctccgtgggcacatctcctcttccccttctcttgccactgtctggcagggaggggttatccctagatggaaaggagtctatgcacccctcccattccaccctgtaatttccaaggatggaccctcctcaagaaaccaagagcaggcatccccccatcccaccctgagccactttcttaaggaacaaacatgggacagcctttggacacagaaaagccctaggcagagtgaagacagggtcatggatcccaaataccactgccaggaggcaggtggccttggcttctaccctgacctggtcatgaactcactgtgtgaccctcggcaattcctttatgctctctggaagggagagggagggttaaagatgggatgattgcaaacacctccccaagcttcaaaagcctatgattctaaaaagattcagctttccccctccaaggcttctagaattctctgtgtccagtaaaaaggaggggcactgctgtaaccagcttgtgcttctggtgtcactaagcaaaaaagcctaacatctagagtcatgaataattaataggcctatagaactggaaagggactggagacctagtacaatcccagtatttttgcaaattgagaaattcaggtcccaacagataaaagggtcttgccccagttattcagctggctattcatgtgactgtggagcccagacacagaacttcggactccaagtccactgctgtttctgccacccctgctgctttccttaagagaagccctcctggcctgccacatgctcaagggggactttccatgccagcttcccagaaagagtggcaacaagcccaaagcaactccagaagttaagatcccttgtgccctatagcatgaagccctcctccctccccacacgtaagaacccaggaaattacccttctggtttaagcttctgtgatgggtgtggcatgtcatgtttgagaagcaaaggaaactaggtcaggtatcgggggtcagtcactcaccccttccagtgtcgggtgtggggtggttgggagtaatgagagctctgagcagggaaccccacagtcttcccccaaacaagtgtggaaacagaataattccctcctcttgtcaattggcaacaattacccactaccagggctgctgggaacacacattcatatgtacgattaactctcgattattcgtgtgaatgaagaggaggagtctgggaaatggaaaaaaaataaattaagaaataaaaacaacactagacccataagcaatccaaagccgcttgcttgtaggctacatttgtgattagaaaggcggagtctcgcctttccaaacactcagggctcagtccggcatttgagcgagtccacattccctgagcacaccccggccgggtggtggggaggtgatgtgggtgttgcggggtagggggggacacgaggccattgacagggagacgaaactgtccctggatgtaaacatcaccatggaaactccacaaacacttgccagtgagattctttccccttctcccaccctgcgcacaggaaagggagcatgcccacccccacctagaccgtgctctccatcacccattcggagctgccaaaagtcccccgggcccccaccaggtcactctcctcaaagggcaagagcatgccgttgacagagaggctgcgcttcgtccagatgttcgagaccttccgaggaggactgtagccgcccggcacgacccctcccgccgccgcagcagcaaagtcccccatgtcgaaggagtggctgcgtttggccttgccctccaacggcaaggggagcaggctcctggcccgggccgcagggggccccagcagtggctctcggtccgagtggtggccccgggccgacgtcccagcccctctcccggctggagtcctggagtccagcagctcctcctttctctgactcttgaggtccagggaggcgaaggcccccatcaggcggtcaaggctgggcttggggcgcggggcggagggtgggatcctccagggggcccgtcccagccccgcagcctccccactgcccagggagctggaggaagaggagtcactggcgcgggccaggctggcggtgaagtccaggagctcgttgcgcaccaccaccttcggcgggccctgcggcggggccccggctggtgcgctgcttggaggcggtggctgggcgccgttggtctgcgagtacacattgctcacggccgctgccatcttgctgggggcctcgtggttgcagaccttgtagcgcaccatgaggatgacgatgaagaccagcagcgtggccacgatgatgcccccgatgaccaggatcatggtgccgcccagaatctggctgtgcatggactggcactgcgggtagtcagccttggtgaagaactgggcgcagcccacgatgttggtggccgtgagtgtcgtggctgtgtcatcccacatggccagcacacacaagtcgtagccagtccctga

SEQ ID NO: 316 - DNA, 128258 bp, Homo sapiens
tgagcccactgcatgtctgtgtctccagatcctcagtgtcatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatctactctgtagcaggtcctgtgaaaacactttaggtggacaatcccttgaggtaagtggtatcccattttataggtgtgaaaactgaagcaaaaattcattttcctaagggcacatggatactttgtggtggagtcatatggggatcagaaaagcctttgaggcctttggagttagagggcagaaggcaaggcctgagccgctgtaagccttaggagtttaggaaggctccagaagacaaatggggtctgtagaggctgttaactcagccaggcttcttagagttgcatttcactaactgatatggtttggctctgcgtcctcacccaaatctcaccttgaattgtaataatccccaagtgtcaagggcgggaccagatggagataattgaatcataggggtggtttctctgatgctgttctcctgagagtgagtgagttctgatgagatccgacggttttataaggggcttccctcttcgctcggctctcattctctctcccgctaccctgtgaagaggagccttccaccacgactgcaagtttcctgaggctgccccagccgtgctgaactgtgagtcagttaaacctcttttctttataaattacccagtcttgggtatttcttcatagcagtgtgagagcagatgaatacactggccctgcctgggtttcagaaccagccttgaacctttcacagtggccagaggatggggaggcagaggcccaggttgcacacttcttgcctgagtgttggggactatctgacccaaaacaggtgcacagagggcaggagaggatgttcccaaaggaaaattagagtttagaatcaaaagaaggggaaggtgcgtgtttgggaggtaaatagcaaatactcttcataggttcactagagtcttgctactccaagtacgatccctgggccagcagaatgggcacagctggagctgattggataggtcccatgagcctcaggccccacccaggctcaatgagtcagagtctgcgtcttaagaagaccccctggtgatctgtgcacattcaagcatgctgccgttttccaaagcacttgcaacactcaggatgcttgcacggtcatgttgccaccatccaacctgcagaccccattcttgagattgactgggagttcctatcatgtcctccatagcaaggggatctagaccagaatcaagccttggatctagttctcaagtctcttttgtctctttcagtttaggaacagtttgtcaactttccttcacttttgtgaccttgatacttgagtttgaaggctgtctctcaatttgtgttctgcccagtgcatcctatcagaaggcatgtgatttcaacttctcccataccaacaacgttcactttgatcacttgattaaaggggtgtctgctaggcttctccacagccaagttactattttccctccctttataattaataagcattttgtaagtgggtactttgaaactatgtaaattgtaaactttccatttatgcattttaaaattttgattgatgtaaacttgtgaattcccattgtatccttacaaccctttattattgtgattaattctgatgctcagcttgtccctgatttggccagtgggaaccccgtcgagctggcttctgcatccttttgatatgtcctcatcatcctttgagggctgaaacaaccaagagtttcaggctcattttttgttttgtttttttttttttgagacagaatctcattctgtggcccaggctggagtgcaatggcgcgatctcggctcactgcaacctctgcctcccaggttcaagcgattgccttgcctcagcctcccaagtagttgggattaacagtgcccaccaccacacctggctaatttttgtatttttagtaaagacagtgtttcaccatattggccagactggttgtgaactctaggcctcaagtgatctgcctgcttcggcctcccaaagtgttgggattacaggtgtgacccaccgcacctggtgtcacaggttcatcttgtattttcccatctcagccctggaatccgatgtttctccagagaatctgggttcctcttagtggaaaatggtatttagaagccaaggttttggtgataagtatgctctttgcttgtggaacatctctgctcccaggctctctcagtgaacagagttagggagtgtgtgtgtgtgtgcgcgcgcgcgcgcgcatgtgcatacatatacacctaagtacacatgagtttactctgataacatccatttccaatccagcatcacagagttgatcctaggttcttccctcttctctaattgtgagaaacctggcttccattacccttaggttatttactcatttgattaaccgcctgcaggtaagtaatctcccatctacactgccacgccttctcctgtatggacgtcctgcctaccctgctcaggctctaactcccaagtccagctttccctgagtctgcagctgtcttcctcacactcccgtggcccaccacaacttccccccacctccttgtcactgtggtcccctaatggcgttaggcctgaatgaagaagggggaaggatgaagaggacattggtagcttgccttaactccccaggtaattctaatgtgcagtgattgacagccactaagatacatcacctgactttgtgagttcaccattcggtctgcaatgggttttggtaactcagtggctctgtatgccgtgctgaaggggaaaagggcaaagtgcaaaggcaggagggatggagaaaatatagcagctgccatttatttgtgtttttcctacagcggtggttctccaccctggttgcccatgctggagctttaacaaaagccaatgtggacccattgcccagagactctgatcccatgggtctgttttgtttaaaatgctcttcaaggcattgtgaggccaggaaaacaaagaaccaaggctctcccgggtgcggtggctcacgcctgtaatcccagcactttgggaggccgcggagggcagatcacgaggtcaggagatcgagaccattctggccaacatggcaaaaccctgcctctactaaaaatacaaaaattagctgggcatggtagtgcgtgcctgtagttccagctacttgggaggttgaggcaggagaatcgcttgaatccgggaggcagaggttgcagtgagccgagattgagccaccgcactccagcctggtgacagagcgatactctgtctcaaaaaaaaaaaaaaaaaacccaaggctctcgaggcatgcatgctgttcagcgagccctgccctgcattgcgaaagggtagagatttgtttatttgtcagtattgaaagcatggcttgcaaagttttcctgttaagagtcagatagtaaatatttgggacttcgtgggccttataggctctgctgcaattacttaactctgctgttacagtgtgagagcagctgtagactatagtaacgtacagccggtgtggctgtcttctaagaaagtattatttacaaaaacaggcaggttgctagatttgacctgagggtgtagtttgcagagccttggtaaaggttttcaaatttgcattttaagccctccaatttcaagttatgctattggtggggaattttaattaaacagaaaataatcaccaatattggctcaaatatttcctgatttaaaaaaaaatctgctcttgttcctataaatagtatataagatgtaatcttgccctgggttaaaccagtctacagaggtagatctcgcatttgcttttgttttcttctacttcaactcttgtcatgatcccaaattaaacaactagcaacagaaatgttcaaatctgtcaaatccaagtgttaacagacctgggaccaggggttcctcatagtggcttagcacagcatacagaccactttcctttggcccaaccggccttggggtctggagcaccaaacaggccctgaggaagcgtgcaaggaactggaatgcggggaaagtgatgaaatattttgttggttggcctttgcttgtttgcaaaatatatccaatgctcacacctgagagacaacagacatccttatttgtgaatagtctgcactagataattcagatttcaagtcatctgtcattcgtacttgataatgatttgttcttcatttaaagtggcctgggtacagagcaacatcccctgtctttatcacatgagctctgcctgaggcagcttcagcaggtaggcaggcaggcagatggagcacagcccattctctgctggtgcactaggaacagcagcacgtgtggtgttagcagctaataattaaaacaacgtttaagcagtgggttgagatttttaaacacaaaccaactcaaaaacacttctctgctttctatgtaatagtgctcacatcatttgtatgattgtctcgtctctttaaaattggaaatattcttgtttccccaaactgctaataagctctactgacccatgctaaaaataaagctctttcggctgggcgcagtggctcatgactgtaatctcagcactttggaaggctgaggtgggtggatcacttgaggttaggagttcaacatcagcctgggcaacatagtgaaacaccatctctatcccaaataccaaattagccaggcacagtggcaagtgcctgtagtcccagctactcaggaggctgaggcagcagaatcactggaacctgggaggcggaagttgcagtgagccaaaatcgcgctactgcactccagcctgggcaacagagcaagactcgatctccaaacaaacaaacaaaacaaaacaaaacaacaagaaaaacagaacgtggtggctcatgcctgtaatcccagcactttgggaggccaaggtgggtgaatcaccttaggtcaggagttcaagaccagcctggccaacatggtggaacccccatatctactaaaaataacaaaattagccgagtgtggtggcacatgtctataatcccagctacttgggaggctgaggcaggagaatcacttgaacccaggagatggaggttgcagtgagccaagatcacaccgctgcactccaggctgggcaacaagagcgaaactccatctcaaaaaaaagagagaaaagaaaagctttatttgtgttgattccattattccactattgcacagaagccctgcactgtgcttggaatcagcttgatcttgagtttgtctggttttcacaggcctcctcttcctgacagtaaacttgaaaatatttttatgtgggcacttgggttttgaaggactccttgggcctcaatccccggtgtcctaactctgagctacagagctgactagaaatcctgtaagaagaccaccatgtggaggaaaccctccaaagcacacaaatcatccatctcagaaggaacacgacttggaaaggggaaggacatggtggtgtgcccattgattgactcattcagtgatgcctaccgggtgcctatcatgccaagctctgctaattggcaggtctgcagagtgctggaagaactcacctcctcagggagaaaacagacaaaaacaagtaaataatgggaatgtcacagcaagggcacatccaggcctgggttgaagacgctactttatggtggctcacacctgtaatcccagcactttgggaggctgaggcgggcggatcacctgaggtcgggagttcaagaccaacctgaccaacatgacaaaaacacgcctctactaaaaatacaaaaattagccgggtgcagtggtgggcgcctataatcccagctagtctcgaggctgagacatgagaatagcttgaacccgggaggcggaggttgcagagcctagatagcgccattgaactgtagcctgggcaacagagcacgactccgtctcaaaaaataaataaataaataaataaataaataaaaaacaacacgctactttagagaactctctgaggatagatctcaacagccaaccattgtccaaacaactgtgcaagggcaggaagactgaagctggttgaacacttttgctttacctggacctgattttttttttcctccatgcagaaaagaaaaagataagtgcctatttttgatttgctaatgcagcttttctttatttgtactaaggctgcataatgtaggctttgtaaagtccacgggcctgaaagcacgatacatttctaatggaaacactcccatgcatgattgtacaacaggaaagcgataaattaccgtgattttgtactccctgcagctattagttcggccctccttcaggaatgttgctttcggttatagaaattctacaaatattggttcatcagaaagacaaatattaaatgaaaattatgctcaaggacatgagaaaaagtgtgcagagtacacacattgcagacttgagaaagaaattgtcctcagaacaatttgcaatacaaagcttgcttaataatttactggaactggtaaactcagcgattatgccaggcactggatcttcaattaagtgtaagaaaataggcttacagtgtaagatgtctggaaactgggagcacttctattaatgtgaatgtgagggtttttttttttaattagaatattcttacagtttcaattccaatttgacttttaactgactttaaaccgattgcttccatttcctattcataggaagtaaatgattttagtcagagtcctagccatgcaacttatcaagttgattctgggcaaattcactgctgtgaccctaggtttctcacggtgaattctcattgcaaaagggctgcctgacccatagcagtaggtgcagtgtttagaacgcacagaactgactacagacggcttgatttactgtgacaggattatgctaggtctggggacacataatgagaccaagaactggtccctgtggagttcagaatctgtgtggaagatagtgtgatacctgctctgctcaagcagccgtggaagccctggaaagggaacaatatgctgggtgaggggcccaagaggcagaggtgacactgacggtatctcagcattctcgaaaaagggtgcaggtgctgaaggcagcctgtccgtgaggtgggtgggccccagccatctagggggatgtaaaatgctctgatacagatagaacctccttcattttaggtgtcaatttaccacacacccaagctctaccttctaatttttgccaactttattccacagaagtctcaaattatctgcttgtccttaaaacagataagcactgacttttgtcagttgtctacatacaacctataggccatttaacaaggaaattctagccataacagaggtccctgcctaagttttaatttataattctaagactgaagtcttttgaaatggcttaaagcacttgtgcaaacatttgacaagataaaaatgaaggtgccagttgggtgcagggcctcgtgcctgtaatcccaacattttgggaggccaaggtgggcaaactgcttgagcccaggagttcaagaccagcctgggcaaccggacaaaactctgtttcttcaaaatacaaaaaattagctggccgtggtggcatgcacctgtagtctcagttacttgggagtctgaggtgggaggatcacctgagactgggaggtcaagactgcaatgagccgtgatcacgccactgctctacaggccgggcaacagagtgagactgtttgtttaaaaaagaaaaaaaaaaagcagcagcagcccacagatatttacagtatactttattcaaagcatttcagttaaaattattttgggttcaaatacatgaacatataattatatataaaatactatagttctcaatagtttacagtgacatcttttttagaattagctgcttataatttgagtgtaaatgtattacagaaagctgctaaattgtttatatttctacttatttcaatttagctattagatatttagaacactcataagcccacctacagtatagttattatactttaaatatttatattcaataggggaatcaatacaatacaaaagatatttgaacagctagtcctttgtaacacccccccgctgctgccgagagggctagataagggggtcttacctatttcctctgtaccacactcacattttaccagagtccatatacagggccagtgtggagtcacttcatgcaaatgagatggtactttcagtttccccaaaaagatgactgcgaaatccagattacaccccaacgttatgcctcaccttggagacctattctaatgaatgtcaattagtgaatgttgactaacttgtggttagcatgactgcaaaaaaatgaggcctgcttcagtgcaatcactaaagacaggagtgaggctcttggccaggcgtggtggctcacacctgtaatcccagcactttgggaggctgaagcgagcgcagggggaggatcacttggggccaggagttcgagaccaacctggccaacatggtgaaactccgtctttaccatacaaaaattagctgaacatggtggtgcaagcctgtaatctcagctacgtgggaggctgaggcacaagaatcacttgaacccaggaggcggaggttgcagtgagctgagattgcgccactgcactctggcttaagcaacagagcaagactatctcaaaaaaaaaaaaaaaaaaaaagatgcttttggcaaacctgtaacatgtgcaggtcctgcatctgggcagtgctcaagggaaagccgcactatgtccactgggccaagactcaacgttggccatgccccctgcttccttaaatctaacgccacaaaaagagttgaagtaaaagcctggccaataccatgatgacatctacttcctggcttcccgccatcaaccctccctcacaccatctgcgggcaggtagcagatgcaggagagagagttccacaagacagaaggtcaacagcacaagttgcaagaggcccgcctacgtccccaaggcaaggtctcccctgatgtgaacagtgtgacccaagttggcactgaaactggaacagtagggagtcaccaaattcaaatgaacaaggaataccccaaaatggggagagttctcaaaacattttcaacatttcggtaattaattacctcatctccagttaggtcaatattccatattattaagacaccttttataatggcaaactctcctgactacctatcttagaatttttttgaagtcactacttacagtgtagatattaacaggcatgagattcaatatagggatcacttttatttcaaacaattaaatacaaaccaatattttaccccttcatagatgaaatcacatcttttcaggatatgagtataaagtaacaagcctagggcagagcttgtactgacaaagtcctgaaactacaatgagaggaaacacattgctctacttcgggataagtcatgaccgagactcaatttcagagacgctctatgaacagaggtgcttgaagccacagtggcagaagggaaagatggggaagtgtgccgaagagcctccaggcatgacagacagtcccctgaccaagcacaagtaacaggccctttgggtctctgcttctcactggaaaatgatgaagcctagatctgatgactcctagtgccaacatttaacaaagttcgaaagttatgcaggacttcacacatgtacggaatggctgtatcacagaatattatgcgttagaaagttcacggtcactatacctagctctaaaatttttcagagaaacagcagactaataagtgaatcttaaataaaggaataacattttaatgaaataaatgaaacagagcagggaaaccaaagagccaattaggggaagaatcctgaaaaagtatggcttcacacagcagcagcattgaagaaaacactatcgatttttcccagagaaaaaaactccaaaaatgtccaataaccaagtgcacagagttatggtcaataagactttgaacatgcatcacacatacataagtacataaagaaaattttcatttatttttccctcagatatacttcaaaataacatgtagacacagaatcacaaatatatacaaaacaaagtatcgcctggttatttcaagaagagttttccctcaattttcttagctgctgtgcataaaattcaaagctttcctgttaaggagaaaaaaagagggaagttagagataccagcaagaggtgatggtacataacttaaaaaatcataaaacactaccaactggtagctaagactgccaggcccatggaagatgctgcccctcaagcttcagtactccttccttgtttcatgaaatcacaagttcaagggcctcgggttcagagttaaagctagcagcaggaggtagggtgcgtgtgtgtatacgtgtgtatgtgcaagcatgtgtgtgtgcacatatggaggtatgggtatggaaggctgaggtgtttgaaataaacacggtgtattgactcagttcaatgacataacaaaaaggaattgtgcatatgtgatttctcttattaaagaaaacatgccgggcacagtggctcacgcctgtaatcccggcactttgggaggccgaggtgggcggatcacgaggtcagcagttcaagaccagcgtggccaacatggtgaaaccccatctgtactaaaaatacgaaaatgtgccaggcatggtggcaggcccctgtaatcccagctacttgggaggctgaggcaggagaatcgcttggacctgggaggcggaggttgcagtgagccgagaccgtgccattgcactccagcctgggcaacacagcgagactccatctcaaaaaaaaaaaaaaaaaaaaaaaaaggcaaaatttcctagacgaagaaataaaaaccaacttatgtaaatgaacaagtaattaccactgacataatatgcttggctgttgaactacaggccattaaatcctatttcaagttgaaatgagagaactgccccaaggacatttggtaaatccatgcctatagctgaaggtctgagacagaccttgtattttaaactgtggccccagagagctatgttctccgactgccgcagccaaggcatgctgctcagtccctcaagccatcccctgagggctcttcacagagatctaatcctcatgtaattaagtcttcaacttattttcttacacattgttatgaagtgcacataaatctgcagaggtattttttccccttaattaagaaatactcacagggggttcaatgaaagggacaggctctccagcatacttcagcaaagatgcgtaacgctttagaaacagatcatccaattttgtattctttgcagtcaaatgttcatacagtgctttagcagatgtgacatctttctctgagactgacataaagaaaaaaatatattaatcagagataaagacaacctatcttactcttttcaccaaaacagccactcagggacggctggatccctttatcccacggcaaatgaacacttaactactttcagtaagaagccacattcagaatctaccatctccctcacttctctacatccctcattcggcatcactcactttgaaggagaagaaaatgacaaatatggctacatttaaaggactttagaataatattgataccattcacttaggttattacattatttaagacctatgatagttcaagtgaccacaaactgaagtcctcagttataaaataatacacaccattcaatcccctttggcttaaaaccactgtgaaatcaagataatccaggaactgttgtggagagggacatgtcaattatgtagaaatctacatcaacatcaagatcatcagctcaacatcaaaaaagcttttcatttttctattgtaaaataaacaaatatggaaagtatagttagctacaatgatacacacacacaaaaaacctataggccgggcgcagtggctcacgcctgtaatcccagcactttgggaggccgaggtaggcggatcacgaggttaggagatcgagaccatcctggctaacatggtgaaaccctgtctctactaaaaatacaaaaaattagccgggcgtggtggcgggtgtctgtagtcccagctacttgggaggcggaggcaggacaatggtgtgaacccgggaggtggagcttgcagtgagccgagatggtgccactgcactccagcctgggcaacaagagcgagacaccatctcaaaaaacaaacaaaagcaaaacctataaggagacattaacaagttacactagtttcacttaagtgaatgatgaaatatgttaggagccaaatttggctggctctctacttgtggctgatttgtggaaattttttagtttaccatggagatggtaagggctctgctaacaattactgctggtaattcaactccttaattttgcattagattgttagcatctaagcatcacataaacccctgccctacactgactctgatattgtcaaccgcaactccggcagcaccaggggaacccctaagacagaggtgagacgttcagcaatcaaagagtctcccaaagtggaatgagggtgactcatcagctcttagtggagttggaacacatctttgctgtttccatgaagtcaacttcttgtgtaaatcctttatttcccttcctgaggagctgaaccctttaagggctcaagctctatcttctaggaagctgctccgaaaattctggcatcttgcctttctttacttcttgattttctaccttcctcccaaaatggattacctaatttagtagtaacacacacagatttatgcgcttgacactatttcacattacaggcataccttggctttaatgcactttacagatgttgcgttatttacaaattgaaggtttatggtaaccctgccttgggcaagtctatcaatgccatttttccaacaatatgtgcttactttgtgtctctgtgtcacattttggtaattcctggaatatttcaacctttttcattattgttatatctgttacggtgatctgtgaccagtgatctttgatgttactattgtaattgggggatgctatgaaccatacacatggaagatggcaaacttgagaaacgtgttctgactgcgatgctgactagtaattctcctgtcttcctctactcaggcctccctattctgagacacaacaatattgaaattaggccaattaaaaaccctattatagcctctaagtgttcaagtgaaagagtcatacatctctcatttaaatcagaagcgagaaatgaaatgattaagcttagcttagtgaggaaggcatgtcaaaagccgagatacgctgaaagctaggcttcttgcgtggaacagccagttgtgaatgcaaaggaaaagtccttgaaggaaattaaaaaggtgctacttcactgaacacacaaatgataagaaactgacacagccttactagtgacatggagaaagttttattggtccggatagaagatcaaaccagccacaacattcccttaaaagccaaagcctaatccagtgcaaggccctaatactagcagaggctggttcatgaggtttaaggaaagaagccatctccatgacacgaaagtccaaggtgaagcagcaaatgctgatgcagaagctacggcaggttatccagaaaatctagctaagaccactgatgaaggcggctacactaaacaacagatactccatgtagataaaacagtcttatattagaagatgtcatcaaagatttcatagctagagaggaaaagctaatgcctagcttcaaaggacaggctgactctattttcaatggctaatgcagctggtgactttatgttgatgccaatgctcacttaccattcccaaatcctagggcccttaagaattacgctaaatttattctgcctgtgttctataaatggaacaacaaagcctagaggacagcatggatgtttatacatggttcactgagtatttaaagcctgctgtagagacctactgctcaggaaaaaaaagattcctttcaaaatattactgctcagtgataatgcacctggtcacccaagagctctgaaggagatatacagggagattaatgttgttctcaggtgccctaataaaacatccattctgcagcccatagatcaaggagtaatcttgactttcaagtcttaacacattttgggctcacttcggcaacacatatactgaaattggaatgatacagagaagattagcatggcccctgcacaaagatgacacgcaaatgtgtaaagcgttccatgttttaaacataaaattaaaaaaaaaaaacatgtttcataaggctatagctgacacagacagtgattcttctgatggatctgggcaaagtaaactgaaaaccttctgggaagggttcaccatttctagatgccattaagaacatctgtaattgataggaggtcaaattatcaacattaacaggagtttgggagaagctgatttcaaccctcatggatgaaccccttgagggtctcaagatttctgtggaggaaatcactgcagatgtggaaatagcaagacaactagaaggagaagtggagcgtgaagacgtgactgaattgctacaatctcatgatcagacttaacatgaggagaagctgtttcctatggatgaccaaagaaagtggtttcttgagaaggaatctactcttggtaaagatgctgtgaacactgttgagatgacaacaaaggattcagaatatgacataaatttagttaataaagcagtggtatggtttgagaagattgattccaattttgaaaagacattcaattgcagataaaatgctaacaaacaacatcgcatactacagagaactctttcgtgaaaggaaaagtcagctgatgtggcaaactttattgttgtcttaagacatctcaacctttagcaatcatcaccctgatcattcagcagccatcaacattgagccaagaccttctaccagcaagattatgactcactgaaggcacagatgatcgttaactatttttagcaatatcttaaaattaaggtatgtactttttaaaaacataatgctattgcacacttaatacactacactatggtgtaaacataacttttatatgcactgggaaaccaaaaaattcatgtaactttgttcattatatttgctttattgtggtggtctggaaccatatcttccaggtatgcctgtgtttagttactggaaatttgataaattttatgactattagctctattttgaaataatacagaatgttctccctgtaaggacggaaaaagagaactgacttactaattctgattcttgagtctgttgtcctcccatagataaaatcaatgaagcaattctttatttaccccatgcctccagtgagcaaatcagtgggccacagatggagaggtgatcatgattgagaaatgctaacatttattttgatgactgaggaaactttagacaatttcctttcatatgtgattgtctggcaatcagggaacaaactggttaaaagaccagaatttgaactgggacgtaaaaaccttgggctactttttaatcaagggtctgtcatttcaaaggagtagcaggcaagcagagagggtactgaaggagcaagaaggccagttaagtgagtctcaaatgtgtacttgtttcaggtggcaggcccttggggagactgaactggtttctgatatataagtccaagaggatttccaggtcttcccaggagcctgggattctactcaatatacccggactgctcggaagatgttcagtgatactttttaatgttaaagttatatgcataatttcatatttttcttaatagtttaaaaacatattccagaactgagttatttatatcataattatctgatatttaggattactgcctttgagctgaagactaagacttagttcactatactacaagtcatttacatgatatagtcacttaaataataaagccatttaaataaataatatagtcaaattaaacttatattaccatagcttttcatgagggaattgtatgcttcttccttttcatttaattcaggaatcaattctaacacagatttcacagttgatgcctaggaaattacataaaggtaatattatgaaaaccgcaaattaacagtgaattagaacactgacaaatcaacactatattaaaaattttcacaataattataacagaactacctattaaatttaatgcactattgtcccttgtatattagcatttgatattgactcaataatctacagctaaaagaaaccagcatttttccacaggttaatgcaattccacttacatttctatgaatatttttctagaatatgataaacacattgcttcttttgtcaagtggtgaccataccaagaagttatgagatcccaagggtagagagataacaaccctatctttaggtgccacaactggttgatgaaattgtaaagaattcagttaaaacattctgaagtgttacacacttgacatacaaaaaagagcatttccagaatctcactgaaatttttacttatttcttccaggaatatgcagactcggctatggctttatttcctgtagcgagtgaatacagaactgctatgccgtaatgaatatctgctgagtatttcccgccctactccaacgttactggataaacccatgatggatatataaacatctatgccctcttcccatctcaccaagaggagcaaaatctggcttaactattctactgtcaagcaatggaacactgttaacaggcatcttaaaaatcctaactcctttctatagcatgtttattcagtcaatccacacctggacctgcatcctcccagggcttcttctattttaaactgtcctgggtgggatgttctaagcagacatattgccgtgcatttcccgtcccatctcctggacaaggcaacagggacttggcacagtcccacaggtggactgacaagtgcttttcagattccttatactttttaatcacacgtataaaaacacagcctctctgaaaggaaagaaggggcaattaaatattttctaaaagttgttggtagtaaataaatacatgagtcacagatgcaatgaagcaaattttttaaaagtgtaggtatatctaggggaagggtgtagaaattcaggaaaacgtagacctcccaaactggacacagcctaaatgtttcaaataaaacaagcatcacagttggcatgtggtttgaaacttcataaagaacccaaataaactaagaatgtagtttctcgtatacaagaggtaaaatccgatctaagagaaatttaattttatacttacagttaaacatcaaagtagaatgtgatatacctactatgtacccacagaaatttttttttaaaaaattttttcaaaaggacttggttctattacatacccacccaccccttttacagtgtaaataaagtaactgcacaaattagaattaatttgtggctccatatcaatttgaaagccaagtggctcatttacctgatggtttatacctgataaatgctcaaaagtagccacgtgctaggagacactctggagtgtacattttccttggtagtgcttctgcattgttaaatgtcccaaggtgaccgaagcaacataattttaatcttccatttctttctttctttctttctttctttttttttttttttttttttgtaaagaccaggtttcgccatgctggccaggctggtctcaaactctgaaactcctgacctcaagtgatccacccgcctcggcctcccaaagtgctgggattacaggtgtgagccaccatgcccagcctaatcttgcattttttaagggccttttcttggggctctcaatgcatacctgtgtaagtggaaaattcctgcgtgaacttgttttacatttccagtacagctaacagacgacaaaactgactctaagtagagacaagcaaagtcttgaatctctatagtattctcaaataaggtcctgaaacaacaggcttttatgttaaattcaatacttctgagcaaggcacgtacagtatcattgatttgtaagcaggtaaagcacagtacctttccttgtttcctagaattcctaaggaggaacaacaacaaaatcggggtttgttcagcaattgcaccacatctctaaaaattaaaacattattcagtaagtgaaggtttctgataaacaagtggatcaaactgaatatttccaattaagaaagttcacaataatacagtagtgtattattaccaataggaaggcctaatagtcgactattattttttaaggcaagaaaaaagaaaacaagtgcaagctatgccaagctttggtgaatgctgtccttggcattgcaagtataaagtttgtttaaaaagaaaagggaaaaattaaactaatgcttcaacaaccacagaataaggtttaggactgcaaagaaagaggaaaaaaagaaacattattcctctccaattatactgccaagcattcacaagtgagctagggatcataaggttaattatacatttaataaggtgtcagggagataactgctcatttctttataaaaattaaaatgtacaaagcaagttctctttaaagtataattacctacacttatgcatacaaaaggactgatttcaatctctctattttataaaaggctttcactgcaacagacagccagcgcttgagaaagagaccaaagttaaactaaaaaaaaaagtttacatgacagaccagataaatcaaatgtctatccaatcttagatgctatagtaaaatcaaatatggcaagacaatattttagtttacactcatcacagatgtcattcttttaagtttctaaaagaacactgctctttcaaagctttaaaacactgtcaatactaaaacgaatggtataaaaagaactttttggggccacacagaacatttacattacgcactgatgtttttgacatctgtgaataaagtattcttcgctacggcaagaataatcttttactgtttgacaagcaggtaaaggatgggtgaagggtttatcatctgaaaccccagtctagtgatgagatggtaaatgaaaagactctgctgttgcatcaacactcagctaccaccaagagcccttcagtgaggtcactgcagataacgcagttctttctgagggagcaggcgccatccctgctgccacccacccaggcggctgtcaattgtgctcttccagaaaaaccttgattatggcagagaacaagctagtagatgaagtaccaagtgccactttctaaagaactatcaaaaggatgtgttaaaactgattgcataccatcatgtgtataattagatatgtatatgcttattatacccctagtaggtacttagacatgtacatatgaagataaagcatgagtatcttccttcttttttttttcaccacgtaagatagcaagataaaacaattttaaaagtcctgaaatccctatcataaactgccttttccttaaaattaaaaaaaaaaaaaaaaacaaaggaaaaaaagtaaacaagcaaagcaaaacaagaaaattcccagtgaaccggaatttcccttctccagcaacaaaagtaagagtctgagaagcagtgctaattcaccctttataaaactgttaacagagatacagtttttcaggtattccttttaaaaatggattggattctactgtcaaactagatgaacttgaagaataaaaactggaggtcaagcacatgggtagttttaccttccctatctactacttaagatctttcacagctggtaaaaatgtaagggaatataatactatttacgatcagaaattggtcccacgcctcaatttgacacagggagtctacacaaacacagccgttggcgggatcacggtgactgtttgactgccacctgctgggaaggggctccccggcggtgcctgtttgtgtacattgccagtggcagctaggatcacccactgttctgtcggcacttggcatagctttatatttagtgctgttaaaatggcatgaatgcagttgtctccttccctgaaggttgctaatttaactgagagtgcgggccacagagacctgcatttgtcatttaatgtgtctgtgacacacaagtgaatagaaagcatattcaactcttaataaaccttgaataaggcactgagaatgtttgagtattcaagtgagaagctgtacttgaaaagcaaacatttcctactttttgtttgcaaactgtgttgccatggtgacgcacagtatctagcgcatttgagaaattaaagtagaaaatcaaaggaattgttgttttgcattatctatctgcacagaaagatttgtctttaatcatttcagcgaaactcgctgccccatacctacccccgcaccacccgccgctccccgctacctcaattctaaagacatttctagtttgatctggcatctttaaaaccagtaacctaaaatctaccatccagtccttgtcctgcaaccgtgattcacactgaatgtaaacaagctagctgcacaccacactgaatttctagtattccaccacacgcctatgtctagtaatttctcaatttacttcttgcaagcctcgagccccactgctccatgagtggagggtcattacctgtaggagagctctggcatcatccaccttgcctgcatccacaagttgaaggaaaaaatcagtgacaggtttataaattgcaaactgattggccaatctctccgccatgatgcttactggaaaaatgacaggtaagaaaaatctttcattagaacagtggtataactcacctaccaaagaaatttggtctagtctcactagagagaaaatgtgcttgtgtgttctttagcacaaacaactaacttactcttttcaactgctggttccaactgctcctctattacttttctgaataagtatgccaagccgaagtattggggttcaatgactttattctctgaagtaagcatattttcaatgttttctattgcggcatctatgttattactgttaaaagcaaaataaattacttaaaaatttgcttttatgttaatattacaggcagtttagtctaagaacttacttttatatccactcatgctaatactttaggaaaaaaatgaaatacatttacacttaaccaaataaacactaggcaactgaaaccctgaatcacatttaagtagcaaaaacattcactagctggttcgtgctgcagtggttgtttattttgcttcacagcagttcaaatagttgcttgttttaacaatgctctacagacaagatcaaacaactatatacaggagaattaatgaagataacttttaaaattctgtatcttaaatatttaacttaatttttgccactctttggatataaaatgaaaacttgtataaatgctacaattttggctttatgatccacaacttgtcactactgcataaaaatagtatttaacatctcaggattcttaaagatactgatgatgtttcaaaaggcatatatgcatgtctctaacttatggtcgcctcaatttctttttgtcaggtattatacatttggaaaatactcagtttatactaaaaatctcaggaaaaagtatcttcacactttacattgaaaaaaatcagttacatggtcttatttagcaagttatggtaaaaattatctctatgactatctttttggttaaggtaatctataatggatactttactgttaccatatggcatactaaatccaatcagtcaatattgtgttgaaattattatattaaacataattctctaactaaaaatgaatactgttacaatatatttctcttacaagttttaaggaattacttaatagtgaatatgttctccgaatcatataaaactgtgtttatgtggtaaaactttaaaattcacccagttcttagatgagtaatttcttcaatcttctaatgtaaaacaatcacattttcttattaaagggaagttctatctggcgaaatagtttgaaaaggtcaaaacaaaacacaactgtttctcaaacaaacaaaaaaaaacccctacaaaaacaaacattatattttaatatcatgtcccattaaatgtatgcaagattactaaagaacattttttctaaaagcatactgaaagtatcaaattccataaagtactttgctagggagcttattaaaaatcaagtccttatttatttctacaggggtaattctcaaaaggaatctagagacagtggtaagaaaatcagctctaaatacctccctttttgtgggggtgggagagtgttcacggggtgggtaaggaatatgaatacggaaatgcacatttttaataagcttgcggggccttctgcttcacaatattctactagtgtccctatcaaatattactgacaaacaaatgagatcatttttcacttctgaacaaagtgtttcgacaacaagaggcctggcatatatacacaggaatgagaaaggttatcaactgtggagcaagatttatgaatttggtaaatgctgtttattctaagatttaaggtaaagaaaaaacatatttttcaacatataattattccctaatcagcaactagcatcaacatttcctctgcagttgataaggtttccacatgtctaaaaaagtttttaaaaggtggtatctgaggcaatgcccattctagtgaccaatgaaggaaaagaaggcttgcaaatactcacttctttatttgagccaaagcaatgttattgatgaaaaccatttttgaaagtccaatggagtcttcgagtccatttaacatcttctgaactacttctatgttttcaacatcacccttcatggccaatgcctggatgacacgggtcactgctaacctagaaggggtctgctgctgatccaatactgttttcagtgttgtcacagcctctaaaatacaagagcaggagatggcttttcttatatgacctgtgctgactttaatgcattttgaaaaccagcttttaaatatgagcaccaaatggccataaacaaaaagctatgaataattaattttagattacagaaaattattaatacttcatgagatacccccaaaaattatttacttgactatataagatattagaggcccgaggaatttcttctttaagtcacagagaaaatacaaatgttaccgacaatatgagttccatttagggataacattcagtgactaaagttggtaagttcaaatgaatacaaataagaaagattttctagagtttccaaaaatgtgtgacttctatccatgttcatacttgtccagattttaactcgaagattaaatgatcatcaaaacttaatatcccaacaattctttctcaaaaacactaaaaacattgatcctctaggatcaatgttccaaactgaaacattgaactttaacaccaacaaatttattttatgattagatgccttgtgattattttcctgcactaaattaaaaaataatgcctactgatttccacaaatacagacagtccctgacttacgatgggtttatggggtagttaatgcattttcaactttatcccgacttagccccatcggtaagttgaggagcatcagtataatcaatggagttttgtttgtatgtttttttgaagtatcacactttcaagtacttgattataaataactatggaatagccttctagctaactgactcataaaactgtagcaaaatcatgatatgaaataaagtggtagactgaggagtagcctaacaatcacccctaccattatcgaagaaaacttaatagctttatagcaactaaagcaatgtaacttagacaaaactaagactctccaaacagctttccaactaagaacagcttagttttacagaaaaatggggaaagtgtattaattgaagtgtactcaaaatacagtggaaagacatgatgaatttagtgttcattaatgaataaagaatttatgattatttgaaatctacaatcttaaaccactcattctcaaatgagaaaaaagaaaaacaggttaaaaagcatagtcaataaaaatttaaaaatacacatgcacatataggaaacaaaaaatgtttttatactatttaaaaatatttataataagcttgataaaattttgctaatgggtggtcatacacagataattataataatagtcttattaaccaagaatattgtcagctagggaggctcttcccacagtacatcaaaacaataataacaaaaataagattaatgatggtgatgacagtaactcaaacttattgagcatttactacatgccaggcacagcagtttaaacagctactgtcacaactacccttccgagacaagtaccaattttacagatgagacccctgggcacagagattagtttgcccaaggtaaaatcatatttttagacaagactcgaagattccaatgatcccagagcttccgtctatgagtgcgcgtgtgcacaagagagcagaagggtggggagaacagaccatttcacatctgtctaaagatagcacaggaccttgtgacctaaatcctattctcatataaggcttgccttctgtacagttaatgacttcagggacaccaaaaatgttacccatccacatccctccccccaggtcctttcccactgtcacctaattccaacatttactcaattactcactagtgatactaattacactgtacaagtgccacgtatcagctattaatattcaccaacagtaaaatttaatcggctttattttttctttctgctttagatggggttgagaaaaggaaacctaaaagaaaggcagaacaacggaagggaatttttaaaaatcaagagctctcatcagccatggagcaaaataagaagatgggaatagtgcaaacactactcctgtcctcactgatgatcattttactctaacaacaggtttgtggtgatgtgctcagggaggggggtggggtgggggtgggggaggtagtgcaggaacagtgcgctcgaggctcctgctctcaggcaacctccaattgagctgaacagctcagaagagtagatgagaaattataccatgtcctttcctgtagcttacacagggcacctaacataaaaataaagggtaccaatccagctgaagaaatctgggtcaggttcagctgaaaaatgaaccccctgaaattagaaaagtgttttgttcttatctccatgtctacagaaacaaaagctatttatgacaatgagcttatttatatggcgagcaagtttaacttttcattgttttaaaattgtttatcattttattacataaaatactaataggacataaagtcttttttgggggggccgggagaagggttttgttcttgcccaggctgagtgcagtggcaccatcatggctcatggcagcctcaacctcctgggcttaagcaattctcccacctctgcctcctgagtagctagaactacaggtgcacattaccatgcctggctatttaaaaattttttgtagagacaaggtctcgctacactgcccaggctggtcttgaactcctggactcaagcaatcctcctgccacagcctcccaaagtgctgggattacaggtgtgagccattgcgcctagccacaaaagtctgggcacaagaagtgttttctattcacttacatattcagtactaatcaattaggaagacagctaaagaccagtacatttaggtattataagcaacattaaagctgcacaattaaacaacaacttcctctcaaggatgtgaacttatgttataaacatgcaggccgggcgtggtggctcacgcctgtaatcccagcactttgggaggccgaggtgggagaattatttgaggccaggagttcgagaccagcctggccaacatggtgaaaccctgtctctactgaaaatacaaaaattagctgggcgtggtggcgggcgcctgtaatcccagctactcaggaggctgaggtgggagaatcgcttgaacccaggaggcggaggttgcagtgagccgcgatcccaccactgtactctagcctgggcaacagaatgagaccctatctcaaaaaaaacaaaaacaaaaaaaaaaaacaaaacaaaaaaaaacccaaaacaaaaccagaacatgcagtgaggaataataccattattacagagataggaagcaataaggttacatttccagagctttttcaacctttcttgaagatctcctaagtgggttttgttgtactggcaaaactgcagtatcactgtattcactcaaattcaaatgtaaatcttaaagtggaaagctacttagctaaatttaagagattcgtcatagtgccccttgggagatcattcataagacctccacatcccaattcatccccttcaaaactcataaacagcctctatcaaaccagtggcccccaccccaatcccaatcctccccaaagtcatgtccacatctttcaggtgtcattctcttaacattaatttgaaaactccaaacttcaaacaaacactgtattttattgctgttggtattatgaactattaaaaaagtattagattaagttttaaaaatcaatattataatcatttggtgcacaatcccacacatttaacactcaatttaactgatttggtatctcacacacaaccaacacaatatgcaagaaacaactgctgggaattgtttcagatgctctaaagtatgttaatttccaaagcaaaatgacttgtgctgtgaattttaacgcacttgaaagcctgtactttctctcgttctggaacacaaattttgcatgtctgaagagctgtgattcatcttaagaaaacccatcttgtgttaaatggaatggaaactggactaagtggtcaaatgacaagtacattcatattcaagctgtattataaatgcatgtacagtaatttatgtctctcagctaccacaaaaggctcttgataagcaggtaatttgctaaatggactcctttatccaagtattcgaagggcgttacaagaaaaatctgcagaggcattaatgtgacgtaaaggtcaagcattgtgacatacctttcaaataatcccgcctaacttgcgttatgatgaggcggctgttggcagcatcgttcagtgtgaagcccttgatgtgggtctccgcgctaaaagaagcagacatttagaaaggaattactgacatgcttctgatacgataataaatggttgagcaccaaggtgaaattataaaaactactgttcgtatgttaaaaatattgctgcaaaatatcgacctggagacagcttttgtgttatcctgtcaatggttatagaaggataatttttttttgcattctgacagatgacaaagttggaaatgagcaacaaaagaaacaaagtacaagattttttttaaacaatcggttcagattcttgaatgctgacatattagatgactaaaataactgcgtgccccgcattgttctgccatatcctaagctggatacttttttttttctacattcacagtaattataaaatgtaaaaatcttcttccagaaactaaaatgaggatttattttcagcactgtacattttaaataaaaactaaagcagattactaacactctatcatttggtcaattaattttcaaatttctgccatctagattcatacagtttctgaagctgaacatactgcagaactcaaactattggtactttaaaattaaaaatttcacacaaccatcttgccctagcttaagtttgaaacaaaacaccaacttttaaaactcaagagcaaaaaatcacttgacttttcaataaaacctacaggatttaaaaaaagcaaaatgaaacaacaaaaacaaacagaaaaccccaaaacctagctggagatttctgtttgctacactgtttgcgcatctcctgtgatgaaatttctgcatccttaatgctcccagagttcatctccggattagaaaatctaaacaggtcaaaaggagcaaaagcaattgctcccatttgccttatcgagctcagtgatgaccctgttgccaacaacagcatgccctgccaacacggacatataagctgggcagattgcaacaaaagtggggtcactgctaaattattttcatcaatcccaagaaaatcccccagagacactacgacatgcccattctctcagtcactttcagcctctaaggtccacccctgcagtccctggacacaggattttcttattcctccgaccaatcctctttatcccaccaaagtacccattgctcagtttgacttttctccctttgtcccatctgtcaacaacttaagtcaacaactcatgcatgagactaagaattgcacaaaggatttactttctcaatctttcacatgattaaataaaaatgagacactattaaaagctcacttctaatattattacatgtattataccatattaatttaaaaatattcacctacaattcattaaaaccacaaggcaacaaaacttgtctttgacactaagtatgaactacaaacctttcaaaaacctcaaagcctgtaacattctttttcaataatctcttcctctctcaagctgcctgctcattacaaatatgaaagtggagataaatatcaggaagaagaaaccccagatctattctataataatatatcctacatatgtagaaactgaccaattacaaccaaaacagattccaaagtggcaaaaggaaaaaattttaaaaagttgcgggtagagatctttatattggaatcatttatacaatataataaaagacattaacttttcacacctaattttgatctttccttctggaaaaaatcgagtccagagctctcaaatcaaacttcctgtgatgatgggaatatcatccaatcatccaataaccctattggctgtccaatagggttagccactagccacatggctactctgatgaagaaacagaaatcttaattatattttattttaactaatttaaatttaagcagtcacatatgactagtggttactgaactggatagcagagaattctagacattttatttttagaactgtcaaaatgaagggaaaaaaattataggggaaaaagagtaccctctttcaatttacgaccaactgcaaaaattaaactatcttaaccaaagaagacagtattatagggaaactttcacattggacatttcagagaatttattgctctgaaatgacagcctttcaaatttaggagaagttttgttgccttatggttttaatggattaatggattttaggtaacacttttaagtaaatatggtataatacatgtaaaaatataggcatgagaagtgagctttcatgtaagcaatgactgtgcttacataatatgcagaaaggacattagttggtgattatattatttaggataacaaaaacaggccaattcaacaaaaatcatcagtgacagatatagcattatttccgaacagaatgatacaggaagccaagaggaacgacagaaaatcaagtgctactctcaaaagataaagtagggttgttgttacatgattcctaaattccctaagaatatggtttaatgttagcagagatttaaaaaaagagtttatatcccttactgctctttgaatcagtggtttccctcccttgaaagaattcactacagataaattattttgaaacatgaagaaactaaaaatgaaagaaagatggcttattgaacatttttaaaagttactattactttagaggttccatggcttattgggaaggttaaatgactttgtaaataaaattgaagaaatcttattagaggtcaagtgtatctgtaacacattagatgacaacaaaggcaaaataaaaatgatattttttttaattcataggaaaactatggccttttttttttctcactctgtcactcaggctggagtgcagtggcgcaatcttggctcactgcaacctccgcctcccgggttcaagccgttctcctgccttggcctcctgagtaactggaattacatacaggcacgcaccaccacgcctgactaatttttcgtatttttagtagagacagggtttcaccaagttggccaggctggtcttgaactcctgactgcaagtgatccacctgcctctgtctcccaaagtgctgggattacagccacgaaccactgagccaccatgctcggccaaaactatggctctcaaggttgaccaagtgaccttatataggaaactgtaaaaacagctatttatggatccagagtaagactgccagaataatactagggcggtaccgccacttgctacagtagctcatttgaccaccatattataataaagttgcctataaaaaagcagcagttgtttttcactctgatcactgatacagaatgggaaatgggaagagaggacctagttggcaataaacaggaaccgaacccacaaaatatctcttgaaatatctcaagtaacatagttagttggataattcgtaacttgaactttcacttctgaattttcagtccagcattatttttaaaagtactcaacaatttaacccatgaaacaattctacatagttagatataacattttattggttcaagggagaggacatgcatccaaagcccagattgacttcaggctttggatcttgggttctcttgggtagacacagacgcacggaggaaggcaactcccaaataaccctggtggataacacagctaaaagaaaagtctcacttgtatgtcaaactcagaagcagagtatgatggtagacaccaaagactgggaggaggggaaatgaggagataatggttaaagtacagagtttcagttatggaacataagtaagttctggagctctatacagcatagtgctaacagctaacaatactgtatttatactgaaaattgctaagaggatagatcataagtgttctctctcacacaaaaaaacccaattaataataataataataataataataataataataatattgagggtgggaaaaaactctggaaggggaaggatatgtttgtggccttgaagtaggcaatggttccaagggtgtatacttatccccaaactcactgagatagatacattaaatatgtatctttttacatgtcaattttatctcaggaaggcttcataaagatctagagaagaagggaagaagataaacctatgtttcacaggttgtaaatttaaggcaaatagacggtcatgcttacaactatcttccaggtcagcagtttcaaccttggtagatcaagatccatgggaggattatagtaagaaatgatgttttacatagacaacccaatccacagatacatacacacacgcataactgaaagcaacttttcatgaaataatatctttactacaggaaatactttgaaatagtctatactatttcattgaaacaatgttggttctgtcccacttaatagatgtcatgacccactaattggctgcaattgcagttttgaaactactctagaccagtggtcttcaatgagcagcatgcacactgcatgaacactccagggtaaggcaaggaaacctttacatctctctcccttttttttttttgagacagagtcttgctctgtcacacaggctggaatgcagtggcgcgatcttgggctcactgcaacctctgccacccaggttcaagcgattctcctgcctcagcctcctgagtggctgggattacaggcgcctgccaccacacacggctaatttttatatttttagtagagatggggtttcaccatgttggccaggctggtctcgaactcctgacctcaagggatccttccgccttggcctccgaaagtgttgggattacaggcatgagccaacgtgcctgggcttaaatctctttttaaaaatttcaccttatgaagattttctattttgagtatgttttataatatagttacatgtgatacatcaagtacaatttgttattaatcacatgcgatcagaatgcttaagacatgattcttcaatcacttgggctatggagtaaaatgtacattctcaggccccacaccaaattggctgaatcagaatctttgtggtgagctgagaggaatcttcttatgctaccagagtaagtatcactgttctagaagaaacccaatgaaaatgaaaaaataaataaataaataaaattaaaatctgtactttcaggaagcatttcagaggtctttgtgaccaaactcaaaatctaattttttttaagttttctgtctttgcttctatctcatcacttaatcatacttaattctcaacacaaaatgcttctcttttttctggctctccttcattatcacagagagggttgggatggagagtttcataattttctgagaaaagtaattttagatgatccacacccttgacctagtggttacagatgacaggatactgctcactgtcaaattttccaagtcactaattaagggtatatcgagtgttctagatatatatatatatatatataaaatttgattaggaattgagaaaacacacaaatgacacacagagtacattaaaaacccaacagtcctagtgcgactcttgtatcaagacatacaaatgatgattcaagacaacacacatatacacacagacaagtacagtcatacagaacatgtttttcaacattaaaacacagacactaaatacggccctatgatgcataactttagcaacactaggacactgccaggttttcttgtgatgtgaaaggatggcaggcatccattttctgcttaggattctaatattctaaaagtgctgcggacttaaaatttttttcagattattccttttcttttcttcttcttcttcttctttttttttttttttttttttgagacagggtctcgctttgtcacccaggctggagtgcagttgcgcaatctcagctcaacgcaacctccacctcctgggttcaagtgatactcctgcctcagccttttgagtagctgggattacaggcacatgccaccacgcccagctaatgtttgtatttttagtagagacagggtttcaccatgttggccaggctggtcttgaactcctgacctcaggtgatccacccacctcagcctcccaaacttgtgggattacgggcatgagccaccgcgcccagtcagatttcttttttttaatccaaaaacaacacgaaaggagggggaaacacaaataagatgtgttcagtacctatgttttctctacttcactctaccttcttcaacacatagaagaaatctttaatattaagtaatattatcatacactcatcatacggaagaagaactaaggatcagagatagcaggtaattttcccaaggtcacagaacttttaagtaagattcaaatcttggtctaagttcaaagtccatggtgtctttgttttctcaggctgctcccaccacaaaaggtacatggatttagatgttgaacaaggaacagaatataataaaattacttttctgtgcatggatatcttaaatgaattgtgatggaatataacttagtaagcaaaatgtactgcactgtatatggccagtaaaggtgtttttttttgaaggtgaaaaaacctgataaagttagttaaccatttcatatgatttttatgggtagctgaggccaatcaagcaattttactacacagcacattactattataattattggctaatggcagccaatattcttttttaaacaagaggtttaataaatggactaacacttacaatgctttcacttccattgcttgtgtaaaataatcttctgacatcagtaatttaatgagattgctgtaggtttcagcattaaacacaatgttttgctcttttgcattcaggaaaatatcatatgcccctatgagagaaaacagacaaaaaaaatgagatgacattattctgaaatgccaaaaggatggaaaaaatcctgaaacaaagacctaaacccaaatatttttgctttttaataccaacccactgttaccactctatagagagacacactgacataattcttcaaatattttaaagacaaagctacaggtttggaaactacaccttaatctgaatggatggtgcctgaaggggtttcctcttaaaatgatttctcataccagctttcttaagttgatacattattttctttgtaataaaaatgagaaacagctcttctgaatttatgaaaagacgatactagtttcaaaataaatcgcaaaatgtgtgttaaagtccaaataaaccagaggtataatttagattgaggggagcaaaagattcattttaaagcaatctttaatctataagtgggtggttacaatggttaacatttcagcacaatagcactaaagagaatatagcctataattctaaaattaggagatcacattatttggctacgacaggacttatacaaaaacatacaattttcaaatatacagatatctaacaagtaaactaagcaacatttgtttgactgattaacagttttatttcacttgttcacaataactgtcagtgaatgaaaagatgttaccaaaagagaagtaactacacttttcagtcacttatacttttctgaaataaaactgcctggctataaacagccaactgaaactacaatctactcccttctgtggataaacaaatcacaataaagatggggcataaatgaactatcacgtacggccttctacgaatatagggctcaatgtaaggaaatataaaacttctaattaagacagaacatgatattatttaatgttcagaagaacattttaagctactttagaagtttctgaacaggcgaaaattgttacgcttctatgtatgagttagggaatgtgtgcattagtcccttaattaaacttaagtggcactgtcaaagaaatatttatccctttaagctaaatttggagaaaaaaatatacggcaacatttatatttgcatcttaaggagaacagtttgggcaagtgaaagtaacaatggcagagatttatcacatttcaagtcagtcttccatagaacagtccctgttagtcattaaatttccaagtgctttacactagatttctatggttgtgaacaactgtatattccaggacactggcaaaaaacggaaaataaaaacacgctaatatgcaagaagaaactccactatcatttactgattattccatcagatacctagtctattcggtgtatttcacttttctgaaacgggagaaaataaagacatattttcatttgagtaccagtatcaatgcatcacaaatttaagacttttatttacttattaaagtcacagaatggcttgctaaataaaatatttaaaccatgacacacaataagatgactgcaataaaatctgccattcaatacccaatgctttttagggggctaaaaacttaagatgtaatgcaattattgtcaacttcctaacaatcgtatatagtatttcacttgtttggaaactcttgttgttttctaaaactgtggccttcacattaacttggtgtggctgtgtaattagtccctgttagttttttttttaattagcattttaatataccaaacccattcaccgcacgtttgtttccaatgtgacaatcacgatatacctttaagtagactgaactaccagaaaaatgttaatgtaagcattcaattttcaaagcattcatattttactaaacattcgaatcctgagatatacaaaaaaagaaacaggaaactctgaagagttatggccaggcacagtggctcatgcctgtaatcccagcactttgggaggccaaagtaggaggatcacttgaggttgggagttcgacaccagcctagacaacgtagtgaaacgcggtctataccaaaaatacaaaaattagctaggggtggtggggggtgcctgtaatcccagctacttgggaggctgaggctggagaatcgcttgaacccaggaggcagaggctgcagtgagctaagatttgcgccaccgcactccatcctgggtgatagagcaacattctgcctcaaaaaaaaagaaaagaaaagaattaacaggatgaaaccaattagataaatgaaaattccagaatagaggtagctccacatttataatacacactgcattgtatttaattatttaactacttaaatgttttcacttaaactgtacactaaccatatattcattttagtcatttagctaaatcaaagcttcaccagaggacgggcgtggtggtggctcatgcctataatcccagcactttgggaggctcaggtgggcgatcacttgaggtcaggagtttgacaccagcctggccaacatggtgaaaccctgtctctactaaaaatacaaaaaaaaaaaaaaaaaaaaaaaaaaattagtcaggcatggtggtgggtgcctataatcccagctacttgggaggcaggagaatcacttgagtccagaaggcagaggttgcgccactgcactccggcctgggcaacagaacaagactctctctctctctctctctctctctctctctctcacacacacacacacacacacacacacacacacacacacacacacaagttcatcagaacatttacatagtattaatcaagcttaattttatacttcgctttcaaagatgcatagtgtgtactcaaagatatatagactgaatatgcagcaaaggaaaatgcctcagaatgggccgggcatggtggctcacgcctgtaatcccagcaacttcgggaggccaaggcgggcagatcacgaagtcaggaatttgagatcagcctggccaatatggggaaaccctgtctctactaaaaatacaaaaactagccgggcgtggtggtgtgcgcctgtagtcccagctacttgagaggctgagacaggagcatcacttgaacctgggaagtggaggttgcagtgagaatgcaccactgctctccaccctgggtgacagagcaagactccttctcaaaagaaaatgactcagaatgaataaaaagttatactataggtaactgaggaggcataagaacttatttttacttcatacattttacatcaatgccacaaaatttctttctttctttttttgagatagggtctcactcaatcacccaggtgcgatcatggctcaatgcagcttcaacctccggctcagctgatcctctcacctcaacctcctgagtagctgggactatagtcctgtgccaccaagccaggctaatttgtgtattttctgaacagatgggataccactaagttgccaggcaggtctcaaactcctggactcaagtgatctgcccaccttggcctcccaagttgttgggattataggcatgagcctgcaagcctggccaaaccttctagttaagttaggaaattaagaagttctataaatttctaaattgattcctttccaataaacctcaaaactatcaatactaaaataaaaaaattctcttgtgtttatttccttaatggtaaactatcatgaaccatccttgaaatccaccccaaaactgaaggaatcattctatggaaagctagaatgaaaagaaattaacaaaagtaaagaaaataagagtaatatatgattctggaacagtataagaagtctaagtaaaaacataaaattcaacttacaagctcataacagagggttaaagacggtcataaaaaatttaaagtaggcataataaaggtgaagatgtcttcaggaaagtttaatactagagaaagggaaagagtcaagaaacagacctctaaccttgagatattgctggatcacttcaacacatactagtatagtaattaatgccttaatcattttttgctttcaagtaagttataatatgtgccacaaaaagttattttcaaaaaatacttttaataaaaatgtatgccaacaatagcatttattacgaaaaatttcatatgtacagcaaagtatgaagaatagtacaggttgggggtggtggctcataccagcaatcccaacacttcgtgaggccgaggtgggaggaccacttgagctcaggagtttaagaccagcccgggcaacatagcgagaccttgtcactacaaaaattggctgagtgtggtggtgtgtgcctatggtcccagctacttgggaaactgaggtaggataactgcttaagcccacgaggcgggggctgcaatgaaccatgattgcgccactgcactccagtctgggtgacagagtgagacctgtctccggggggaaaaaaaaaaaaaaaaaaagaatagtataatgaacctcaccttccatatacccatcacttatatctaacaattaacatcttactagatttgctttttttttttttttttgagacggagtcttactctgtcgctagtctggagtgcagtggtgcgatctcggctcactacaacctccatctccccggttccggtgattctccggcctcatcctcccgagtagctgcgatgacaggcatgcaccaacatgcccggctaattttggtatttctagtagagatggagtttcaccatgttggccaggatggtctccatctcttgacttcgtgatctgccagctttgggaggctgaagcctcccaaagtgctgggattacaggtgtgagccacaatgcccggcctgcttcgttttttatagcttaagcatttttaaatacattatagaaattttgacttttttcatccctcaataactcatgtggatctcaaaatttcagaacatttccctataagtaaatcataataccattatcacatctaataaaaataagagtaattccggccaggcatggtggctgatgcctataatcccagcactttgggaggccgaggtgggcagatcacgaggtcaggagatcgaaaccatcctggctaacacagtgaagccccatctctactacaaatataaaaaattagccaggcgtgggggcggacacctgtagtcccagctactcaggagtctgaggcaggaaaatggcgtgaacccagaaggcggagcttgcagtgagctgagatcacgctactacactccagcctgggcgacagagtgagacttcatctcaaaaaaaataataaaaagagtaattccttaatattatctaccactcagtcaatagttaaattttcccaattgccccaaaatgttttcgttaaagtatggaaggggacaagaaatatgtaaaatttaagtcctatctctatcctagagcacttctaattggttgggcttacaccccacactgctattagaaagaagaccacccccccacacacacccccatccccgtatgtgcttgccttttttttggttcaatcggcaggcaatcaatatatctttctggaaatcaggttctgtggttgaggctgacgaagaattcagggaatgtttttcatcttcataccacaactttaaaacaaagttattctgttaaataaaaactggtaatcttttcaatataaaagtaggctaatctataacctaattatactgacaacaaaatctgttacgattatgccaaaaacaattacctcaggtacgtcaaacggaacttcctggttaccctctctaaggatttctgctaataatcttaatgtcttttcacgaggaataacattttcttcttggattttattccagactgcatcagctctttgccagtcaccgtttatttctgtagaatttgattaagcagaaattaatcaataaatatgctaaacagaatacacaaaaatatttagaactttttcttatttgatgttgaagaaagcattattccaaatgctgcctttagggaaaggaaccaaaagtgaccgtgacccgaagtcgagaagggaacttttctctgtacttctgaattacaaaccaaaaataccctacctattaaaaagcaataacaagaagcccccatcacactttattacacacttccaatcatgttgataagaagtttgtctttttaatgttactgagaaagtgcctactgccgaaatcaaaatcagaaacaggtgacaattcaactatgacctttagcgttgcaaagatcctggaaatatatatatatatagatatatatatatatatagatatatatatatctatatatagatatctctatatatagagatatatatatagatatagatagatagatatatggcatatgccaccatatacatacatacatacgtgtaccgtatgcaatatacatatatctgtgattgtatgcagtgcatacggtatacatatatctatgatctttgcaaaggctacaggtactggtccgtggtctgttaggaaccgggctgcacagcagaatgtgtacggtgggtgggcaagtgagcattacccgctgagctccacctcctgtcagatcagcggcagcattagattctcataggagtgccaactctattgtgaactgcgcatgtgagggatctacgttgtgaactccttatgagaatctaactaatgcctgatgatgtgaggtggaacagtttcatccccaaaccatccccatcccccaccacaacctggtctgtggaaaaattgtcttccatgaaaccagtccctggtaccaaaaaggttgggggctgctgccgtatagtacacagctgtggtgtgtactaaaatgattgcaagtgtgtaattctctttacaagtgacaaatctacaaaccttttcacttagttgaatagagaattgtctatgtttcttgtgttgacatgaagagtttctatgaccctgtgtgatacatggaatcttcttagatttcttatctcaactgataatgttatcagactattacaagggctgggaaggaaataggcagatcccttcatattgaaaagcccatttcctttcatgtggtaatctagtctttacaaatagcaaaaactccagaatcaaaactttgtttttagaaattctcatggttggaagaggaaacatcaagtcatttaatataataaattagtttctgcttgtgaaaaactggggcaagatatgaaaaatgtcacatgacactaagtgtaatacaattattaaatgcacagaaaaactgctttagatgtctttttttaatttgctagtatgtataagaaatatctggattgtgtggcatccagctctaggaaggaggggtttgttttacagcacaaatgttccagacaacatgaatacatttgttcctcagcattttagaggaaaaatactaaaaacacgtaggattttcctagattattctccccaaaaccaaaaagttaagttttttgataactaatgactcctaaaagtaaaaaattcaaagaacaaaaaacaaagcatactcattcttcatgggaaatcagcaatttaaaaaaaaaaaaaaaaaaaaaaacttagagaaattcccctgggtcacacagattgcagcctatatattttttttgagatggagtcttgctctgttgcccaggctggagtgcagtggcccgatctcagttcagtgtaacctccgcctccagggttcaagcaattctcctgcctcagactcccgagtagctgagattacaggtgcgcgccagcacaccccactaatttttgtatttttagtagagacagggtttcaccatgttggccaggctggtcttgaacccctgacctcaagcaattcactggccttggcctcccaaagtgctgggattataggtgtgagccaccttgcccagctgcagcctaaactttcatacagactacatcgcaaggaggcccagatggcagaaattaacctaaagtgcagagtgattttatacatatactgataaaattagcccaactaatataaaagccttacatttacaaccaattttcaaaacaagactctcattaactaattacgctttttcttcattaaaatgttattgtgtaatataaaattcaagtatttcaagtatgtgaaagtataaaacttatttgatttaaaaaaaaaaaaaaaatccaagcctctgaatctttattctgcagtggagcacttctgttgactgccaaaaggtccttgtggactgtgggaagacagggaaggtttccaacagctagacacaatactgctaaggacctttaaaaagggattagttattctaaacaataaaaaggtgggtggataatctacaactccgtgcctttaggctgcaagaattctgggaacataattttctttgtttaaaaaaagcacaaattatacaaaaagcttctactttgggaagacaaggatattacagagatgcacctattaaaataagacttgtgggcaggtgcagtggctcgtgtctgtaatcccagcactttgggaagacgaggtaggcagattagttgaggccaggagttcgagaccagcctggacaacatggtgaaaccccatctctactaaaaatacaaaaattagccaggtgtggtggtgcatgcctataatcccaactactggggtggctgaggcaggagaatcgcttgaacttgggaggtggaggttacagtgagctgagatcgggccactgcactccagcctgggcgagatgtgaacactaaaacaaataaggactaaaataaaacacaaatacatgttaagaacccataaattcattttttaaaaaagtcattcatcaacttcagaggttttaaggataccagcagttaagattcgtattaaaagggagaaaaagcaagtatttttcttgtgaatttatttcatattgttaagtaaaacaaaaagaagccacaatgtagaaatgtagaatgtgaaacaagtaaagtataaaacaatcaaaacaggatataaaagaatcaaaataataggtacatacataaaaaatacatggatataaaggtagagagagggcaatgtacagagaagacatggaaaggatggccaattcacaaagttacgtctgagataagcggttagggggtggtggtggacacaatgacattttcatagttagctagtatagtattacattgtttgaatctttagtaatcagaatatgtccatttcacttgtgtaataatggaggaggaaaaagccatacaatatgaaaagaaatgtaaatggctatacatacttgaagaaataatatatgaatcattactgagacggaataaatgctgaggttatacatactttttaaatagattcaaagaattgtattgcaaaattacaaatgtaaggcagtttgactcttggatagactactatacaaagaaactaatttctactttctatctgtaaagaagtgttcagaacataagaaaatgtttgtcatatagaaataatagaaaattccttaagcaagtgaggaagtcatttcattcatgtaattaatgtttgttataggttctagaagctaattttgcaacactgtcacaatgaaaggtcacaatatattgggaaggatagaaatgaagtttgaattaggacaaaattttgtaacagatcatgttatattgagtccatagaaaatgaaagcagttttatattaataaaagctagtatttaaatgtatgtaagacttacacagttccatgggtgttggctgagctacatatctttgttttgtgcatgtttctgtattatgttatgatttacaacaaaattaagtgtgtattaagtatgtgaaaggaaccgttttaaaataaacgaaggaaagttgcttttcaacaaatatccaaaaataactactaatccaatctctttcaagggctaaaatcacatcctaagaaagaaatccacaatgcaaaatatggatttttaaaaagcataatgaggccaaggcgggtggatcacaaggtcaggagttcgagaccatcctggctaacacagtgaaaacctgtctctactaaaaatacaaaaaattagccaggtgtggtggcgggcgcctgtagtcccagctactgggaaggctgaggcaagagaatggcgtgaacccgggaggcggagcttgcagtgagcaccactcactccagcctgggcaacacagcaagacccaattcatatcttatgttccatttcaaagcaactgagtccatgtaacaatatttaaatagtggcccaagtctgaaggcaaaatgcagaaggggatagcttgctttttcttcagaaaggaaaggattagggctatcataaccagattatccatttataacacggcagaaggtaggaagtatacaaatgtggttaaaaagaatatatacttctctataggattccactggcttccagcctcctaagaagctaaccacactctgccaacctcctcaaactattgactcaaatacaacgcaagaaggaattggagacaggtgtccaataggacacatagaggaaattaaggacaagaaaatagtattaaactcagagaccatatatccctaatggaaattttaagatgaagctaaatgttgtatatttttttgtttctttaaaaaaaaaaaaaaaaaaaggccaggcacagtggctcatgcctgtaatcccagcactgtggaaggctgcggcaggaagactgcttgagctcaggagttcaagaccatcctgggcaacatagtgggaccccgtctccacaaaaagttaaaaagaaaaaaaaaattattagcaaggtgtggtggcacatgcctgtactcccaactacttgagaggctgaggtgggaggatttcttgagcccaggaggttgaggctgcagtgagctctgatcgcaccactgtactctagcctgggtgaccctgtctcaaaaacaaagcaaaactaatagtaaaagttcttctgaataggaagagtaagtttgtgtggctggccacctctcacctggccttagactaccacatacttacagttgttcttacccgctgcagtgttaagacttggtgatggggctgaccctttcagcagagcactacctttacatctgcagtgcctaccacaatgtctagcacacagtaagggcttcatagttttttttttttttttctgaatccaagtttatatagtcttccatgaggactacttgaaataataagacatatttagacatatagtcagtgcttcttttgaacttggcacattagaatttcatcatgaaattgtttttaaaaggaagaaaaagtaggtagagtggaatgttagtgctcaaacacagattataatttgcaatttgaggaccaactgcctaaaatacaggtttttaattctatacattcaataccaaactcagcattgtgtgcaagaatttgatcatcgttcaagccaaagtcttaagaattacactgtgaagtatgtatttcaatacaaccaaaaactggaatgtaaaattttaagcaagtttaattttatttacatcatcgagatgtaaaataaagctttcaatggtaataaatacaagtttgaaaagacaaataaatccccttattcgtttggtgaagggaaatttgccaagagaaaagaagaacaataaatctagataaacatccatgaaacaaatagggaaaggtcactggctgttctaagtgttattcctctctaccgaaatatcctaaaagaaactgtaaagctccaaatgtgtacactagtataaaagtactagagcattgtttgaaaagagagatcgaaagtttcagaaatgtcaaatacaaatactaagatttcagcctcaaaaaacagttaaggatgtgaatgaagattaaggcacaaaaatgaataacgtagtgttgttttagaaatggaaaatggaaatctattcacaaacccagtaataggagatgataggctgaataaattttagtatatctatgtagtatataagttatttgtaggtgattaaatatagaaaaatgtttgtaatatatagctgactcaaaaatatataatgacatttaaaaagctgtttaacaatgagtttgtatatagatatgcaagataagcatctttttgcaaaaagaaaaaaatctctacttacatgaatgtgttggtggttacctatttataaaagtcaccaataaatttacctgaaggtttaaataaaaagaacagaaagaccgttcttacctcaaaaagtcctattaaattctgtggttctgatgaaggttttcgtactttctcattattgcagtaagaatgtcagaaattatgaagacatacagtgtctagtgctacgatataacattctgtgataaaattcaatctagcctctacctgagcctctgttgaatgaaaactgccttctgacaatccctggagctccctcaaaaccaaatactcctttcctgccactgccttcaacagaataaatgaaagcgtgaagaatagttaaatcacttactatacagttttagcagattgtagtacatctggtctctatcacattcaaatagcttctgtgtcagctccactaatttttccagagtttcaaccttaaaagtaagattaagagatagatctaccttgtgtaaaggatgtattttacagttaacaaatagcagtggaataatctttcaaattagctttaccaaaagggcagttgaacttcatttcaaaagttaatgggctgagcacaacaatatgaatgaacttaatgccactgaactgtatacttatacaaggttaaatcataaatcttacattatacttattttaccacaattttaaaaaaatttggagtcaagaacacaacatgaataactaattcaaaggtatctgggtgggagaactcaatgagtgtatcgtacgttaacaaaaatacttccccctccaaactttacactcttcttgccctgtggcttttacttggcatggtgcaaacaggtacctgcaccagaggagggcaagcagaaattccagagctctgggaagcaactccttcttccactaaggactaatgcaggcttgaagtgccaaggacattaggtcagcctgctccaaccaactagttaaagataatatcatcagggcccaggttaacagtttagggtttctactgcacctcaggaataagaaataagccattgcttatctggcaaatgatcgagataaacactgcttccacaatgccctgtctctcgaagtccccaaatcttcatgtgatacagaggacccttgccttctactcacacttttaggtgattgagacatctgaatcaaatacaaacctgattatttgcaacacatctgtcacaaaaccactgaagccttgcagatcgagctctaatccctggagtctgtaaaataaaataatcacatagcacccaaggtaaggcttcggctgaatattatttttttcctcaaagacagtttcttttcttatgaatttgctgccaaatatatatactaaacttatatactaaactatatatactagtatacaatctatatactaaatttatactataactaatacaaactataattaaccccatagttatcaaagacctttaagtaagagtagaagagagcataaaacacaaactatgcttaacctctgcctagaagacgccgataatttccaaatgctgcactgcacgtcaaagttcattccataaatctttaattaataaaatggttatactgtctttagttcaaaaataagcgataaactagaaaacgtcaaataaaaagtgtgtgtcaacattcacatgcatgtgctcttatttttaatttatttttttttagacagagtctcaatggcatgatcttggctcactgcaacctccgcctcatgggttcaagtaattctcctgcctcagcctcccaagtagttaggattacaggtgtgtgccaccacacctggctaatttttgtatttttagtagagacgggttgcaccatgttggccaggctggtctcgaactcctagcctcaagtgatctgcccacctcagcgtcccaaagtgctgggattacaggcatgggccaccacacctgactgcacgtgctctttctcatttacacgctctctcttgaacacacacacatacactttattccaatagactcaggagacaaaaattatcaatgttacacaaagtaacagttgtcacaataataaaccattggctttcgtttttaaaagaaaatgctttgcgaacttcacagtgataaaagtactctaatgacttttgcctagcacctaaaactaaatgtttaaagaacaaaacaagctaagtactttaaaattggtttatagtctcagttcaattaaacaactgagacatatgttatatcctcaattagaaattactatcgtttggtcaataagtctggcttcaaagcacttagtttacaattttggatactggaataaaagacaaaccatttcaacataattccaaggatttgtcactctatagtattttcatcatctgcaagagggcttcaccattaaatactacatttcaatcacagcattatggtaagaaaactacatactcattagccctggctgctccagtctagaggaggtatctttactgctttctccgctcacttctgttgatcaaaccaggtatcccttgaatctaatctcttaagtcctcattatttttaattttaaaaaataacattgtacaacgttaaattaagaactgaagtggaaactaacatcttgcagctttggtgggatgacagaaaaattggtagactagaagttggatagcttgttctcatttcctatatcatccactttttgggatacaagaaatcaatgatgaataaattagtcattgaaatacagtctcaaatactattaatatctacactcaggcacaatttcttctcaaggatttttcttacgttatttgttttgtttcacacgcataatactgaaaatgaaaccaatgtcaatatatactaaaagcccttgaaaaactatgaaataatcctcttcagaacacggcaaaatgcaagggctacggtcacttacaactttcaatattactgctgatccaaatgccaacaatctaaacagcacaacttttatgacatactctttctgtttgtggctgattaatctgcctgtctttggcaggacagctgatttatatggcagatcttcccatgtttcattttgaaattgagaactgttttcatatataaatctcaatcatcaaaagaacatctaggtcagattaactaaatctcctaggctgctgtaatgtcaagatttctggcttatctcttaacatcttattgaattttaaaaactgcaagttgaaagcagaaatagaaaatgtaataaaaacatggagaagaatagaattctaattgggatgttaaatataacatgaaaaaacagttaatgttaattaaactcatatttagttctttctgtgttgccacatacaatctatctaatgaacagtgaggatacagtaagtatttttatagaaacaattgcatgtttgtttccacctgagctactgtgcttcaaaccacaactttctgcagttgcaattcactactaggtttacttgtataggggaaaaaaaagtaatccaaagtcaaaaataactgtcattactttaatttcattacaacactctgatgtaaatttaccataaaaagcttatcataagcttctatgtatactagtaaaaatagatatccaataattattacctgttaggtaaaaagaaatgaaagtttttctactgcatttcaaactctgtctcaaggaagattatcctgaatttaactcaaatagaaattttcacctgttctgatttttcttgccacttctgctggagatgtcaaatgaaagcaacaacaaaaaccgcccgccctagcctcatgtcccctagttaacatagtaggaggaaaaatcatgtgcacaagggctttaaagaagggacagacaaagacaagaatgctggagaaggtggtatgcacctgtagtcccagctactcgggagactgaaataggagaactgcttgaggccaggagttcaaggctgcggtgtgttatgattgcacctgtgaacagccaatgcactccagtctgggcaacacagtgtgaccccatctcttaaaaaaaaaagaaaacaacatccccaccccaacccaagtaccgtccaagtacaactgacccttgaacaatacaggggttagagtttgaccatctgtgcagtcaaaaatccacatataacttttaatttcccaaagactgaactactaatagcctactgttgactggaagtcttagcaatagcaaatagtcgattaacacatattctgtatgttacatgtatttaatactatatcattataataaagtaagctacaacaagaaaatgttaaggaaattgtaagaaagagaaaatacatttacagtactgcattttttgataccgtaagtttatgacatctttttacaagatgaatttctatctgaaatggcaggcaaccagaactgcagacctcaatctacagtacataacaagcaattcatccttttcttgaaatgtcacaactttacttcttagaagcacttccagcatcactagtgatactgtgtatggatgtcatggtgttattcaaaataattacagtaatacaataagtactgtagggaattttatgtacttcgttacttcgtatgactagtacttcgttacttctgtttacatttctctcagctgtgaatggcagcatgtatagtctatgtgtgtgtaagttttgataaatgttaacttttaataatagatttgtatacgttttatggtagcaaataagatagactagaatctgcctatattttaagcattcatgacatacctttttcttaatttttttcagtatttctaggctatgcagttcatctgtgagttttttcaaatctccaaaaacttttccagtatatttactgaagaaaaacctacatgtaagtggacctacacaatccaaacctatgttgttcaaggatcaactatatttatccccatagctagcacagaacaagggagcaaaaaaggtctcatggtactattaagtcttttagcatttgtccttttctctaaaattttccaagatagacttgaagaccatgtataataaggaggaaaatatggctgagcaagtccaattaacaaactatcatgaactaaaaaattatccacttgaccaggtgttataggagatactaaactaactcacaaaagggggtatatatttacatgagaactgacatatcctgaaattttggaggacaaaacaaaaacaaacaaacaaacaaacaaacaaacaaacaaaccctagctctaaaatccactgtctgtgtatacgatccacgctggcttattaaggaaggcaaatgggataaaaattcctgaatcagatctggaaaagaacaaaaggaagagtaacaaagactgggagatcactggaatccaagcttttggtcttaaatcaaaagccatcaaaagagagtttttcccccactgagaagagatcaaaatgtactccggctgcaccgtgatggaaaggcaaaacagcagatagggagagagggaaaagtcaagaaagaggaattccggagaaagggtaagttattttcgacagttcagatattgaggggtcatgagatcatggacgtaggatggtacagaggaaccaatagaaaacagaaactcagggcctggtttcaaattccgtaactactatacgttgagtatcccttatccaaaacgcttgggaccagaagcgttccagatttcagatttttctgacttttggaatatctgtattatttactggttgaacatcccaaattcgaaaatccaaaatcttgtaagcattatttttaatggccacatcattccatttcataaacaaactggagttcatttgcgccctttctcctttgagaaaaactttcactgttacaggtaataatcataatttacatctttacctactttggttttcagatgatttacttaggatcatttctcaaaagtgggtcaaatgtcattaccattttgaaagcccctgatacacaaagacagtaatgttgttatgtctttaaggatgggacctcctttatggttcctggtagcagagccagaactaaaactcagggttcgtgagttctagtccaatactcctattgctagaaattatggtaaaagaaggtatttctctgtaaacaaacaaacagaaaaatgacttccttcttttagtctatgaccttttcaggtacttcatttacctcccaggaagacagtgttgcagaccatacaaataaagtatcactttttgggttactcattcttttttttccaagaccagacattaaatccagggaaagattatatatacaagcaaaaaagttaaatgatgtatgaaatgttaccatattaaaggtttctatcaagaaatatattatttaatttaactcttagccctttgagtagttctgcaatcacttactaaatgcctgtcatgtgccaggcactgctaggttctcagaaccaacacaaagatgagaaaaaagttctgctttaaacttagcatttcgtattctaacctcttcccttgggtttgattcccaagagttcttaagacagcctacagaggatgtatctgcagaagagacagaagggttgacctctacacagtaaagaatggcatagagaaggaagggaatcaaactagcatttattaaatgtctgataatgtaccagacaatccagatgtcattttattagtgttatctaataagagttctgagaggcagaagaacgataaagggaggaacctctttgctgcctcagggccctcacacaggcagttccttctgcctggaatgcttttgtctctactctaagtgcagacgcacaattcatcttttaattctcaccctaaacactgctacactcaaaattaaggtaatggtggtggatttttatgacactttactcagtcatctcaaatgctatgtaaatgacggagagagacctgagttaacagaaaatagggtgaattaacataggtacaagataaatgaagctcttagatctgatagagaatctcctgtcatgaacccttaaaggtggcattggcagatttcttcatctgaaacctccagaatgaagctctttagcaaaggtgattgatagcatttgcatggcttcccagttggaccagtttccccttccctccttcctttccttctcagtctttctcccttcccttcattctagtcaaagagatagacctttaaaaagagaatctacagaatgtagtaattgctataagatgaagtgttgtagaaaggacttttttcagactaggtctttctgaggattgcttgtgcccaggagatcaaggctgcagtaagctaagccaccactgtactacagcctggctaacaaagcaagaccctgtctcaaaaaaaaaaaaaaaaaaaaaaaaaaaaaagactggagactgtcaaatatactacatataacacatgatacatgtatgccaattcatcttaaaaacaaacaaacaaaaaaacaggtgatatttacacattgaaccttgcctatatctttcttcatttaatgagcttatgactggtttatctaattatttccacaacgcttcaaatacacagcagctctgtaaattcaaccatagtgaatctacccaatgataagacactattgctttttttgggaatgataaaaatgttgctcatgacttgtagtattctttctgtaaagctattcttcaccctttaaaaaattttgtacacacctactacgaaaattctgtcatcagcagacagccattcctaaatgtggttgtactgtggcaaagctctaagtaattaagaggcagtcttctcttgcctattcatgtggcaaacatgtaccttatgctgaacatcatattttgaattatgtgaggtaaagaagacaacacaatccctacctttaaggggcaaagggaattaatattattgatcacttaccataatccaggaaacatgcaagctgctttacatacattatgtgattgaatcttaaagacagatattatgttctcttttatacatgaggaagcttagaaaggtttaataacttgtccattatcacataagcaggtagatggcaaaacaagaaatcactcttctgcctctggctctattacaccttactacacaaagacaggcacatgcattcctcctgcagaacctctcagagctgagcttcatttccgctctgatcagtgacctgctaatactgacactgtacctacagaggagcagaactcaatagccagacagctcttctcacatttggattcactgtactttcagaagcgaatgtggaagaaaaattataccattttctagaaaatgtaaatgaaccacttaagctacagaagcacctgtccaagatagcacgatagcatgccccactgtctgctgacaagtgggcagattgagtcataaaatggaaagagaagaaagttctgaattgatttcacagtcctccttttctatactacaccgttctcttcttcaaaaaacatcaggaggaaaaaaatacagttttctgggttgtgtgcctatattttcagtttcatgataagcagtcatcaatacacaaataaagaggtcaaacaccacttttgcatcctgtcccctgtatatttttggaaaacgacattgaccaaaagcgaagtataatctgagaaaacccatgattactgatgtatttataagttaacagttttaatcacatgaaataatttttcttaaggcaatgggtccatcttctgcggaatgttttgttttcttagtggacacagaattgtttaatagtgaaattaatcacaatttggacagactttatagttggcccttgacttatcaattccactaagcaaaatttagtaaagcctagataaaatatactaatcctaaataggccaggtttgtcacctaccatttcccataagctgcttagcatagtggaaaaaaaaagaagaagaaaatttaaattaaatgccaaacagttgcagacagcacttgtttggctgattaacttgtagacaagcattacaaataaatcttgagcatggtctgcagcaaattaaattccactgcttttaagaacaaagaattctttggcaaagaggattagcaactttacacccaggaatgccagtttaatttaattgttccacaatccaagatttaatatgcaaatatcattttgatatataatagtgaatttaacaaagtgaggaaacaaatttaatatacaaccagactgccttttctgaactgtaattatatacaataaagaagctggccgagatccccctcccccaacattactgggattgaattctattaacatgaatcagaacaagtgtaattaaaggttaaaatttttaaatgtattctaattaagagtctaaatagctctacaattagaacactgtagttaaaatcacacctcaatgatcttcttggcctctttgtaatttcctgtttgtaggaaggcaaagaagagatcatagagcatcaccatttcaccttgttcttggctcacaaagtccattgctaggtaggagagaaaaaaatatatatattaggagaaaaaaaaacccagaaaaacagtatcatatgaagttccagacaaatacaagaaaaatttattttaaaaacaaatattaagaataacttaaagaatatagctatatcgactaattaagtacctaacagagtagctacaaagagaactagtgaggataagggtaaaaaaaatcttcataaaggcagatcaccaagaattagaacacaaaaataacagacattttttcaaaatgaacagttactaaaatcaagaacatgtataatattggaaatctacctgatatttttcttttagatttcacaagtataaagaaagtttatctgaatgtgctggccttctgctggtttctcttaacaatacactaagattaaatcagcaagaagggaaaaaaaaactacattaagatactagaaagtgactcacctttctgaattagatcagtctcgcctttctctaccagtttacacaagacatcatgaatccttggtaatactttatacttttcatagcagtcaatggcgacctcaagagcagtagataggtcgccccttagaaacaaaaaaattagcaatgaataaaataaatcgaattcagcttagtctcttagtaatactttagagagatgtttaatgaccagttaatatgtaaacaactgagctttacttaaggtagaaaaccacaaagctaaaatgggggaaaaaaagaaacaatctttatatataagtaaatgttcagaaaacatacatcatcagcaatccactatttaccctgcttcatcttttattatttcgtgtgttaaagggtactttataaaaaagtccaaatagattaaggcattctctgattttactgtaaattctgactttatgtagaaagttgctgtaagaatgtattacttctgaaagcaaggactaccgtcaaatacttttttccaatcacttacgtgcctttaacaattgtatctcaataatttcagatttggtaaacgttattaaatgtccaccaatagctaataaggaattttcaagaactttttcatctttatcataatattttctgtactgtcaccttactagccaagtaggaaataacctcaagtttcatatatatgggaacttactattatgaaaactaggatattcgtgttggtcagtgaattctagaagaattctaaatacttttttcattaaagggtaagcttttaaaaattatttccaattacaaagtcaagccttcttttatgtgagaaattaaaataaaaagacactgtcattaaatcagtttcttaaacaacagtgtggtactatattcttgtgggtccttaagaagtattttccccccataaaaggacaatttgctttcaatttactttaaccctgtctttattaaaagtttttttgtaatttctctcttaccatactgaaataaaattcacaggtaatataaaaaaaataaaataaaaggacaatgttagtatgagaaatatttaagaccttgcaagaccaggtgcggtggctcatgcctgtaatcccagcactttgggaggccaaggagggcggatcacctgaggtggagaaaccccatctctattaaaaatataaaattagccgggcgtgatggcgcatgcctgtaatcccagctactcggggggctgaggagggagaatcccttgaacccgggaggtggaggttgcagtgagctgagatcgtgccattgcactccagcctgggcaacaaaagtgaaactctgtttcaaaaaaaaaaaagaaatcccttggaagaactatagagattatatgatccaattctacttgccacccccttttactttcaaagaaataatgaaactggggcatctagagactggctgatttgactaaggctaccaggtaaacagaggaaggtactaggtaagcaagtcgctggacttcccattgtcagttcagtacatctaattacacattatgctttattaaaagcactggtatttgaataatgtaataaagtggtgcaatttggaataagaaattaacgatttatgaaaagagagtatgaaaggtattttaaaaagaggcatggttagagacatggctccaagtacaactagtgacaattagtgaaaatctttgtagagaatataaatttctcatacacataacagttttcaaaaccagaaagtccttttatacttcctgttaaagccttcacatttttgcctattatacaaatgttacattgccctaagttgaattactattttatcaagatctgattttaagctgtactaaaaaagtaaaagacaacgaagaaatgttagttttattgcaataatagtgacacagtgaaaacgagcctatcctgatggaactcttaccttatccccttactaagccctgtttacagtgcatcttctggcaccccacagagtcatttgaatttttgtcatttggggtgaagactaaattacaggttaatttcaaactgcaagtagatgttgcaggctggattactgtcatagaagagaaatggtacagtagctaccacatatgatataaagctttatataatcagtattttcccttacttcagacacaggttcggttattgcctttctataactctgcttaacgaaaaactactaaaacattttttaagagcaaagctaacacacatacgatttttttttaagtggcatgatttgcttttccagatcaattcccaaactagaatagtattgtctcaattgtatttccccctacattaggtcaaagctatcaataaatgaatgaataattgttctgtcaatcaaagcgacacgttaatagtctttggtctccaaatatatgcttctgaagattatacatgttcagaacaacaacagaaaaaacaagaatggcaaaatggaaataattcatatatttgtcagtaattttaagaaccaatgttactgctcttaggatgccaacaaaatgaattagaaatttataatgaaatacctcatacaaagtgtactggagataaaaacaaagtaaatgactagtcagttcttcagtccctattatctaattcggacttgtggttggatcatgtcattttaaaagacaaaaatttacattccccacataatttatgtcactattaatctttcataataaagcttgaaaacttaggtgatgacggaaatgaaaaatatgtttaaaagcacctaaaatttgcattgctatgaagatagctatgtagtcataggactttggatttccatcccaactgataagagtacttatgctactcagctgtagcaacgtgatacatttctagaagtggtgatgaaaagcaaattatcacaacagctgaactcaaggacatttgggttccctcctagttctaacaggttctatgactctgtgcttattaggttcatctaaagtgttttgcacaagcagagaaaatcatcaggtgaaaataccacttttattaggcaggatgaaatcagtaagggaagcacaatatcaaaaggagaaaggtaaaaattgctttacaaccaaaatgtgggacaacacattaccaatcagtctacttctagcttctgtgacccaaagtgatctgtgaatttctttgagcactagaaatgatttaaatcctgctaagaaataacaataatcctctgaagaaattaatgttgacacattaattttgcattcaaaactttgagcccatgcttgtatcagcatatatgcataattcctaaagcttcacatacaaatatttaaaggctcactcctaataaaaatttagtcaatgctttcacaaatgacactaaaagaaaatcaactctgtagcatactattaccctttataaaaaaaaaaatcaagacacccccctcaaaatttcaatagactacataattttcatgcataaaactacgtacactaataaaaagtaagcaatcattttaaaaagcagtattttgtttggtgcaaattaaaaatataagctttaccaaaattctgtaagtctatgaaataaaggtaaaattgaggaaaagattctgtaattttaaattttaagaacatatatatgagataggctgggtccagcaagaaatttggaaacttaaaatagagttaaattcattaacttgaatagactcacttggcctgcatcaaaattcattctagaatctagaattcacttcttaagggaacatgactacaaagagctactacaaactacaattttttcattattacacggaagaacatcccgataaataagcttgaagctccgatggcaaatctgatagtaccactcatttgagtcctcattctgaaactgaagtatgctataacgtcactgacagaaaaacaaacaccatgtagcatgtaagtttgctggacagacatttctatgggacatccaccaatcataaaactatctactttgagataccaagaaacatgtactcctaaaactcatatacattcctcaatacatatacctgtaaaaatcataaatgtatttcatacaatctggaattgttaaaacaaccacgagtgacaactatctatttatctattagtagctttaaacttaagtctcgtaatttatactaagtaactttctaatcccagagagtatacttaaacaacaaaagaaagatggccgggcgcggtggctcacgcctgtaatcccagcactttgggaggctgaggtgggtggatcacgcggtcaggagatcgagaccatcctggctaacatggtgaaaccccgtctccactaaaaatacaaaaaaaaaaaaaaaaatagctggcgtggcggtgagcacctgtagtcccagctactcgggaggctgaggcaggagaatggcatcaacccaggaggcggagcttgcagtgagccaagatcgtgccactgcactccagcctgggagacagcaagactccgtctcaaaaaaataaaaataaaaataaaaataaaaacaacaacaacaacaaaaaacgaaagatgacaaatattgattttttttatttggaataaagtactttaaacttatacattgttagtgaagtggcaatttatgtaacaggcttccttactgaaatgcgctcaaatctgcaatcactacagaaaagaagggctgtggggggagaaaaaagtttaaaaaagaaaaaacaaacaaacaaaaaccaaactgaactccttaaaaacaaactatcttacaaatcctcagcagatgttcaatatgggaagaaaccaattcaagagaaaccatcatcttcacaaaaattattctgttaagagaaccagcacttgaaagagctaaatgttttttttctgttcatcatctataaatgaggaatcttcaaggagactggtgttgcaattacaactaatcctccccaaaaaattaactgtgttgaaggctttgtaatttccctaggtacaatttagctgtcacttactttaaaatttactcaaacatgcgttcggaacagcactaacttcacatgtcaagtgctttccagccaattgagtctaaactggaagtcggtgttaaacaactgaatgattagacaagatagctcatttccctgctcttttgttcagaataaaatgccacatttacattatcaggctcaacaggattttctgacagaggcagaaaaaaccctactgcacactgtccgtactaagcacatgaagcctgtcatttaccaatcatccttcaaaaagcaatagccatgaatgtaacttaattacgacccaatgatccttgacgaaaaatcatcttatcactgtcctgtccccctagggcaaatgaaccactttttgtcctttggcactgatgatgctaaattcttaattgcaataatggagtaaaagagccaaacctccttaatttcctttcagcacataaggagttttactctagaaggcaagcattcccataaataatgaaagtatccagtacaaatgaagatgctaaaattgaaggggagcatgtgtaacagaatcatcaacattttaaaaagcctatttcccatttatgtaacatattaaagtgttacagtgagttccaaaaacattgttacaagttcatcttagagaaattgtgacctttatgaactcaagattaattcagcaagaattctgggaggatagtatatatgaagttcatgacacacttaaatgaaatgcatatgtacatatacagattataacacaaaccagcacaaaaaaaatccttaatggaaagcagaaattaaagctgctttgatcacttgcaccaacataatccagttaaacagcttcagttattttttaatgcatgcaatgaaaccaaaatggatcaggtataaaacaagtgaacctgaaactgcatcatacaaatttttatgctttaatatctgatggcccagactttattaatttcatttccttgaccataacatgaagactaataaaaaactcttttaacctattttaaagcatttctttcttccttaatgtgacggattgctgtcatctccatgaatcaggcatgattttaataagataaaatacttacaaaagaaaatgtttgaaataatactcatttggactacatgtaaaatacgtggcttagagactgtaatgtaatgtaaatgaaacataaaaattttgttcaactgcaaatttttttccattcaatgcaagtattttcattttgataatacaaaagcaggttagcttaccaacttctttataattttctaaatctgttattgttttggatttcccttggcaaatgaataaaaacagtgtattttttctatacccataaagcttttttacattgtctaaataacacaaactgacacagtattaatttctcctgtgttttgtccaatgctggaaaagtcggttcagaattaagatccactgaaacttaaagagattatctttctaaggaactcagtctcatggaactgcttcagaattacaacacgaaagtgatattctctttagagccttttacagtgacatgccaaaaagatgcctgcctttgaatgaaagggtgaagatttatgatgatgtttcaaaatgttttttatacttttatcacaagtttgaataaataaagctcatttgccagatgagctcatacctgctgaggtcaattacatgatattactgaagattatacacatttaatcaaatcgaatacacgtggactttttggcaggctagtgtggttaatcctagcacttgtcatgattctgaattaattagctatcttccatcagttggagaaaacacaattgagaaagagtttcaaagtcagggttttactccaggcatttcccctgactacgaatgtttctgctgttttctgtaatttcataaatataaaatttcctttatctttttattagtctcatgactctgaaagagtcaatagccctttttattatgatagatgaaactgaaagacctcatcatggagactgcattagcaaagtagtctaaaaaaaaaaaaaaaaaaaaactaggcaaataaaaacagaattaaaataaaataaaaatagaagatatacatatctgaaagtagtaaaacaccaataatgaaaagacactaatttagatttccttagctcaattagcagggagagccaaatttgactgagacacagaaatatctgacttcaggatataatcagaagcacagaggatgctctaggttaacatttgaattccacaccgtttccattttcccatgggtaagctctccttggttcatgagccccatctgcagacctctttcggaaagctttcaggtctcctctgtcttcaaagtatttctatttgtaagatacttttctacgatggcctcattttcattgttaattattttatttttgcccggtagtgtaggagggcctaatttttctgggcactgggcccatttctttcaaatccttctgtagagttgcacatgcaatttgcagaaatgggtcttttaagcaattgaaaaaaattctaataggaagcatattaattataggatttctatataaagttggctatgaatatgataactcaataacacagtcattatttgaatcactatttctttaaaaggatgtaatgctgagactgtagaggttaagatttgaccagtcatctaacccggtaattgtttttgattggatggcaaaggaattatttcatgtgtgcatgcatgtattcacacatttttttaagttagttaaaagagatggtttttattatacatttaaaattcaacactaaatcatttattatattcaattaattaaactctctaataaataaagaaaaactaccagaaatttggggaaaacatgagaaccgttaaaatacatattttatttttctcctggcatcaacaggacaacatccacactacatccacagtgagatatttctgcgtttcagtcaaattcagctctccctgttaattgaactaaagaaatctaaattagtatcttttcattttcggtgttttactactttcagatacgtatatcttccattttattttattttaattattatcttctatttttgtttgcctagggttgtttaaactaatttgccagtgcagtctccatgtaatgcagattacaaactatgttaagctatgaaaaagctgacaaagaagatctaggaaatttaaaaagcaaaacagaaaacaaaaacaagtacaaaagaaaaagatgataaattacgcttagtcatcttactaaaatgttttattcattataaaatagactgactttatgatttacattgcaaataatgccttaaattgagcaccaacaagagcatttcaaatggaaaaattaacaaactcagtaaatcttgccctatcagtaaaattcatctcctacaacatttatcaaagctagaataactgtaatggtatatgtatttaaaataccctgtgaagaaaaggagcactgaagatgcttcaacacttattacctgaataactgtcaagacacatactcaaaagccccagaagatccttttttcttatatttattaataacacttatcaggctcaaaactaggaaaaactagattcaaattcaagtgatcacatgctcctacaaaaaaagcaccagggactattccattgatatgtaaagccacaggaccacagggctgctagtgattttaaaggtcacctagttcatattagccctcttactctgtggtaaatgacctccaaggcttccccatcatgagggtatttataaagtataatccgaaaattattagactcattcttttaatgccaacatttaaaattcaaaattcaattaacttacttttccaagtgtacagtgaccaatgggaaacttatgttggtggatggttctgctaaccctagagtcacgatggcttcatgcaactgttttactgtttcaatttcacctcttaaagctgcgccatttagcatgtggaaaaaggacaaggctgttgtatctttgataagaacatccttctctttcatctccttcagaatgttaatagcatctacaatgaagtaacacaaaagacccttaggtaatttcatgtagggaaaacaaactgctattaaaacagcatttcaagcccagcaggaatgtaaattctagtgtataatgccgatttcaagttaattactacttgcatttctaaacgagactacaattataaatccacaatagcatggttttatcatttccctgcaactttgactacaaattatagatagggactatgtgcccactctgtaccacataaccctgtatggtctgccctatagctgtaagatcctcctaaatggatgcttttatcgttcagagctaacatctgctaaatcacaccattgtttcttcagcagatggcttgtcaggaggccagataataaagatgtgtttacactgtatatacagccagactaatggtctgataccgatagggcctgtttgctatgtcgatactaattagccaagcagagccaatgaaagctttccaaaagactgcatgttaatacattagattcattaagcttcattaggaaggcagaaacaaacattttaggatatggaataagtgcatttttataatgttgttcttaattattacacagacaaaatgttttgaccactttacaaaaagtgattttaaaaaaataggctaatccttagaaagagttagaaaggcgtcctaggaaaacattcaatgttctaataaatgattttctccatacatttttccctataataaaattaaaacaatcttttctgaaaatcaaaggaaaagaggaaggctaaaaaggaaatttcaaaataaagccaaatcagaaagttaagaaacaagaaaatagtatgaatgtattatcaagtgtaattaattttattaggcttagcattatctcaacgagaaaatttgagtatgcaaatcagctgtgtaatcagctatgctttttccatgaaccattaaataaaaaccttaattaaaataaaaactttaaagtatatattttgttaatgttattaaaaagtaaggcaaagactactgcaaaattcaggcgcatatattaggttatgtttataggttttacgtttataggttttacgttcagccttcagaccttcttaagcaaaaacaaagccattagtgcaggcacataagcaaattgtgccataagtcatgatcttcaaactcaatccaaacagcaatgctaataaaaactagctgcagaaatgcaaaaagcactgagctgtgcaaatgtaaatgacaagcttgccaatccattaaaactaatggcctacactgtccatgtagctctggttggattcacatgcaaatttctatgcaaagtgttcaagcactttgcaggacatgatatccattaatatcaattcacatgttattccagtggcaagatacttgcatcacatatttcctttatgtgctgaggcttaccttggagcttgccatgctttgccaatactcttacaaggcctacatacttgccggtgtcaaggacagcagatgaatctaagcggtcactaaaaattaaagccacatttatattgttttaaaagtcaattaactgctaaaagaacagcaacatccatttaatcacttttcaaaagctcatcagaagacctgaactaatgttggcctctacgcttcagttaggatttctttttgaagccatatacaagttcacacgaaattatattcaaagtgactagtgaagtaaaagcccaacactacatatatattgcatcactccatctgcaaaggatacttatgaagaaactctttggctttaagtgattctaaccttcatcacgaatacttgacatttttacttgaaaaatctaacaggataggaagccaaaggtacctgagaaatggatagaattttatttacactacaatattgaaagggaaatgttatcaagcctcttaaaacagttaccaccatcaccactgttgtgatgatatataatcaatggaaaaaaacctttggttctaaggactagaatgtcttatcatacttaaacaaagacaccttgctgaacataagccacaattaattaaagagccgtataatacgaaatttcaaaaacactgacaacaaaagaatttttaaaaatgacattatataagagagtaatattccatctagataatctatcaaggtctgtagagcagaataaatgttgacaacttgtttcagtgccagggtactcacaattcttctttcaagttcaaggcatcttctactttatcatgtcgacagcataaatttattaaagctgcatagccaccagtaaccatgtcggattcatattttgctttcaattcaagggctttttgcatattctaaaatacagcatagatgtgaaaaagaagaaatcagtgtgaaggtaaaaatgtcacatttttagctttactgttcagagtttagaaaaagttaatagtactttaaaaataaatggtttcatgttaacaacctgactctgccccttgatatttttattcacctctaagaagtgggcaagtcttacacgtgtaggggttaaaagatgtgttatctgtaatataaaataggccattatttatgccaaatttgatgttttaggctttgtgtatggtattatttaaaaaagacttccagattaagtaattcccaaatcaaatcctaatcacagtctaatttcaggatgcagaaatatgtatcattgaaaagtttctcagtctagtttagtatccaagtaatatgaagaaatattttagaatttaacagtagcagattataatcataaagttagtcatgatattttttccctaaaactacaagtttatggctcaattatattgaactagaaagtgaaaaatagtctagtgatatcccacaaattgcagacatacactaaaatgaacacaaagtacagctggatgcccgctgaaaaaaggcaagggaccctttatctcagaaagagcttttttccagcaggaaaatggaatttcaatccctgcattaacaacctagtaatatttgacttgcaaatgactactgcgtgtatcagttgcttgacaatctagatataagagaccggagccatggcttgaaaggacatttggcatgtatgataaacctatcacagctgttactatcattcactttgcagattatcgtaaacaaactacagcaaccagaaaacatgccattcaaggtgtagctgaaattagttaacctttcatttaattgcattctttacaagcctgacatataacgatcaattgtaaaaatcataaatattatatttggtttttcttattgttaccaagaattttttgccttaataatatttaaatattaaaacaaatgttacctcttctgaacaaagcactaatatgagttgctttaggacatctcttataggttgattttcagcttttagtgtttcaagtgtggactccaattcagatgatgtaagttgcacagtctacagaaaagaaaaaagaaaagaaaaatttcctgaaaaaggaaatatagtatgccttttgtcactcttccctttaaactgactttcctttctaccttcctaaatgtcataaatgctatcagggatattaattggggaatccatggatggactccagggatttacaaaccttctgagattatatgcaaatttcttagatatgttgatttttctgaggtggggaacaggttttaccaacttcttagaggtatacaagatgataaaaatgtgaggaatcactggttttataagtacacaatccagaatactcattaaatatgggtattatagcatgtagaatctagtcaaaatcctacttactttttgaaagtctaaattcttactctcaaccaacaagtgagcatcctaaaattgaaatttaaattagcccagaattagaaaacacacgtaaaaatacatcagcaaacatcaaaagcaaatttgtaagtctcacctcatattactacttttcatctttccaaaattttagacattctcttcatactttattaatcaatgtaattaacgttataaatatatttatgaatatataaatagtatttatgaacaatcaatgaaaagcttcgttttaatggctgtcattgaaacaaattttttttctgaccaaaagcatcatatttaaataaaattttaacatgctgttatatgtaagttaagcattttatccagttgattgctatttcacacacaccttaatcaattcaggaacatggtagctttccaggagattacgaatgcctctgtagatattttcaggaatttttacattctgtgagaagggaagggaggggggaaaaaacctgagttttagacaaccaaactgaaatttgtctaacagaaattatctcagacataatttaagtctccaactcttgcatgtcattgagaagtggtctggttgtacttaaaagcagcaatttcaaatctaatagatacatgtcaggcaggacaggcattatatagcaaaaaacgaaatggtaccatcttctccagctgatggaagtattgtctcaaatgctcctccttggcctgtacctctgagtcactcatgctgtcaatcaagttataaagaaaatagccaacagcttctgtggaaaaaaacaagagaaagcattccactaaaattaccgagactgtcatgttatcaagattaatttataagaaatcattttggtgtgagatgtcaccctgatgagaggctctgaaatggcaacaatgatcactgaggcatagagattatgtggtttgggagcacatatctaactggtgagtgaaaggaatattaattattttcagaccgagtgacagcttttcagtactgaatcttacttcaatctattttttttccaccactctgtgacagaagtggtcctgcccaaggccttacccctttcctgtccaaatcacacgtaataagaataaataaatgtcttgtacacatttctatactgttttttttttgtggacaatatttagggaagcacataaaattagaaaggattgttaaatgttgagtaaagaaagttaaacaattttaataagcagatacagtaatcctgtggagagctgcctattagccaatgaaaaaccaagattaacaaagatgttttgtaacaacagtaattttcctttgcattcaagcataaaatgtatagggccatgttacagtaatacctaggatagaaatgtaaactttcaagaggggtaccatcttacagaaaactatatagtctagcttcattatatgaaaaatgaaaatcattaaatgtcaaaacaatgtatttggggcaataaattacatttaagcggaaatccacaagaaccttcgctacattttatgtttaaaattaactacacctgcaaaacattaaaagcacataaatactaagaatcactgatttttaagcctatttccatagatgttagaagaaacatttccccaatatctgaaaagaaaaagcctcccaaccctgtctttagaaaaaataattgtaacaaaatcaaacactttagatctcaaaatgttgtaatcaatataaagatttataaccaaatgttttcaaattccactttaaaaaataaagtatttactgctgtaatcctcctaacccatcattacacagaaaaatggatttgtggataagttacaatcatcgaaattgaaacgctacccgtcggtcctcgaggctcctggcaataacgtccatccttgtacaacaattctgttatctggtaagacagaaaattcgtgcattgcagcaagagaagcaaacaagaacaaacacaatctgaaattgaattcttgaaataataaaacctctccccagtaaggtactattctatttcacagtaattcaaaaccacccccacccgccaaggagattgttttgtttttaaataataggtttgtcttttaaaaacaaaaacaaatccatgttgaaggaaaactgcaatgttttgtgaaatgtcacacagaaagactctaaactgatttataaattgatatataaacatcactctgaatgaactgttataaatagaaaagagcttataggaattattgaccaatattattcctcattatattgcttttggtcttgttgacactgaactggtttcctcattttatattaagttttactgaaatataaagtaaaatatcctgaactgctaaataacttacattttttagatatttaataacaacttccattcatcttaatgagactaaaacaaaaggggtctaaagattaaagtgtctattctcatggattcttttttttttaatttccaacttttattttaagttcaggggtacatgtgcaggatgtgcaggtttgttacatcggtaaacgtgtgccatggtggtcggctgcacagatcatcccatcacccaggtattaagcccagcatccattagctattcttcctgatcctctccctcctcccattggattcttatcaattggattcacaaacactaaaagacacacataactattatttttcaacattaactctgccagcaaaattttagtagaaaaccaaatataggtttcatgataaaaattattacataacctatggtattggcttgtaacgttaaaagcaccttatgatttgcaatattagagggacttacctcgctccaaagatttatattcatagacctgcagagggcagcaaaggatcgaaaataaacccaggtttattttcaagtatatgcatacttgtaatatgtacagatcaaagtattaaaattaataagtaaataaatgtttgctgtatcaggatgaattttcaggacaaaggtaatttagaaaggctgacactcacccacctcaaatattcaaaataggccaggcctggtggctcacatctgcaatcccagcactttgggaggccaaggcaggtggatcacctgaggtcaggagtttgagaccagcctggccaacatggtgaaatcccgtctccactagaagtagaaaaattagccgggagtgttggtgtatgcctgtaatccaggctactcgggaggctgaggcaggagaattgcctgaacccgggaagcggaggttgcagtgagccgagatcgtgccactgcactccagcctgggagacacagtgagtctcaaagtgactgcccacagattgcttgttacttgtaatgggaaaaacagttactacataatggagaaatcccaacacctggaccgggtgatcaaaactaatgtgcctttaaatataattccctgagaagacagagtatcactcatgtggtcttccagcaggggataacttgaagctgtaacagtgaagaataaaatacagtaaaataagataaaaattaggtatctttttttggttaggctacaaagagctttaattccaaggaatcttaacttgccagtagcctaccacatttgaaaaacaggacaaggaaagtagagaacaatcagagtttgcaagaaagtgaggggctaatgtgccaaagtgcataatattaagtggtaaaacttgccatggttcctttgctgtatcccggacccatctgggcatttgatgaattctgattatcaactaggattaattttgtcaggtatgatattacggtggttatgttgttttatttaaagtaagttctgagatatatactgaagtatttatgggtagatgacaaagatccatagttatttttaatagtccagcaaagaaagagaaggggaatggtaaaacaggactgccaaaatcttggctgttaaagctgggggatgggtacatggcagctctactttcgtgaaggtttaaaaattccaaaataaaaaaataaacacataccatgtccagtctaaattttgtacttctattttaactctcaacattagtaagctgggcttcctttatttatttatttttaaaatttactttaaccatatatttttatcaaagtatcaacttactgtcaaataaaaaatagttaaggctgggtgtggtggctcacgcctgtaatcacagcgctttgggaggctgaggtgggtagatcacctgaggtcgggagttcaagaccagcctgactaacatggagaaaccccatctctactaaaaatacaaaattagccaggcgtggtggcgcatgccagtaatcccagctactcaggaggctgaggcaggagaatcgcttgaacccgggaggcggaggttgcggtgagccaagatcgcgccactgcactccagcctgggcaacaagagcgaaattccgtctcaaaagaaaaaaaaaaaacaactggatattaagctgccctcaaacgtggcatgaagtacctaaggaaggcatggagataaactttcaaaatttcacatatacctaaaacaactgaaaatgactaaaagcactaccttgaatgtgaagcttcatggtgaatgccacaggtttgaaaccaaaacaaaaataaacggtatccttcaaaaccaagctgttgtaaggaacagttaccagtgcccaaaccagtgcaatctgacttctggccccaaactccactgaaactacttatgctaaaattaccagtgatttttaattcaaaattcaactaacatttttttggtcctctttcactaagttttggaatttctgttgttgttagccattatctgctagatgctactcaacctctttcaggaactgtccttccctacatgccccttaaaagtgacccagactttgtactaggttctaagtgcattatattttttatcttaaagacaatcctgcatgtacgtatttaagttctttgtttcccagaagaggaaacaaatttggtaaggcgatgtaaaataccttcaactggaaattccacagtcccctaaaagaatcccataaattgtgaatgatctcctaatgtttcctgtccccctatctgcctttacctgtactctcccctttgaatatctgtcaatcttaacttcatcatgtaaacctttcaatggctcgaagccatgtgactcaaggtccaaatatcctaacttagaatgagactactcataaagacccctgggctaccattttggctttatttcttgtaattatttcatagtttcttaagctactaccaatctacttacacttccccagaaccactgttctctcagcctcaatgcctcggcctgaaaaacccttcccttcccctctacaaactcaatatgcctctcagcaatttctctgcagcccctgccctgattcatcccttccccaaccttggcagaagactgagtaccttctataaacattcatagttacgaagactagtttttggagtagaagaaagaaatcacctgtagttacacaagtgctctgaattaggcacatattcttatgaaaaatgccaagttaccacaacctacgatttttctttatctacaataagaaaaattaaccaatggtatacagttttaggacttacatgttgaaatatgttcctggaaggaatccgcttaaacttatttttactatgtcaagaataaagacagatttgcaactgtgcaaacactggaggctcctgggtagtgtcccctttgttaaacatatttaaacattttatctaactttaaagtggaaagttaaaaaaatgaccaatctgtggctagttttaaacccaggaatcaattaaaaattttagatgctaacaaacagggaaagcaccaaaaaaggatttaagtcaggggagacgcagagcacctagcttggtgtggtttaaagataaggtaatccattttcgaatattttcaatgttatctattcaaataaaaatataaataatctgaaagcacacataaattcagttatagtatacataatccaatcactaaaaacaaaacaaagacaccaagattctcagagcttctagctgggcttcttccactacaatagtatcaaaactcttctcttaaagatactcaataatggccaggccggtggttcatgcctgtaatcccagcactttgggaggccaaggctgggggttcacttgagcccaggaatttaacaccaccctgggcaatacagcgagacctcatctccattttgaaaagaaaaaaactcagtaacttttccaaataccaaactgaacaccctctttttatagggctatctcccctacatctctgtaacttgcgacactgactacaaactcctttgactccttccagtaactatccaagatcttatccttacatttctctctcatctctgcaacaaggtttaaaaaaaaacatatttcacatgtgacagtgtatagataaatatccctcaaatgcaataccttacaaattgacaacaaaaattgtatgacctagtagaaaactggcaaagaatttaaataggttatttcatagaagaaatccaaatggccaataagtatgctctaaccctgcttaatagttaggaagatgcaaattgaaaattatacattaagatgtcatttgtcatccatcagcttggccaaaattaaaaagcattgtaatgtctaatacttgtaagtttgcaggaagtgggtactctcatacattgctggtagaagtgtgaattgctaatctaagtatgagctaatacaactttttctggaaaagtagtatggtagtagctattaaagaatacatacactcttgaaaacagacgtctcttttttacattctagccactgaggggggataaactaatgtatatataatatatatgtacacacatgtgcatgcatgtgcacaaacacatatacatatggacataatatgtaatgtaccactttgttttggtagtggcaaaaattagaaggaatctgagtccattaataaaggagtgattgaaaatttatggtatagccctaccatggaatcccctccagatataaatgcttagatttatatcagtagaccaagagatgttcatgtagtgttgttaagtgaaaaagaaagatgagtagtatgtaaagtatgatatattacttttgtttaaacaaaacaaagcaaaacttcaaacacctcttacaggtctctgcttctatacagagaaaagcatggaaggatacactccaggctcttaattttggcttccacgatacgggtttttatagggagagggaaagtacttcatgaactccattaaattatagtcataattttataatatgcatcttttgcagggaaagatgagccatagcttccaacaaattctcaaagagatcaatgaatcaaaaaaggttagggcagcaggtgcagaggctcacacctgcaataccagcaccttgggaggcagaggtggcaggatcacctgaggccaggagttcaagaccagcctgggcaacacggtgagactccatctccacaaaaaaattttaaaattagctgggcgtggtagtgcacacctgtagtcttggctaaatgggagcctgaagcaggaggattacttgagctcagaatttggaggctgcaatgagccatgttcgtaccactgcactgcagcctgggtgacagagcaagactctgtctcaaaaagaaaaaaaaaaaaaaaaaagaaaagaaaattatgaatcactgtgctacactgcttctctcaacagaataacctgggcaacatagtgagatcccgtctctacaaaaaaattttaaaaatcagccagccatggtggcatgcgcccatagtcccagctgctcgggaggctacgatgggaggatcgcttgagcccgggaggtaaaggctgcagtaggctgattaacccactgcactctggccttggggacagagcgagaccctatctcaaaaaaagaaactcattcttgtgtgaactaccaataactgattcaacaaggattaccaatggctgctaaaaccaaggagggaaaagtaatggaaaaacagggtagacacagtctcaaattaccaccccatagtcttcttagtaattacaaagtggacaaggggcctctgcaagagagatgtgcgaatcaccatcttaaccaagtgatcaaactttggtggtggcatcattattgcacacctgcctttatatctgttgatgtgatacaatgtaagacgtgcccatcacccatgaagtactattgctaaaaatgcttaatctgagtctcatcatgggaaaaaaaaaaaaacagaaaaatacaaaatgtagaagagacattccagcctgggctcttaaaaaacaaaacaaaacaaaaaccagtgttattaaaaaacaaacaaaaaagctaaggaaattgttctgcattaagataataaagagatgtagcaatcaaatccaatgcatcaatttaattgactcctcagtcaaaaagtgaaacatctataaaggaaacttgttaaagtgggaaaatctgaacatggactacatatatcagatggtggtacagtattgttaattttttcagagtgatactgatgttgtgattttagagatgatgactttattcttaagagaaatatgctgaaagatccagtgtcattatgcatacaacttcaagtggttcagccaaaaagaaaaaaacgtgtgtgtgtgtgtgtgtgtgtgtgtgtgtgtgtgtaggtactttcttgtgtagagaaagagggtatgagagaaagtagacacggcaaaatattaacaactggcaaatctacacaaagggtattacagaggatgggcacagtggctcatgcctgtaaacccagcactttgggaggccgaggcaggtgaatcacctgaggtcaggagttcgagaccaacctggccaacatggtgaaaccccatctctactaaaaatacaaaacttagccaggcgtggtggtgggcaccggtagtcccagctactcagcaggctgaggcaggaaaatcacctgaacccaggaggcggacgtcgcagtgagccaggatcacaccactgcattgcagcctgggcgacagagcaagactccgtctcaaaaaaataaatcaaataaaaaagggtggtatgggagtattcccttttactattctttcagcttttatgtttatctattttcaaaataacaaaattggaagggcaaggtcattaacattctctgagcacacagaaggggagaatgatactttactgaataaaagtcaccttgcaattaaatgctcaaagaataagctgaacatacatatgcaaattggtctgtaactccaacttgccattttgaaacaggactttcttcctggaaacaggatctttaccaaacctgtgtgcatttctcagaaaagatgacacaaagctgcctaaatttaattcaatgacttaaaagaaaaaattaaacaagcaaaggttatttcaggtaaactgaatgtacactgaaagataagaatatttgtatttttcctcatgcaataagtcaaaaggacaggagaaatcagtccatgttcaggcaaggaacatttaagttgatcatcttacctcctgaagcctagcagtaggctacttcttatagactgcagcgagatgggcaatgtatttgatttcactgcaaaagaaaatgaccatcattaaatctcagaccaaacaaatttaaaaaccctgtattatcaaattgaaaacatatttataccaataccttttagttttcattttggaaattgtatttaaaaaataaaaatgttttcatacaaaattagacaatgcagtaatatatatctgcaatataagctacccttttaacgtatttttaattttcatgaatatatacaactaattaatttataaatatcctttcctataaatggcaattactaacataccagcagaatcagagtcagcctggtacacacactgaggctgtatgttgttggacatggtggcaccatgaagagagagactgtaataccctacaagacttttgttctttaaagacagcacatgagaggaaaaattcttttctcggagaggtgttgggttctgttgaaccattcatactttctcatttcattttccactatgatcaatgacctgcactcacacaagagtaaccacctaaagtaataataaaataggtcatacgtccgttatgtaattgacttatattgatctttcacttttctgagtatttgtttgctctactactcattttgacatttaacagtctacaaccttgtatgtttcaatgctgacattataagcctgatttgccattgtgtaagaatcacaccttacactgactcttcacataacccttgccaaactagcaagggatgagatcacagtaggcattccctgaatttgtttttccctgtaattgtactaaaatgggaccatgttataagtaatagagttaatcttttcactataaatgtaatgtggctactgaataatacaaaaaggatgggattagagaggaattcatagtagaagcaaattctgaagacaataaatacagtttaagtgaaggttaaggtacctggtttcattaaagaaaaatcccatgggaaaagtcatggcccattttaagtgttcatctccccaaaaataacaaattaacccacacacataaggagaattgttttagatcagctgctatattccttgaacaaggagcctaagtttctcagtgcttttatagtgtttgaaaatctaaaagtcacttttaaaatgacctgcactgagtcactcaaggaattttaaagggaacaccaccacatgcctctcagcagcttttaatttcatgtgatcaaattagttttccatgcctacaaacacaagtgggaaaatgttctctactactccaaaacttaatcaagataatccatttactgttctctactacctgacatttcctgtgatgtagtaaccagtagtgcattcctaagagctgcctgaagcacgtaccagcaatcatagaacgaaccgctcttcaaagacttgtaaatcaaagctggaggggaaggcactgacaggaaaagctcaaatacttggcaaacttcttggcatttttcttttttaaatctaataaacaacctcttgaaaattcatttttatactattcaaaatagtattctacagaatattgtcaagtttttattcattaaaaagatgaccagaaacatctcagctatgaaggctgctgacaaaaagcatctagtttccttagcaacaaacaagcctgaaaaatcaagaggttgacaacgaagtggaatggatgatatgataaaaggaaaaggcagctctcatggatccacctcgtgagcccagattcctctgctaatgcttctctgttttcttcttgtcagattggaaaatctatatagtatacagagtggaaggcaaaatcaatacactcagatagcagccagcaataatactcaatatttgactcaaataactacaacagtcaccatttttcatactggacactttgcctttcccttacaatattacaacaaatattttaagcgacatgcacaagtaatacataccaataacctggttggtataaaggttccacccatacagtttgaatataacattaatgagagcttaactgttaacattttagggagctaaaaattaattatgtctgtgttttgtttgtaaatgacatatttttcagaagatctgaaaaactgtcaagcaacaccatggacgtgttaaaaaataaggtctcttaagaacgtcttatttattaattaaaaataaaatacaggccaggcgcagtggctcacacctgtaatcccagcactttgggaggctgaggcaggcggatcacttgtggtcaggagtggtgaaactctgtctctactaaaaatacaaaaaattagctgggcatagtggcatgtgcctataatcccagctactcgggaggctgaggcaggagaatcgcttcaactcaggaggcagaggatgcagtgagtcaagttcgcaccactgcattccagcctaggtgacagagtgagactgtgtctcaaaaataaataaaataaaataaaataaagtgcagtatggtgaaaagaacaaagctaaagtctgaacatcttacttctggttcaaatcactaaccttgggcaaatcatttaacttctctatgcctttagtcatctatcaatggagataattgtattaacatgtgatgagcattataaagcacactagtgtttaaaaatgtttagtaaacatttgctgtgtttttgttaatgaagactagaagtctttataatagatgttagtttaaaaaacacttcagaaacaataccgcatttgattttcacaactcccccaagttaggtagtactatccctgtttagtaaaagtgaagcagagaggttagaagacttcttctaaatcacataatcggtggccaaattataaagaatatccacgtcttcagggtctccaggtccagccttcagtctaacaccatattacatataatattcaatgtccttataacattaaaattacttccaaattatccacaagttcaactcataaaccgttttatcagtctggctttaacaaaacatataaaccttccttgctttcattgcgtgaaccaccctgcatgccctcaatagtaactgaaataaacatctatcaagtttaccgctaatgttgtatacttacaaaatgataatacaaagtctaagttcccatttgctgcttcacttctcaatccagcttgagaaaacatatcactatcagacagacatccattttcctggagataaagcatatatcaatgagaatacatctcagctaacaatattttgataagccaaagatcctgttttcctgattatttgaatcaccatattctctgattttctagaaaaatagataagctcagtaattgaattttagcaaaaatttaaagatgacatttcagcattctaagttaaatgcttatcttcaaatacagatggtctgatgcctttagagggccttacttccaggatgagtttactactgaggacactagaataattctcccattcaagacaaaacaaagattcaatgcattaatctaaaatattttggggcatacagtttggccaggatctaatttaatgtaatttaactcatagaggctcatcacttgtcccaacatcatttgtttaacaatttaaatatatgagtcaaaatttagctcaaatacatttattgaatcattttattatagtatattaaaaaaccacttaatcagcaataagcaaggataaaaaataaattatggcatacccatacaatgaaacagcatacaagcataaaatatattttgtggaattaaatactgttatgaaaaggtgtcaaatgaaaaaaagttcatcatgaaacaaatatgagagaagtgtaatttttcttcaggtctctagtaagccagaaacagagacttttagggggagtttgaaagtaatgaaggcaaaaagaagtaagtttttaaaaggaaaataagaatgttctttctttttattaaactatagcctctgtcaagttaggtggataataggaacagtataataagagttgctcgataatatgaacagtatactttcttgctaaaagagatttctccagcctagtatacatctgaaagaacatacatgctaagcaatgactatctcaaggaactatggacagattgtacagccctaccacttacttgtgttctctaatttatcaacaaacatttattatgtaatttctgaaaactaatttaaaaatgtactttttaatgcccagctgaagacaaaaggcattatcaggtagggcgcagtggctcacacctgcaatgccagcattttgcgaagcctaggcaggctgatcacctaagattaggagtttgagaccagcctggccaacatggtgaaatcccatctctactaaaaatacaaaaatcagctgggtgtggtggtgggcacctgtaatcccagctacttgggaggctgaggcagaagaatcgcttgaaccggtaggcagaggaggttgcaatgagaccagatcgcaccactgcactctagcctgggcgacagagcaagactctgcctcaaaaaacaaagaaaaaaagcagatcaatactgtgagttctattaagcacttaacagagtagttgttttcaatcccaaaacactcaatactactgaaattccagcaatgaaggcaacatagttgagatgagaatgaatgtaaccaaatttgggataagtttccaaattagatctgctgttccctaagataagtcactagtgagaaagccaaagcagtaaccacaaagacactgatctgggggctgtatttctgcaaagaaagaaaacatctgaaaaagtaagaatatgtgggaaagttacttaaaaaattttttttaacagtaaaatatgtatagtacaggctcaacatactccactaagaacttagggaaagaggtgaagacactgaagatataaaccctaacacttcagaagactgtaattatgtaattattttaatgaaagaaacactctaacattattagaaaaatcaaggtattacatgaatgactgtgtaggaaacatctcttaaacaacatgttccttattaggtattaggtgctctgccaacttgttcctaactgcacagcactttttgttttgtttttgtaattcatatattcagcgctaagcatgctgttttgaaagtggaaaacgcaacctttgctaatccaatgcactgtcccaatcaacatcttcatgtgcctcttcatcaacagcttgcctactctgctaaggaccagaagtagaaaacttctggtagaaaaacaaaggtttgaagtttaaaaaaagagagagagacagaaagactagtatatatactattagtgcatttatgaaaatttatgggaagtgaaaaataatattcaaaaagtgaaaactgaagcagggcacagtgacatgtgcctataatcccagctactcaggaggctaagacaggaggattgcttaagcccagagttcaagaccagcctggataacatactgaaactcctgtttctttaataaaataaaataaaacctaatttataaatgaaaattgcaggggcatttcaggatgggattaggagttaatattgttttaatttttcccgatattggcatattgtctttttaatacacaagaaaaaagctgctttgtctttttgagttttgaaagtttaaccactataaatgttataccaactaatatttttacaaagctttagaaaattgtatacagggccaggcgcggtggctgatgcctgtaatcccaacactatgagaggctgaggcaggtggatcacctgaggtcgggagtttgagtccagcccgaccaacatggagaaaccctgtctctactaaaaatacaaaattagctagccatggtggcgcatgcctgtaatcccagctactcgggaggctgaggcagaagaattgcttgaacccaggaggcaaaggttgcagtgagccaagattgtgccattgcactcctgcctgggcaatgagagagaaactccatctcaaaaaaaagaaaaaaagaaaattgtatacagatttgaccattttgagtcctcagttcaatgacttttttgtgtgtcaacactaaacattaaggaggaaagatatcctcttcaattattaaattaaaaccacacttgtactcacctgcaaaatggctcgtgctgagtttacactatcaaagcatggaatcacataatctgtatatgtttcctgatcaggatgtactcccaattcttgcattcctttgaggatttcaattatacctaccaaataaaatgtagaagcacagagatagagaacttagaataaagtaagaaaagatcggtaagttcagttcaattattttctgaatcacagtataagaaaattactcagcaattcgtttgtctaaaaggcagaaaagaaacactgtgagatacaatgataaaaaaattaactcctcctttcttcatccccctctgtgaaacagtaaatttcaagaaactatccttgaaattataagtataaagaaacttgaaacaattaagcaatgtgcccaacatttctggcaccccaaacagtgattataatacaacactgctattatagagcaatgatggacttgtacacaaaaaatttgaccagaataaatgctgcaaagagaagtgactgatttcaaaacatgttttcaattaagcacttatgtaaaaagttccctaattgttactaatttctgatttcatattttacaatgtaagaaggaaaaattaatagagaacaatttaatgaattattgtctaattgtatttaaaactaacttaaaaatcaaataagttgtttcctctatctcatttcccactcacaaaaatctcttttaataacttcttaaaaattaagtcatttcatgttttcagagctacagtgagtttcaaatagatccagttaattctagacaactgtcagattactcaagtatcacctaatttgacagaggctacagtttaataaaaagaaagaacattcttatttctccttctaaaaacttacttatcttcagcttcattactttcacattattaaaactccccctaaaagtccctgtttctggcctactagagacctaaagataaattacatttctttcgaatttgttacatgatgaactccagtacaaataattgacagtaaattcctactgagtacagaaaaacacaagcaagtctaactacattataaatacctgcacatttcttttagataaaatttaattatgtaaaaaaaaaactataattttttttaaaatttaggttatgaatcagaatattttaactttaaacagttcaccatatacaaaattacctaatactggcctaaaaacagacaaatagaccaatgcaacggaacaaagaatctaaaaataaacccacacacatataatcaactaattttgacaaaggtaccaataaatggtgctggagctgcaggcagtggttcacacctatagtttcagctattcacgaggctgatgcaggaggactgcttgagcccaggaggtcaagtccagcctgggcaacatagcaagaccttgtctttttttgagactgaatattgctcggtcgcccaagctggagtgcagtggtgtgatcttggctcactacaacctccacctcccgggttcaagcaattctcctgcctcagcctcctgggtagctgggattaaaggcgcacgtcaccacgaccagctagtttttgtatttttagtagagatggggtttcaccatgttggtcaggctggtcttggactcctgacctcgtgatcctagagatggggtttcaccatgttggtcaagctggtcttgaacccctgacctcgtgatctgcccgcctcagcctcccaaagtgttgggattacaggcatgagccaccacgcccagcctggacccttatcttatacaatacacaaaaatcaactcaaaatagattaaagacttaaacttgaaaccataaaactcctagaagaaaacactggccttgacaacgactttttggacttgagaccaaagcacagacaataaaaacaaacagtgaagtggaaccacatctaactaaaaagcttctgcacggtaaaggaaacaataaaatgaaaaggcgacctatggaatgcgagaaaatatttgcaaaccacgtatctgataaggggctaatacctaaaatatataataaggaactcacaaatttcaatagcaaaaaaaccccaaataattcaattaacaaatgggcaaaggatctgaatacacatttttccaaagacataaaaatggccaacaggtttatgaaaagatgctcaacattactaatcatcagggaaatgcaaatttaagccacaatgagatatcaccttacacctgtcagaatggctactatcaaaagtcaaaagcgattagacagtggtgaggatggagagaaagggaaccctggtctactgttggtgggagagtatggagattcctgaaaaacttagaagtagaattaccaacaatcccacttctgagcatatgtccaaaggaaataaaatcactatcttgaagaaacatttgttcatcccagcattattcacagtacccaagatgtagaaacatgctgtcaacagataaagaaaatgtggcatatatacacatatagaatggaatattattcagccttaaaaacaaagaaaatcctgtcatttacaacaacatgaatgaacttgaagcacatgctaagtgaaataagccagatacagaaagataaatactacatcatctcacttatatatggaatctactaaaaaaaaaaaaagttgaactctgttatgggactggggtgtgagtgaaaagggatgatggtccataggtataaattttcagttatacggtaaataagttctggacacaatgtacagaatacttgatatttgctgagagagttgatctcaagtgttctggccacaatatttttttttttttgagacggagtttcgctcttgttgtgcaagctggagtgcaatggtgcgatctcaactcacagcaacctccacctcctgggttcaagcgattcttctgcctcaggctcctgagtagctgggactacaggcgcacgccaccacgccgagtaatttttgtatttttaccagagacggggtttcatcatgttggccaggctggtctcaaactcctgaccttgtgatctgcctgcatctgcctcccaaagtgctgggattacaggcatgagccaccacgcccggccaatacaaaatttttaaaaaggtaactagctaaaaaaaaataaaaataaaaaaataaataaaagcccagcacggtggctcacacctgtaatcccagcactttgggaggccaaggctggtggatcacctgaagtcaggagtttgagaccagcctggccaacatggcacaatcccatctctactaaaaatataaaaatttgctgggtgtggtggcacacacctgtaatcccagctactagagaggctgaagaaggagaactgcttgaacccagagggcagaagttgcagtgagctgagatcaccccactgcactccagcctgggtgacagagcctccataactagctgaggtgatggatatgttagcttgactgtggtaatgacttcacaatgtgtacacatatcaaaatgtagccaggtgagatggctcatgcttgtaatcccagcactttgggaagccaaggtgggaggattgcttgaacccaggaatttgagaccagcctaggcaacacaaggagacccctgtttctaccaaaaaaaattatttgaactagccagccatggtaatatgagcctgtggtcccactgaggctgaggtgggaaaatctcaagcctgggaggtcaaggctgacagagtgagacactgtctccaaaacatcatgttgtttatcatatagatagatgatcgattgatagaaagacagatatagatttagctacacaattattaatccttcatacctcagtaaagttggctgggaagaataaataaataacctaatatcttcaaatctaagaggtttaaatgtatttttcaagatgtaaaaataatgtttttaattagccaggcatggtggcaggcgcctataatcccagctactggggaggctgaggcaggggtattgcttgaacccaggaggcaaaggttacagtgagccagtatcacgccactacactccagcctggacaacagagcgagactcggtctcaaataataataataatgttttttaaaatccctaaacaaagcatgtgcttactgaaatttaagagaacatgcatgtagagttggtccacactgcacacagaagcctaacaatacttgtaagcgaaatttaaactattcctctaataattcactgggtatcactactaacaaccttgataactaccataaaagatggcaaatcccactgtgctcttctttatatgaaaagattactaagcacctgacatgatgacatagctaagttgcttctgaattcctagtaatagatttgtgttaatcttatgtcctcagtgtcctttctgaccagtaataattgtttccaggacaattattatttagttaaagtaaacggctaagttgctggtgagatactctggtgaaatgacaaaaaaaaaaaggctttggactttaaagacccagctctcccccttagttctggtacttaatagcaatgtaaatctaagcaagttgtcgcatgtttctgagccataatttggtggcttacacactagaaatggaaatatgccaggaactgtgcttccagacgcttttacacatattcctttgctaaatctttctaactaccatccatggactatgcaaggcaatatgtgtcgaagcacttaatgaataattttctgacctataagagtctatgcctattgaatagatggaagttccaagaactgaaatattatacataggcatggaagaaattcttgtggtctaaattcttagggcaagattgcagacaacagaactataacattctggaaaaaaagaattttcaatattaccacttggcttagatcagtatgtcaaactccaaggtttcaatcagggtttgggtgtgcttctctacataaagaaagctgaaatgcctttagaagtcaactaatcaagtgaaataagctagacacagaaagacaatactgtctcacttacattagaataaaaaacagtcgaaaactcacagaagcagaaagtaggacagcagttgccagggactagggtgagggagatattggtcaaagggcacgaactttctgttaataagatgagtaagttctagggttctaatgtacagcatggtggctactattagtaatactgtattgttgacttgaaattggtaaaagaacagattctaagtgtcctcaccacactcatgcacacaggcatacacacaaatggttaactatgggtgttgaaggtttatggttgttaattaacttgactatggtaatcaggacacaatgtacctgtatataaaatcattatattgtacaccttgaatatatatagtttgtgtcaatttttaaaagtggggtaaagaaagtcaatgaatcttctaacaaaagtataaagtaatttctccaagatcacaagcataacttgagtaagaaaccaagtctcagtccgggcgcagaggctcacgcctgtaatcccagcactttgggaggccgaggcgggtggatcacaaggtcaggagatcgagaccattctggctaacacggtgaaaccccgtctctactaaaaatacaaaagattagccgggcgtggtggcgggcgcctgtagtcccagctacttgggaggctgaggcaggagaatggcgtgaacccaggaggcagagcttgcagtgagccgacatcaccactgcactccagcctgggcgacagagcgagactccatctcaaaaaaaaaaaaaaagaaaccaagtctcttaattcctggcaggtgcttgttacactacaaaaaatgctaaagcctacatgtttttcctgcaatcagaaagaactgggattaagtccttgttctgccaccaaaaaggatgattttcagtggctccttgttgccaatataggaatgatgataataaagctccccacttaactctcagggtagtcactaaatttaaaggaaaaaatatgtgcagaatcctaaaactactaaataactgggtgtgtggtgttttgtttttgatttttttgttttttgaaacagcatctcactttgtcacgcaggctagactgcagtggctacgatcaaggctcaattgctaagctctagcaatcctcccaccccagcctcccaagcagctaggagtatgccacctcgctcggctaatttttctatttttttgtagagacaggattttgccaacttcccaaggctagtctcaaaatcctgggctcaactaatgcccctacttcagcctcccaaagtgttgggattacaggtgtaagccaccacacccagcctaaataaatgttaataggagcaataataacttaatttttttcagctgtatcaaaatactgtaataatacataatcctgaaaagtttctcagatgatagatttttcagtgtttgaaaactggccaccaaattgactgcagctacaagattcttattcttacaggaaacccttcaccccatcttctaagcctcaaatatgtttcattctcttagttcttcatttttccagtaacatttatcagaaggaggagtatgttctgctcatttacattatctattttgctggcatttttaacttacattatctttctaactgaaactaaagcaggctcaagaaaacctgggatcccaccttctgctcaatcactcgctcaggcagcctgagagagcagacaaagaaagatattctgttcagtaactatagtcagatggggggatagaagcacttaccaataagaaggaaagactgatctatctgaacaaattctaataaaaaatacaattcacatttcttttcacaagaaaaagattaaaataatcttacattaacttagatataaatagattccaaacctctgtgaacacagaaagtctaaactaagactaaataatctaataaaaatatttcaatatagccatgagaaagttgatcaatctagaggaaagtctccatttaaaaagtttaatgagaattataacagctcaccaactatcaggaatgatatatgatttgcctgaacaactttcaccaactatgactgtttcattccacaggattttacactctagccacggcactcactttattaggaggcaactgcttcctctttgaaaagtaagttccgccaagagtggtggctcacgcctataatcccagcattttgggaggctgtggcgggtgatcacgtgaggtcaggagtttgagaccagcctggccaacatggtgaaaccccgtctctactaaaaataccaaaaattagctgggtgcagtgacgcatgcctgtaatcccagctactcaggaagctgaggcaagagaattgcttgaacctgggaggcagaggttgcagggagccgagatagtgccattgcactccagcctagacaacaagagcgaaactgtgtcaaaaaaaaaaaaaaagcaagttccttctattcaaccacttcactcaactggcatttgggctttctgatcagcccttctttatgtattttatccctttcacattctcatttctatgttttctaaatatgcccagggatatagatccatattcattacaggttatttcctgaaagtcaggccaactggctagagatgcattattctaagtgataacttttcacttgtgccacagagataaatactagtaagatgagccatgaggaagtaattataaatatctttcttggaggttggtgatggctaaatttgcagccagaaaaattcaacagaaacttgattattatacagggcacatgccctcaggacctcctgaggctgtgtcacagtaaaaaaaaaaaaaaaaaaagaaaaaaatatatatatatgttttttaaaagaaaaaaaaaagacacttgattatcctattgttgaaaactcttggttccactttgtctgatccccaaatatctttgattttctgaagagatgtatttattcctcatgaaacacagcacatcctccatcactgcagtcactttcttctgtgatttctaccattttatacgtgactttcactggacaaagaacaagttcattgcactaataagaatgttactttcttaccttacactaaagaaactataaagaatacatacagccatttctctgttatataaaagaagactgtagaatatatactttactatctttcaggacctactgcaaagaagaatatattgtttttaaaaattgtaaaactgacaatcttttgcactctcagaacacacaatataaaagcataaacttttatattttttcagacaaaaccttcatcgattaaaaaattcactctcttttagcaatgttattcgtgtaaaaactggcaactaatttttaaacagcagctaagaatttttagaaaataaacacagtatagtacttacaaaagctgaatatggaagggttatagtataaaaaaggatattttaaaaggaggacagaaaccctctattctaatcccagcctaatcacacctagacgtggaagctaaggtcagtcactgaatgtctgtgtggccctcagttccttcattcacgtaatgtgagctttcagtacagcacttttaaaatctaaattctgagattctaagacaagatggatttgagataaagcccattttctactatttcaactgctacaaccatagaaagaaattacctaactcttttatgtttactaagtagtaaaaatgtagtaatcaattcaactgtgacatggttgtggaaagcagattaacctgatgaacaaacatttcaactggtaccaaaaaaattttcatacttgtgtaaaggtggacaatactaacatgcctgaagagtttgatggaatgatgtaaactttctgtggttccaaaacactgggttataggttaccttttggagctttcagactggaggatatacaaagagttaatcaaactagcatattgttttcacaaagatttttctaaaaaggatttagagacttttatagccagaaacaattagggaatacttgtttcactatttcctttaaaccagaagacggctgtacatttaaaataaaattgcaatatgaaagtctgctaaaagcactttttttgttgtttgtgcattctgtttgtcacccaatgtcacactaacaattctgcatctcattccaaagcacattatacttcgagataaaatgaaaaagaccattttttgtttccccaaggggaaagtacttctgttaaaagcatctttttatgagactactctttctgaattaccaataatgcaaaccgaagaattagatactgtactctaaaatttaatatttgttcaattcttattcatatcctatagacatcccatgtgtacaagggaaaagtatgataaatgcttaaacgtacttaagaacctgaaagattgaacatttttgtccttcaatcagcaggctgtcaggtcatgagtactcatttcacaataaaagttttcctgcctttcctattattctaactaagctcagttaaaaagaaatagattggcccacaaagaaaatgaccatactttttgttttcatgaacctaattgtatatacaactttatctttattaaaggtagacaatctgatttcaaacactatatataaaatcaagaactaaagagtttttttaagaacttaaaaaaactacgttcattaagtttgaatatcaagatcagagatgaaataagaaatgaaattaatgaaattcagatgaaagaaatccatcatgttttgttttttaaaatgcttacacataatacttcatgatgacttaaaacaattccattatctcataatactcaggaataagtatgcttttccaaagaatccaattagatgtgcgtgcaaactgtcatactggctctgggaaccattacaaatcggtaaaaggcaaaatctaaccttgaacatttttttccttccgacgtccaactagcaatggccagaaatagtgaggtctgataggaaaaccttcctccttcacagccttcattaaggcttttgccaaatctgaaagagatatcataaaagatcacaaagctacctcagcaaaacttccttacttggctttaactttaagaatgtagtaccagttttattggcgagtaaagcacaatggagggtgaactgcagaggaaaggagtgcatctggacttcctttaacttcttacagtagtctgttagcttctccacaggctgtgggaaaaaagtcaccacattagctggattggcaaacaccccaccgtttgacctgctgcaaatattctaccacttctgagatgagcattttaaaccccgcatcctctttctacccaaaaatcttgcaacacaagaacattgttatgatgtttacaactggtctaatcttataaatgttcctatactttaaagaatcttatttcactgccaattacattgtctacaaagtaaaagtggacagaataccgtattcatagtcacacagtgttgtaaaaagaaactgccaaagacacttgggccatcttcctttgatacggggcatgctagtaaaatttgcaacgctacatcttccaatttttcagtgactaaaagtaaaatgaggttcattgcatctgggaagaaaacaaagacatcttttgttaataaactgaacaatatttttacactgcaaccaatgttccaatactgaagacaaaataagaattgcaaacatcaaaagcatataactgcctaaataacaataaaacacctgcaaatcaaatcatccccatgtgttcattaactcatgtttttgggcttatttaactgactttaagagttctatgttcaactcccacaatgcccattgttagaaaatgtcctttccatcatgtaagaatagcaattcagatttttataaaaatcatgtaaatagatttttttaaaactacctggaatatatcttctttcacatgtaactttttccaaaatttctgagacatactgaggatacccagctttactgaagctaaaaataatttgcagtaaatcacggtccataaggtgaagctcggacttctccaccttctccagagtctatagagagttccagaaattagaagacaaagttagagtgtttttatttaagtattaaagctaaataaaatatccagattcaaaaaactagggaaaaataccacctaaaggtttacgacttcttttaaaaaacaggaaatactctacttcaacagtaactgttacataccagcaccgagatactaaactataataattctccataaatactactttctgcaaggaaacatctttgaaaacaggtataaacttcactttcctgcctcatgtaaaacataacacaaatttttacaaatgattttaaagtatgtttatttagacataagtcatacctgcttaacatggtcaatgtcgcccttctcagcatatgcattcaataatgcgaggtatgtgtctggaccaggctcaattccggcatctctcatcactgtgagaatgttttctgcattctccatatcactacaagttaattcaaaaaacagattattatgcttttgccaaatttaatatagttattcaaactaaaacatatgcttattaaaataaaaaatgctaagtaccatttggaattatgatgtcagaaaagaactaatgtatattaaactggatatatgtttctgaaataataaagatcataaacatctgatcccccattaaaaaataataataattacatagacattaaataacataccctcttaatattatgtaggttatgactcagacttaactttcgaggtaagaataacatttagtaaattactcttcaaaaataaaaatattttccagagcagttacttcagatcagatcaagcccagtttcttttttcttttttttttttgagatggagtcttgctctgtctcccaggctggagtgcaatggtgtaatctcggctcactgcaacctctgcctcccgggttcaagcaacgctcctgcctcagactcccaagtagctgggattacaggcacctgccatcatgcccggctaaatttttatatttttgtagagaccgggtttcaccatgttggccaagctggtcttgaactcctgacctcaggtgatctgcccacctcagcctcccaaagtgctgggattacaggcatgagccaccacgcccggcttcaagcccaatttctaaaaattcaaataaaagaaagatttgtggaacaaatgtaaaagctcattataaaaatattagtatgctctacctcatatactacagatttttttttgaagggatagacaaatgtattttaagaactgtctacaataattttctctaatttaaaccccacttaacaaacaaaaaaggagtaaaatgaccactttagcatctcagccatctatcacttaagaaccaaaaccttaggttgaacattacccagctctggcatgccctgtcacaagggcactgaatactgcctctgtaactgggagatccttagttttcataaatccaagaatcttgctgcaaaggaaaaacgaagatactcattgaaagtatttataagaacactctttacaacatgtacagaattaggccttgagttacttttgtttttaaaatataatagtaatatacatttgttttagaaaccacaaagaaagaactaatccctttgatccccttcccacaaaaccccactctctaatgtatcaacagtcttgaagtactatcgatacaaatactagatttttaaaaatctgattatctgatttgtcttacactactaattacccttttaaaagcatagtttcataagattcttttagataaaaatgaaattatgtattccaatttatcccttattttccaaaccttccattcataagtagtaataaattttacataagcagagaaatggtgcaactgattttctacactacttccagttttataaatgaatacagcttaaatggttaagaacatttcccttaggaaatatttaaaaaaaaaaaaaaaaaagcaaagtcagctttatagctcaacaactttatacctctctccagtaaatcaaatttttaattaaaatagcaacttttacttatcttttctctcttacacgataattttatattttatgtaagtcagattaccagattttctagattaaaacagttctgaaacaatttcctccattaggaagaagctttaaaacaaagagtgaacagacattagatttacaaaatgtacaaatttgttcgcttaaacatgttcatacagatccatacctggcaccttcaatatctcctacattacaataagaagcaatcaatctctggtatgtcacctgtcaatgaaatgggccagttaattttaaatatacttttttttctgagtaaagaaaaaaaatggtggatgtgaaaatatattcacaatagcaactacttactcgatttggttgaatgtttgcttcctccatttttgccaggaaatcagttggtgagaatttatattcattttgaagatagactttaagtaaagcattatagtgactcacatcatacacagcacctacaaatgaaatttaaaatgaatttttagaaaagcattgaaaatcctatgctttaaagtggacctaaatttaacaaacaaaaagagtaaaactatcactttagcatttcacccatccatcttggcgctcagacctatctacacagatactctgtcacacagagcaagctaagcatgtaagacagtaattactgagttactgtatagttacaagtaactgcctattcggatattaaaaggcctcttacttatgaagcacaaaattatcttcctgttagaaaacgctgacaatatccctatatttaaaagtgactgtaagatttttctatataaagcagtcctcacattacagacacactgtgaagaatggattgtaacttcagttctttcacacagtaggactgtgctggcaattctgtcactcaaagccttcattttaaggatgcattccattttcagctgatgaacatgatctatggtatgctcttgttaattatctgtattctaatgacctttgttttctttgtatccctactgtttagggccacatcaaataaggttaccacacagccttactctactgagtcatgacatcatggtctttatatcaattttgtggtaacatgtctcactacattttcatgcattaaatttcacatctttattcaactgcctgtgaccatacaggcctatggttagtatctgggggtgagagtatgtgattttaggcagcagagagctgttccattaaattaatacacatttttatcttaacagatatgtttctttcatactatgtttcaggcactatgctaagtgttccacatatagtggctcactcaaacttcacaacaactttgagacactattatcagccccatcttacagatagctcagatctgtcaacagctcattctgtaattttggacaagttacttaagctaaaagatctcttgtatctttataaatctgtaaacaagagtcaaactggcaaactacaaggtttctggcaatattaattcaacaagtatgtatcaaatgccattatacacaaagcatcatgctactgtcaaacaggaaaataaagaagccatggattccatccttataaagcagacacttatacaggagagacctatctgtaaagaatgttaatataataacacattgttaatctttatatggaggaattaatgttattactgctgtgtaatgcttttttctattttagaatgtaaccttttctgcatatatttctcccagttcaatgacttactgacatacagaaatttctaatttttagagattcaatattttagctttacttttctgctccttttatacttataaaatccttttccattctgaaagtcaacatttatctatatagtttttaacttaaaaaaaaatcaacttatcaaaatgtattctagatgtattcaaaactgtgaaggaagaatctgtctttatcctgtagtttttttcacataggtcctactcactttttgaaggatagtcctaaatattttatttatctgtagctatactttcttggattcttttctctattttcttttataactagaagaggtatggattcttaaacatttagtgagtccagctaattactgtgagctgattttctgggattttgcagattaaacaatcacatcatctaaaaataataacttcttgtattgtttcacatcttatttcattgcattatacatgattgttgtcggttttagatttttaacacattaaagaagcatctttctatactttaagatttttttaaatcaggaatgaacattaaattgtattaaaccatcttttttcaaattattttttgaatacgtactatgttacatgacataaaactgaaaaggtataaaaaggtcaagtaaaacctgtatccagtgttcatcatccttctagaaatattttaatattgtatacacatgcacgtgtaaaaacacttttcttcaaaatggtatcattctatacatactggtctacaccttaatttttatttatactctggagaacacccccattggcatataaagagcttcttcatttcttaaaacagttacacagtaatctattttacgggtactccataatttatttacctaatcccctagagaagaatatttgaattggttccaatttcttactattacaaacaagctacaatgaagaatatccttttgcatatgtgagtatatctgtacctaaattcgaacaaatggaactgctcggtcaaatggtatgtgcatttataactttgacagacaaaccggctattttcttctttttcttttttaacttaccgtacttgtaagtaatacttgttatgaaaaattatttattgttaatgaccctagatgtcactatacctcaccaaataaatattatcaaaaaattatgaatcaagtagcccttccataaaactgaattacagcatttatgtaaacaaacacttttttgcaaaaagaaaaaacatctacaccttttatacacatcatatatttaaacaatcatacctaatttctgaagtgtgtcccatatcctatgagcaaattctgttctctcttcaagctttagttcaggcaagagagaaccacaactacgtagtagaagcaaggcatgactaccacctaggccacctgtggaaaaaaggttaatggataacatttaacatagcagcaatatcacatagataaatatcaaaatttaaacagaaatctataagcattcaaaaatcttctggctcaaactgagagtaaccataaattagaaaaatcctatcctaatgtacagtgttactaagttacaagtcaaactttaaatattagtctgctttcttaagaaatctaaggttataaaatctatgtaatctgcaaaactctatcaaatacaaaaatacaaagaacctactttataggcagtgcttgctacaattcaaaggctaaacttcccagtatcttatgaaaacagtataaagggccaggcgcgaatcccagtactttgggaggttgaggcaggcagatcacctgaggtcgggagtttgagaccagcctgaccaacatggagaaaccctgtctctactaaaaatataaaattagctgggcgagatggcgcatgcctgtaattctagctactcgggaggctgaggcaggagaactgcttgaacccaggaggtggaggctgcggtgagccgacattgcaccactgcactccagcctagacaacaagatcaagactctgtttcaaaaaaaaaaaaaaaaagaagaaagaaagaaagagagagagagagagaaagaaagaatactgtaaagcagtgtaattaacatctatgaatagaaaagttaggttcataatcagctacaatataagcttccctctccctatatctgtaagctttatctacatatccctgaaagctgactttaaaacaaagcaaaaataaaccacttagtatgattccatttatatgaaatatctagagtagggcaaacctacagggacagaaaatacgctagttgttgcctacggctggaagggatgaggagttgggtaatttctttttggggtgatgaaaatgttccaaaactgattgtagtgatggttgaataaataagtcagagagagaatgtgacacaggtctttaaatgtacataactatagtaataattaatacttctttggtatctctcaccatcagattttatatctacacttctgagtgtgtctgaaacccacgaataggctttaggaagctacagaatcctcttaaactgcatgcaaaattatgcatatgtttgcatgaggcttttgggggtcgggggcagggagtgaaagacctatagcttgcatcaggcattagtgactcaaacagatttttagtagctaattgaaaatgaaaggaaaataatggaaagctgtcttatatgatcatcttacagaaacctgacactctacaatggaaggtaagaaaaactagttatcttccaagaaacttactactaaaagtgactccataaactaggaaaagcaaaaagacaatttttattttctgatatggaataaacatctagaccaggtatggtggcccacgtctgtaatcccagcactttgggaggccaaggcgggtggatcacgaggtcaggagttcgagaccagcctggccaacatggtgaaaccccgtccctactaaaaatacaaaaattagctgggcagtggcatgcatcggtagtcccagctacttgggaggctgaggcaggagagttgcttgaacccgggaggcagaggttgcagtgagccgagatcgtaccactgcactccagcctgctgggcgacagagcgatactccatcccaaaaaaaaaaaatctaaaaatgttttagttactccaaactttgcccagatgagttgacaagatagaaatcacaatcataacataaatgacaatcaacagaatataacaaagaaaattaaagtatcaaataatctactgtgtaatgagcttaccctcaagtatttatttaggttgatgcaaaagtaattgcagccattatgtttaatggcaaaaactgcaattacttttgcaccaacctaaatttaagacttttttttttgttttaaagacagatgtctctctctgtcgcccaggctggagtgcagttgtgcgatcttagctcactacaacctctgcctcctgggttcaagcgattctcatgcctcagcctcccaagtagttgggactacaggcacgcgccaccatgcctggctaatttttgtatttttagtagaaatggggttttgccatgttggccaggctggtctcgaacacttggcctcaagcgatctacctgcctcccaaagtgctgggattacaggcctgagccactgtgaccagccaaaagtcaactttatgaacaggaaattttgaaatacctgagcggcaggtatcattaaaaactttttgtagaagcttctttggaatgcggccagttcttcgaacagaaagatctagtctcattagagcccaatcaaactgattggaaatcttcctagaagaaaaagtggactcctcttgaatatctttttctttggcagcaatggcatacagcctggctgggctcagtagtcctctaaaaaatgaaacataattaataataatcagttgctatctatttaggtcattttttgaacaaaacttaaacaaattttaaaattagttattaaacacctaaaatcacagtacaataccaaaaatagaggtatgaactaatgggaaagaaagttttagcttttactttagataaaatcatatacacacatacataaactatatgcacagtaaatctcctgaataattgacaacatcttggtaactttgaacatggaatgatttcaaaatcagatggaaatacagtgtgttttaagtgttttttaaatctctccttaaccaaaacaaggtaatgacagaagatgaagcagtttatgctgcaaagctcttctcatctctgtaaataagacaagagatctaaaatatatccaaaatttttataactacctttaagttttctaggtataagcttactatgaatttaaaagaagaccaatgtccaggctaaaacgatgcagggtttttttttttaaggatcatttaggcccaaataatttctaatctgtctaaataaagttgaaacacttaatagtgataaggctcttaattcttatctgctgtgcaactgtcaaaatgttagctgtattctttcctaattatttaaaacaactgccaccaaaaataaataaagtgttaaacatcattaattttaaggaagccagaatggaaagaaaaatgattacaaattaggtatggtcagaatagtacattatgtgtttacaaagagcaagcaatctttaaaccattcactattttagtaatggagtctaatatgcaagtcgaatgctctctaacatgaaatctgagggcttctaggctgtacctttttttaaaataaacacaattttttacagagactaggaaaaaaaacaccacaatttttagaatatttttaggtttatagaaaaatcgtgcattaagtagagttcccatatactttcttctctaggctattctaggtaaaaatataagctgtacctgatttaaaaatatcagataaaaaataattcttatgtgtgaaggaaacctgttatcaatctgagttgaatttaaaaatgctttctctgcatttaaacatcacttttaacaaatgatttctaattatcagtggtttacacatttattgcaaatatcttagttacagcagccactaaatatattatacactatataacaactaagtataatataatcacatttttcagacgtacacattttcatcacaatggtgactttaaaaataaaacttacatttctatcctatgttattaatctgaaaaaaccagtcacaaattgaatgatcaagtatgtgttgttttactaaaggaaactatactagaggtttcacctcaagtttatataaaacgaggctgtaattgataatagactagaaattctaccactgtgatctgggagaaatcatgactctaaccattagtgattccaccatctaggtataaaataatggaaaaaatcaagatactgactaaataagacaatgtcttatttttgtaagaccaatgatcagcacattgtagatggctaattgactcgagtttgtcaaacgagctgaattaagctacaaaccacagaagatatacccttaaaataatatttatcccttacttccaaaaggcatttatctagttgctctatcagttgttactaaactatccccttcttaatgtcccgcaagcacaaagtgacattatttttaaactgtccaggacaacatgtcaagtttggaggagtatgcaataatattagtcaacaacaaaagctgattaatacagaaatttcaaaattgtgaagtctatttgccaaagttttttacacaatgcaaatctgataaactgttaaagagcaaaaataaaacttccgctacaggatattttttaaatgtaagagaagaccaactcaaatttcaggcagaaaacatgtttataaactagcacattgttctgaatattctaggcaaatttttctcatatacatgtctttactgcagccgagtctccttctcataagtgtgcttggatttaattaagtagaaacatgaatctattataaaataaattgggatagaggaaggattacatatttaaccaaagaagtcttcactcttcagttatatggtccagaacttatttttaaattcactctaatacattctggaaacaagagtttcacagcctggagtaatgggtatgtcgtcacagaaaagaaagaacagaacaagtccaggggtgacggtggggccccacaagaagatcacacccaccaggcttgcacaagctggagctcactgcctccaaatgctaaggaccaaaattgatataaccacataaggggaaattattgtatcatctcatccaagtatcatactggctcctttacatttcctagttaaatgtctcaggttccttccagactccagctcctaccactaatactcaaattacccataaatgttttcttgtaaaatctaccatttaaagttattatctctcagtttttttaaaaaaattaaggtgggtttttttttaactcttcaatagaaaacgatcttatagttgaatgtccattaaaaaaaaaaaagatataagggatcagattatcctactaagcaggcttccatgggaccctccccactacttttaagcatgtaccatttttttaaaaaataaacacaattttttgataagcagagactgactagaaaaaaacccacaattttttagtgtttttaggtttatagaaaaattgtactgaaagaacagttcccactttcttctccctcccatttcccctagtaacattttgctgtagtgtagtatctttgttacaaatgatgaaccaatgctgatacattatccatcaaccaaagtccataatttacattagagttcactgtgtgtatacatgttttgacaaacatatgacatgtatccacctttacagtatcatacaaaataatttcaccaccctaaaaatgccccatgctctatctcctcattccttccaccctccttccgaacccctggcaaccactgatttttacctgtctctagttttgcctttcccagaatgtcatatagttgcatcatacagcatgctgccctttcagattggcttctttcacctagcaatacacatttaaggttcctccatgtcttttcacagcatgacggcgcacttcttttcattgttgaataatgttcttttgtagatatacatgatttgtttacccatttgcctactgaaggacatccaggttgcttccaatttttgacaattatgaataaagctgctataagcatttgtgtgaaggttttggtatggacatgcattttgaactcatttgggtaaatacctaatggtaaatctatgtttagctttctaagaaaactatcaaactatcttccaaaatagctataccattttgctttcctactagcaataaatgagagttcctgttgtcctacatgcttgccagtatttggggttttcgacgttttgctggattgttgccattccgatagtggtatctcattgttgttttaatttatatttctctaatgacataagctgttgaacatcttttcgtatgcttatttgccatctatatgtcttttctggtgaagtattttctgcccatttttatttattttattttgagatggagtcttgctctgtcacccagactggagtacaatggcgcgacctcaggtcactgcaacctctgcctcaggattcaagcgattctcatgcctcagcctcctgagtagctgggattacaggcacacaccaccatgcccgactaatttttatatttttagtacagacggagttttaccatgttggccaggctggtctcaaactcctgacctcaagcgatccgcccaccttggcctcccaaagtgctaggattacaggcatgagccaccatgcccaggccatacacgttcttaaaactcttctctccactttttttcttcttcactgatattatgaatcagtttagtgtcactttagagctatcaagagtttaaaggtagatacaggtagaagacagaagaggcattattaatagctaatgtttatcaggtgtttaatttgtgctgggtatgagaaaattataacttacaaatgaaaaaactgaagcaacttgcccaaagtcatcacagttaaggctaatgatagggccagggttagcactcagacggtctcattctgagacggtctcattctgaaacgaactcaacgtggcaaaagggcattgaagaaactaatctggctgcaattgggtgttcacactggaaagtggtaaaaaattaaacctagacagtgagagtgagactagacagtgcaaagtctctaatggcagataaataagggatttggattttatgacacacttgtaaagtacaaaactagttttcatagagccgctctctcaacttattttgttgcactgtaatgtagaaaatggggaactcaaatttatctcctacgttttcaccaatccctaatttaactattccacttgaattttctttagcctgttgatacgctggatcacgtggattgattttcaaatgccgaaccagccttgcacagttggaataaatcccacttgatcacggtaaatcattctttttatatactgctggagcctcccgagttttaaatgtatccaaaatgcaaaaagataatgccttttaaaaatgtttggtaatgagccggacgcggtggctcatgcctgtaatcccagcacttaggggaggccgaggcgggcagatcacgaggtcaggagattgagaccatcctggctaacaaggcgaaaccccgtctctaataagaatacaaaaaattagccaggggccgtggcgggcgcctatagtcccagctactcaggaagctgaggcaggagaatggcgttaacccaggaggcggagcttgcagtgagccgagatagcgtcactgcactccaggccgggcgacagagccagactcctcaaaaaaaaaaaaaaaaaaaaggttggtattcccttcaaatttctccactgcaaccaaccattccactaataccctgttcccacaaactcaaactcaaaatcttagactaattattttattgggcaaagtctctcagcctttacatcccatctagtgagtgcttagatgtctgaggctcttgatgaactcatggatttctgcaacaaatctttagtttctcaggcttcagcctctcttcatacaactgccagatcaaccatcctcaaaaccatcttttttcaaaaatcctatcattgttctttacttatcacatcaattctgttcttccatttattaattcaaaatatatttactgagtgctttctatgtataaggcactggctagaatattcttatctagtaataaatctaataaattagacctttaaaaatattaattatggtaaatgtaattaagaaaagaaacaacgggccaggcacggtagctcaagcctgtaatcctagcacttttggaggccgaggtaggcagatcacttgaagtccgttcgagaccagcccggccaacatgtgaaaccccatctctactaaaaatacaaaaataagccgggcatggtggcaggtgcctgtaatcccagcaactcagaaggctgaggcaggagaactgcttgaacccaggaggcagagggtgcaagtgagccaagatcgccccactgcactccagcctgggagacagagactctgtctcaaaaaaaaaaaaaaaaaaagctggacacagtggctcatgcctgtaatcccaacactttgggaggccaaggcgggcggatcacctgaggtcgggagttctagaccagcctaaccaacatgaagaaaccccatctctactaaaaatacaaacttagccaggcatggtggcgcatgcctataatcccagctagttgggaggctgaggcaggagaatcgcttgaacctgggaggcagaggttgcagtgagccgagatcacgccactgcacttcaatctgggcagtaagagcgaaactccgtctaacaagaaagaaaagagacgccactgctcaataaacaatagctgtcttattatagaaggtgctcaataaatgcctctgagtttttgtttgtttgttttttgagatggagtctcgctctgtcacctccggagtagctgggactacaggcacccgccaccacgcccagctaatttttttgttatttttttcagtagaaacggcgtttcaccatgttagccaggatggtctcgatctcctgacctcgtgatccgcccgcctgagcctcccaaagtgttgggattacaggcatgagccaccacgcctgaccaaatgcctctgagtttttacaatatctttcctttatcttttttttgagacagggtctcattctgttgtccaggctggagtgcagtggtgcaattatggctcactgcagctttgaactcctggcctcaagcaatcctcccacctcagcctcagctcccaagtagctaggactacaggtgcatgccaccacagctggctaatttctttttttctagagacaggagtctcactatgttgcccaggctggtcttgaactcctggcttcaagtgatcttcctgcctcagactctcaaagtgcggagattactgggcctggcctaaaaaatcttttataaaactaagtcacaatgaactttctccctctaagaactgaattctccaaaaacttttgacaaatttagctgccccagttttatgctttatggtaaatcacagaattttagactaaaaaagctactagccacccttctacactttataacaaccttctggcctgaaataccaatccactcctttccacctatcgagatttcccttccatctcccaggatcctccagtcaaatgggatgtctcctgtgtctcacctatggaggaagtaatgcaaagtcagttaaccagattgggaccgataatgtgacatggacactcttcagaatctatgaagatcccttccagatacattctgagatcttctatgtttacttacctgtgaaagtctttaaatcccaagtttatatcatatattgccttttaaaaaatgtttttgtccataagtaatcccttcaccatctaaaacacaacagtctggacctcattctgcacccaatgataactaccatggcagttaactgtaaacaggaaaatgacaagatcaaatgtgtaacatatgtaaaacacttgtaacatatgttgcaacatatgtaaaacatttcagaaacgggaatcacggtatctggagttgaatctcaacttgaggtcttgaataaattatacttctaaccctgtttcctaatttgtaataacccacggaagttgaaatgtttgtatgatgttatgtttacaaacacactttgaaaataataaacatcaggccaggtgcggtggctcatgcctttaatcccagcactttgggaggctgaggtggtggatcacctgaggtcaggatttcgagaccagcctggccaacatggcaatggcaaaaccccatctctactaaaaatacaaaaattagccaggcatggtggcatgcgcctgtcgtcccagctacttgggaggctgaggtgggagaatcgcttgaacctgggaggcagaggttgcagtgagccgagatggccccgttacactccagcctgggtggcagagcgagactccatctcaaaaaaaaaagaaagtaatcagcatctattctaaaggtaccattgtttaccctaatccccaaatctacttttcttaattctgctaacactctcaccaatcttctgttctctttctctcaagaaacggatcttttcgtcagttctttactacctcgttgaaggcctattactgctaatttgcaataccagtgttgttccatccccacgttcctataatctacataaactttgtcaaaatctgtacttaaaatcctccaacggcttccaatcatcaactaacctaccttctaagcaatcttggtagcctcaagaaatcaacttccaccacatcccacacagctacacgggataaacggcctccaagtctcttcacgctcttctctatttttggaacattctgaatatccactaccatgtgtcctctaaaactcaatgtccccctgccataaaacaaatggcactgctcctctctctgaaataccacaatattatattcttctcttatggacagcacgtctaatagttgtacatgtgcctgtctagccctgtgattgataaatctacactcacagagcagaggccgaatgttacagatttcagaaccccaaaggacccatcaggttctttttttttttttttttaattgagatggagtctcgcttcgtagcccaggctggagtgcaatggcgtgatctcggctcactgcaacctccacctcccgggttcaagcaattctcctgcctcagcctcccaagtagctgggattacaggcatgggccaccacgcctggctaacttatgtatagatacttttatttttttttttttttgagatggggtctcactctgtcactgaggctggagtgcagtggcctgatctctgctcactacaagctccgcctcccaggttcatgccattctcccacctcagcctcccgagtagctgggactacaggcgcccgccaccattgctaattttgtttttgtatttttagtaagagacagaatttcaccatgttggccaggctggtctcaaactcctgacctcaagtgatctgcccgcctcggcctcccaaagtgctgggattatgggtgtgaacaatagtacccagccggacccatcagattcttaatatttgcagaagatttttctaaaatgagagttttctaaaagttttcttccaactttagaaataaaaatcacaccatcccatcaaagaacaatatgtaattttcacctttaggccaatcattagtctagatctacttccaaacagattgagctcaaagcttatctttcctctgaagtatacaagtattatgctaaaaaccatcacacaaagaatacacacacaaagcagctctgatccagaaatgcaaggaaaatgtatgtgacaaagcaagagtatttatcacctcaaagagaacagagtaaaagctggttttccagaaagcatctatttgaaaaatagatgtactgagatgggaaaatgaagagcaagaccacatattacaaagtaaaaggatatacttcttggtgctacaattttgaaaacagattactaatgtctaataatttcactcactaatactcatttgtcctcaaataggacattcctggaaatcaagctcagggtgaatttgtgtagacacactgcactgcatgggtgggttaagcatcccttcaatctcctccagtttaccatattccttcttcaatgtcttaagattttcattgattcactcaacaaacatttgacacctactatatgccacaaagttaaacaccagggaaagcaaaaggagtaagacacagtatctgccttcaagcaacttacagccagctccagagtgttggtgagtgcacgtcatagtgttaatgggtgctttagtgatacacggtctaagaggaggcacaagaaaggagccagtcaaatgggagaggcagtcaagttaaggttcaacagagatgggggacacctgactaagggggaaggggagacacattccaagagtcaacattacactcaaaggcaaggaaatatacaacatggcccatcaaagccttacagatccacagacaagcactagacctacaaaatcagaatctgcagtttaacgagagccccaggcaatcatgctcactagagtttgagaagccctgctgtagagcacttcaaagtagtagtctggtacggctagaacgcaggatgccatgggagggaactcagaagagttgacgctccagaggcaactccagctcataaagcacctgtgctaaagagtctggatctccttctggacccaatgggagccaccacaatgcttaagtgtaagcaggaaaatgacatgatcaaattatcagggagactagggaatgatgaaggggctggaggaaaagggatgcattccaaatgaagcagatctaacagggcttaatcatttgtgcaatcaataaatggggggtgaagggagtgagagatgaatgggaaaacaaatatgtagatatccaggatctttctggaaggcaggtagaaacagcaacattcacgaaaatagggaacacaagaggaacagatgaaagaagaaggaggggtccaatttgagctgtgttggctctgaagtacctatagttcaagcaggtggatgtgtagtagatggtccatatctgggagaaacatcatcagataggtaagtaatgccctgaaaaatggaaaaggtcacaaaagagaatgaaaatgttgagaaaacacagaaggaccacgagtaaaactaccaagaacatcagcatttaataggtgaacagaagcaagaggaatcaagcaaatgagacaaatcctaaagagaagagaacctagaaaaatggtgtcatcaataccaagaaaagtgtctcatgaaggggaaaatggaagacagagtaatatgccaggtcaaggcctaaaaagtggatttggtaattaaaagaggtcctttcaaaaagttaaataaacatacatcttacacatacataagtcattagaaggacagctatcaatgaatggctctctggttgacataattaagggtgatttttagtttattgttcccaccacccaggttttgcaactgtccctcgaggcaccttaaggaataatttttgcaactgttcttcaaggcacttttgaaataatttttcaaaaatacaataaaaaaatcaataagataataatggcctttgacagcggtgtgactgcagtggataggaaagtgaatgaaaagtgatgaaattaaagggacagagaagtatggacagggaagagactgagaaacttctagagtaaacagagttccaggaaaggttctgtgtttcacgtgggcaagatctgggcatgcttacaggatgtcgggtaggagactatatacagtgctcagagtccaggaaaaagagggaacaatcacttctttattgcctgctgtcacctgaacacacagtggtgaacaagacaaagtcctgctctcatatagcttaccttctactaaagaaaaaaaaaaaaaccagagaaataagtaatgatatcagacaagtgaggtgtgccacgaataaatctacagtgggaccggcatgttttggattgagtgttgaggtaaggcttccctgaagagacatttgagatctgaatgataagaaagcaactttacaaagataagggggaaaggcctttacagataatgaaactgaggaacagacaggttagtaagatggctgagattacgcagtaagtaaacagaacccaggtctgatgaacaccgagaccaccctttctactaaactatgttctctctttattcagttctcctcaaatgcaacagtgaagataaaagaaaatgtggaccttcccctggcctcacagaaatgctgaggattagaaaaataagagtaatgggcacaactttctcaaaagaaactctgaaagccaagagatgtatatagttctgtgctcagaggcatgatttcggaaagttaactgttcaagcccaataagaaaatataggcagactccaaattacaagtacgctccattccaaagattataactaagttgttaagaaatcataaattatttcctccacgtaattttatggcgagattaggtgttcaggctggtccatgaaggtccgcataaccgtagatattatgactcctgtagtaaccaacaaagcacttactaggcatcaggccctatactaagtgcttaatacagataattctgcaatattcctaacactactactactcccaccttatagctaaggaagctgaggcctggagatgttaagtaacttctctaatggcataatgcagataatttgaggataaaatgcagataaatctggagtaggctgcagtctgggcccagcctactgcagatccctggctctcagtccttacgcgagctctcaaagtaccttaatttacaagcatcagtctttcaaaatcattttttctccaatgctaaaagctcagcacctatctccccttctctggtggtcagaatactattaataaccaaatgaacactttcaccaacttttcttttcccctccactacaaaagtctataccaaacctatctctgataaacctcaaaccatgagagcatttattcgcctatctgacacccacttagagtttaacttgcctttgcatccccagattccaacagagtgccttgcatgtgctcattcattcaaagacacttacaggacgggagcggtggctcacacctgtaatcccagcactttgggaggccgaggcaggaggatcgcttgaagtcaggagttcgagactagcgtggccaacatggtgaaacccagtctctactaaaagtacaaaagttagcctggcatggtggcgcacacctgtaatcccagctactcgggaggctgaggcaggagaatcgcttgaacccgggaagcggaagttgcagtgagctgagatcgcgccactgcactccagcccaactcgcgcaacaccttcttaaatgctgaaggaaaactccattcaagagaacgcaggcaaaagcccaaagtgatcataatccagcgtccagctttaagtcatccgtggctcacccaaactcccaacccactcctcgccgccccatccctcgcaaaaagctaaatttccaatatctaaatgctaggtggttactgatcaccaacggtgaccgcacgtgggacaccacccaagctggccaagtgtaaggaaaagaccaccacccgacttcccaaagcagtcttcaaagcccccctcatcttcgttgaccatgggtaccccgagggcagtaaggtccaggctgaagtggcgggggcaggattcaagccggaggcaggccatgcccacagccgtgaccttctgaaggcgcttaaccctgtcacccgaaaacccctggtagggagcgtggtgcggagcccggggaggctaggtcctggggcggggagaagggtggcgagcacaggcaggacccggtccctgccggcacccacgaccccgggggaccctggcgccgcagcttgcctggagaaagggcctgggcactcacccggccacgggcccggcgcgagcggcgggcagataggaggcggcatgcagccggcccgggccgccagggaggaggcgcagggagagcgggaggcgcggggccgccccggcacgcagcaaccaacgcgcggatctcagcagggctgccattgctcgaacgtccccgcagcgggaagcacgctccgccagaaggacaggaggagcatgtgaccgcagggtagcctggcgcggcagagaccaactgccgggcgtgccaaatgtggggggagcgacggattgttttaggttggaagatggaaaaccgcacttctccgaggacagaagacccaatgtaatatttacataaacgatgttgcttgattcattatcgaagcttttcttttccgtcttccgtctccgatctgggcatcgtgttcattcgctgcacccctgcactcctctgttggtagagccgcaagaggtcaactcctcccaggttggcgcagaggcttgtgggaggccaactagtaaaaataccgagaactctcgaggagagccgactatgaagatcccaggacgtgggaaggtttcccccgcccccgagtgcagatgttgctgctaacgttcagccctgacgccatgtccaataggaacggcccttcactctcagaaacgcgggccggagaaaccgtggaggtcttttgcaccttgccgtttgcctcccaggttcaacatgataggatgtggattatcagggcctgggaacagtgtaaaggaacgcgcaggtccccaccctaagcgcgtacgcggggcctcgctttagaaaataaatgaattctaccaaaaatcctatagttttaaagctggaattgaactgactctcttccccaaccctccacccctaccgcgcctctcccttcagtaaatgcacatatacatgtgagaagtaaaagaacaatgtaattaagagtctccagccaaatatggggagaaaactggcaagttaaacccatcgctggcgaagtggctcacgcctgtaatcccatcactttggaaggccgaggcgggtggatcacctgaggtcaggagttggagaccagcctggccaacatggtgaaaccccatctgtactaaaaatacaaaaaattagccgggcgtggtggcgggcgcctgtaatctcagctactcgggaggctgaggcaggagaattgcttgaacccgagaggtggaggttgcagtgagccaagatggcgccattgcactccagcctgggtgacacagcgagactctgtctaaaacaaaacaaaaaaaccacgtcgctgccttcacagggcttacagactggatcggttccctgtgcacacgtgggaagctgagaacagccttccactccctctacacctgcctgtcccctacctatcacgaggcaaacgcggcgggtatttcctctggaagccctcccacggtcatttccgaagtgactgtttatcccactggactccttatcagttaatcccacgaactccttatcagtagggactgtgatctcttattgtaggccatacacctacccagtgccagacacacagtaggtctcattaaatatgtgttaaattaatgtctattttgagatgacctagctcacctctcctttgagagatgagggaacgaagacacccgctccaagcccccaaaagaaacaaggtgaattgattgactctgggttatattactgagcactgggaatacaagttattcacctattcaacacgtatttattgaatacatatccagtgccatacactatttgaaatcctaggaatacagcagagaacaaaacaaaccaaccctagattctaattaagctctttaaagtttaatttgggaagacaaaaagaactgtgatgcaaaatacgccagggtaaagggattgagggtgtcatggggggagttgctttttttttttttttctcaagacagggtcttgctctgtcacccaggctggagagcaatggcacgatcttggctcactgcagcctcgacgtctgggctcaagcgatcctcccacctcagcctcctgagtagccgggattacaggcccaagccctggctaatttttgtatttttagtagatacgggtttttgccgtgttgcccaggctggtctcaaactcatggcctcaagcaatctgcctgcctcgtctcccaaagtgctgggattacagacatgagccacgacgcccggagagttgatattttaaataggaaaaacgttgaacagaaacctgaaggaaggaaaggaggaagccaggagaattttctggaaggagaaaaaaaaaaagagtggttaaggcttagagaacagcaaacaccaaaacccagaggcaataataggtgtagcctattcagagaactttaaggaggaggactgtgtggatgagagaaaagagcagggggtagagagcagggggtaggagtagaggaaggagcagggggtggagaggggcctggaggtcagagaggtagttggaggccatatcaaacagggtgttgtaggtggccgtgaagactgacttttatttagactgaagacttttacttagaatgagatgagaaaccattggatagtttggtgtgttgcttttaaagagatggagtcttgctgtgttgcccaggctagagtgcagtgtctattcacaggtgcaattatgacacactacagccttgaactcctgggctcaagcaatcctcctaccctggcctcccaaggaagtgggactacaggtgcatgccaccacacccttttgctttttttttttttttttaagtgcagtggcacaatctaggctcacagcaacctctgcctccccgggtccacgcgattctcatgccttagcctcccaagtagctaagattacacgcatgaaccaccacacccagttaattttgtatttttagtagagatggggtttcaccattttggctaagctggtctctaactcctggcctcaagtgatttacccacctcagcctccctaagtgccgggattataggcgtgagccacggcacccagccacccatttgcattttgaaagggtcactctatctgctgtttggaaaggagattttaggggaatggggataaataaaaatagaccaaagagaaggctaatccagaatagagatgctagtggcttggattagagggcagcaggtgaaatgatgagaaagggtcaggttcttactctatttaaatagtagaaccaaggggatttactgatggattggctgtggattgtaagtcaagaacggctccaaaggttttggcctaaacaactagaaagatggagatgactctgatttaaaaggagaaaacaaagagaagcagatttaaaaagtgaaatcaaaaatgatcttctagaatattaagcttgtgcctgctagacatccaagcgtcaaatttgaataggggttggctatatgacatacaagtcagttcaggggaaaagtcagagctaaagatacatttgggaatctgcagcttgtacctaatatttgaagccacagaaatagatgaaagcatctaggaagaaaatgcagatagacaagagagggagtccaaggactgaggcttgtgtcatttcaatctttagaggatgtatagatgaaaatctagcaaaggaaactgagaaagaagagccagagaggcaggagaactgagcccagtgaggtcacaaatacctgaatgaaagaagtccttccaggaaggaattatcaatcacatacaatgctactgttagttccaatacaatgagcatgcaacattgaccatagaatttgttgtttgtttgtttgttgagaatgagtcttactctgtcgaccaggctggagtgcagtggcgtgatctcagctcactgcaacttacgcctcctaggttcaagcaattctcctgcctcagcctcccaagtagccggaactacaaacacgcaccactatgcctggctaatttttgtatttttagcagagacagggtttcaccatgttggccagtctggtctcgaactcccgacctcaggtgatctgcccgccttggcctcccaaattgctgggattacaggcatgagccaccgcgcccagccaattattgctaattttctaaggcatgataatggctttgtggttacgtaagaaaaaatatgtttagagatgcatgttggcactggaatatgtagaagtaaattaacatgatgtctggaattgtcttttttctttttttttttttttttaatgaggcgaagtcttgctctgttgcccaagctggagtgcagtggcgccatctctgctcaccgcaacctccgcctcccgggtccaagcaattccctgcctcagcctcccgagtagctgggattatacgcacccgccaccattccttccaatttttgtattttagtagagacgaggtttcaccattttggccaggtcggttttgagctcctgacctcgtgatccacccgcctcggcctcccaaagtgctgggattacaggcgttgagtcactgtgcccagcctggaattgtctttaatatacttccccaaagaataaaaggccgggcacagtggctcacacctataatcccagcactctgggaggtcgaggcggaaggatcacttgagctcgggagtttgagaccagcttggtcaacatggtgaaaacctgtctctacaaaaaaaaaaaaaaaaaaaaaaaaagcaaaaattagccgggcatggtggtgcacacctgtattcccagctacttaaggggctgaggcagaaggattgtttcaacccgggaggtggaggcagcggtaagctttgttcatgccactgcaccccagcctgggtgacaaagtgagaccctgtctcaaaaaaataaaataacaaaaatatagaaaaaggaaatgtgacaatatgttgataatcaatgaagctaggtgatgggtatatgggagctcattttactattctatttttttttttttttgagatggaatctggctgtgttgcccaggctggagtgcagtggtgtgatctcagctcactgcaacctctgcctcccgggttcaagcgattctcctgcctcagcttcctgagtagctgggattacaggtgcatgccaccacacctggctaatttttgtatttttagtagagacagggtttcactatgttggtcaggctggtctcgaactcctgacctcaagtgatccgcctgccacagcctcccaaagtgctgggattacagggtgagccactgcgcccagcctattctattttgtgtatgtttaaatatgttcacaaagaaaaagaatttaaatgctggttatattttgatttcgcttctcactaatacggcatgacttggagtttgaaaaacattgtattcaaatagtcaatataaatgcaaagtagacaaaagcaccagctaaacaaatgtaccagactataccctgagaactggagacccgttcataggaacatgattaattgacttctccaacaaatagtagctcaaacatcaaaacttgcagttgttgctaaaccattttacataaaatattaaatctccaagattgtagctattataatctaagaaaaagatttgcatgtaacactaaagtttaaaaagaaaaaaaaatttaactttgaaattctgagcccaaggtatagtactcagcaccctaaatcagaagcttacaaagcaggtggcattacccttgtttctcttagatcaattaatttatttcttgcctcctaataattttttatgaatcacagtgatcagaaaatataactgattcttcataactgtttgtcagcctttttggaatctattccaattttgacacaagcacattcaaaatagtgtgagcaaagaaccaagtgattgccttaagtttaaaagcctgttttactcaaaagacttaacatattttaagcagcagatttaatgtttagctgtgattatgttttctcttaaggcaacttgtctgatgaatcaagggcttctcccatctgtgactgcattttttatatccaaatgtattcatgtatgtaattcccaattattcaaaaattattctgctcagatctttgtttgcacacagcttcaagattctcactacaagtggaggtccaatttgccattgttacacccttcagcaacacttctgtcaaacaatgattctttcagaagcttacaaaccagcaagacagatgcagggtcatgtactgtaagaaagtaaccaacgctggcaacaaggagttgttgctgatattttcccagtgttaccatgtgtgaaggctgaaaagtttatgtgtttcccacagggcagatagtgtctggataaatcaatatagaatagtagtcaaacataattggcatttcaatgtactatacaactgaatccctttaaaacataaaatggatataattcttatattactgaaaataaactttaggacgtctttattgaacaatcattgttaatgcctaaaatgtaacatgaatctcttaaatttcctggataatggatggtttctgtatgtcttgttttgtttttaaggaactagaaaatgtatttaattttctttgagcaatggataatgtggaatttctattttagcttgtgtatctctgagggttgaaaaataatttacattgaacacttttatgcaacttgccttctgatcatttcagtttaattgggagagggaggactaatagagtttacttgggctagtacattatggattttccggccgggtgcagtgactcatgcctgtaatctctgcactttgggaggctgtggcaggtggatcacctgaggtcaggagttcaagaccagcctgcccaatatggtgaaaccccatctctactaaaaatacaaaaattagccaggcgtggtggtgggcacctgtaatcccagctactcgggtggctgaggcatgagaatcacttgaacctgggaggcagaggttgagtgagccaagatcaagatcatgccattgcactccagcgtgggcgacaagagcaaaactctgtcttaaaaaaaagaaaaagaaaaaaagaagtatggattttccatttcattaagttgcaagacactgatgtggctcttgttcttggcttcccatcttacttttctttctctttttaatagatcctacctctgagcccagagatggacacatgaccaggcctgactaatatatcaccctggtcacaatgatgattctgtaacaatcctagagatgagacccaatctaccctaaacaacgtttttcccttgaactaaaggagctagtagggagtgtgttttggttttttaggtcatggagcttgaaggaagggaagacctgcctgcagacagcctcttcaccatgtgaagagagcccattttctgttttttgttttgttttttgagataggatctcactctgttgcccaggctgagtgcagtggcaccatcatggctcaacgcagccttaacctcccaggttcaagcaaccctcctacctcagcctcccaagtacctaattttttttttttttttaaatggagtttcactcttgtcgcccagactggagtgtaatggtgcgatctcggctcattgcaacctctgcctcagcctccggagtagctggaattacaggcatgcaccatcacgcttggctaatgtttgtatttttagtagagatgaggtttcaccatgttggccaggctggtctcaaactcctgacctcaggtgatccacccacttcggcctcccaaagtgccgggattacaggcatgagccactgcacccagcctattttttgtatttttttgtagaaacggggtcttgccatgctgcccaagctggtcttgaactcctgggatcaagtgatatgcccaagttggcttcccttcccaaagtgctgagattacaggtgtgagccttcacacccagccaagagcccattttcaatggaagataaaaaggtcaacatacagaaggatacagatgagagagggagagagaaaaaaagagaggacattctgatgacctattttgttcccttagatatagcaggaactgaattccattctcggattccccagtaaaatgagttaataattttctgttgatttcacctaacttgagtagggtttctgctatttgcacctgaaagagccctgactaacgtaaaaactggtaggaagaaatagagtggcacaatgtgcttactaaagctagagtttcaggaaatttttttggagaaaaatatcaggatagtagagtttgtttgtttgtttttggccttcattaacattctggacgaagggaacaaacttcactccacgctaaatcatttgaaagcaggagaatggcaacagctttgttgagcagtcctctctccagttgcctcaatctcagaccactgacagtcacataagctaggtcttagagaattaccaaggctgaattctgtgcctgagcttgcatttagtgtgaccgaagtcaaggaagtggacatcacaagaggagattactgggttccaagaggggtcagaaaaactgggcgaagccttaaaattcagattgctcccaaaccctccttttctgtaccccttacctgatgaaagcaacaatttctccatttgtaaagcaccatcctctaaggttcatcttggaatcaagtgacatgtccattattatattaccagtttacaggttgggttcccagggaaacagattctaagactcagatttgagcccaggaggtctattggagagtgctgtagggaatcatatttgagggatgagggaaaccggattgggcagaaggagagatcaaattacgatgcagttgcaactgaggcctccctcagatcctacagagaactttggatctcagaagacccttcaaagttattctgctttcagccaaggcaactgggcctttatactccattactgaacagtcattggctgtagactctcttcagggaagaagcatggccttgagttaaatgaaggcaggggggttcccaaagaaactcaagctgagagccatcagctgccaacatgtgcagcagctgaggaagagtacctcagccctaaaggaggaaacccaggtggtgagccacatcatctgctatgccgctctattgtgtcatatcactcagaggaaaaggttgtattaaagttgttaagatacaaccaagagccagaaattacaaggacagggtccagatacagggactatgacttgataaaattttggcattggttactacctaatgtaaaccgtaggaattagatagtcagttgactagtgttttaagggaaatgtattagcagagaaactatgactcttgtaaataaggacttgtagttggctcaaagccttaggccatctcttatgcaatccctatgccctctgaacacaccaataagaattctcttcaatattgatttaagatatggccatggtggtaatggacatgaacattattccatcaagtagaattgttacagtcagattgcagaccaagaaaaatcacctctgctgccagggaaagaagtctttataagccctgcccaacaggaaatggtatttgctgtgcactgactgtgacttctgttggttatttcctccttttctcatttttaaatgtgaatttttattgcaatccgcctggttttcttcccaccactatgtgttgagcctgttgggttagataaatttataatttatccatagactattagatcacaatgagccacattcaggaaatgtggtacacaaagcaggatgtataaacgatgtctgtcttggggttgtctcccactaaagagtgagtggcatgttttcacttgagtgtggttcagttgagttgttagattaaatcgctttttgaattaattatagaaagaaaggtatgtgtttgtgtctgcatcttagaggtcaaggaaaagatcgtgtcatgtagctgtcattccacactgtttcccctgcatgcatacttcttctgatttccagtatcagcctccacctctggccacagggatcagcacgtgatgctggaccagcatatgacagaatcacatctttttggctaaagtcattctttttggggacccaaactaggcaatctgaataattcatttgattttactgactgcagctagtaggaaagatgtct

SEQ ID NO: 317 - DNA, 64714 bp, Homo sapiens
ttcctggggcccagccagcagagaagcctgaacccaacattatccacgaggtacagccacacttagagacattcgtccaacagatggaggaacaccccttcaccccagaaaaaataacacgtttatgccatgaaagttcacctttttgtcatctatattttgtgtcacgatatctgagcacgtgtagcgtttcaggtatttgcgaatgtccttgagcacttacgaataaactgattatttgcaagtaaggcattaattcagaattggggttttcttttaagtaatggctcacatgttaagatgcaagcaccggtgaaaatgtgtgggctcacggcgtttgctcggttttcaaataattgaagtgtgcagaaagggaagcagatacgcgacacttatgaagcggggagtagctaaggacatttccctaattgcatttgtaaacaggaccaaaattagcccaaagccccaaaacatgcatgttaaatgtgctctgtttagaaacagaatcacttctgagttgaaatgaaaaggcaagggtgtttgcatttgtaacattagggaataaaagtgactttctaagcctaagaactgttgccggatctccacccaccggagcaaagccatcccggaggacacttccacactcccaggggccacagggctcccccagcccaaggccggcagaggcagctgaggggaagggcctggacttggactctcgaggttcgttgacccctttgatcacctcttaagtttcctgaggagtagaatgagtccttcaacagaaacagctcctgctgatgaagaaaacagggacccagtgcgacaggcaggcagctgagcaggggctcctggagcccagggttgggtccggggaccatagggcagccccagctgaggggcctgaggggacagagcctgtcagggcccaggccctacctctctgcgcctcccacaaatgtgtcccaccgtcctcctcctcctcccttggtgcaggctcacagtgaaacctccctcacgaaggaggcctgggactggcaggaagcagagcaaaggagggaccctggctggctgtggcccccttgggacggctgcactgagcctgtgtgagggcacgtggaagggacaggcgtccagctggggctcaggcagtagaaggtgagcggccccaggccctgggccatcccagagggtccccagagtacaaccaactcttaatggaggcaggcaggggggcaggaaagccctgtgggccaccagagccactaggacacagctcctgaagacctagggctgggctgaaggccacagggtgatatcagggaatagctcagacccacagagtccagaataccccatagcaatccaggctgaatacaggctttcgtggaggagagtttcgtagcaattggagaacaagagtctgggaaaatggtaggtgggctctgcctctgggaagcaaggaggctggggctagcaggtaggccccagactggccccgagcagaggcttgggcggttcagcctgcagtccactggacgctgacctgagtgcctcagcctgaccagagagacaaggcatctcctaaatctgagaagcagcagaagccccgaaggaccagagaggatcgcttcccagccatgaagaaccgcagcagatggcgggagggcaccagaggaggggtgggccaggggcccaggacaggctgcccaggccaggcgtggaggaggcccagtgggtcccacagagacactggacccaccatagacaggggcagcaagaggctgacctcagagaccgtggtcactgatggggggcttttctcccgggaagcagctgaagtctagtaatgcccccacatggccctgcctctctgacagggctctgaatcccgggtgtgggaggccagggcagcagaaaatcgagtgacagcacacaacagagggatgtctaggcttttgggaagggaggtcatcaggcccccaacccatcagacggcgcagtgtctgggtgcacactgaccctggaattgagtttcctgctggccccctctccctctctctggcagaccgccttcttttttccttgaccgcaggcagtgacccccaccctgtccactaagccttagccccatgactggggctcccagtgggaagggaaatggggaaaagggcaccgagcgtcatggcagtgcaatgtgggaggaatacagcatagaccatggccccgtagctttaaataagaaatttattgcaaatatagaaattgattctctccatacaggaatctccgagttgaggaaaacaatttcgtgccattcagttttaaaacaggaaattgagggaagggagaggcagatacagggaagagaaaataaagttaacccccacccccaaaagaagaaaaggagagggttcaaggccctcagaggaaggaaagtttcgtaacacagcaagggttcacaggttcagagcccagggcctgagcccagctctgcaggacccaaaccaggtgcccaaccacagccaacttggggactggcggctcctgaggaagggagggagggagggaagtgtggccgccactgcaggaactccaagcccctgtcccagccctgtgctggagtgtggagtggcagaggggcagaggaaggaggagcaggcccagaccatcctgcccgtcctacaggacccccttcctctccctcctgctcagcaggactgcctgacctttagtgaggcctgaagccgcctctggaggcaagcagtatggaccctggttttgtcttagaaggggcacccagggtcagggaaggagtgtgtcaggatggaatctgagcatgagagttagaggaggtcccctctcctggggctcagccacctctggagcagccaccttgtcagacaggagaggtggcaatggggccagccaggcaaggctgccctaaccttcacactggcttccacgggcaaagtaagcccctcagggctgagcttccccaggctccccgacggcttgccccgcccatccacactcatggaaagggggctctgctgggccaggaatgggcaggggcagggtagtaggggacagaggcggtgcttgggggacaggcagccactgcaaccccactccctctagtctcgtcttcacacccacccacccacccacccttctggctcctcttgtcattcacagcttggctccctgtccccccatcccacacaggatgctccctgaccagccttgcccctcccccatcaccctattttaattttctgcaaggcgccagtcactagggagcattgtgtcttatcccttccctgcacttaggccccttataagctaggacctgtcactggtgtccttaattcctgatgccatcccggcctcagcactgtcacaaccgagtttgtcagctctaggtctcctttcctctcctttccgtctctgcacttctgttcaccccgctgttacatttccaggagggagtggggcaggcgaccaacttccagttgagaacatgggtgactctcggccagcctgatactccccactgctgctgccccagctgcctcccggggacgatccaggcctggccttcccaagcaggtctctttactcccaccctcctcgctcccctgacagcccttttcccagacctacccagacacgggctccccagcctggacacaggctgctcccacaggcctcctgcactgcctcaggaggggagcccaggtgagggattctttggtgggcagagagagactcttcctgccgcggggaaaagcaaggccgggacccgtgacgaggtttccccaccaaccaggctttcttgccttcatgccagacctctgtgttttgctactggaaggccataagctccaacagagggttagctgcacctgctgtgccctcccaggaaggagcagacccattgtgctacttcccagaaacagcttcagaggagattctccaacagaggcaggcaagcccaggtgtgaccttgttccggcccaaggcaggaggcctccccgcagaggtccagggcgtggcacccacacatccctcgctccaccgggcctccatctcccctccctccctgtggccccccctgccctcttttcctggtgtctgccctgctggcctgccccagaccacagcccagctccaccatgctcatcatcatcacaaacccagaccttggatggcaacattttgtgaatacttccctcccgcctgggaaaaactcatcctgagcaggacgtgggacacagatgcaggccagcctccgggtgggctctccccaagctgagcagttggggctctggcctggctgggaggccagagacccgagtcttagaccccgctctgcctcacaaagaaccacatgaactgggtcttcaaggccagttcccctcctggatcatcagagtcctgctctttggaagggcccctgtccctgcagtcagagagtctgaggtttcctaaatatcttcacgcagaaaggatggggaaatggcaagcgcaggcccctaactcctgctgctgggaaccctccctggggcccagcccaggcgtgctccttcttcccacgggttcctttctcaaagcccccaccctctccctgaagccccccacgaagccccaagctcctggcctcctacactcagcagtgtgactgatcctccaccccagctggccagccaattcaccaggcccgtctgggagccctgacttcctcatctacaaaacgggaacaagcgggacggacagacagtcccttccaccgggacaagagcccttgaggaggcttccctggggctgccctccctggcatggaggaggggaaggaactggggacaagggaggtggcagtggagagagggagggaggaagggaggtggcacatgggcccaatgctcagaaacacaggaggtgggtgtggggcagggctgtgtcttggtggcacctgttttgggtctgtttttgcagagctgacccctccctgggtttcaagagctgctcgtcagatcacaacagacagaatgtgggaaagcagggcatcagagagggggcgggggagtctggacaaactggcacatacacgacagatgtttgctcagaaaaatacagtaaaatcgtcatgcaaatataacagggagtctgcttcctcacacccctggcttctctgcctgcttgcttttctcagttgtgccaagggggtgtgaggaggggttggggggcaggttttgggggccgggggaggaggtctgctccgcgtatccatgccgccccctcccctcctcgccccaggagaacagtcttttctttgcaaatgtcaccctcaaagtgagccctgggcttcgttaaccccaaagttggtgtgagagaggtactcagctgagcccgagcctcctagccctctgctgtcctccctcaccccctgcccccagcaggaaggtcgttggggtccccaggggatggcactagctttcctggtcagagcccctgcccaccaacagtgccggtcttggacccattccagtgcctaccctcgcccctcagtcacactccccaaatctcaggaaacccatgtgggccacaggccctagactgggggtctctggcaggggcgtggggagagccggggccccccaagctgaggtgggtggcagccaagcgacatgttgctaggcgggcaaagctgctagtagaggcgtccccacaccccgctgggccagctcccacccagaggtgaaggatgatggactccggcccatcagcatcctgactggtcaagaccccagtctcaggaccgcagatttgcttcccaaaagagctggccccaggagctgctgccaggctggccctccctcaccaccctctgccaccgcctacatggacagagaaccccagagcccaacggtcactctgggcaccaactgccaggcacagggttaccatggtgacagaggctggctgggaggggctggggcgccacgaacccagcctgctcctcaaccctctctcgggtgggggcctcactgtttgtgctttgtttgatgttgggtgggggggtcagaaagagggaagtggccattgccacggaaacatgggagcccctctggccagggggccaggcctggatgagcagcccagaggggatgggtgagaaagccctccttccccgggtgggcggctgagataggagccgagatcccacgatggggtcgggcaggtggggacacaggccatggggacaggcaggaagtcccccatgacagctcctccctgcagccctccaggcatcacagtgcaccgctgcccttctgcggtgggcaggggtctcggaggaccagagaagctggggccgggagcctgcacctgagacgtcctgggagctggcctgcccgccacacgccccactcttcccaggccacgtggaagacacttgaagtgggctggtggaatgtcgccctgcctcggctcctttcccgtcaacaggaccctctcccttctcccgggtgccggcataggggtcaaaagccccccaggattctgaatcacagctgcacactctgggggcactgccatgtggctttctaggaagaaaaagcacctgcctgattcccaagtccctcagccccaagggaccacagcttcggaaagggatgtggggtgggcacagggcgggcaggggtccacaagagagctgcagggggttccgggacagcactgggctgggaagttgggggacttgaggctaagctgctgtgtgaccctggggttgtcaactcccttctctgggcctcagtttccccccctctctaaagtggaaggagacattgcccgatgtctaatgctaaatctgcaggtgacttgactcccagcttgggaagggaccctctccctgccctagaggggcttcagtccctctctactccagctttcttgacccccacacctgtttctagccccagaccccccagaccccacaccctctcttggcttccttcctccccccgccagccccccggccctgcacaccccagcagagtccctgggcagcacagtaaagacgactggtttcggtatcagtttgtaaactttaaggaaaatgtgtctctgttttcctgtccgttattgtcggatgttggtttgttcacagtcgggtggtggtcaggtgtgtgtgtgcgtgcgtgcgtgcgggtctgcatgtgcgtcctctcctgggccttggcccccgagtctgctccccgccctggccgcctggacccttcccccaaaaggcccccagccctctggctccgacctcaccagggaggaaggggggggtcacagcttctgctgggcggagacccccttccagtaatcaaggatgtcatgcagatcctcgtccttggcgaactggaccttcttgcgcagggcgtgaccggcggccatgtacacctcctcccggtggtgcttcttgtagggccggaagcgctcccagatcttgtgcgtgctctcggatgagtactcggggctggaggagtaccctgagtagtagtgtctgggggagagctgcgagtaggtggagtcacgcttggagcgggtcagcggcttgaggaaggacacgcgctggctcaggctgtcggcaccctcctcgtagtacagggcgggaaagctgtgccggtgctcgctgcagtggtaggccggcttcacctccaggtggtggatgcccccgcccccgccgctgcccccgccgctgcccgccggcaccagcgggagccggtccagcgggctgttgagggggctgcccttctcgatgtacttggagtcgcccttagccagccctgtggcggccggatggtcgggcacgtccaggctaaagaccttggcgctcttgatggaaccactggacgacacgctgcaggtcttgcgggtcacggccgcgtcggcgctcagctggcgctgtagtgggtggtgggagctctccttgtagggaggcgaaaggaagctgggccgctccagggccccggggccagtggctgaggaggcggcagcagctgcagggagggactggcactcgaaggccagctcggggtccccactgctgctgccgcctcccagaaaagaggccgagtccagcttgagagcatcgatgcagttgttaatgatctggttgaccttgtccacctccttggcaatggtggagatctctgcagccgagccctggccgttctcgaggtccgggaggtcatcctcgggccgagccagaccgtccccgccggcgcctgtgcgcacctcgatatagttgcctttggtggctaccttgggtgtgtccagcccggcctccaaccccttggcggtgggcagcttctccccgatcatggaggggatggaggccatgcgagatacgggcagcacgggaggctcgcccagcttctgggcggcgtgcacaatggagccggcatccacatcagccccgtagcgcatctccaggatggtcttcttgacgttgacagacttctgcttctcctcctgcatgcgccgcttgcgcaggcagtagtacacggctcccagcacgataaccatgccaaagaggcagcccaggatggtcatgatgtagtgggtggtggtggaggtgctgggcgccaagtctccggggacggggtcccgcgtggtgaaggtcaggcaggtgtggttgaagcggcggctgttgcgcagcgaggtcacgcagaaggtgtactcagtgtgcgcccgcagtttgtccagcgtcacgatctccttcttgttcttgagggtcatgacgtcggagaagtagctgttgttgtactgcacgaggatgtacatcttgctgtaggggtgtgggatgatgaccaccagggtggccgaggtgaacgtgacgtggtgcagcttgatggctggccctgccgacgcatccgtggtggacgaggccggcggctccaccgaaaggatctcgtcggggttgaagcccgagttctcgtctggctccctctgggcgtcggtggagtagggcgtggggtggctcacgggccgggcgggcagcgagccattccgacacttggcctggagtacggtgatggcgttgaggctgtggtagggccggggcaccagcagcgggtagccggcaaactcccgcggcgactcacactgcaggcggtcgtagttcttggtgacgttgttgaagaccaccagccaggccaggaagccgaagaggtcgcactcacagttgaaggggttgccggccagctcacacaccatcaggctggcgaggctggcaaaggtggcaccgtccaggcggctgaggcggttggaggacaggtcgatgctgatgaggctcgggcactcggagaaggcggtgggcgtcaccacctcgatgaggttgtgctggacaaagaggaactgcaggcggctcatgcctcgcagcatgccctccgtcaggttgctgagcttgttgtagcccagctgcaggacctgcaggctcgactggcccaggaaggcaccgtcctcgatgtaggagatctcgttcttggtgaggttgaggtcggtgaggttcccaaagcggttgagcgaggagtagagcacggctttgagcttgttctcgttgagccgcaggtcgtgcacggtgctattgatgtgctgcgggatggtctcgtagggcggctggttctggctgcagatggccagccacacgtagcccttgtcgccctcaatgagccagcagtcggcacgcacggcacccggccggcacacgcacagcagcgccgccgcgcacagccccaggcgcagcatggcgctggcctcggagtgaggggccagggcaaggcagggggtgcctagcggccagaggctggggctggcagtacagtcctccctggggccgccaccatcttgggggcgacccccagcacgggggccccaggcaaggtgggtacagctagtgccaactgctggggatcttctagggtgctacagcaggcactaggcctggctagggctgggggtgggggccccacagcctgctccccaccgcagcgttgctccttgtctcctgctaggaaggtgcaagggttctcagggcttgacttcctctccctcctcctcctcctcctcctcctcctcctcctcgtcttcctccttggcttccgggctcagaacttcagatgattcccacaggaggctggagagtgccgcactgagccaggagtgagagagatgggggcaggaaggaagagacccatctgcacctggttcctgaaaggcagcatcgagagcgggtgacagatcagtgtgagggctcagagcagccccgtcaagctccagcgcaggccccccatcccttctccacaccccgtcccagggcctctgtgccagcaagcactctgggggtccctgttacatcaaagaagcagggggttggtgggtggcaagaggcaggagggggcccaggggctgggacggagggagacagaagaatagggggagtaggggcagagactgaggatcatgggcacagaagggacactggagagaacaggtgagcacaggtgcagacacacacccccagcaccctggaggccatgctcatccccctacctgcacagagacccacatgcccccacatgagccagacctccatggcatgcacacgcagacagctacacacacacacacacaagcacacctacaatctgcacacgacaagcaggcccatacacacgtgtccacgtacccaagcgggcacccctgaatccacaaaaagaattaagaagcccagcaaaatgcctcctttcctccatgcccaaagataaataattcatttgttgtgtaactgctcttgttccaaaaataattcccttgtctcagcttccatgggggagggggagcagaatatcgcagctgtggggccccccaagcagagggacacagaagccggggtctcccacagtgggagggcgtggggagacctcatctcacaggcagagcagagccaagggaaagaaaggccagactctgggaggccagaggtaccccagtatcatcttcccaaagtgccttccctggagcaccttgatccttgggagggggccagccttctggagtagcacggctgaggcccagctccccttccatggctggagagtcagaggcccagagagggacagggagttgccccaactaacatagcacagcctagaccaggatcaaggttcctaaggcactgagcccaagtcagatgtcaggaggcctggagccccacaactgctcagcccaattagctaggtaaaccacaacatcttctatttccacagctacaaagtgggtccctttctggcccacttgatgggggagaagaagcaggggactcatgccgcccatttgcaagatgcagaagggcaggggaggcaccacgggggtcacagcggcagaccatctgcatcaaccctcactttccaagtggggaaactgagccacagactcaggggagacttggccaggttgcccagcaagctggacacagccccttggacagacctcagccccagcccccaccctgtgctctcaactatgggaacagcccagttctccctccctctgccctgggcaggggccagggatgtgaagatgaggtctgagaaatccacgtttggacacagaaagccagagactgttcacaagagccacctctgcctctctctcctcctcctcctcctgggaaagtccaggaaagagaagagtgcttaaaaaaaaatttaaacctttgccattaaagcaaaaccaatttacagcactgagccccagagggctggaacagaggaaagggaaatgggtgaggggtcgggggttaatcccacaagaagtccgaggtggggatggtgataggtgaacagggagtccagatggcccgctggactaaaggctgatgctacgtcagaggccatcagaggctgtgatgatctggacctctgaggccaggctcacacctccccagtcgctacagaaccagcttgggggcaccacaaggcagccaggcaggaaggggtgcccaggcagcagacagcagctctgtccttggctgtgctatgcaaaggtctcagggctgcagagaccttggcccccgtccagcacggccactggctcctgggggatcccaggccagttctacccctctctgagcctcagtttcccctcccacaggtagcaaggttgtactggaagaggccgagtctccatgcttgccacttcagagatccacgagccggcctgtcagagaaccctcgtctgctccaatgcagtccctcttcctcatcggggaatgtctggggaccgcatttgtatgcaggtgcacacacaggtggctcagagtgctgatgcaggggtgtgctgacgtgtacaagtcaaggatgggcgggcaggcgcgtgtgcacacgtcctctgcatcagcttcgggggcatgtgcttgtgtgtgcaggggcaggaaggtatgtgtgtcggggacatcccagagaatgcaagcacccatctatgttatagttggcatgtttaagtacatgtgtgttctgtgtgttctacacgtgtgtgtgcctacatgcaactccagcccctatcctcacatctgagttgctcaaaccagcatccccacagccagacccagggtattgggcaaagccaagctgtctggagccttgggaaagcccaggccctgccaaaggatgcgaagaggctgagcgtggaggggcatgggagaagaggcccatgtgggaggggagctagtccccccaccagctcttcccaaacagtccagggtggacagaggcccgccgtgccccaagcccagccactccaagctctgcccacctgaacctcaaggtgacctgcctgtggccctctctcctcttcctcctggtctccaggatggcttgggctgggcccagctccgacccacccccgtgactcagacggagttgggaggaggctcccatcgtgctgtcccaggggcgtcagctgcccggtccccatcccgggctgcctgcctgccacccgtggagacctgacgcggccagggagggaacagagaggccaaggcagagaaggcgctgacagcagcacttggcccctagcccagctgttcacgcactcaaggtgtggggggtgggggcagcagcctgtcctctcaggtctgaggctaagggtccagcggtcacatggccaaggtcatgcccctcccctactcccatgagggtggtcctcccacacacacagcaggggggacagggcagcaccccacatacccaggtggtgagagacgggaagaagggggtgctgcagggaggaggtgaggactgagaatggtggaaaagcaaaaatatcaagacagccgagcagacagacagaggaggagagaaaaggagaaagcgcgtctgagacagaggcaccgacggcagtgagctatctagatgatagatggggggcgcaggggacacgggcacctgcttccctcccgcagcccagaggcccgggagacaattgacacctggtctggctgaaccacgagaatgcagcctgtgaccagcccagagggagaggggagcagtggaagcagctgtggggcgcagaggcctcttctgcccagagcccggtggcacagcccaggaggggtgcagccatgcaggcaagcaggcattggggggtggcatgttccagcaaagagcagggctcccgtgccctggcctgactggacccctcccctagagcttttctcccttcaggccccaagtgccccaccaccagctctctttaaggggcactctctccttccaccacagaagaaacagctgcacagccagggtgcatgctgttatcgggggctcccggtctgcaggctgcatgctgtaggacgtcccctctcatggggacattcatgggcagagaggagagtcagtgagacctcacagcacttgctgctctgagggcagagctggtggtgcaggggtctcagttcagagctgggcaggaccacagaccccaaagtcactctcagcaaatgcctcccctctccggttagtcagctgcccagtgatcccgctgggtttgtgccctttccgcccgggtgctcctaggtcccgggcccctctctggactcagaactgagaagacaaggagtcctggctcagtcccacccctgccccccctcggagggcaagcctggcacagcgcctggcctctgtgaatgacagccgctgttgttaatgggggttttatagttatttcttcacaaccctcatcacccaagatcagggttcccctggactcaggcttgctgaacctccgggtcacatcctctcagccccccgctataggctgactcccaagcttccctgtcaggggagcgtctggaccccggacccggggagagcccccactgcactgcggcgtgtgggaggggttgaggggggttgggctaactccccaggctgggtgagagggtgaacagagcgaggccagctggggacgcaggcagcggaggtcagcagggaagatgcaggcccaaccagctctgagacccaggtaagctgcaggccctctccgagcctgtttctccccgtgtggcaaggtgagtaccacccagctccagagttcccccgaaatcccagacatgacagagacacacacgctcagtccagggcaggaggccccacaaacacaccaccccaggctcccgcttgtgtggccacactcttgcagggacacccgtcagctccaggagcaggtggggggaagcgcagtctgtgtcctggcctcccaggagcagggacgtgaggctcggccagggaaatctcatttgcagcagctcataagccctggcacaggctcttccctgagccaggctggccaaggctcccggaggtgtcattgtcaccatccgtgtcattgccattactgaggattaggaggaccaaggactcctggggcccagccagatctctcaggtaggcagctgcctcaccccttgctgctggaaccctagcaccaggacaggaactctgccctcagggacaaagcctgccaccccccggggaagagactcaagccgggggtctgaacaccagtcttttcactgcctagagctccttggagctcccttgtcatggagctccctgggcctcagttccttgtctgtaaaatgggaggattataccttcaccatggaactaccgttcggtaagttaactttttggatttccagcacaatgagcccttactgcagggcatagatggtgcggggaagggtcctgggattgaatgctgagctgtgtgacatcaggcacattacctaactcctctgggcttcagtctcctggcctctaagacagtcatataccccttatccaatgctcctttgtgtctgacatttgatgttcctcgaatcttatatcaaccccacacagctggtgctgtcagcctcatcttacagatgagaagacagaggctctctcctccccggcttccctccaaagggctgggaccatggcaggggcgggacatgcactgagccagtctactgggttttctgcccctgtcagaggaaagcgtgcaagggggagttgtccacaagcctcgagagatttcgatgtttccatcaatcaggaagtactgattccaggccagctgtgctcctcaaacccctaggcacactccccaccccaggacctttgctcttctctctgcctggaatgttcttcccccagaatccccataatccacctgagatctctgctcaaccactccctgcccctgacccccaccttctctagccccccagtctgagataactcactcctcacccaacccaggcttcggtcccctgacagcagccagcactacctgacgtcacttaattcttcatcatcgccctgccttgccccacccccagcagaaaagcaaagcaggatttaactttgttcactgctgtaacccccatgcctagaacagggtcagacgtacagcgggttctcaggacatgctgtgtggagtgagagctccaggctagggatggtggggagatcctggatcccctgactcggctgagtcagtcccagctactccggaggctgaggcaggaaaatggcatgaacccgggaggcggagcgtgcagtgagccgagatcgcgcctctgcactccagcctgggcgacagagtgagactccgtctcaaaaaaaaaaaaaaaaaaaaaaaaaaaaaaaaaaaagaatcttcaatatcagagggagaagccccccctgtgatggggtgctcatgatggggcacaaaatgtgccgagccttccttttagtttcacggccgtccttatgcctcccattttacaggcaaggaactgaaactcagagaggtgcagtgatgcacccaagaccacacagccaagaacccaggccagcctgagctagtggaaccagcagactttccaaggctcctccctggaagacgatgtcccgtcacctgcagacctccagtaacagggctctcagcgcccacctaaagctactggttctccttttttttttccttttctttgctcactgccgcctctgcctcccaggttcaagtgattctcctgcctcagcctcctgagtagctgggactacaggtgcatgccgccacgcccagctaatttttgtatttttagtagagacggggtttcaccacgttggccaggatggtctccatctcttgaccttgtgatccgcccgcctcggcctcccaaagtactgggattataggcgtgagccaccacgctggcctttttttttttttttttttttaaaaacagactctagctagctctgtcacccaggctggagtgcagtggcacgatctcggctcactgcaacctctgcctctagggctcaagcaattctcgtgtctcagcctcccaagtagctgggaccataggcgcatgccacgacgcccagctaattgttttgtatttttggtagagatggggtttcaccacgttgcccaggctggtcttgaactcctcagctcaagcgatccacccgcccacgactaccaaagtgctgggattacacccagccaccgtacctggccctgattcccttcttgaacagctctgattactagaaatttcttcttctattacaaagccaagtctggttccttgtgcttctgttcatgggtgccaccttgctctctggagccactagggacgaggccagtaccccataaagacccttctgacatctcctggtctgttatcactctgcttatccaagctaaacagcaccacgtcctctacctgctcttccttcgctgtggtgtcaagtccctcctgcccttgggtacagctgcccgggtcatgcttgctgtcaaggtccctcttacaacgtgtcgcctggagccaagcaccagtgccgatgcgttcagagcaggatcagctccagaagcctccacctccctcggctgggctccctgcttctgttcatgcggtgagagtaaggaggcaccagcgtcctgtcctcaccttgtcctagatgtcaaccaaacctctaggccccttcacacacacggccaggcagccctggtgccctcacaaggtccacgggcagctctgggcagtatctgtttaggtctcttctgaggtgctgggtgttcgtccacccccattcaatcatgtcttgttagtctcagccctgcacaccagctgctctgggtcccgggggagctggctcctgcccctcactgctttggcacctgctccgggctctgtgtcatcctgcactgggtgagcaggccatgactgcatctgtgtcacagggaaacagggaccgggcccaggctaggggccctgcctgcagttcagccctgggctgggtgaggcatgctgcccaagcagccgcacacccacccacgttgcttacgcgttccacatgtattccctgaacacctactatgcccctggccctgggacagacagatttgcctccccttcactaagctgccttcttactcaaaagagcttaacaagaaccacacagcaccaacagctgacagccaaggcgtcagggtctctgcaaggccttggtgctttggacgcgcatctccaggtgtaacctcagccaaagaaggggcatggggctgggccgctgagccgcagtgtgacctcgggcaagtcagcacctcatttccctgggcctcagtttcctcatctgtttggaggaaaaccacagtacacatgtgtctctggtttgctggggccaccccaaagccctgtcacctgcccaccgtgtcacccccccatggctcacccggtccccgtgcctcccctgctcacagggtgccacagtcatctttactacctactccatgtccaggccttggtggaaggagagaggcagggggtggaaggttttaccaaaggtcttggccttggcaaaccaccctgtggcctgacaggagacacctgagcctggttctaggggcagctgtaaccacatggcccgtgagcagggcccactccctggcaaacccccaccccagcccacccaccaccaggcacctggggataggattgtcccacagccaaggatgacctgtattaaaaacccacctcctggctttcccagaatcctccaagctactcaggagactgcctccctcaccccttctctccccaacctggcctttacctctcctcccctggatcccacctcccccatggactgtgcctcccacacctgatcccaccttcccaacctgacccctggcctcatcccatttgaccccacctccccaccccccacgacctctagccactccccacttgcccttgcctcccccacctgaccctgcctcccccacctgacccctaccttctccccacccgacccctggcctctccccacctgaccccgcttcccactcccaacccctgccctctccccacctgaccccgcttcccactcccaacccctgccctctccccacctgaccccaattcccactcctgacccctgccctctcccgacctgaccttcgcctccccccggcccctgctggccccctcagctgcagcccctgggcactactcaccagtgtccactggacccgctctttcaccagtgcctgcgcagcacggctgcctctgcctgcatggcctccattcattcattcaataaacatttatggagcacctactatgtaccaggcgccggctaggcccgccctcctggctctgcctcctccacctgctcctcccccagggtcccaaggggcgaacgcttccctgccctccagtaccctcagggctgtcccaagacaggggcagtgcatgtggggaccgcaagggggaaatggaggctccagtgtcggacagcgaagccccctgagaggtagcccggggagggatgggcggcctccgacaagatgaaaagtcttcagtgcttgcactggctgggcctccgcacttcccatattaactcatttaatcctgagccaactttaaacatcttaaaagcactatcactattcccactttgcagatgaggaaactgaggcctcacaactgctacacagtggcttccagcctccacggccccaggctccgttcaagagctgctgtgggatcctgtttcatctggatggtggttttcacatttttttaatcagttgccaatattgaaaacttggcagattttatttcaaaaatcctcatttctggaatccactgagatacagggaagatctggcttccctgggtctgcgtccccggaggcacagcagtggcacaggccggggcagcatccaacctcctccctgcctctctggtttaggtggccagctgacccctgcacactggagtttatgaggccagcaacaaggggggaaccccagagtggggacacgtagaaacccagcctgtcaggggtattcctatgagcctctcagcctgggacccaagggtgccccgatccctgcctcctgtacttgacccctgcctgacctcgagcccccctcccctatcctcctgacccatggctcctgggttttagtaccaggatactaacagcatggatcggtcatttagggagggaggtctccagttatgagtctggggctcaaggattctaggatgtatctaccatttatttggtcctaaaagtctcctgtgtcttggcctctgtgggtcaccaattctacaggactttaagctgtcctgaccctctgacagcttccccttggctccatgcggccccactggggagaggtccccaaccaagggagttcccacacagccaccccaggcccacctgtcaccttgtggggcccacttctctcctgcctgggtcaagtttgggactcctactggggtttgagggttaccctctcccaaacattattcccaccccacagaacactgccagctggcctagcctaggtgctgtttccaagcatggccactgtggacaccaggagacctgagttcctgaagccacaccacagctcaccaaggggccctggggtttctggaatggctccttggtcccacccctctccccatggactccctcactctgctcacctaggactgggacacctgcctgctacgcccccagccccctgtccctagcatggcccagcacccagggtcctggagccctctaggcccaggctgagaaacccctcctgaggccacagcccattcagcttctgtcgcttcagaacctctaaccaggcgatcgcaaggggtcagtatggacaccagctggggtggcccaaattccctccccctggccctgagaccagctttctccagaggaggtgggagggtccagcccacactgacggccgcctctgaggctacggggggcctgcagctgcagcagcagagaacaaggaggctctgtcggtgcagaggggtcgacatcgagccccggaaactccccggggagggccgccggctgggcagaaaccacagcccaaacgtgaggctatctatgtgacagctgctgtggccaccaactccgcgtggccagtccaccaagaccggccctccctaacgtgctgccaaagcgcagggtccacattcagctcgaatccaggctatgccacctcaccccgtggtcctggcaagctaatctgtcctgggtctcggtttcctcttctgtaaagtgggacaagaagggcaccagctcagagggccgtggagggggatggccacaggccagggtctgggcagggtcacagctccaggaagctgcctcctgcaggtatcgctgtgagggtctggcgcgtggcaccgtggcacacgccaggcaggcaggaggacctcattacccaccgcaaccatgacagtgaggaaggatggggcctggcctgtcttcctttcagtcccgagggcaacacacccctctttgcctctgtccctgtcccctctctgatgtccaggccccccaatagcctgctcccacccccaccttcagcctgttccccggcctcggtttctctcccagcgccaaagcacaatggctgttataattaacgaattatctcagcgtgacagctgtggtcctttgaaaattagcttgaataacaagatcctggtgtatggtaatttattttcctctttctccccccttctctctccctcacttcagccttgtcatgcatgcaaatgtttttccccttttcctccttccctgacaccttccccctctgtagcctcctcgtcctcctcaggagggtaagggacagactaagcttctgccttcaggtgaaaagatgcaggagctgaccctcctgggcacctcgtccgcgctggtgccaggcacagcgcctgacatgtcgccttctgaaatctccccacagacctaagtcctgccaccttcttcctgggctggggacctgcagctttgctttcccgcgacctcccaggccgcggcccctcgggctcctctgcttgtaagccaagcagtggcctcccctgatgtcctggtccctgctcactgcctctctcaaacccgcttccccctcccctaccccaagagcccttcaacccttcccaaggcttctaatgtcagctctgggctgaccacacccaaaccaccgtacccagctgcctccggggcccttccctggcacctgaaactcactcgtccatgtccacctccacggctggactcatctcccacggccccttccccctcctcccctgcttctctcccagttcccagacacagtgagaggcacccacacctccccacctgcccctagtcccgccttggtgccgccgcctccccctactgctcctgctggtctctctacctccaaccctacctccccactccatgccccctccacccagcagaagatgaactttctagaacatcaacctgagcatggcactccctgctgaaaagtcttcgttggctcgggctgatctgggaaaattccaacagcatccagagcccagcccacatggtcttgtgggagccgctgcctgttctgccctcctacctgcctgccttcttccaacctggccggggtctctcctgtgggttcccacagccccctgtgcttcctccatcacaaccggaatcataactgctgctgctacctctggactgagttccccgaggaagggtcctgcttctcctagtaggtgctcaataaatatttgttcatggctgagtgaaggaggccagctcgccgccctcatatagataaggaaatcgaggctccaagtaattcatgacttgctcagatcacacagttcatgcaaaagacaaaaccaggatttgaaccaggtctgtgactccagtgctcttctgggctcttctgctccctggggaagtcggggaggggtcagcttttgcacagatctcaggggacttcagcctccctccagcctcagttgggcaataaagagaccagcttctagcctaggctgtcactcccttgagtttgaccttggactagccacatgactctcagggcctcagtcttctcatctgtaaagtgggaaggagccccgcctcactctctatcccagagggtggctgatagggcagaaactcaggtcttggagaaagccagtcctgctaacatctgggattttcctgacctcaccctccaaatccaactgcattgcccttggcaggcactccccggggcttcgtggggggcgtccccaggatgggagaggtcacagagaataggaactctttcagggggaggtagtgggagaagcatgcggggcttgggagtcagattatgaccttgggcaagagcttcctctcagagcttggcgtcctcctctgtcaattggggccacaatgaggactaatgtacacagtgcctggcacagtgcaggtgctgccaaggccacatggctgcaaggttctatgggaatgtgatcctgaagtgtgccccagagagggagagagaagagggtgagacagagcaggaccagctgttcctgactctccctcaacagcccacaatggctcccactggccccagaatagagctcacaacccaacctgtggccctagaacccctctctccctctctaagctcacaccccaccatgtcccctcgcaaccctatggaattgagggcacgcccacacccatatccaccaggccgttactcaccagcgattagctggtactaaccctgggacccattcccacctgtccccatcccctgggccgagaccttatgcctcctcctctgagaagcctttggagatctcccttctgcagggtgacccccctgctatgcccccacaaccccgaggtatagcccttggaatcctggatgggtcctagagatcatctcccccattttacaagtaggggaaactgaggtgcggacgaggaacagcagctctccagtgatgcacttgaacccgggtctctgctgcatccagcccaccaagcagcttctctcctggtgctgagctgtttagcccttgcctgtcttctccatgccccctcccctgcctggagctacctgaggacaggaccccatcttcctgtctgcgcccctcccccagtgcccagcctaaggcctggcgcatagtaggcactcagtaaatgtctgttgaattgaattgcgctcagggcggccagtcgtctctgctctgtaagaaaagcatagagttagtggagctctccccaagaccaggggggtgggaaccaagctggtggggtgaggaacctggcctgccccaaggagcccacgggccctggggagggggcctgggaagctggaacattcagacttagatgagtccgaattctgccccaacaggctgcatggctctggtaagtcacactgcggcagggcctcactggcctcatctgtcaaatggagatgacactccggtccctccaggctctgaggactgcttgtgatgaggaccagagagatgtgaggagtgtaaacagtaaaccccagctcacaagcatggagtgcccagcgcctgacacaggagagtcgggtgcgaatgatgcccattctacagatgaggagactgaggcttggagaggggcctggcttgcccaaggccacacagcccatgcattgatctcatgctgtacacacggcctccctgccaagccagagggaagcaaggagtgataatgaaccccagatgaagaagctgaacccaccaaagggtggcccaaaccttacccaggctggcaaagattctgcaggcaaagggcccagcgtgagccccagagctgtgaagggaagggtgagaagccgcattctcccctccccatgggggtgagctctgattccacagccccccagagggttcaaaggcatcctcagatccgcagctgcaaaggcctgggcaggcctgggtgttaatatagatcagtagagactataaatacacgggcaggctggtcactgcagggcggccaacctggcacagccaagacagaggttctaaccccagccctgccccctcccgccacccctctcccttctgggcctcggtttccttgcttgtcaacagcaggctgctccatgaccatgactgccagaaggttctttacccagcaacacacagttttctgaccccagccaggctggcccagggggaggccctggaggcccaggcagagacctgggagaagagaaggatgtacaacaggatcaccccggatacctgagacagtcaagcgaggggctagactatgcctctgctcaccagcctggagctgacaagaggcagagaaaggagcctagaagccagccattcattcattccctctctctccattcaaacagccatgctgtgagcacggcctcccgcaagtggaggacccacagccaaagccaggccttctggttggggctctggtggggatgacagggagatgaatgggcatctctttccctatccgcccaaggctgcgtgggggccatcctctggctcccgacccccatcccaggtcgcatgacagggacactggttttacatccaccttctgcctggaccacagcctcatagaggacaaagaccaagtgtggacagtctcactcaccctgtaaacccagggcccggcaccgtcccagtaggctctctgtacacgtccacggctgaaaatcaccctgggaacacaagagagccaccacgcacagggccatgacacaggcccaggaacagaggagcacaccgcgccggcacccgctgtgtgccaggcccccgcacacttcacacatggcagccacactgtcatgcctgcttgaaggatgagggaactgaggctgagaaatgataagagacatgcccaagagcccacagctaaagtggctcagcacccatgactccccagatacaagtccagctgatacagcagtctgaccatcaaagggacggtgtctgggactccccgaaggccaggcataggtgaagggacagtgtcccacttcctcatcagagcctcaaaacaaccccaaacggcagacagacccttacatgacagggagagaaactgaggctctgagaaatgacctgtgcccagccccaggcctggcaaatattggaaagggccttcccaggcagtgcgtgggtcccacatcctctgagactcaggaggaaggggtgcagacctgggcctgagcccaactggccctcgcgtggctgggtgacatgggcagtgaccggccccctcagagcctcagtttccccaagacccatctcctctgccccacgcacctgctgcaaggaggaggaaaaggataacccacgggcaactcccctttaaaaactgtaaagtgccattcatctttgttcttccttcttgctgtcagtgcaacagaagcaccgtccatcttaagggaatttaactgctaccgttagactttccttggccctcctcaaccacttctctgcccccgtctctaaaaaggctcacctgtgtttgtgagatgctcacagtgagcccacccttgttaagggattctctcacatttcatcctcaggatcctaggaaccagttttttgttgtgttttttgtttgtttgtttgttggattctctttttttttttttttttgagacagagtctcactctgtcgcccaggctggagtgcagtggcgcaatctgggctcgctgcaacctccgcctcccagattcaagcaattctcctgcctcagcctcctgagtagctgggactagaggcgcccgccaccacacccagctaatttttgtgtatttttagtagagacagggtttcaccatgttagccaggatggtctcgatctcctgacctcgtgatccacccgccttggcctcccaaagtgctgggattacaggtgtaagccaccgcgcccggccagaaccaggtattatttttatgcccgttctgcagataagggaagtaaggctctcagagattaagtgacatcctcaagatcacattgcaagaaagtgagcgtgctccccacgccactgtatatttgcccccacatatctgtatattccactctcagtggctgctagagacctctggttggttaatgcccatctgttccctggtttatccgacttcccagatgtatgtaatattcatatttccatcagcagcagctcacgcacccctttccaaggccttcaggagccccattaatcattcagacacacctgcatattcattaacttctcaattaatacagggtcccttattacttcaggcctgctgcctgcattaaagacacttcaacttcgttcattattaaactcccctgataaatgatcaaacccctctttcacagagggggacagcgcccaggccccggggctagcaggcctgctcccagtgacagctgctgtgtgaccttgagccaggccctcaccctctctgagcctcctgtatgtttacctggtaaaatcaggcaaaggatggtctctgaccaccacctggcctcgtcaaggtggccctgtctcatcctttgtcctttctctgcgtgtcttttcttggactcacgtaatccctccccagaatggaagccgatcctctctggaggtttccttatgctcccccatcaacagcctccactcgcacctgggcctgggcctgggctttgcagtcagtgggcctcaggtcctggcactggcccatcatcctgagggcagcatctccgggctaacttggcttgggcctggcagaccatgacacgtcccaaatcagagaggacaactgacaccccccaccagttgccggactccaactgccacacaacagtatcgatgaggacaacagtaataataacagcacccagcacttcctgagcctggaccacgccccaggccttgcgctaagtcccatatggtcccatcctcagatcaacctccacttaacagataggaaagctgaggccagtgaggtcaagtcatctccctaagccaggctggagctggctctgcacccaggcctcgctgactcggggtccccagagcgtccccatcacatgtgccaacaggaggccccagcactcggccaccctcttgccctggctccttccagcaccttcttcccaagctcttcctttataggcccgatctctgcctaatggagctgcaggcgacacggaacgggtcccccattcgctggcagatgccccaatccatctccattatgcctggcgctaaggagcactgcaaatgaagcgtgatgatgccaccgccagcatcactcctgctggctctgacccgcctgccacctccacctaacatgcacaccaggctgcgactgatgtccacaggcccagctgccacctcgtacagatgcagggatggagcctttgctcctggccccactggctgtgtgactgtgggccccttactgaaactctctgtgcctcagtctcatcatccaaattatgtctgactccaccctctccctcgtctctcatttcccatccacctcgacacctctccaggccacacacctgtgtgtctgctgccgcccctccgtccaagcttgtctggatggcagcacccacctcccagggtctctagtgtgccccaaggtcctcccctccctctgctcggctcgggtgctgtcttttatggactcaccgaggcctctttcttaataccctttcagccgcttccacagttcccaggctaaagccagacgtcctcctgaaggtcaaggcccctcaggggcctggcccggccgcctgttccaggctccctcccgccctcctcccgggcagcctcacctctcccaggatgactccttggtgagtgtccagcccccgtggaccgtcagggggccgcagtggccagcaccgtgagtcctcccccgcagctcccgccccggcacacagtaggcagagcgatcccgcagcttaaaggaatgcccccatcgagtgcagacagcaatttcatcctacgggccgtggtgactgtcaacagtgcctcatacgctgtaaatgaagaactcttcactcctcgcctgggactgagcactgggttggctgccgcaaactcaacaccaacccccgaccttacagggtgtcaagataaagatcgtcaggccaggcgcaatggctcacgcctgtaatcccaacactttaggaggccgaggcgggcggatcacgaggtcaggagttcgagaccagcctggccaacatagcgaaaccccgtctctactaaaaatacaaaaattagctgggaaagggggcacacgcctgtagtcccagctactcgggaggctgagaggcaggagaatcacttgaacccaggaggcagaggttgcagtgggccaagatcacgccactgcactccagcctgggtgacagagtgagactctgtctcaaaaataaataaataaataaataaataaataaataaataaataaatattgttggattaatttctcagatgagaaaacggaggctcagaaagacaaagtggcctcacagcgtcacagctggtaagtggtgaggctgggattcaaacctggctctgcctgtgcctggttccagcaccagaagaaacgtcctagaagtagtcaaggagcatcaatcgagtgccgaccacacgccagacccaagtaggcatttacatcaatcacttcatgaaaacccctccacggccctgggagacgggcactgttattctacccatctgagacacgagggatcaggcccagagcagtgaagccacttcccaaaggcacacagctaagaagtggcagggcctgagacacaccaaggtgttgtcccctctagctctgcccagatctccttcccagcctcctctgctgtcaggggcactctagggagagaggcaccccttggctggctctgtggcagccaggagctgagcaaagtccttctctacctgggccttggcttcctcacccacggggggcaggggatgtggacaagacaacctgggggtcctgtcagcactggcacaatatccgtgcacccaggggcccaccacacaccaggtcctgggcttggcaccgtgggctgcaaagacctgcaaaactagtgtctggcgtgcagggcatcaccaagggaggcccagggtgggaggggcagggagccacctgttcagggctcaggggacaagcagggtgcaggtccctgtctgctgtcagcacaagcaccacagacccaacaggaagccagaagaagggtcacggacacagctgagcccccagatacccgaagctggtggttaagtgggaggctcagcacctctgaggacccgctaccaccggagggctggagacccccggaaggggctgcatccagctaaccagacattccacatccgatgagcacctagcctaggatttcaggcacaccgtggaaaacacaaagacaagccaggaactcacagacggacaaatgcgccagagactttgctatttaaagaaagcttcctgtgaattattttataaactaagtatcagcctccaattccccatcaaaagcttgaattttcagattgggtttgctgaaagtgagctaacactcctggctttctaggtgcttctgtattgcacaccccaagggtgggacgagggctgtgtccccaccatgtccccggcccccaacatggggccagcgtgcagaagaggctcagcaaatgctgcagaagccaactctgttagcgcactcatttccaaaccccaggagcagagctgcttgggtgccaggatcccccagcgggcacaccttgtgccatctactttcagaccctctggggcactttgaaggaggtcagagctggcagatcccttagcactacccaggcccctgtcatgcagcaggtgaggaaactgaacccagagaggacaagagccttgagccctacggcctcccagccacgcccccttcccttccaggcgcccccttcctgccccgacccactaaccactgctgctcctccaggctctgtccttggcctgtggcaccctcgtctgccctctcctccagggtggcttcatgcatgcccctggctgctcagatcgcgctcggtcatggtcaccactgcctgcctgcttgctcaggcccagatcccagctttcccgtcaactcctgcctctcccactggaagatgaagatcagaccagcctccaagtccatgccaggacaggccactatcatcacttgcctatcactcacagggatctcctttttttccaggcagagggaggcttccggagggcagctctgatgctgtctctcctgctcaaaatctttctagggctccctgcagccccagggctagagcctaagctccttcttggtgggtgaccaccaacacggtgaactcctaccagcttcagctcgggcatcaccgcctccaggaagccttccttgaatccctggtctggcttcaccactccactccacagcacccccatgctcaccagctccaagtggcatcccactgaagggtcactgtgtcccctccagagggccaggaagcacggcgtgcccctctgtgccccctcagtgcccccagtgagaagcctggcatggagaaggcacccagggagtgaaaattgaaaacacaaaagaacaacataggcccccaggcatgtaattcccagctggcatccgtctccactcgctcacccccacccacgctgagtgtgcccattattatgactgatgacagccaggcctcccagctccttctggctgctgtgaccatcaggaagccgtccagtacgatggctcccatgctggccctgcccacaggacagtctggtcagacgggtgcagagggacagggaaaggagggggaacgtggacagagcccctgctggaagcctcgcctagaccccaaggtcagctgactctgctggccttgtgggagccccgcgtgaccttcttatgtggggacgtggggctctcacttccaaatgaggaaactgaggctccaagagcaagcagccgacctgaacccagagatcggcattggtctcctgcccacttcttcttacattggatccaggagcttcctaagcacaaggaggggaacgagctaccgggctgggcattttacaggcgttctgggaggctgtgggcacccgggaaagaacaccaagtctggggtcctcataacctggactcagacccttgctcggttcccctcagctgtgtggcctcggcagcccgcgcagcttctctgagcggacgtctgcactggtccctgggggtgcgaggctgccctgcagggttgctgtgtcaaatgagacggtaaggacacagccaataacagccgaacatcttccaggccacgctgcgggtggattattgcatctaatcctcacagtgactctgggaggctgagtctaacagggtccccatttgatagacaatgaaggtgccagggtcaaacgccttacccagagccaggcagctgtgggcggtggagctagcgctcaggcctgggtagaccgtgccgggcacatggagggcctcactaaacaacattattttttgactccaacctgccctttattcctcaaaggcccctgaatatactggcctccagcctggcctctccctcctgcaagccttcgtagggactgttccagccacctgccgtgcctctccttccacttccagaaagcaaacctctcaccctttacattctcatcaaatgctacctcttccactgagccgccctgggctccaccaccccactcctgtccggccccttccccctaccccagtaaagccccccagcacagcagtctcctaactgactgtcgcctaccctgcctcagcccatcctctgcacagcagcccaaggaagcctcccgcagcgcactcacatcgccgccctgctctaaagcctctggcgcctccccagctcctctgctccacagtttaggcccctcatgatctggcttggctctgtctctgcaatgtgccctccaataccatcaagacaaactgctccccgcttcacacacgcaggcgtgcacacacacgcatctacacatgtcatgtgtgcacacatgtgcacacatgtacacctctccagctggtgcgggatctcctaggctcctcccttgcttgggcctctacttccactcctgccttacccaccttcccacctccagcccaaccccagaacagcacctccaagaaacaccccctgtaattcctcagctcccctaccagctccttcctggaacacagcatccacctggcctgttcccaaacacatacatgctccctgctgctggaagacacagcgtccagccttttcctggcccggagggagctcaggggcctctggtgtcctccccagactcctggatcctccctccccactcccagggatgggcacgtgagcttcttacccctctctgaactcggagaggctttttgcagctcttggcctttccccttgagattccccggcctggagtaccctcctgtcccatccccgcccagtgagtgctacttctcaggcaggactcaaagctgcctcctacaggaagccttccagcccaccaggcctcagccaccctgtaaggactggctggcaagtctgcccctgtgtgggcttcctgagggcagggactcttttcatgcccaggcccatactggctccttgagaactgtctgctgaggaaacatgctccctcctgtgccacccctgagtgcctggaggcacagcaagcaagttgatcagaccacggagaccaccggcccacctctcccacctccaccgaccacggggaccaccagcccacctctcccacctccaccgaccacggggaccaccggcccacctctcccacctccaccgaccacggggaccaccagcccacctctcccacctccaccgaccacggggaccaccagcccacctctcccacctccaccgaccacggggaccatcagcccacctctcccacccccactgagccccctgcgtcgcacacctgggccaccggcctctgccctcaccggctgctggctcccatgagattggaatagtatccaaaatcttcccagacttcacttcttcacctcccacctcactcacttgctccagccaccacctccccgccatggccgccttgctcctcctggtaaatgaaagaaggaagggcttgcagagcttgaccacgtgcttcctcagcacccactgaaccctcaaaccagcatcattcgcaaaggacagaggaggaaactgaggcacagagaagggaaacaactgcccaaagccaggctgctgcagggtgaggcctgcaaccaccccctccctgcctccaaaggccaagccctccacgtccccagcccatgcagcaggtccctaggaaaccgggaggggcaagggagtgcaagggagaagaatgtaaggaaaggcggggttattatcctcccaggtcaggggcctcaaccaccctccactccactcagagatgctgacccaccccctcgtgtctacccccatcccaccccactccggtccaatcagacttcaccttctgtccacaggccgactcccactgtggacagagagctgcccccactgacacgggcctgggggtagcagcaggggcagttgtcccctcccctcacccccggaggcccacacacctgtgcctgaggagcacctcagccacctggagggccagggctgcctgggcagggctggggcaaaggcattctggcatcttagggcctcctagcaggtgcctggtgaccaaacctgactaccaagaatcacagcctggcagaattggaagagcttaaacctcttcgctgtcacccattagacagatgggagcctgaggcctgcaggggtgccaggactccccaaggccccctcagcctccccacccaccctcggtgggcacgcctgctgggagcagcccctgagcccctggagggaaggacatggcctcactccccgccagggtcccagcacccggcccagaacaggagttcaagagtttccttgaacaaataaaagcgtgagagagtccatgccggacacaggccctgccttgccttcttgtagagggatctaaaggtggagatcaaacgagggcattagcctgaaagtgctttcaaaacccataaatcactacacacctggaagggacttgtaatccctaagtggcgaaaacggtcacaggttaagtatttcattcagtcattcatttcataccgattctcaagtcctggctctgtgccaagtcctggggacggtgcaggggactggcaatgacctcaacagacatggcactgccctgaggaagcccacggctccaagggagtcagtcaaacagggtaccaggaattacaagcggaacatgcgggggccgtggggcctaggccaggtggggctgcctggtcttccagaggaagggtcacctagctctcaggcctattggagacaaagggtctccaaaaagcaggtcaactagcaaagggagcacagctccccaaccagccagtgtcatctcaggtgggcagtgtctaagacagggacacacagttgggcagtatatataacactatcattgtcctcattttaaagatgaggaaactgaggcccagagagccaaagcaacatgcctcaggtctcacagctcttaggcagcaaagctggtggtcatggggcctcctgcacattctcaggtccctgaggaggcttggaacagtttctagaacattcagccagtgaactaagggccaagccactgtgatgggattcaggccagctgctccactcccagcagggagggaggaggccgcagccagggtaggccaatcacacagtgggccctcaggaaacacggccccagctggacctgcagaaatcactagaaacagcccaaacaaaccatccctgcacaggagctgcctaatgcgagcctgggggccaccgccctaggaggcgcgtgaggtttcccagtaaccaagccggcccggcagccctccctttaatgcatgcaaacgaggggcataaatttctgcttacttaacttcacaaatgttaacaagcccataaaaaataagttattcttccccagctccacaacacccttcgtttgtttaattttgcttctcctctccccgcccccagcctccttggcgacaagggaaaagcttgtcttttccgtcttccatctttccctgcctgcggggtctgcccttgcctcaacctgccccagggaggctgaaggaagaagccccagataaggaatcagaaggcccaagagtgagccctgctccctcctccacagctgtgtgaccttgggctcctgacttaacctctctgtggtttaattgcctcatctatgaagtaggaacagtagctgcaccctgcctgctttggggttcctgggaggatcagaggagataatccaagtaaagtgcttagttgtctctggcacagagcaaaccctcaataaatgttagcccatgctattatgtaaagaagagttaaataccctccggttaatccatttgtagagtttgtcttccggggcaagctggcagctccaaaggcagcctgtggttcggttttgttggcagactccgtgttgacacacatttgagttttgatgccatccaaactgaccgctggagtttgccacaggcccaccacaccctattgccctacacagaccagacgtgcgccttgcagtgacccggccccggtgagcgtctgagtttcccacccctagttcttgcctctcaaaagcctttccaactggtgatctcactagaggcatcactaggcccagctgaccgataaggaaaccgaggctcatgaggggggcagcaacttgcccacagttcccaaggaaggggctgtggagccaaggtgagagtgcagccaccagtcccagcctgtcttctctcctgagcccctgtgccaccacgacaggttcagggaagcctccctggcagctggaggagcaaataaatggccagttacgcaggtggcaggagagatggtgttcagcctccaggggctcggtgggtcccaggaccaggcaggaggctgagcagaagccagagcatgagctgggcctcgtcccagccaacccgaggcatgccaagccagggtggcattgctgtgcaccgagcacagcactggggactctgaaagataggagacgggggttagaggtggcctgttcccttcaggtctcctccacatcctccacttgagcccacttccaagaatggcccgggccagagaccatgcctcacttgcccacaactgccccctcctgctggcatcgagcagaaaaagccatagccgcagcctatcccagttactaccagctacatcttccccaacaacatcccaagctgaggccactttcattcttccctctctcaccaatcgcaagtcccccatgaggtatcactccatgatgcccctccccccacccccaggcaggtgcacctgtccatccattcattctgcagaacaaagctaggctcccagcactgcagggacttgcccaaggtcccaccaagcccagagtgaaacccagctcctagacatccctaccaccaccttcccaatttaggaggagtccccgagggcatccctagggcagagggcagggccaggctcctaaggggcggggccatgcaaggcgagcgaggggccggagggtggggatgggccgagagaagactggatcctggtctgggtcccggttgcctgggcaacaggactaattaattccaactccatctgtgccttggctggatgggcggtttgggctcccgggtgtttgttttgaagcaaagggagagaagcgagagggcctgggaggctgcggcctcggggtctagcgaggggctgacattcgccccaaattcacatagcaggccctcacccccaccacaggaaaaggcagaaaaggcaggccaggcacccagagaccatccgggacctcctctccccaacgaggctcatcatctcagcccaaacgaggtctcacacagccagccatcggcggtgcccgccgtgtatgcacacgtgtacacgcacctgcacacgccgaggagaccacaggccccagaatgagagagccttgggtttggctgccagcttagccttctgagtctcagcttccctgtctgtaaaatgggcaacaccactcccctcaaagggctcttgggagaaagagagggacgtccccagcacaaggacacctgaggggcctcatctgtcctggggtccaggaaggctttgctgagggtgattctggtgagggaaccacgtatgtggtacccagaaggtggcacttttgaggaactggaacaaggtcaggagaactgagatcaagataaatggaacatcagaaggagagggagccccgaggccgagccaactccttgcagatctcaaggttctggatcttggcccaagggcagtggggagccagtgacatgctgggggggtgacaccaatggaagggtttggaatgcatcggaggggcgggaatggcgccagcggcctgtgaggaggctgcaacgagacgggcctggagggtgacttggtgcaggcaaggacagcagggtgggcacatgaaggcagatttgagtcaggcttagcgaagagagtcgggcaggatggagagagagaccaaggggggagttcagggatgccacccagggtctgggtgggtggctgagtgagcgtagtgcctgccctggaacagggagcctcagagaatgggcaaatagcagtgcaggaggacagagcagagcccgggtggggccagttgagctttaggggtcagaggaacaccccaaaggagtgaccagtcagcaggtggccacacgcaatgtcctacagccagaggcaggtgacagtggaggatggagactcaggcatcccttgcacacagctgttaagatgctggcccgacagcagcggctgacacccaggctgggagggtcagcgctcagggacaggtgcagcagctgggagtggatgctggtgctcaggagcctgccacatctgcctgtgttcaaagcccgaacccaacacctcaccagctatgggatccttggcaagtcacttcacctctctgagcctcaacttccccatctgtaaaatgagaataaaagcaatacctaccacataggttgttgtgaggagggccatccccccagatccttagctgagccccagagacacaggagttccagctacctgctggtgatcaagaaggaaggactgggcctcaggccctgggctgaatcctgggtcccctacttaccaactgtggaaccagggcaaggcccctcacctccctgaacctcagcattttttttttttttttttttttgagacggagtctcgctcttgcccaggctggagtgcaatggcgtgatctcggcttactgcaacctccgcctcccgggttcaagcgattcttgtgcctcagcctcctgagtagctgggattataggtgcattccaccacacccagctaatttttgtatttttagtagagagggggtttcgccatgttggccaggctggttttgaacctctgacgtcaggtgatccacccacctcggcctcccaaagtgctgggattacaggcatgagccaccatgcctggccacctcagcttcttaaaatgtaaaatggggatagtgaaggtatcaaccccatggctcatggggtcactgtaaacatgaaataagaaaacatgtcaggcatgggtcacctgcctgggacatagcaagcactaaataattcatcactgctgtcattacagttattgtcactgctcctcccagtgacccaagaagggggatgtgctgatgcccgaataagaaacaagaaagacaaaggcctcaacctagcatccaggacctgaactgaccaccacgtgatcgcaggatcccctttccctgcccaaatagcccccttagcctgagacagggctgcatgagactacctggatctgaaccctttcctggcctctccgaactgtgtgaccttggacaagtcatctcacttctctgagccccaggttcctccctttaggaaaaaaaaaaagggtggagggggggtggtcctgggcaggcacaatggctcgcgcttgtcatctgagcaccttgggaggccaaggcaggaggatcacttgagcccaggagtttgagactagcctgggcaacatagtaagaccctgtctccacaaaaaagttttttaaaaacttagctgggcatagtgagacgcacctgtagccccagctactctggaggctgagatgggaggatcgcttgagcctaggaggttgaggctgcaatgagccacgattgcaccactgcactccagcctgggcaacagggtgagaccctgtctcaaaaaataaaataataaaacaaatgaaaaataaaaaacaagggtcccctatctgtaccattgtcccgagggctgaacgaggtgatacgtgaaagttgtccagtccagtgatggcacacagcaggtgctcaacaagtgacagcagttacgatcggtgattggatatgaagacctggacacggggacgaatgactgcatacaagcactcacaacggagtgccggggtgtggtgcctgtcagctcaatcacaccccagagggctgcacatctcgggattcacccccaggtgaccctccctggcgctcccccatcagggaaagggcagagagcaaagggacccccagacagtgcctcccatccatgccaccccccactcccaccgcccctgcagcaagcacacagccacgcgtgtgccgccccagccccgtgacccactagcagcccctcccgtcccccgctctgcatctgctcaattagggaaactggggagcgagggaaacaaagacttaatttctgagctaatcagcctgcctcatactaattaccatcctcccgggcattagggcagacttcctgggggaggctgagggggaagctggtccctgggaatgacacccctttcccctaaagcctgagagcccagcaatgggagggtggtggtgcagggggacagggaggcttgggcaggtggaatttcagggtgggatgaaggagacgtggtcagaagcaggagacagagtccactgggcaaagcaggcaatgcacccgtggtcacctggacagccccaccttcccaaggttcccgccccatcctccaggcagccacaggcttgggagaggcccagaacaggtgccccagtaggcatgcagcccatggccttggccaagaggacagatggacaatttgaagctggataattgagcaatgatcagagggaagcttctggatcatggcctactgggtgtgtgcatttgtgtgtgcttgtgtgtgtgcgtgtgtgtgtgtgtcgtatgtgtacatgagcacaccagaacaagagggctcgggactgggagccaggaagcctgcgttcaattacctgctcaggctctgggaaagtccttgcccctctgaaattcaggctataccacaagcgagctggagggcacgatttttggaaatcatttcagacgtgaccacagggccacttattcttcaacaaatgcttgttgaacacctactatcatgcagccggctctgtgctggcaccacaggcacattcgtgaacaagacagacaaggtccccagcctcacagtgctttcactgtgatgggggagccagggagtcaacacgaaaatcaagaaacaagtgccttggctttggcagatagaggaacgtgctctgtagagagtccacccataggatgtggacaagcgatggggccaccacaggtagggcttatggcagcattttttagaaaacgccccacccggcggccaggcgcagtggctcatgcctgtaatcccaatactttgggaggctgaggtgggcggatcacgaggtcaggagattgagaccatcctggctaacatggtgaaaccccatctctactaaaaaaaaaaaattagctgggcatggtggcaagcgcctgtagtcccagctactcgggaggctgaggcaggaaaatggcatgaatccgggaggcggagcttgcagtaagccgagatcgcgccactacactccagcctgggggacagagcaagactccgtctcaaaaaaaaaaagaaagcgagaaaaggccccacccagcaattaaactgcagataatcccaactcatggaggacctcagagcaacccctctcccttctctggacctctgtttcatgcacacagcgcgggagctggatgagatgctgtccaaggctgattcagtcccacaagcaggagttctcacgagtttctccaggccgggtgtgtgcatgagaatgtctgcatgatccccccaggggctgcggtctagcccacacatttatacatacacagacagatgaccaccatgtccccagtcctgggcccggctgcacaatggatgtaccagatagacaggtatgtgcctgatgatgagaggggtggggcatcacataccccagggcccatcagctcccaatcacgggatctgcggcccgcactccaggggatacactcagctctgctggcacaggcgtcccttgaactgcctccctcccacctggtcatggggccttggcagcggcccaccatgtgctgagcgcctgagcctcactgcacggaattctcacaacagccctgccaaggaagtgctgttaaccctgttttacagatggggaaattgaggctccgctaggtgaagtcacttgctcagtaaataatcagctaggcactcaaatcgggcctgatcccaaactgccacccctaccatatgccaggaccttcttcctggaccactctcaaggctcaaaccagggcacccgcctgaaccagctctgcccaataactggccttccagggattgccaagggcgcccaacacagcaaggcagtcaggttcagatggccagtttcaaatcctgatttcatcaccgagtcgctgtgtggctgtgggtaggatctttaacctctctgttcctcagtttccccacctgtcaagtagggatggtgacagtatctattttgctgggttgttgtgaggattttgctaagttctataaagttcttagagcagtgcctggcacatggtgtgttgatataaggaagatatgattccctttgactctgtgaatggcctgacacttgggttccacagaaggcaagagacagagctgcaattcgaacgctggactcaggactccctgtccagggctctctccctacagcatcaaggaatctccagcttggccaagggaacaaaaaagtcccaggactggcccaggctcagccccaaggcggaaagacagcctgtgaggaagactaaagggatgagagccacaggccagggaccaggccccagaccctgctccatcacctgcacctccctcctctgtgcctggcactcgcctacccggccccacccccagctccggaaggcccgggcactcctgtgggcactcaaggaccctgggaagctcctgggccccgaagcagctccctgtggccccaaggagcccagtgcccagtgatcctgggatgcagcaggtggagaacagcagggaacagcgtggtctcccggcaccaccttccaagtccctgggtactctgtccccagagacagccaggggtcctggccctggacccccacaccctacctttccccaagtcccagggagcccgcaggcaggaatcccagccagaatgggctcctgcctaaagtgctcagccaacagcgagaggagcccagatgtccacacttagccttggaagcagatcccctcaaaccagcccacccgtgccccagggcagcgtgccgggtcagaggagcttgattctgcagtcagacacttcagatctgaagtgggtgaaagtagaaaaagtgcaaacagcccaggcactcacaacagggaaatgtcctttcaagaaaagcccattccaaagtggattaggacccaggtcccgccgcacccctgagaagggtgctcagggtgcaatcaggggccgcaggagggtgcagggccagctgcgaggagaatccctcctgggtaagaacagatggtgtacgtgtgtttgtaggtaccaggaaacacgggtcagtgacagcctctggggaggaggccttgggaacaggcagtggcccattcctttctgctgtgcacgccgagagcatgtgccagttccccaggtataagggggtttgtatacttatgcattgttttacacatacatgctccaaaacccagcaaatgcacaaagatcacgagggcacacacatacacacacacctgcccttgtgtgcccagcttccatccagccagctctctcctgcggcctgagagacaggcggttgcggcaaacagacggggcagggccagagagatgggtgggcagacagagacaaagagacagggagagagagagaaacagaacgaatgagctcagctcaggccctagggtgatcctgctcagagcagccactttaggctggtccaggggctgcgggaagtgaaagtgcccaagaggaaagccggcaagtctccaccctcagcctggccactcactgcggtgtggccccgagccagcgcctcacctctctgggctgcagcctgcccacgagtgcgggcagtgggtgggagacctgctggctccgaccctccagcactccggggtcctggttccctgttgagcccccgcttcccctctccccagatggtgctgagggcagcgtccaggtcagctgccatctcagcccagccaggaactcactcccaaagcccctccctcccctgccatcagccccagcatcaaattggagagggacgagccgggcactgaccggaaaccgcaggcgtggatactgctgtcttcctgcctcatctcacctaatccccatcacagccctgatcccattctaccacacgaagcaaccgaggagcggaggatgatcgggccggagccccacggccagcgggggatgaatatgaatgagctgggatggaacccacgcgtctactccaaagcccatcggctccttccacgacatcctgttcggcaggcagtaggaggggccacaggggcagacacccccacatttcctgacctagcacccagaaccgggactccacaggccccagcctgtctccagcagcctcagaggtgactctagaagggcccctgaagcctgcctccctgctccgaccaccaggaaagccagcaagaagcccagtgctagcattcctgactgcacgccaggcgtagcaccaagtgcttcatagtgtcacccttgggtggtgggcactacttttattcctacttgacaggtgaggacactgaggcacacacaggcggggcaacttgtcatgggtagaattgggaactgacagctgggcccatgggcctgatcactgcatcgccccatcctgtagcctgggagtttttccactctgacctgcgaccaccaagccaaggagtgtctagcggggcagcaaaggcctcaccccagaagcgctgcttagatcaagggcccttgagccaccaccattggggcacctcagtgccaacccctctctgtagccggtctcttcccaggatgatgcttgggggtccctggagagcccccacctccatccttgagtcccagccctgggtgaggaggggaagcggagaaggtctgtgtgcccccacagacctcagacaatgtcctctgggacaggggctgtcctttgcctgaggtccagagggagtgtaggacaagcaagactcacacagcaagcggaggcaggaagggcaacatagcccttcatctctgcctcccagcttggcacagagggcaccctacctcctatgctgggtgggttgagctgtgacccagtgtggagacagggatggggctatgggttctcagtagcttctagcttctcacgcagcccctggcaaccctgtgggcctactgtgtgcagatactcctatctccaatcctatttcactccatcccctccaggagcctggcagtatccccatttcacagataagaaaactgagaccaggacatgtgaccactcaggcgtgggatctaactcacaaggtctcacttcccaccaccaaacaggccttcctgcagcccctgccccaatccaaccactcccagccctcagggactgcctcttccaaaaaaaaagtcttcccagagctcttggaacctccgctcagaggaccatctctcctccgacattcagaaagcagactgaggttgggcgcctcagtctgtacactcaggcctgtaatcccagcattttgggaggccgaggcaggtgtatcacttgaggtcaggagttcgagaccagcctggtcaacatggcgaaacctggtctctactaaaaataaaaatacaaaaattttctgggcattgtggcagtcgcctgtaatctcagctttctctccagcctgggcaaacaagcaaaactccgtctcaaaaaaaaaaaaaaaaaagaaagaaagaaaaggaaaaaagaaagaaagcaaactgaggccagcacacccacagtgcctccaccctcagactggggctcctgggaattgaggctctatctccctcagacagggcactcactccccttcccaaagactaagaggtcccaggactccctcctccagcacctccatccacacagccccctacctgattgcaggactctgccccaaggggccaagcaggaccccaggccacgcctcagcccctcctctcccttcttcctggcactcctccaggcctggccagtaccaggcaggctaccctcccaccaccgggccctgtccatgaatcccacctctgttgggcaccacagacccccctttctcctccccaaacaaatggggtcttgagcaaggcaccgggacaaccacgcacaaggccagatctattccctggactggcgcggctgccagcggggtgggtggtcaggcttgcggagctgtctgtcccttccacagcccctccaggtccagcctctggcattgggagcccggcactctaagctcatcctggcagggctgggaccagcagccttcctccccgggtgacccaggagtgggcctgggccaggcacccctaaccacgctccccacttcctcccctctcccttcccttgacacagtgtgggcggggacctctgagcataggtccaaatccctgctctgcaccctggaagagaatctctccaggcctctgtttggtcgtttgcaaccgggtgtgacactccctatgctgcaggggctgctgtggccacagacggggtgaggtacaggaagaaaatcccggcacagaagaggtgctcagtccaaactggtttttctctctccttcattccctcttctgccctagggggataagaggtggggctggcagaaatgggggtgagagggcacaggctggcagagtagaaaatgacctgtcccaggcacttaaaatgttgcctattccaaaatcaaagtctcaaatccctctacagctggcagtgaagtctcctaagactaggctggttaaggctcccaagaccccacagccagcctgggcaacacggtgagatcccgtctctacaaaaaaaaaaaagcttggcatggtggtatgtgcctgtagtcccagctactcaggaggctgagatgagtggatcacttgagtccaggtggtcaaggctgcaaggctgcagtgagccatgactgcaccactgcactccagtctgagtgacagagcaacagcctgtctaaaaaaaaaaaaaaaagatcccacagcccattaatggcaacactggggaggaggcctcagagctaagcctgcaaatctaagctcaaagcccactgcctcctagaagccagcccagatattatccccattttacagacaagtaaactgaggtacacagtagttaggtaatatgcctgaggtcacacagctagcgagcatctggattgatttcttttgacaattcaggctgctaccaaaagctgttcgttatggcacaagccccccctaagaatctgtgattttgactcggcatccagagtcaggtccaagttcttcagcctgaaacgcaaggcctcccagcaaggtggtatacagcagcagaagacagcactggacctcgagtcaaatgcccggcgtgccactcacagcctgctgtgtacccacggcaccttacccggcctccctggcctcactgtcctcttgtataaaatgggaataacgagactgacctcccagggtggctggtggggttacctatccatgcagtcacacaaatttattgaacctctactatgtgccaggccccattcaaggtacttgagatagagcagagaacaagacaaaaaaaaagctgtcttcagggagttgatactctacagtggtgggagggcagagagtaagcaagcaaataaaacagcatcaagttgtgttaagggctttaagaaaccagagggaggaggccaagggcaaaggatagggtgctcgggaggacttccctgaggaggtgacagttaaccagaacaggagacagacatgcactgagccaggagagcagcagtgagcacagaaggaacagcaaggtcaaaggccagtgaatcaaatgagagctggagcctatgggaaaatgcctggcacatagcagatgctcaataaacagcagctgtgagcattattactctaagccccccaaaccccttgctccttgccttcctcttctggaaaccaggttgcgatgcagcttgaagtgcatcctaggtctcttccacattccttcattcatttaaagtaaccctgcttccattaatagtcctcccattttgcaggtgagaaaactgaggttaccaagatcccatagcccataaatgacagcatcgggacatgaacctaagtctagtggtctcaaaccccacactcctggcagccttgggcggtctcacttacaaagggcactcactacattcccccttcccatcccaagacagctcagcctgtcagaacgtctctaggatgaaccaaggtctgagcctgccctttgaggccacccaggacagccctctctcttccttcccaggtcaccctgaaatgttagcagctgccacctggagcacctcccagtgccaagccctgtgccttactttgtcccttggccttgctctggcaaggtgaagtagggattcttatcatccccattgtacaggtgaagaaactgaggcccagaaaggtggagaaacatgcccaacggcagcttccaggaaagtggcagtgttgggatctcagctcaggccctcatcacctgaaagacagttacccgtcacttcccaggcctctcaaatggccctctttggccatcactctcagtcctcccttgcctggcctgtccccctggtgatgccaaaatggtagacaggacagtcttcccctgactcggttattctcagggcaccaccagccacatgcctggcatgcggtgccctaggccagggctggctgagcagctcagagcacccaagtcccatgaaggagaccagtggccaggggctcaggcaacggctgtggggacagggctcgcctgatgaaagtgcacacacaggccctggggcaggcaggagaggagcaccagagagggagcctgccacacctgctccatcctggctcagccaccagggtactatgtgcctgtcagaaggctctctgcctctccggccccgttcctgttaccaccaactcaggaccgtactcccaccactaagggtcatggggaaaggtacgatgccacagaactctagtgagatctggcttccctacgcgtgtcaggaaatcattttaaaacgatttttaaaagtaatgatggtgggccaggcgcggtggctcacgcctgtaatcccagcactttgggaggctgaggcgggtggatcacaaggtcaggagatcaaaaccatcctggctaacaccgtgaaactccatctctactaaaaatacaaaaaattagccaggcgtggtggcacgcgcctatagtcccagctactcaaggaggctgaagcaggagaatcgcttgaacccgggagacggaggttgcagtgagcagagatagtgccactgcactccagcctgggtgacagagcgagactccgtctcaaaaaaaaataataataatgatgatggtggtggtggttcccagtcactgagagtctattacataccaggagccatcacatccatgagcccaaataacagccaccctgggaggcatgtgcctcatctccattttacagagggggaaactgaggccagaggtcctccaccataaaaaccagagccaggttgcaaacccagaactcgctgctctcctgtgcagcttcctgtttttagtaattgaatgaaatgctgcttcaggagaacccctggggactggggggagagagaggactcaacggtgtcagagagacaggctcccccagggaaggagttaggcctgctgagtccggcactcagggagggagatgctccccagaacgtgcctgctgggtgaccttgggcaagtcacttcccgtctgattcctcaaaggcaggtaccaatgctggtcccccagagaacggcactgggtcaacaggtcctcagcaaacatgacggatggggacaaagtcacttgggggcaagaaaggagcatgtgcccagatgagagacttatgagatcagaggccctggggagcgagagggctcaaggaggcagaggtgggaagatcatgaccacagaagtgggagggaagggctgggtggaggcactgggaggaagcaagcgctggtgcagcagggtctccggtctgtccacaggggcaggcaggataagtgcagacccgcccactgtgcctcactccccagccctccaccaccaagaacccccacttcagcctgtgacagcaacaccaagtcccctgcagcagcccttcccccaccacacctcctccgtcctccggggcgcacccaccaccctgcacaagcccccttcagggcacccatcactacccctttcctggggacctccaacacctggacagccacagcccctccacgtggggaccaccgcaccttggagatagcatctccctatccttagcaaccaccaacactgtgcgcagccagccagcctcctttctctgtctcctcctctctccacggagaccacaatgccacagaggcggctccctcaccacggcaaccaccgtcactcagcgccgcctggacaacagctccctccacgtggccgccaccaacacagcctcggtgacagccccagcctctcctctcctctcctctccagggcagccaccagccccagccaggacggagcagctccttctgcctgcctgtctgcctgtttgcggcctcctagtgccagacggctctccctgtgcctccaaaattcaatgacataggatcaggccccatatcaattctgctggcgttttcccctgctcccggctcacttccagcctctctctctacaatggacagacccccacctgagcgagacccccaccatgttgtcccaggccttcccctggaagctggctctccacccccagcaggtgcacagatgccccctgacctgctggagtgcagactaagcctgcctcagcctctctgccgggtgatggggcaggagctggggtccttgagccaacaggggcttcctgcccaccctccccagtgggcttgtcttagcccccaacaggcctgccgctctgcaggccgcctcataggccctgtggaaggaaagctgggtgggaggggtgcccacggctgggggcaggggccaggcccacaagaaggaacacacagaagcctgaggctgggccacatcacaggtttgcaaggccgggtcatgtgagctatgctcacagacagcgacacacacacaggcaaaaggaccctgtccttaccagatgtctgcagcagaggaggcccctccggcactgtccccaacctgggtctcagaaaggttccccaggcagcagcggcagcagtagcaatgagatctcaggtcctggcccagcccgggtggcagcagctcctcacccaagtcctctccttctgcagggaggcgagggggagagaggggagggagggagagaaggggaggagagggaggggggacagcaggagggagggaggagggaaaaatgctgaagtcttgaagggtacactcacttctttcttgggtttcccatggcaaccgaatataccacaaatgaatatcagggtgagacagagaggaggtaaagggagaggaggaatggagggagatggaagagagatggagaaagacagagatagagagatgggggagacagggcagggagagatggagagatgcagagagagatggaggcagagatgtgaaggcactgagatggagagatggggcagggagaggagaagagatggaggtagagacagaaggatgatgaggcaggagagatggagggctgaggcttccaatcgtaacccatggggctcaggggccagggaagaggccaggggccacagggcttctttcaagcccctgggcaggaggagcaggcacagatgagtgagctttctgggaaccaaggggcccccactcccaccccttcaccttgtcccacactccctactgggctccacagcctggaggtgtctccccagtcacaccccagtcacagccatggtcacacatgtcacacccacgtgtgtgtgcacacacactctcacactcccctgacccccagtgcccccacacagccctcaccccctccatggccaactaccctcctctcctgttggtcactcggatcaccaacgccgcccaaccccatcgtcagccgggccccagggaacaaagacaccctcgccctcggcacaccctctcctcttcagaactctgccaggactggcacacgccttcccctatgtgctcagcctgttcccagccaggtgtaatgcctctaccccaccttcccgccacatgggctcacacacagcctaagagcacagtacctggctgacctccacctgcgcagacaggcgctcccagacagacgggcctcggcggaacctcgtctccatctgcgcaaacacgtgcgcacacacactcagctcctcccgaggaggcccctctccctgtcccgccccgcaccccaccagcccagatggtactcttggccctcccccgcaggcaggggctcacacctcggccccctcggcattgccattcacaaacatatgtagacccaccaagtgctggcagccagcggcgcccaacggaaaataaacacacactcgggcctcccttcccctctccccgccacactgcctcaactccctcaccccctcccaaaggcagagaactagcagggccggcttcctccaggaaaggctcccaggcctagctgggagcacacaattgaccctcagcccctcagccagcagggatgggaaagcaccccagaggcacacactataccctaacacacacacacacacatagacctgtcctcccagagcacacccagacagaatccacacaggagaacttcccaccgccgcagagaaacgcacatcacagacccagagactcgtgggcctagagaccaaggtgcactgcacacagctgaaccagaacacaggggcgccccacacagacaccctccccaacacgcaggcccacgctggtgccaaaatgcatgcggccactgcacagacgcacaaaccaggggcaccgtggactgccccgccccacgctcaccaaacacacccagaaaaacgtgcccagggacacggggcccccaacatagacacacgccaaaacatacatgccccaagcatgcccacacacagggaaccactcccggacacacgtgccaatgcacatgagccaacacacccccagcacagccacgcctgcacgccacagcgctcccagggcagttcacgcggcgcgtccccatgccgtccacacccacccggcacacacaccccctcgccagcaactcgccgggtcctggctccggtcgccccctgtgcccctgcccagcgcggcccgccccgccgccagcccccgcccctgccggtcgctttccgatcccgggcaccgcgcagagcccagaggctgcgaaattggctgcgagcgtcaggggctgcggctgcaaattctaaacacaggcaagtaaggaggaaagccgggccagccgggcgcaagttccggaggctggcggggtgggccgcgggggacgggggcctcgaagagccgcggacggcggaggacggtgcggaggtggggagcgcggcgaggtcgggggggagcagggtggcggtgcggccccggcggggctccgagcgcgcgctcccgtccccaccacgccaggtccgcggcagttcccgcccgccccctcctccggcccagcagccatcgcgcacccgccccgtgcgcccccaggacggacaatcccagccggcctccagacccaggtctgcctccgccaagtggatggaccatatcgagccaccgctacgcggctgtgcgtcggtcgcctcctccaggacgtcttctctgctctccgccctcttcgccgcttctctgccctcacctccacctccgcctctggcctctgctcacatgcacagccgcaaactcagctccaccagcgccctcgctccacaggaagggagagggagggcattcgccctgtgcaaggtgctggggcaggcccgctccaattccacttcatcccgaccacactttaggctgctaacgtgcctagctttagcagctgtgcagcctcgaacccgtgaccgcacacgctgcctccgattcctcatctgtgcaacaggaatgatgcagaggggcgttctgaggatttaatgagggactccttaaacaggcttacagcagcagtcaacgaaacggaagatgattagccagtattattagtcagttttggcccctgacttgctgctgtggcgcggaaggttaggcacttctctgagctcaagctcctcctctggaaaatgaggatggctttgctggctccagagggttctgggaggagtctcagagaccccggggaacatgcagctgccatccaaccagcaaatgtgagtgaattaatcttcgggaaagcattaaaattgcaagttcctgcaattttcccctcgtccactctcccaatcaaaatctcagtggacagggcccaagaatctgcattttaacgaacacccagagattctaatgctccctgacaaaaaggatattactcaatttcttggcgcagcatggatggtcccgtgtggttgttcctcaaactacatgtccagactcatcttctcaaaatccactctgggcttccccacctccgggcccctgctcacacggtcactccatatggcatgcccccacccaggggtaggcaggacctctttcacaatcctccagccaaagttaaacaagataacagagagcgccttgcccgatgcctggcacatagcaggtgcataatcgagagaattctgcaaagcccagagcagaagttggcacaaactctccagccctgcctgggaggctcgctccacacctggcctccagcctgcagcagcaaccccctctcggtcaggtcacaaagggacaagaatcacctgtcaagcaagccctactgtgtgcagaccccatgctgggcacttgtcagaggttcccgtgtctcacctctcctccagggccctgagctctgccaggcaggggctcctctctgggggttcctgcctgagccccggggcccagcatttctccctgggtgaaacatgctaataagggtgtgtgtgcacgcgccatctgaatgcaaaatgcagcgatccgtcctcggtagcatgtagatgaaaggaatttgtttaataagtattttttgagggcctaccagtctccgcctgcacagagctgacatgaagtgggagaaataagacaggcaataggcagatgtaggaaatccactggggaatgagaagggccaggaagggagtgaggcaggtcggctgaccccacagcctctgtctctccaagattcaggggcaattgtagggggagaaggataatagatgggccaaggagggaaactgagtcaggcctgagtcttgggactaggcccacggcaggctggtcaggcagccttgggattcattccctacttccccctgagagaggtggtgaccagtgtatacaaacagtcacaagagctggcagcacccaggctcttttcatgcatccttaggcgcccccaaccccagcagtacccatgcacttcaggcggtgaaaagcagagggtgaaaaggatgggaaagaaacacacacatgcatgcacagtgcagaccccttccaggaagccaggaatgaacggagggggcagatgggaagggggaggaaaataatggcatctctcatgccagacaggatgttatacacgtggtcttctcttacctaacctttagcatgacctttaagacaacccagaagggttaagaatttgttttttttgttttttggttgttttattgttgctgttgttgttctggccaggcacggtggctcacgcctgcaatcccagcactttgggaggctaaggagggaggatcacgaggtcaggagttcgagaccagcctaaccaacatagtgaaacctcgtctctactaaaaatacaaaaattagccgggtgtggtggtgtgtgcctgtaatcccagctactggggaagttttttttgagacggagcctcactctgtcacccaggctggagtgcagtagcacaatctcggctcactgcaacctgggcctcctgggttcaagcgattctcctgcctcaacctcctgagtagctgggattacaggcatgcaccacgatgcccgaataattttttgtatttttagtagagacagggtttcaccatgttggccaggctggtctcgaactcctgacctcaggtgatccttctgcctcggcctcccaaagtgctaggattacaggtgtgagccaccacgcccaaccaagaattcggtacttttgtccccacttcatattgaggaaactgggcctcggggggggggggggaagtgacttgcccaggacccacaccgaggaggaaaagaggttggatttggagccctgcccctgccctttccacaagcaagatggccaggtggggagtccagggggccacagctgaggccacgatagactcgggacctgaagaagatactgatcctggggcaacctccccactgtcacccgggggagccctccaagcgctgctgttcgaggcactgtgggagggccagggagcaaagggctgcctttgggggtgtcccatctctgtggggaatgggatggggggttgagatgcaggcaccacccacgaggcccctcctttcctgtctctccttgcagccaaagcaaagggcgtccgccacccccagcttccctagggcagggtcactgcacccatttacagataagcaaagcaaggcccagaaagggccttcagtgagaggggtaggccaagatgtagaggcctccaggcccatctggcaaaggagttcagcagccaatggtgctgatgtgagagtttcccttcgagggttccagtcctggttccatcgctgtgtggccctggactggtctgtaacctctctgtttcttgtcttcaaaatgaggaataataatagtgcctgctgcagctggcttttgtgggactaaacgaatgccgcccataaagagcttcgaaccgggcctggctctcagtaggggctcaataatattagctgatatcattattattattatcactatagttattactatttcaatcagcagcatcgtgcagccagcacccttcctctggcaccccaggcataagcaagcctgcccaggtggctcttgagtcctcagggcttctctggggctttcctggggactgtcggcagagctagggggaaggagagggggctcaattattccaacccccagacaccatctccagtaataatgtcaatgcctctgccccaggtggtaattgagccaagagaaggttaatttaatcatggattgggctgggacggcaggaggcagaggactgggtaaaccttctagacgattaacacagctcctgaagaggtctaacttgctaagaagcgtcaggtttcgaggcaatcctacttctcggccatccactccacacagcacatgtcacaacatggggcaggtgggggcaccgagagaggagcttggcccccaggcactgtggccggagcaggtgagggtagcagcaatgtgtgcctcccagccctgcacacggttgtcaccctttcacactcacacatcacacccgcaagggaagctgccaccaccctcttacagagacaggagaggctgacctctgtcacacacagccaggatgcagatgcggcaggggtgtcactggaacccaattctgctgccaaaaacaagcatcctacaagacctcaggggatattgaggaacaggcatggagcccccagtgaccgccctagacacgccccactggagaaggcttgctgagtgtgcccgttcctatcacgctgactgtttctggagcttgtgggtggaagagcaagagagcactgacctgggagtcaagagcagcctctcctccagccagagactcttggccttgggctcatcacctggcaccccaccaccaattcctcatagctccatatctctccaggaaaggaaggtacccctcgagaaggggctgggtaatcaaatgtgtctccctgtagccactgagggcggcgggggggggatggaattcacattaaatcaacagacagcttattccagaactcagtttactcatctgtcaaatatccacataatagtggctaacttacccacctcaaagaactgccgtggaaatccaaggaaagaaaagaaagtcctttgcaaagttagacttaaaccaaaacaggaaagcagctactctgggctagggggataggaggtgagaggacagagctcacgtggactgagcccccaccatatgccaggcatcagcacccgccccccacaaggcccatggtctccttaacccccttcacctctctaacccctcaccccatgttacagaggagagactgaggctcagagaggcgacgcgaatgcttaaatcacaaaacacagaaagcagcaaaatgggattcgaaccaatggcctcacgctccctggctatggccattttctattgtcacatgcactgacacactcactcattaaagcacatccacccaggggtggtgggcctggctgggatgaagaggaaaacagggactggggaggtcagatagggggctgcagcacattggaggcctccaggcccacctggcaaaggagttcagcagccaatggtgctgatgtgagaacctccttcgggggttccagtcctggaaggtgcactcttcagggggcaggacttaaggaaaggggtcccatgcccactcaggatgctgggaaaggcggcctcttgggagggaccacgccacgcgtcctaaggctccatccctctccccttcccacccctcatatacaagagacataaccacactcggccacacacactcccgtgacatcacatttacacactctggctggggggagcaacctccgacaaaactgtcccagtgacgtcacctgcggcctggagcttatgtcacacctgaggttctcactgacctcacatacatactttttcctgatgtccccacaattaacactctttcttcctgcctaggcgttgatggcccagaggtacccacctccccacccacacagttgcagggcccccggctcatcaggacagcacctgcctgtgcacccctctcaggggacacacatgcccacatgctttgctgatggcccagacgtgacacgtcccacaggtgtccacgggccacgagaacaggggtgtcagccatgcacatacacatacacacacacacacacacacacacacacacacacactcccagtcccatctcatgatgcaacttgcatattaaaacgcctctcggtaaccgcgccgggcagtccgcgccccacagcttccaccacattcctccaggtgctgccagcacccccctccctccagctttctgactccgacagcctggcctgctgatagcgacagccgcagcccagacacacacacacactccagcccaacacctgcgtctcagcaagggaccaaggcagtgccctccagccgcagctgctgggtgggaggagtccagggggaaggggcatagcacagagccctgagctgcagaaagtgccgagtaccacgttcctccccagctgagtgcacggtcagcaccactgtccccttctcgtctccctccttgggcacgcctgacacaccatggcctgtggcctctgttttggacacaagctccccgagtgtgcatgcacacgcgcgcgcgcgcacacacacacacacatcagctcccttccctccaaacattccgaggaaatcctgccaggccactgacagtgtgcgtgtgtgcgcttgtgtgtgtacagacagagagcagggtccaccccatgtccacacacacacgcacacaccacacacacacagcacgcacaatcctctccacatgcacacggcgccccaccagccaacacacccaccccctccccgtcccctgacagctgctggagcccacacacgcacgcacacacacacactggcacgcgctcgcacacacacacaaacacacacacacacacccggcagtggccccggccctgccagagctgcagtgtctgcgatttatgccgcctccctgggctgcctccctccttgtccctggccagcgcctctgaaagggtccccaccccccaattctggtcttaccaaccccaccgccgtcaagccccaccctggccccccttcccctagaaggcatccaccccgtcaacccctcttaccagctagaggatgaatgccttgacccggcagcaccccgtgaaagagaggggttagggcccccgattcgaaaagatgagggcagagaggtgcagtgtggcaccggctggcacaccgtccaccatcgagcctctgcaccacccccagaaacgctcacctcaccgaccgtcctcggtgtcctcccaccgcctccgcccaccgccaccaccaccacctccctcgcgcagggtggtcccccgggggtctcacggggatccccagacccaggagacactgggggtggctctccccgtctcatccccccttccgtgtccctctccaagccccacccccactgacggagggggtgccctccggctccagccccgactcccaccgtctccccggtcggtcgcggcgctcggatccagaggaattcacttaccccagccccagccgggatccgggccaagcaccgcctccgggaagcggcggccgcggggcctgcgcgtgtgagtgtgagtgtgaatgtgagtgtgagcgcgggtgtgggtgcggggtgcgtggccgtggggtggcccgcgtgtgtctgtgtgtgtgtctgggagcgcgcgtgtgcgcgcagacgccgccgccccctcctccccgccgccgcgcctctgcccctgcctcggcggggagggcgcccgggaggggccaaacggcgcgcgtcagggaccgcggcaggctgtgtccgtctgtccgtccccgtctgtccgtccgccagcccgcccgctcccggtgccctccgcaggcctttccgcagcaagcccgctcccgcccccgagccggccgcacgctccacggacacacgcgcgctcgcagacacacgcccgcggggctggggccgcgcctggcgccgccgctgcagctgcagcgcccggggaggcgaaggcggccccacggacccgagccccggcctggcggacccctgtcccggccgcggccccctgcgctgctcaccccgcgggatccgggtccgggtccgggtccggcctccgccagcgcattcaacagctgggggcaaacttgcggcggggccgcccgaagtgcgcctggactcgccctccccctggactccgcctccgctgatgggccccctctccgccttgtacctccatgccctgccgcctgcgccctgctggttggtcccgcgttcaaccgctggcgactggggaagtgcggctgctgcgttcccattttacaggccagacaactgaggttcggagaggagtgattcccccaaggttacacagggagcctacagacagtattagactttacgctcccctaccttgtgccagggcactcactgcctttccccacccctccaggagtaactccaagggatactgggctcatctgtagctagagaaccttcattaggcttccagaggcccagttccccgccccttacgccaaagcccctgccacctgctgccacctgcaaaggggtggatgctgggaggaggaggaggaggtggaagatgcaagaagcctggcacccggggcctataacttggtgcttgggcatgcaagcacctcctcccgaggccctgcgagctgcatgtcggaggcctgctgccagcaggccctgtacttctccatcacttttataggaccgcatgcaccagcgcctgttctcaggtgttgcacagcagatgaagtccaggctgcgggaactccccgtcgggacatctcatgcaggtctggaataaggagactccccagaagaagccactgcctgagctgaatcttgatggatgagtaggagttggccagctaaagaaggagaagggtgtcctggactctgggaacagcatgtgcaaagaggcacagaggcatgaaacagctttgtatgtgtgtacagggaactccacggagttgggtattagtagagcagaaagaacgtctgtccagaaattcctccctcctttcaactaagaacagggaacggcccaggatggggctgggagggcagacaagcactgggtcacaggccacttgttgtcctggggtatgcagaaggactattgggcgttccccacctgcaccccaggctgcctggcacactcctacccatccttcaaggtccctcgctgcaaacccaaacaagccatgtgctgtctctgccctctaaactgagccctcctacagggcaggggcggtatccaacacatggtgtgtatccctgacaaggctgggcaagaagcagggtcccagctccaagaccttgctggaagagcccctcaggcggaacataacggcctctgcgccctctggcggatccctcgagaaattagagtgctccccaagccaacagcccccctgtggctctcaggcccagacactttctgagatgggcactggcagatgccacctaatccgctcctgcccaagaaactgagcagtgatgaccccaaagaataccagggagtcagtggcaaaacagcctcttgctgctctgtttccgagacattcccagtcatcttccagagtgcaagtcacaaccctctctgagcctgtttcctcctttgtgaaagaaatatagcaaaagcagccagtacccccagcacagtgccggccactcccttctccctggagacctccaggtctggctggatttggtcagaatttgtttgaagctctaaaacggtctaagaatctccctttggagactttgcccttactgggcagatgtacattgacaagagtttcagctcttagctgactttctgccaccatatagaagatagagttggcctggcctgagggtcatagtggaccacaccatctagacactcgactgggctttctctagaccatagtggaaaggatacatgtctgcactgtcaaagacagtagccactaactgcatgtggctattgagtgattggaattgtggctaatgtggctgaggaactaaatttttaattttaattgttattactttaaatttaaatagccataatgtggcttgtggctgccatgtgagatagtgcagctccagacatatagcaagctccttattaaaatcaagcccaggcagacctaatgcacacacacaaacacacagacacacacacagggaaccctgaggacctgggaatgcggggagcggggagctcaggagactgcctagaatccgtagctgaatggttaagaccgagacaaacgtaagcaataacatgtccattcccacagtcactgccccagaccaggcttgccgtcacctggatacctgcaacaaactccctcaccacccatctgtttaaaccctccagtagctccccagagcccatgcacagaggcaaatatgttctctttctcatgacaagtgattggcagcagctgcctagaggtgctcaccctttgcagaaaatggcatgatcaattggtgatgtctgcctcaggaataaatacagagatgaatggtaagccctctctgctacaggataaaatccaaacactatttatttatttatttattttagagacagtgcctctctctgtcacccaggctggagtgcagtggtgcaatctccactcacagtggtg

SEQ ID NO: 318 - DNA, 605631 bp, Homo sapiens
tcccattcacaattacttcaaagagaatgaaatacctaggaatccaacttacaagggacgtgaaggacctcttcaaggagaactacaaaccactgctcaatgaaataaaaggatacaaacaaatggaagaacattccatgctcatgggtaggaagaatcgatatcatgaaaatggccatactgcccaaggtaatttatagattcaatgccatccccatcaagctaccaattactttcttcatagaattggaaaaaactactttaaagttcttctggaaccaaaaaatagcccacgttgccaagtcaatcctaagccaaaagaacaaagctggaggcatcacgctacctgacttcaaactatactacaaggctacagtaacctaaacagcatggtactggtaccaaaacagagatatagaccaatggaacagaacagagccctcagaaataatgctgcatatctataaccatctgatctttgacaaacctgacaaaaacaagcaatggggaaaggattccctatttaataaatggtactgggaaaactgactagccatatgtagaaagctgaaactggatcccttccttacaccttatacaaaaattaattcaaggtggattaaagacttaaatgttagacctaaaacgataaaaaaccctagaagaaaacctaggcaataccattcaggacataggcatgggcaaggacttcctgtctaaaacaccaaaagcaatggcaacaaaagcaaaaattgacaaatgggatctaattaaacgaaagagcttctccacagcaaaagaaactaccatcagagtgaacaggcaacctacagaatgggagaaaatttttgcaatctactcatctgacaaagggctaatatccagaatctacaaagaactcaaacaaatttacagaaaaaaacagccccatcaaaaactgggcaaaggatatgaacagacacttctcaaaagaagacatttatgcagccaaaagacacatgaaaaaatgctcatcatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtggcactgtaaactagttcaaccattgtggaagtcagtgtggcaattcctcagggatcttcaactagaaataccatttgacccaagaatctcattactgggtatatacccaaaggattataaatcatgctgctataaagacacatgcacacgtatgtttattgtggcactattcacaatagcaaagacttggaaccaacccaaatgttggaaaatgatagactggattaagaaaatgtggcaccatggaatactatgcagccataaaaaatgatgagttcacgtcctttgtaaggacatggatgaagctggaaaccatcattctcagcaaactatcgcaaggacaaaaacccgagcaccgcatgttctcactcataggtgggaattgaacaatgaaaacacgtggacacaggaaggggaacatcacacaccaggacctgttgtggggtggggggaggggggagggatagcattaacatgttaaatgacgagttaaggggtgcagcacaccaacatggcacatgtatacatatgtaactaaactgcacattgtgcacatgtaccctaaaacttaaattaaaaaaaaaagattttcactttatcttgtattttcagcagtttgattgtgatatgtttaactttgaatctgttgtgctcactcctgcttaagtttggtggaacttcttgaaaatgaaaatttatgtgttttaagcatatttggtgtttttgtcaatgtttctttgtataatttgtaagtcctaatcttttcttcttatccccctggaaattcagacatgtgcttattagacaaattgatatcatagttgattaaatccctatccatatatttcctcaattattttctttttccttaagataggattagttacatttgtgtgcctttaacttcattcttcagtactcattcttcagtattcaagctgtgcatttttaatttcatatatcgtactctccagttctagaattttcatttgtttctttttttctagtttcaatttctcaatggtctttgtctgctaatttaaaactccatgttcctttgggttctattgtcattaactgtttttttgttgattatgagtacaatccatacttcatgtgtctaatactttgattgcatgcttgacattgtgctggctacactctggagatttgaatataccactgtcttttaatgaatgttgaattctcttctgtaggcagttaaaatactgaaactttttttgtgttgtcagactttaaaaataaatcttttcatggtaagtctatatcatttgtgagcttagttctaagatacagctgttacactaaagcatagctcttattctaaaagtctgcattatctctttttagtctcagccaaatgtttgaggtgtttgcaaagtgttcttgaggctactgtactcgggctaaatgagaattacagtatttcatagtagtggaaaaactctggtaccgctactctactctcagcctcactgcaaccacaggttgaccaaactgtgcctttcagtgtctttctctctgtttgtacagtacagtcttcggccagagactcatagtgaacccccgtgcatgtgtttgtggggtttctggaaagtttcttcttctctgttacattttcccacaaatcctgggcactctagcagttcaaacttcagacttctgcctcctcagctcaggaagactattgtttgctttggactttaccttctagtaccatggtagtcaataacggtcctctttagaaagctggtatgagcatgagtttttttcttttttttttttccccatgaccctgttatttttattcccgaattttttaaaacagtcaccattttttttcaaaatttttgtttatagaaagaggcagatctggtactaactgtttttattcatgctcagaaacagaaattgtattattaattatatttggagctgaatataatggtggataagaggtggtctttgaaaatcgtatgtataatgtcaggtatagtgagcaagaagaagctatgcactaaaaattttggtttagttgtggtcctataatgataaataattatagaagaaggactaaattgggtcctaaatttttgtgccaagagattcactgagatacagacaaacatatgtggcaaagggaagcctacacttaatcccagaaaataaagagatgttattaattttagaagttaggtggaatttaactgatccagtgaaagaatcagttggacaggtcagattcctttgtaaatatactggaaaatatgaaaatactaaaaagggaaaaagaaaggctggaaaacacaggcataaaaggattcactgaaatttcaataccctggtggattcccagtatgattgttctgtgacagcagatttacgatgtatctccctgcctctggacaaaaaggacaatttatatgaaatgtcaagaatacggcaaatccatacagatattactatgttcgtctctttctttttccaagtgaatagacccagtccaagaatacctgacacatggtgatgttagcaaagaaagaacatggaactctttccccagcaatatgtatttaaaaaaagagatcctttagcctatatttcttcctaaaaaattcccgttccagagctcttacataaacttctaaccgttgtgtaaaccagcagcattacttacaaagaaggtggtagggaatttaatgggtcaaagtcattcaatggagatggctgagctcaaaacacttagtgattgccctgttattagctacctccatgagatcacatttttagatttcatgtatgagttagcacatgttatatttgtccttctgtgcctggcttattttacttaacatagtgttctccagtttcatctatgttacagaaaatgaaaagattgtattcatttttattgctgaatgtgtgtgtatcacatttattttatgcattcatcttttgattgacctttagtttgattccatatcttggctattgtgaacagtgcagcagtaaaatggagttgcagacatcccttctttgggaagatatggatggaaaaagggttgattaacgtatgtaaaaatacagttaaatggaagggataagttaaagtattcaacagtacaatagagaaactatagttaacaataatttatttcatgtttcaaaatagctggaagagaagatctggaatctccccaacacaaagaaatgataaatgtttgaggtgatggatatcctaatcatcctgatttgattattacacattacatgcttatatcaaaataccacatttatcccataaatatgtacagctattatgtattaataaaaaataaaaaattaaaaaactggaagatattgtgtttaactttttctatttttgtatgaagcacagttactagtattagcctatatttcttttttttcttttaggaggcagctggcttttaaataatgaataattggccttatgagaagaaacttccttgtaaatagtttaaactagcaatgagcaaacagtgaatatgaaaaaaggaaacaaatttttaataaaccatgtaaattgtcattttttctgttcttattctttaatgcccagatctacaggtatatgaataaaattaataattatcctaggaaatatataaataagagtataattttatatactacccttactatctttagtgcaaagaaaagtaagaaatatttatagtgtggtggaaaacataaaaatttatttacaatataatattatcagtgcaactcaaggcaatctaccacaggtcatgaaattcagaaaagaaagatctcaccaagtttgcggtggcagatggactcaataaatcattctagaaagaagtgatgtccttgatgagtcttaaatgattaaagtaaatatctgagtacactaagacaatacttcataaagaaggaataacatgaaaaattataaagtctcattaagggaaacttccattaatgtatttacagtgcaacatgaaagttaaacagagaaaaaaaggaggcatgtattggttttcttatttgagagtaattttctaggagatttaagattataacgatatttgcagtttagatagattatacaaggggaatagttttgaggaaaatccatcttaaagtaaaaagtacactccgaatcaagagatggttacctctaattaaagcccagatgacaggtgtcatatagaggtgggacaattgttataaataaatacttaggaagtgaaatctctagggcttggtgattgactatatgtgggagaaggtggaggtaaaagcaatagacaactctcaggtttaaacttgggtgactgagttgatggaagtataaggagatataccgaagaagggtcagacagaggaagaatgagtaagtgttcaatgtgattgaatttgactttgaggtattcatatagaacccaggtaaagtctcagcgaggaagtctaggctggggtaaattttaagatccataccatagtgaagattgtaaaaaccataaaaaataataagttcaacttgggaagaaaatatagaattttaaaagaggaggatcaaggatgaaacactaggggacatgagagtttagaatatgagggcagaaaacagaacagaaataagaaaaaatgtattactgtgtgaagaatgaaataagaggggcattaaattgtggaaacataacctttctaacaaatattgctaggagaacttgatacccacatgcaaacaatggagctgagcccctccttcacaaatacacaaaagttggattcacagacctatctttaagatctaaaacaataaaaatcttagaagaaaacaaaggcatacatattcataacctagtgtgaggcaaagctgtcttagatacaacctcaggagtataatcataacattcaaagtaggtgaattgaactttatcaaaattaaaaatatttgtggtgcaaatgacaccaacaggaaagtgaaaagaaaatccatggattaggaaacatttgcaaatcacatatctaagggggatttgtacccattatatagacagaactcttactaggcaaaaataaaactcaaaaattaattgaaaaaataatttaataaatgtatcttcaaaaatgtgtatgaatagctagtacgcacatgaaaatatgttgatagtgattatcagataaatgcctataaaaatgagataagacttcacatcagctaagatggctataataataaaaggatagataaataattgcaactaacaagtttaaggttgtaaagaaatcgataccttcatatattactaatgaaaatgtaaaatggtgcagctatcttgaacaagagtttggcagtttctcaaaatgttaaatgtagagttaccatatgatccaggaattccacttctaggtatatatccaagagaactgaaaacagatgttcacacagaaacttttatgtgaatgatcatagcagagtttttcataatagcgaaagtatgaaaacaaccataatatccattaactgatggatggataaacaaaatgtggtatacccttacaatggaatattattcagcaataaaaagaaattaagtaacgatatatgctataatacagatgaactttaaaacatgaatgtgaaagagagtagttatatgaaaccagatacagtatgatttaatttatatgaaatgtcaagatttgggtcaatccataaagagagaaattagattggtgtctgtgggggttcaggagaagggataaagtggggaccagtgagtgattactcgtaggtacaggatttcttctgggcatgatgaaaatgttctggaattatataacgatgatgatttcataatcttatggatgtgtataaaagcactaaattacacactttaaaatggtgaagttcttagtacctgaattaaatctcaataaagctgtttttaaaacagcttctatatctcctaatcctagcactttatagagactcagcacaactgcttgggttttcttgatgttctttttcagacttgggtacagttaccacaaacaatgcttgctgactccagtgttaggactcagcataggataagtagtttaagataagtgaattgctatctgtactaatgtatctttaaaattcatctaccaattctccaaagccacaaaatttattctgaatttaggtttttatgtgacaatgtggacagaatgtcatgggtgatggagattcctggttttgtaattttcctagaagaaaagacttctgctgagagacacatctgtacttgaattcaaaataatacttcaattctctacatctgtgggagtttccagaatcttacttatacctttcaagatgtactcccctactatgttgctctcatgcccttccaagttagatgtcttttggagagatttttttttttttctttttggcttgcagtaaatgcacaaaggccaacaaactttgtggttctttatagatatccaatatagatacagtgtaaagaaagttcattctgacttttttattcattgatattagataatttggttgttgttttatgttatatgtctagttgaaagtaaaaaaaacttaggttggggaaagttttttcttacatgtgtataatgtttttctctcaaataagcatacattttgaagtaatgcagactgaatttgaatgccatcgccactatataagtctctgagtgaccttgagcaagttacttaactactctgaaactgtcaccttaactggaaaagagaaaaatactagaaataactaccacatttggtttctatgattaggacgtaagataatggatgcaaagttgttatataaaaaatgtattctacaaatatgagtgttatttcctggtgcacacattaaaaaaattgccaagtagccttatgtctttgttgagtatacaactcaagtaatctccttcaaagtgagcagggaatctatgttagaaaaccctggcaggagcaaaccagagtttttattttacttggaatcagagttctgttttagaaaagtgtggtgtcgtttttttctcttaaatgatatgcaattcacatgttagtttatttgtatatgcctacttattaggcatatacaagatcgataatgttgtggatcttattattattgcccaaggggctaatattcacttttcaaaacttattactcatctagttcagcagctcaagattttgaagcaaatctgttttacatacatgtcttaaccttcaatcccatttaaaaaaaatagtaaattagatggttaaccttttagatttgcatcctctttaaaataaagctttacagcaaatgcatttttcctacaaatgtcttcgaaaatgagattgaagaggatgtatcatctaaatttttctgtaaagagcttgcccccgaaataattggaacatgaactgaaacctctagataggaattcctggacacagctgtccattatctttcgggactttggtgcacctcaccctttactgaacacaactttgtgtcaaacactgggctaggagtgctagttgtgatgtttgaggcaacagtggaatttttcttaggacttagtagaaccagttcttttttttaatatgcatagtcagattttgatgatattcagtctgctcatatctataatagtgatattaacgtctatttcactaggatggctcttgtgaagattaaattaaatactgtatgaagaagtgccttatacacagttatataaccaggataatatccagatggaattctcattctctctctctctctctctctcactctcactcacacacacacacacacacacacacacacacacacacatgcaatatcatcttataaatatcctagaattgaatatctcagtagcagagatagtagttctgtttctcagaattgcttttgcaaaatggtgttttggattataattgtgctatttaatttttctaattaaaatttctaaatagagcctattaaatattggatgcttatgatagaacatttgaaaatatagaaaaccaaatgacctacaaaacctctaccttccagtaccatcattccgagctgattactgttaacattttaatggtttttgtccgctaggtctccttgatgagtttcacctgaggaaaaggactccttcaggtgtgtgaacttgagccaccaggtccaaccccattggcaggtgctggtacagacgactgaaatcagaggaagatcagaaatcttcaaaacccagagcagcagatgtcttaacggtcccgaaacgttctttggttctttgcagtcaacattcacgggttaagaagattgcaatgccatgacgggctgaggttgcatttctggacgctgcttactcccgcttccttccatctgtttcaggcaaatcattatgcagttctaattagaacaatcttctaaacactctctccagagcgacgttcttccaaacacggtttaagcggcgagagacacctgcctaggaccctacgcgtctggaagtctctcccagtgaattgggtctcatctcctgccgagtacgcaagttcaattatcggcagattaggtttctactctccgtgccccgccccgcgccatcctggggagcagcgggaataaatgatccgcccctggccagtgctcacccgactgaccagagcgcagcccggtgaccgaagcgcacggggcgatcgcgaggcgccccctccctctccccgcgccgcctccagcgcgagtgacggcgcgccctccgggctccggagcggcggcgccgaacaatccccggcagggctcgcctcgccggtgacatcactcctgaagatactcctcgctcccagcgcctgccttccccaggcgtccgttcgtgtgcccgtctccgcctttccgcctcggaagagcgctcatcactggctggggacagagccgggcaccaaggagcgacaggatcccgaagagagagagagaaggcagcgagggaaggaggaccccggcaggcagcagcatgaaattcagcccagcgcactacctgctgcctctcctgcctgcgctggtcctcagcaccaggtgagtccaggagcgtgagtgacctgaggccaggggcgctgccggggcgaggttggtcctactgtgggtcaccagtgggggccaaggcacttcagctgtttgcatctcccgcctaagcaagagggacgctgtatggtttgggctctgaaatccttctgagagagcagagccctttcctagttatcccagccccctggagaaagtcttaggattgctctcagtgagggatcaaaagctttctcttccgaaggagagaaaagacattttaccctccggtcctattagtagccaaaaggtaacacgcggtaaaagaacaaaataaagaacggaaataggcaaggagggaattgccaccaggcagtgtctttacattggagttgtcttaataaccatagagcttctcccttcccccaagtgtgcctgatttaaggaagaggaaaccagagaaaacagattaatcctggaagatgctaagacttgtacaaaagttcctggactcctgaaatggcatgtttcaacgtcttggataagcttagtgataggcgttttcttttgactgtcttgtgaacaggtctaattaaagagcacagaaggcgattaaaagttagaagacactctcagagtgctgatgcagagaccctagtcagaaacaattaagtactgtactccatcactggccatggatgggactttaagccccattacagaggagctatttttggtggagatttaaaatgcagagattgagaagagttttgtgactccccactgttgatcaagtcccaaagttgtgatgggtttgcttttttcttccacaagcgcagcacaaaggtggactgtttagttgcccaggactgtctttattctgcatgcccttagcatcatattggcagcaacctctttcccttggctactataaaataaaataacccacacaggatgaagatcctttcaagtctacgtgaatagaaacattatttgattgtgcatctgatggcaaataaagtagggatatagggttgtttctaattctgaaatggaaaaggatgaagaaaacttactctgtcttacaaatcaaggctgtaaaattcttgattccgttcctaatctacacaccttctttcaggcctgtgtaaccaaactttccttttagtgtagagactatttcatttaccctcaataattgataaatttagtctttccttgcaaacaaagcccaggtgactttcccagattaaaatgaaatgtaagtttgattcttcattttctgtaaggtttgcttgtcacttcagctcataaagtgcagatggttttaaagaaaaccagtttgcttcccagtattataattagttgctctaaatacagagcccattttaatatttgtggttagctctcaacagttcaatacaaattatgcatcacagttattctttaaattcttgccattcactcttatgttgtgatttagtcttctagagaaaggaaattttctaactttggacacttaagtagatgacagtcaacacatgcataaataataggaaatatttaaacaatagaaatccagcccacagtgattttagactgtgaacatctctagagttccaaaagtacatttgctttttaaggatactataattaaattgaatgaaaaagctctatagtctctagcgtccaaagatttaatgttcgatatctaatacagggtcaaaaagccattatcttttcctttcatgaaagtgttgattttgatagggataaatttctttaaaaatagttaacacacttattacaacaaaaactggaataatcatctatttcactttagctttgaaacttctgcaatgcttgtggtatgtgaaaactatggttattaaattttaccagaagagaatgctgggcttgaaaaagatgaaatatttataataagtagcatatcttattaatgtgattactctgtaggaattcattttactggatacccagaataccctgtgatattgaacaaatatgaaaagcaatgcggtactatcagtgtcattttgcaaagaagagaatatgttttaaagatctctaacagaaggccattctgtgtataatatttaacagttcttataggcacatggttattgtgcagattagaacctaaactgagcagctttgaaaggacagttgtgttagtagggatgagcttattgtcctgctgggaaaagctgagtagctcagccatggccacctgggacagtgggttttctggccaaagacttctgttaacttagtttcttagtcagtagtcctgtatgtgaagcaaatggtatttcacatgtttagatcacgctggatgcattagcaggtggtggtaattgctagtttttcctatagcctttgggtaatctcacctgtcttttattgtcaaactctttccaaagtgtagggaatgcagagcggagactcttaatgcaaatatatatatatatttgtttcattatatctttctctgagtgcattgccttaatactttgctattttatttccaataggtctgaagttcagttctattttaaagtaatctgttcagtgaaacaaatgctgcaggtgaaaaggtagtcttttgactgtgttgtgaacaggtctaatggtatctagcccacagcgactatcctgtcttttaaacagaaatttttgaatagaaaacaatcctgccttttaaatagacatttttgaatagctttctctttttgcttgttcctccttctcaccttttctgaagcaactttagatgctgaagcacaaaatcccataatttaatcacagtgaacatcaatggcccccaatcagagttaatgtatttgtcctgaaagaaagctaaatgttcaatttacacaaaagccaagcatttttctctgttttactggtaaaccccatagagttttaaaaaacgaacaaagaaaaagagctgtttaatgtcctggcatatggtctctcctgcttagaaaatgcatataaattaccaaaaaaaatcaagttaatgatatgaataatgtaactaatacagaaactcatttaaactgtacacaaataaatgtgatcaaagaaagcaaacatgttggtttaatagctttggagtagaatgactatacttttaagatagccttgttgtatagtattaaattgctattccaaggtaggcagtaattcacttcagaaagaagcagtataggtattgaaagtaatggtagggtgaaaaattctttagaagttcttggtgaaaagggacccatggagtgctggagaaggctcatgctttattctgctgaacctctgttcctttacgctgtggttatactcttgatgcctttggattgttaacttttaaatgacttaataaggagagagacatggcaggggaggagtgaaggtctattgacttctggtggttttccatgaagcaagaactttgagcagatggtcggttatagtcctcccaacaggagtcaccttagaggtctctcctggactgtctgatcagcagtcacactacatgtttattttggaatctatttttagatgatactatatattgaagatgccccgggctatttgttccgtgaattaaactaacctcaagatcaacttgatttgtagaataaaggacaagaatcacaataaacacaatgagaacacacaaaaaatatttttacccaaataaatttgatgcaagaagcagtctcaccttaactctcctgaaatattttgaggcaacatgggtttgcttcctaagtcctgtgcacagtgtctgccacacatgacattttacaggatgctacctacgttcctttatttgtgataaaaattgtaccttccatgtaaatgagatagaggtatggctttcttaagaagatattaacacacaaatattttgacttcttacattgcagttttgcaccttagtcacctatttccaatagcagtttttaaaatgacttatctggtgattatctttgtggattaaattttctctgtgattaatgatagggacatctcaaatatttgatttgtctgtacagttgtccttaaccaaactccatgtaattgaaaggaagaacttgaccttctaactaagaagcaaagatcactgaaaccaatgaggaatgcgtggttctaatgaaataatgttttctggtgtgtgttataagaaactatgtgtgcggctgtttctcagtgacttctagaagatttgctaaaatcccttttacaaatggtgctaaatcatttaagtaacctgattaaacaggtactgtttaaaattatggttccttttctgagaaatccaaaaagactctctgaacttgtcttcatccctgtagacatgtctttgatgtttcattatcatgcagtaagaatgtgcctgctatcagtcagttattacatgcaccatcagggcaataaaacaatagattagttatgtatatccataatctagtcatacatacaaataatgatatataaaacaaaattgggtaaataacaacaaaattttacacaaatttctaagtgtgaatgaagcaaagagttaataatgccaattaagtggtgtctggggcaacttctactttccaaggatattgaaaagaaaaatattttgtgatcaacctcaatatcctgccacacttactatatgttattaggtaaacttcttatcctctctatccagttttctgatgtagaacacagacctccccataacacctacttgagaaggtaacagccttcaattgtaaggactgaatgagttcatccgtggaaacagtttagcatattccctaagtactcaacaaaggttagcctgtacagttattatggtattattaatattatttttataaaatctttgtgattgatttggccatagcagaaaaaagaaaaaatatagatacaaatcaattaggtgacatgaaattaacaagaagcatagtcatcatccaaaagaaaagaatgattggtagagaagagaggaagtcagaggtataatgggggttatttggttattaggctagtttttttccaaagtattttgtttgtttgtttgtttgtttttgagatggagtcttgctctgttgccaggctgaagtgtagtggtgccatctcggctccctgcaatctctgcctcctgggtttaagcaattctctgcctcagcctcctgagtacctgagattacaggcgcctgccaccatgcccggctgattttttcgtatttttagtgaagatggggcttcaccatcttggccagactggtcttgaacccatgacctcatgatccacccgcctctcgacctgccaaagtgctgggattacaggcatgagccaccgtgcccagcccctccaaagtgtttttgatggtgctgtacactttggtgaacaccatgaaaatctggaatatttaacttaatgacttagaatgagatttagcataaaagtgaatatttgtctgtttgtatacctaattaaaatgtaattgctataaattttgatatgaaatcaaagctgtgagtacaagtgtcaaggaataaaagtggaagttttcaaactatataggtagggtagacttgaaagtttttatgactttattttctacttcttcattgatttcatcatttaccagcaacatttaaaaggtacaaatgtttagaaaaattaaaggaataaaagatagtattgacatttttttttactacggagaacaaattaagaatcactgatatagaggcagcccaaccattgtagttttgaaaatgaccatatgaaagggatcttatactaagtcagttttaaaatagctttagtggttgttgaccatcaactagtttgcacatacattatcataaacttttcacaattatgtaataacattctgactattacatgaaaaatatatttctctttattttgctatagattactgtgtgaatgtgaatgtgttgacaatgacatctatgaactgagtggatcatagaaaacggtgtaatttaccgctaagagtagatgaaaggtacagatcatgtcaagcttgcatcagagaaagtgcaaatatttactaagacgtctaagaactttgcttcatgagtatgaagacagaaggtgaaggtcacccaagtaaacagtgttctctgaggattctttcgtaaaccctaggagacataattataccataggtagtgattgcattgcaattatgtctgaattgtttggtgttgctttccagtgttttaatctctttaagtgtactttaaaaagcctacgattgggacacatattgtgaacacaagaatgtgttctagtccaaagccctacaatttagaggtgagaaaactgaaacccagggtgactgagacttgcccaaggtcgtaaagggaaacaaactagaacccagaactttccactatattcattctgttctgttatgtgaatgttcactatgacatagctattctgtaattaagcaacatgtgactagttagtacctatgaagaatccagaactattctagttattatggagtataaaataacttaaaaacaaattgttgcaccacatgtaatcatcatagaacaacaggccgtaagacaaagggaattacagtaataagcagttgaacatcctgtgtttagtagatttttgaagaatgagctggcctaaataagattctaggtcattttcaaaactcaaagcagagtcattaatgagttctcatcattgcacaccatttacctcccataagatacatctataatggttcctgctgacctttcagttctattgtaaggtgatatttttggtgcctttgagatctttccattgaaagtatttcctgtaactatagttctcagacatttgctgatataaatctcacttgataaatctgtgctgaaactgtggtatttctcaatgggcagcatgctaactatcttgcaaagatgtgttcctaaatatgttcatacctggctttaatataaggttacattacattttctttggtttacatttctctacactgtcgtcacagtttgtgtgatgatgtagttatagatatataacatttttaggttcagatggttgtagaatattccacctgcacatgttataagctctttgcctttgaatatgttctttaaccattctgaaacttaattttcccctctgtaaaaagtaaaacaataatatctaatatttagggccattaaaattaaataaaatgtatttaagtgtgtctcagggcacatagctgtgccttgtagtccctcagaatatgctaagatgtgttcattattactatacatagatatgatgatttaatatgtttattttatatagaacacctcaagcaatcagcatgtaatttaataatttttttttaaattcaaaataaatgaagtccttaatttcatagttctagactagtacagccaaaattataaaattataatttattttctaataagattctcctggggccagggcaagcggggaactaacccaatgaatggctttcatgaagatgtgaaacattacccatttctgtgacagaatgcattttagagagtacctgcagagaaaatgctttactctaatttctaattctcaccgataatttaataactgaaggtcacaagcatttggcatctcatcttcaggttcctctttttattttttcctttcttgcttgaaaacgagtaagactgaaagtgggcagtgactcgctgtcttccaaactagttttcagagctaaggtattggtaagggctaaatcagattctgggacattcatctcatgtcccctgtggaggatgtgacttcttctgacttcctcctgcctgtcctccagagggttatgatggtttctgaccttcagattctgattcaaaacatactgttaccatctagaatcacttattccatgagtgctgataaatggagtcggggagtttaggggaggaatggagatgacaagaggtgtttgtcgtgttgcatggggttaaatccaaaagaatccaagctcaaacggagactctgaatcagccttccttgttatatgaatttagaaatgtcaatgaacatctcttagccatatttaacagtgcctctctcatagatatgtcaagaggattgaataagctaatgtataaagaatagcatccagcacagagaaatacagctcactatatcgacagtctacattatctaattaaaattttaccctaccagattgtacatgcatttcagcaagagagatcattgagaaaagctcatgtggcatagacaagttagaattgttgatgaagagtttgtggagctcatgcctaacctcctttattacaaactaaaaaaacaaataaaatggtatttttccttcaagaacatgcagataatttgggggcaatgtggaagccaattctctattatcttaaccaattccagttgggaacactaatttaaacaactataaggcttttaagagaaaaaaaaataaagaaagacagtattacctgacctcgtttctatctggtgcctgaagctccaaattatgttgctataatatgggtaaatattaaatataggtataaaataattgttacaattatatttccatattaattattttaaagaggattcattgttcaagattacctacaggtggcaggactaaatgtgtaaatcataaaacaaggacagcgtaacattaacaagacaattgacaagttgaaggtcctggacttctaaaattaagtaatcctacaatgggataagtttggtcatgacctgcagagaatggtccagaagagggactaggatggtagaaggaaaggagaaacttagcacacttgagctattggaatgtagcgtgcttggaaagatactataagagaggaagggaaagcaccaatcactagctttttctttatatataattttctcttttctaatgcttgcggtcatttatttctggcctttgaagtaaactaagcattgggcaggaaaaggtgggaaagtctctgaattataaaagaaacaagaaaatgcatgaaaaattggagtaacatcttaggaagacacagatatgggcagaagcagctttatattgttgtagctttttccttcagatgccacagagaaaaatgttagctccttctgcgtgcacacagaaaagtgaggggcaattttttctttttctgacatgacagtttagaaagatattgaagtatatcaaatcccttttgtgtgttctctatatgtctttatttcagttggccattttatagaatgataacctacaggttagaccaagatttctgaggactaatcgtgtgtgtagaagtgctagctacttactctttgtcacttaatccttacctatgacaacacattatattcatatatgattcatcactagggacccctaagttttgcactcattaaatgactatcccatattcccccagctaaaaattggccagaccctaggtcattattctaagaatggctttatgaatgaaactattaggctgcctatatagaatctagtctctgtataaatgtacagtgaagaaagtaataatcagtactacaaataagaaagcagaagctaaaccatactggcaaaggactgcatgttttcaataggtgagacagagtacattaaaaatattcttaaaataaatcagctaaaatattcattagtttgaaaatcagccaaataaagcctttattataaatacaaaagtttgccaggtaatacatgttctcaatttagtttctccaagtatgctcctcattctaattgaatgataattacctgtgatggtccttaaaaatacatatttcagttcctaccctagacattgaattttcattttaatatggaacttcctatgtatatgagagcttagaaactacagctctagtattgcagaactataaactctagtatactttcatctctttaccatttactcaacatgcaaattgtagctgaagtcaggagaatgggaagatgttgatgttttggcaaaaatcacacctttacacatgtgtataaatacatttagtaaatgaggatctcattgtgctccaggctgcttttatcagtcaatttaaatgaaaataattatccgcctcacatagctttctttaaagggctgagaaaatgctcaaataaattgtgtaaaatatttacatggatttatcagggggcatagtgtatttagaaaatatgagacaaaaggtgaaatgtctgagataaactacaaagaattcacacttaactttctctccctccctagcttttatcactgcaagttatataataaagaggcaaaaaaaccaagacctacacatgaagccatataaatgcttgttctaggctacttggggcaggaaatctgaactttcaaaatgaggagaagtaatatttacgtggtaaaaattaaagttttgatcatcttctccctactccccttaaatggtggttggttttgcatgatgttaaacacttttttctaagaaatgtgtgaattaaatagaatgtgcaactatgccagtcatattgccctagtgcctaaactctgtatcattagttaattctcctagagtgaaaaaagaaactcaaaatataaataataatataatatttataataatataaatgaatagtacttagcaattatataataccatcaaccaggttaatctttacaataaaccttgaggtgattactgatgttgccctaattttatagatgtagaaactaaggcacatgagattagattacttggccaacattataactggtaagcagtggagtctaaattcaaaggccaggtggcactagaacatacattcttaatcactgtactacagtgcctcctaggatataaagtgaagctctggaatggccttaaatttttgtgttggcttcatttgtgggttctagttgcatgcccttccgcaaataaataagtagccaaaattttatatacagttaaagaaggaaggcaaaatgttactttttctcaggtaagctcacaattaaaggtgacagaagatcctttctttaaagttctaactaaaatatttattttgtttttgtggtaaaagaaaaataatcatatattagcatggtaatatctttatgtgtggaggctgttttttaaaaaataccagtgaactatggttttctactgcctggctccagatgtcttccaagtgttaattgtggggcttaggaacaaatgtgtagaatcaggctgacctgtgttctaattatagcttggtatcttctacttgtgtgattccaggtagctgtctcagttcctcagactcataatttaatttttaaaaataatttataacagtagctaaaggttactgcttgttttctatgtgtaagaacagtactacaaatttgtctaaggttactttatttaatgcttttcagtgccttatgaagtgcttgctttacaaaatgaggcattaaggattacagaagttgacatatctaaggtcacaaaattaaaaaggggtagagatgagacttgagcccatgatttaatagacataagactcaggattctaattcaaggtcaggatcctgagacaataaaagttagcaataaaatttttgatggctagatatttgggaagtaactcagaaactaaggagctgttgggactacatgtagaatgatgggacaaagaacttgtgtcatacacacgcgacatgtgcgatgagtgagggttcagtgcacagtaggttcttgcccgctgtttgcatgctgaacctcaagactttccatgtaggaaatagggtcacctttggttttagagatgtgaaaagcaacaaactcaacattcacatttggtctgtcttgagagccttaccatatgataataacagccagatttttcttagaaagtcgtttggctggaactgttcttccactggtaatcagaagatggcactgtgaagtatagtacagtcataactgttctagaattaactcattcatagactgatacacttgcctcgaaatttgtatctaaaaaaagtatataatatgtactagatgatatatatagtatacatatggtatatattatatatggtatagtatatatcatgtagtatatagattatatatgtaatatataatgtgtatatgtattatgtagtatatattatatgcatattttaataaatatattactcatagacatctttcacttttctgaatacttatccttaaaaatatggttatatataacatattatatgttatatacacagaatatataaatatattccgtagtatatattatatgcatattttaataactattttaaatatattactcatagataccttgcatttttctgaatacttatccttgaaagtaggcttatttggtaacacactatcattagcttgattccagtaatcactacagtgtttcctctatgtctacctttctctcgaaggagcatagacttgcaaatttaataatgtatacatttcccctatatattcttttacttgagtgacataacattaagtgaattctcaaagacagctttgacaggtagtgggcaatgtgtgagggagacataatacctggcatttttatagtgttttaattttaattgttatacatgctcataactcctcacaacatcttatgtagcaattcataataacctcattttatagatggagagaattttagtaatggcagccaggtagcttaaacccagcgctctgaattccccattcacaacaccaaagttgctttggaaccttgaaagttggggtgcaaaggaggcagagttacccaatggctagctcttatgtcttaaagaaagaaaacgaaagagcagagtgtactgaggatttaaattgtgatgctacccatttttatatttggaagatgaagccacaggtaccagcctggcaggactaaagaagatggtgcctatgcaatgtttggcatgttttgccatattggctttggttctatattgtcttgggtacatttcataagttcctgtaagtacctgcctgcaacccttgccaccttaatcagttgagattcaggttttttggaatgcgtcagaaaatcccaaattacaatgccttaaacaagatataaatttagttctctcacacataagttatgtaacaggtaggaaatccagggctggctggttctccatggccagcaagtgggcaaacagctgcattctaactttcatgggcttcagttactttaaacttcatcaacccttactctgttaaatatatatacgtataccacatttatattatataacatattgttttgtgactatgttcatataaagaataaaatattaatattatctacttcaagctaaaaattcatttttaaaaattctaattttaaaagaaatttaaaatatttgtgggccaagaaagtattgtggaccattggccattgactctgtgctgctgtgccaagtgggtaagttagccatgtcagtaatgaccccagctccttccagcttgttgctctgttgaggtctttgccctcgtgatccaaggtggccacgagagttcaaatcatccttctaaatagcagcatggaggaaggacacactgctttccttttatgaatactccccatttgctagtcttagtagagtagctggtcccatataaaatggagcctgggacttgtagccttcttacctctgccatatattcaggtaagaatatattggaagctctgtcatactgtctgtgccttcccttctgactgtttatgtaattctctgctatgtaagttgattcagttgctccaaaggaagttgtcttttttgtgtatagtaagcccttatttaatgccattcacagatttttggaaaccacaacttacgtgaaatgatgtgtagcaggtttccttcaaagtcctttctgatgttggtgacaagaaatatcattttgttatacatgacaatttatggtgatgtgaaagctggtgtctgtcgctacaatttttttaattaattaaaaaataaaaaaaaatacaatggcaagattttggattagaatcactatttcagcttacagggatggtaaaagtttacatcagttggatatttgctaggagatagggacagatagggacagaactagggaatagcactaaaataggagtattcataagtaataatctttatgtgactagatatttaccaatgataaaataatatcagtaaatggttaaacgttgaacttagggcgtgctatctgaggtgactactttaaaggcaaagttcatatgtattttatgatttatattgtggtttagacatatgaagtacttaactatgtgcttaaatatttactaaatgactaattcataccttttgctttgttgttctttcttgaactttttccgatgagtggaaagagaacacttaaataacgtgatatagatgatttttaaaaatttaagtgaattatgctaagtcttagcgaagtgtctcttatttaggctaacctcagaattacactgtgataatatgcactagtatccacatatatttatgtttggatcttatattatcagagactagcattttccaaaattctcttccttagaagaaagtatctgtcagggggagagtgaataaagaaagttgaaggagtttctctgtatacttttgtccaactgggagagggatgccatgattatgataacagagtgattaatagatgatgtatattgggctgaacaggggaagaagtgaaaccaagatggtgctggaagcaaaggaaaaggtgaaggtgctgaagaatgtggaatgtggtggttgtcacaggctgaaaaaacaaatagcggtggtggtagaatattggtagtataaaccttaagaaccatcttagaattctaacatttcagatctcagtgagtctttaatatctactccaaaccttcatttttttataaattgaggctcatagatgccaaataacttatcaaagtgatacaaatatttaatagtacaagtaagacgtgggaaaaaagcaaatataataatacgttacatattttattgctgaagcagcatcagtctttcataaaaattgagagaacttcatcataatcatgaagttacctaagtatgtaaagtttttcagaaaaatgacaaatgaataattatggtactttttatttcaaatatctaaatcattcttaacacaaatttcaatgttaaaggaatgattttacattgttgtttgatctctaacacttaatacgaagttcaacgttactttttgtatactaaatatagcttggcttgttgaaataggtcttttaattcctgaatttaatggttatttttttctttgtttttttttttttggagatggagtctcactctgttgcccaggctggagtgcagtggcacgatctcagctcactgcaacctccgcctcctgggtacaagcaattctcctgcctcagccccccgagtagctgggactgcaggcacatgctgccacgcccagctaattttgttgctgttgtacttttattagagactgggtttcaccacgttgcccaggctggtcttgaactcctgacctcaggtgatccacccgcctcggcctcccaaagtgttgggatcacaggcgtgagccaccgcgcccagcaaatgatttttttctatatgacatagttttcctttcagtctctgttttttaattactattattttaagaaaatagatggtattgatgttttcaaatcatgttttctttcaaaacatggaaacaagctaatatcacaaatttctcctaaaaataaaataattaaaattgtatttgctgacatgcaaaatagctaaaaattaagtcccccttgcctgtttttggattcacaaaagacttgatcatatcttagctaaaaacatctatatttgaaagaaaagctacagagtcatatgatggttagccttcatcctttagcagtcgttggtaaggttttatttcatttttacaatcagcatcaagagaacgatatagatgagctttatcctgggataatgactatgtcttaaactattttcagatattatgaaaacattaaaatatcaatagccactttaaaattgtgttgctgttttgactgtctccttaaataattagaagggtaaatattctttttgaatattcttaggatctatataatacgtgactcatatggtttttcctgtgtctactttctgactgtcattacttatagctacagtaagttgcagggccatgctttgggcactatactctgattctaaagcctggggtgtgccatggaaaatcagtcaatgaattccattaataccaaacaatcactaaatgctggtagaaatgaataccttactcttctggaagatcaccaccttttgtctctctttgacctttcagagtctgaatgtagacagtgtttatctcaaagaagtgatgaaaagttgacaggctgggaaaataagagttgccaaacagaatgctaattggaggaccacgtaagcatggaacggatttaatgttttgaagtgtccaagtgtagtgcattctgcaagcatagttaggattccctggctatgttctataataagaagctgatctggctggggatacaagcagacctctggaaaataaaatgtcttaaagatgagtggtacccctaaacagtgcccataaacagaagcatgtggcatatccctggcattcagcaaggggctgtggaagaggagtcttgattggtgggagagaaatcctccactgaatgcagagagtaactagttggttgtgtgtgtgtgtgttttcttttctggcaattaaaaatttcaagacaaagtggcagagaaaaagagagaaagaaatagatggtgatgatcagtctttggttcctcatccatggtgaaactgagagcattctagcataagaatggtttcagaataagtaatttgctttacaattcagtgatcctgaacaaataaactgtatccacatctcagagcagctgagaaggagagcagccctgaggcattacagcacagaatgaggaaggtatattgtagtattaagggaaaacacataataagatcgtgcctctccttctatcaagcccacttgtcaatggaatgattataaatttcactttgtggggaattgcagggtaccatcgtcatacagaaccaactgaatggatgttctttgtttatgtaaataaactttgttaacataattttcttaatttattagttttttttcttttgatattcccaagtgtgagaaaagaaggttatgacaacacagcaataagattacatgaatctatttatcagggcaattgttaaaagaattctccccactggtgttgaagaaagaaatatagtaagacttagtccttgaggtgagggctgttctgtaaaagcggcctggctcaaggaaagctaaattcacaaaactgctggttggttcaggatcaagctctttagggtaggagactttttacatgactttaggtcagaggtcctaaagaggagagtaaatgaattattgttagtaagaccaaagggtgtggtgaacaatcgttgtcattgaaacctctgctgatttgagctcttaatgcttgcaagtgaaggacgctagaaggtctattatttaccatttccccgatttcagggcagagtttagaaccggaaagttcataataacttcttggaaattaactaagtcctctgatgtaggagttacacaatcatctagaatgttatttttattttttcctgaggcagattataaaaccgtatactgtgcctagcatgtgtgaggtaagaggagagaagtggtattctaggaatactacacatcctctgtaacttactctcttcctacagaagtttagtctactgagctgaaagaccccatctgtaaatgacactttttacaaccagcaagagggataacttggcaattggttggtttatagcaattaaggatatataaattaattcaattaatattcacaaagaacttgatatctatcagggaatatgccaggaaataatgttaagtgcttgggagcccagatgcattaaagaaaatacatccttcatagaaggagagggagacaaaaagtgcaaagagtaaagtttcccagctctgggaatagctgtgtaaggtgtcacagaagtaatgactttcctatgggtttcaaaacgtagacggaactttttagccaaaaatttttgcttgggaaaacaaattccaggaagagaatagcaatgtgaaaggtgctaaaataaaataataataatgacagaactaatcataggctctccagtagtgaacaagcactgactaatatgtatgtaaaaacagcaggctctgtgcatcagggtgggtttacctctgtggtacaacctgtgctccagagctcccctagggactgggtaaagctattctgctgggaccacttccttgctgaattttttgtcctgtcatgttttttttctttcttatgaaagttctcatttatccctgataaatcagctttccaaaggaggccctgattatgctctgcttctgtgaaaactgacctgagacagaggctgatccacctggatttgaatccccgtcttccacatgactagttatgtgattttggatgggctgttgaaaatttcttatagtagattttttttttcagttaaattgggaaaataatcaatctcgaagacctgttttgaagattaacagattaacagattttaaagacctgacacttacacttgattaatatatgttacttttctttcctgttaatttgtggaaatgaatgtaaaacctaaaattatttgtatggaatttggataggtcttatatgaatatgaaattctatgaccacttgtcaatctgaaataattgaaataatcagaatccagttttaatgagtttattcaagtaaaaatctgggaatagccacccaggttacagggactccagagaaatgggataagtgctccaaagctaaaagttaaagttgtgcttacataggaagaaaacaaagacatataacaggattacaacattttctacacaaggctgatttatgagtaacaacattttaattggttaaagtttgttttcttttttgtgtggctggttttctttacaatttaaaagtgtatatttaacattccatcttaagacaatatgacagcatgaagtttttctgtgagaaaggtaagagagaagttaatctaaaatgaagatcagccctgaagagggaagaggtctttcctggtgctgtgtagtcatttgtaatattttacaaaacaatgtaggtaaggaagaaggcaaatctataattagagaaacaaaaattacagttttctaggttacagctgcctaggtaacagctgcctgtttatgtgacttatgtcccataatcacattcccttaaggctataaaatttagtttcaacagcttagattgtgagttacttatttttacatactcaagaaataaactctgtgatacaatctatgtgccaagctctctatgtggctttatttccaggtttgataatttcttattaccatctgttatttttgtctttgaacctttcctaatacaaaatacaaagatttttctttatcatattttttgtgttctaagttgaaacatatgcatgaaatcttatttgaaatcttaattgaaacatgaataagataatcttatgtcacctgtccaaaaaactattgctaaaggttaaaaatattgtaggtacaggccgggcacgatggttcacgcctgtaaccccagcactttgggaggccaaggtgggcggatcatgaggtcaggagatcgagaccatcctggctaacacagtgaaaccccgtctctactaaacatacaaaaagattagctgggcgtggtggcgggttcctgtagtcccagctactcgggaggctgaggcaggagaatggcgtgaacctgggaggcggagcttgcagtgagccaagatcccgccactgcactccagcctgggtgacagagccagacgccgtcaaaaaaaaaaaaaaaaaaaaaaaaaaaaaattgtaggtacatattaaattttatgtaagttttttatatttaaaaaatgttctatttattttttcatatatctaaataatgactccaaaaacattaatcacttcaatgagggcatcagtcacgtcactgattattgtaaattgtggagccaataatccatagtttgctttcttaaaaatccattttagaaggttgaatttatcagatagtctgaagtgttaaatgagagtttaatcttgacttattgaaaaatggcatcattttgcttcccatggttatttttatattgtgtctgaagaaagaaaaatccttttgtgtttctcatgtttatggtgtataacaggctctttttaattatagaaaattcctgtcttttaatcactgagaaaacaattttcctcccataaaataatacattttttcatcatttggtttttaaaatgacatattccagggattatttttgaaatattggatgcttatctaacactatccattaagtttctattcatgtggaaaatgaaatggaaatgtaggagaaattattttttagagggaggggataaaaggcctataattaatcagctgttattaatgaataagataacattgaattcaaacaaataaaaaattagttcttaagtgttaggtatgacctcatttaattaagttagataatttatataaatgagataatttaacttatttaaagcttagctaagttaagagacttgcttcatctaatccatgagtcaatggtaaaatcagaatttaagctcagagctgcatgaatctaacatctaggttcttataactttagccatgtttgttaaagatctttgattattttttttaatgtctgatatgcctattttccccttgtaacattgtatatttacagtctgggctaacaagataacaagctatttgagggtgttttatcctttctgtaagtgttaaatgagaaatttcttcctcctttttaaaacgaatggaagagaaactgttaaaaattattaaagagtatagttactgagtgtccttagtccataaatagtttttagaatgttaagatgataactgaaatatcagaagatgatagtgggtttttatgcacatttattagggttgttttcttcttgatcttttcactgtttgtgcctagttcaaagttagtcaataaacagaacatggctttgtgaccaaaaattctctgaaaaagaatttggaggaaagaaactttattccagtgaacagtttgcaaactgggaagactgcataaaacaaaggggcattccagagagcaaagagagggttcggcttttatagagaaagtttctattcaagttcccaatcaagtctatttatgcaaatgaaggattcaaacttgcttagtgctgattgattcacagagctgagttctgattattttgatgcagatcatactctatttgttggttcaggtgacgtgaacaaggacagtcagctatgaaagtcccaagttaggtagacgtgtgggttttctggaactgagtacatgtgtgagctctaggtagcaaatggcctttgggctctattttaaacttagacactgttatccactcaggattcatgttgagggattggctctttcacgtttacagtttcattactcagtttgctctcacagtcataccatcctctttatattttgactacaaatcttattttctactttgacttcagaccattaggattgtatataaggactgttaacagtacccctcaacccaactttatctagaatgagtcttgagctttggagactcctgtacttgaatggagaatacagcaggccatctggaactgtctaggaaatcggatgtagttttagggagaaagataaagttttgaatgtaagattcattccttgagattttattgtttagttatgtttataatattttgtgctgaagtcaattaaacaattgaagaaaataagtatgagatctccagaaatgaaattgtgtggtgaacacattagaagagcagacctactatgtcttcctccaaaactatcttagtgaaaagtccttgggaaagggtttcgcctttcatccaggatacagcttcagtgaggcagttctacacatgtactggaatttgctgtcttttcatgtcttggttaatttggaatttcatttatttactattttgatgtgaagaattgcacttcagattttagtaaattattgccatgtcaatatagttgcattctaatgataatatgcatcttttttaaaaaaggcttttttcaaaataattttgcttcatgattaatttgtgattgcacataattttcataattttagttcagacaatctttagacatgaagatacttgttgacagcacagtacctttgttcctctctagtaactcaatataacaacatcagcaaatattggtatgagttactattattaatgatttattttcataatctgatttcttttatttcattagttgccttgggtttttgtctgatttcagaagctacatagctatgtgatttttaaaatggcataataaagcataaaatccacaagatctttagttttggagaattttgaatgggagaattttgaagattgacctgtgtacccttaaaaggggaaatcaggtagaaagacagctgtcaagaagatgcaatggaattattaccaacagaattgaataaaacacattttacaaaaaaaggttaatatctactctaaaacgcactagtgtatgaccgaaaagcaatatttggaaatggaactgttatcaacaggaaaaacagggaaggatttaaaaaatgactgcaataaatacttatgtctgtagttgcatttggacaccattttgaaggaaccccttccacagaaaccagatgtgatttctgtttttctgtctggagaaagcacacatataatgaaaaggttgtataattattgcacttgtacagaagaatcttctcatgtaaatttaaatttcaataagttgctggattaaactttagcaagggaaaggaaattgtaaaacgtggtcttgtctttcattcacatgtttgtgttagtatgttaattatcctttttgggggcaggagaagtacaatgaagcataggccagcataaatgctacttatacaggaaccaataccagagccagactaggcttaggaaaccttaatggtacatttagatagataattgccatagcagtgaaacagtagaaacttattttttgtcagtgcaaagcaggtttactaattaccagtcccaagagaggactcccattgcatggggaatagcaaagatcatccttaggccaaccaccaaaaactcaaccaagggttttccagggttgcagacaagtcaagagagtggatatgatgcctcagtccgcaccatcattagctccagagggaaataggacaatgcgtgtttttagttccctagatatgtatttctatactttaatatttctgtgaatgggtgttgccatttggtgtaatcttttaggaaaacagattgtgtggctgggcgtggtggctcacgcctgtaatcccagcactttgggaggccaaggtgtgcggatcacctgaggtcagaagtttgggaccagcttagccaacatggtaaaaccccatctctactagaaatgcaaaagttagtcaggcatggtggcgtgggcctgtaatcccagctgctcaggagactgaagcaggagaattgcttgaacctggaaggtggagattacagtgagctgagatcatgccattgcacttcagcctgtgtgacagagcgagactccatctcaaaaaaaaaaaaaaaaaaggtgggggtggggtggggtaagaaaatagattgttttagagtaatataattgtatctgatgaccccagaggaattaaaagaagcaggactcagtccctaaagcaatgtttcttagggagaaaaattttaaaggcctagcatttcaaggtaaggaagaaaaacttggttacaagctttgtagacttacagtatacctacttcatgagtcaatatatcattgcccaccttacttttcacagggtaatgagacaactttcatagaagttaccacatttagcttaattaagaagaaatatatttaggattagaagttcaataactagatccagtgaagcagatcacagtgaacgggcagctcctttgcaattcaaaacagatggtgcctttctttttccattcagatttcctgttttgaaaaaaagtcatatccattgaataccagcaatgtttatgacatagaagttaagacttctaagtcataacacatgtttatggaggaatgatgttagaaacgtttcatagcgagcatgcatttttttctttgaccactgatttgtaaccgtcaccaagtgaaatcctggaaatatatatatatatttttcgaatcagtggaaagaattagaaactatagggaaacctgttttgaatagcttaacatttggcaataactgaccacgagattctctacaaataaaaatggctacctttcgtaggaggatatactgagaaagaacatatggagagaaacttaaataaagtgctatggtagaaagatatagaaccaacttgttgtccctgatgctttcacagtaggactcatcttctttgtgtctttttctttaaattcataacaatatttagcaccttgtgtcagaagacaggcatttggcataaatagtcacataatttctgaaactaattctaaaaaccacctcttttttaagtttctgtcttagattgcttttttttttctttttgtttttttgcttttttgggcatattttcttgaaagaagcaaaatctgtttcattcatctaattatgcaatgcaaagatatgaatatcactttggagtctaagtgcatccgtaagcaagtcttgcatgtatgaaccaatagaggcttctcagttagtctgaaagtcctttgaggacagggtgtgagtcttaggcttcttagtatcctgtatagctcattgtcaaaagctcaggccatgtgctgaatcagtatgtagtctgataaattgtcaggttttctgcatttgaggtgacctttaaatcttattgccaatcctaaagcactctatattggcttttatataatccactcggaaaggatgtgaaattaaatatacaatcgtctttttgacaataagaaacttgttattttaaatccgatttggggtatcgatgatactcagaatgactatgaataaaaaagatttacatagtaaatatattctataattacgatttgaagtagtcagtaaagaccctttaaaatgtttaatcttcctacttccaatatctacattcagaaaaatactgttctaacacaaactaccccaaacttctgtgccttacctcgttcactaacccatatggtaatattaatgtgaaaatcttctcttaaatttctctccatgaattcacatttgttgtttcaatgattattttatctcatggtctcaaaaaataatccttgacaagttatcccaagataaaccttccctgacttgctttctgtcagcatctggttctacagtgagaattcttctggaatgtgcttttattatatcctgccatttaattgcttttcagtataagaaatctaaatgttcttcacattctttgtctttatatacgatgcttaattttgcccagtctgctcaaatttggggcacaaagaagtagcttatttttatttaaagtttaatgttaaaagaaaaatatttatagacaatgtagaaaatgtaaaaaaatgcaaagaaaaatcctctactcaattatacctttaacatttttggtaaattctttatataccagagattgtgtatagtgagttttaattatgtttagtgaataaactaatccatgctaattcacttaaaatatcaagcttcttttttttacaaaaaaaagaatacttcgttgattttcttaattcacaaataataatctattatatatatattagataaatatatacattggtaatggttctcattttgtcaggtagtacatttagattgactatttagctctaaatcaagatcctggtaacagtaatcaaaggtaaatgagccataggagataacaatcttattttaattgaggtcttacctaatctctctggataggtaaagactcaatgatcttggcttttattacaagcccgcatcattatgttgtaatatattaattttgatcccaacaaaatacctttaatcttaggccttagaggcagtggggcaatgaaaccttagataaaaatgaaatgttatttttatatttaagtaaagaaaaaataaggatttcttattatattctttctgtgtccagcctctttgaaaaacctgaggtcaggtgaggcctaagggcagtgaaaagttgaattgatcttcccattcatttatctcctgaatgagtctgaatttaatttatcttaaacaaagatgttgaatggatgcttgatatggaataagagtctagtcctcaaattaatttttatggatactggaagtgtttcagaaattgagctggccagttttatcattttctattagatgacaaagatgttaaatgttatatttcattacagaaaataacgtattaaaatatttttttaataaaacagtttttattgcctacacattgtaattcaagacataatcaactgctagtctcttgcactggtcatctgaaggtggtaaaatgtgactaaggtaaaaatgaatggtctaattataggaatgacctatcctcatgagaacgcaagttttggtaaaacatgctgactacaagagctttcgtttatagataagtgctcttctttacaaagattccattttattgactctgaggcatctagttgaaaaagttatttttcttctaattcagagctcacatttcttagaggaagtttaggtaatgacaaacctttccctgaagtcttttgaaaaccatagaaatttttactaagcaagagcaccattgtttataatttagtccattaactcttttagatcccttgacacaggtctgtggcagaagcaaccaatagtacagttctaacaaggtgaagtgatttacgtaattatgagatattgaatagcaatttttaaaaatgagagtagtgtgctagataggacactgaggcatatttgaatgttctgtccttgaatgtcatctcatttaaattcattccaaatcaatttacaggaccaaaatcccaatcattactacttccacttcctctctgtaagttatgaatgaggcttaaggggaatatactacagatgaaatgacagaacagtgggacttagtcaacccctctctcacaatcactacctgagacaggctaggagtaagaaatgcagggagggaactgggaaaagaattagagaaacattaaagaaagtgaacaaacatatttgccactaatggatttctttttcttcaatgttcaggactatgattctccaatttttcagatattttcctctctcagggctggctctgcctgttgaatatttttcttcaccaatattgagcattttgctttatttatcatttcttattatttcctgctcagtctgaaacactcattttccatatacatatttttccctatatttattttttaaaatagtgctaattggttaaatgcttcatgaggaagaacattaggcacatatgaaaatgatgccacattttgtttacaaaggtagagaaattgcctgcttcacataatcctagaaggtatgtagcaggcttacttgataactctaatttcataatagttttgttatcatgtttttttgcaggcatgactttaactctgagctaacttccagggagaggaatcagtctgtgaaaatattggctttcatgtctgggagcaaagttaagttaaattgctgtaacgtaaagaatatgtatgttgtcataggtaggatcagattaaagttcctttaatgtgatgcagagaaattggaatttaggttgatgttagtgaaaccagggaaagataataacaatagatttttaatatactgcttttttatgattttcacacaattagaataagattttcatctgcaaattctctaatatgttctctctctatatatatatatacacagatatacacacacacagtcctcctaagcataagatatgtatttaagaagggcctttaggaaatcctatttatgttatctttttctgtgacatacattagttgaatatatataaagtaaaaacttggatttaaacaggaaggaagtggttggaatacaagcatgtaagggaggtgctttgaaactatgaaagacagtcttactctttaattttgcttttgtgatacatctatagaatattcttcttataatccatgattttagtgaagacaccagaccaaaatagcatacattaccaaatactgaggtactttcaatattttttacttaaaatttgctttctttgttcattcattctttctttctgcagggtatgaatgacattttaagataaatatccatctgttactaagtttatctgtttctgttttctaaagcaatcattctgctatgaagtgctccactatctgcagggctccaaagttaataaatcaattagcaccaattaatcatttatataactcatgacactagggggcaaaaaaaaaaaaagctcaagagtgcatattacttctggtactgacaaagcatatctaactaaaacctaattcattcaaattttattcagttgtgattcattgaccaaatgttatgattttggcacagttaatgattaaagtacaggattaaactttggatttgggatacaattttaatcctactctctactcttttttttttttttataatgcagtgtaatgtggaaaggcaactgagatatcaattataattatcaatgtttatttagtctggatctatgatcacaaaattatgtttcttttcatttaactatgttccatgggacgttgttaaaacatctgatgcttaaagagcattcagccagattattgtaatatgtgctagtgcttgacagttactataatatattaaatgctcacgattaacctgagttttatttctatttaagaacctgtcaaaattaagtatacttttcattttttctgtgctagacctttctttgatcttttttttggtcctattgatacagaagtttcatttccacaatggagttggactagtctagagtttactctgtcccattgttctcagcacaaagcagcaatattcagaaaatacttaaagagttcatactctctgtttgaaggtggcactctaaggggtcttaaacatgaactatcctagcttacttgaagaagagagaggtaatcccagagatttttgcccattgttaaactctgtgaggaatccaattttgatgctttttattatctttatttcaatccaaacaatgagtcagtggcgaccctccattttaactcataaacatttgggattctcttagccaggtttctttgacattgggaagaactagcataattgccattcagataggcttttagcaatatattttgaagatatttattttttgttcctctctcaatatggtttatcttctaaaaagaggcacatatgttgatatactttgatgaaaaagaacaggcaatagtgggaacttttctgattatctccataaatatacagattgtaatgaatttctataagggaagtcaaaatggcactgattttgtttgttatggatagttcaaaagtaattttatttattaaaatattgcagttctaagagtaaatagtaaagacatacaatcactttctctctgacaagtagttgtacatctggatatgtttttaaatatttcaggccatagtacattaatgctaacaaaagtgtgagaatctccttttagtattgttaaataagaatctctctctctctctctcacacacacacacacacacacacacacacacatttatttgttggcatcttctagaaatttctttgtgttctttcagtttctttattcttcagttccacccctgcctcccacacacaaaccccacttaatccagccttgagaaaatcagactttacactgagcatgttctttcttataaattgggtcactcaacagtcagcttctgggctatcgtctcattttctttgcaaatgctttactctcctttaaagcttaaaaatttcccagagaagagtcctaaaaatctttcagacccaaagctcaggatacaaatggagctgaatagagtgtgatttataattggtagtgctaaagcatttggttttgtgaccatagacatcagcatcctaacaaggaggaaactgcaaattcacagggctggacatccattcctggtaagatgtctttgcagaggtctttctaagtgactattattgagaatatggttcaaccctctattcatagtcgatgtagacatttttttgatgaagcataagagttcccttttataaaatttcatggataattgaaaatataaaaggaagtaaataattctttatagtcaaaagcagatttctcagcatgtttcaagggttactagtttcagtagacattaataggcaatcaacaaacaaaatgatcctcttgagagaagcactggtttaaaaaaaaaagttaagtttccttactgcaggaatttctataatcttggatatactcatgtacaaaaacctctaaagagtggataaatttacagaaattaccaaattagtcaccaaagaacatctcaggggagcaggattatttggattatattttagaaagtgttgttgtaaatgctgatggcacatactttttaaaatggtgattctcaccaggagaagcatctctttctttttattattttattattattatactttaagttttagggtacacgtgcacaacgtacaggtttgttacatatgtatacatgtgccagtgacttgtctgaggacatgctcactcttcattaatcctcatcaaaatattcaaattcatttgcctttaccctctgatcattttctatggagtggccataacaaagcaacctggagattctgctttctacagagacgaactaaaatgtgttgaggacatcacctacttattcaagcccctaaatgctgacaaactatcttacaaggcttttctggttatgcttctctagctgcttaaaatcattaaataattcataattgctatcagtataaaatcctgaaagatagaagtgttatctcatattactaatattctctttattgagtttagtattatacacatagtaggtgatcagatggtagaatgctgggttaaatccaaattaagcttcaaaacatcctaaccagacttcttagatttagcgcaaaacctatcctctgtctcaccccttcaaactcgcagtgcaaatcaggcacttgctgtcctttaataataacatagtcatcctccacatcatagaacttattccagtttataagtgtgtatttgtttattgatatgctttcccccaccctctactggacagtaagttgcataagacaggatctatgtctgttttgatcattttgtctttatacaaaaaaaacctggcatagtaacaggtgcattgtagctatcaaataatgaagattaatgaataaatacatatatccatgtatatattgtcttcatctgggtatttcactcatgagatcaaccatgtagcaacaaacccatgagatattagctttccaaggggaaaacataagtactaatcatgactactaatcatggtcctcctgaaagtgcatgctatagagaaaaaaatctgtaagtagggatttctgagaaggaatcacattagagtataaatacaaatatttagcattcatcattatttctgataataaattgctttcttcaaacaaatgctaatgtgtccatgatcagggttaggaatcaataagaataagacatttaaatacctaatattaaattataagtaaataaaaatattttgtttaaggtcactggtgacactctagcatttctccacaagtagtgaaatttccccccatttaatagagcaaaagaatatgattgtttaattaagttagcctataatacaaaattagatgtcagtcattaaatatagatatcctgtcaaaaactgtataaacaaaatctatcaaacattttaaaattttggaaattttatcttcattttaataattaacaatatttgatctaataggttatataggttaatagatatctctattttatgattaacaatccccaaagtattcagagcagagaagacaaatctgaggttttaaagtttgccctgaaaagaaaataaacacttcatttttaggttagactttagttattgtggaagctttagtggaaatgtcctataaaacttgggtattaaccttctttaatttttgtgtttttcctttccattttctggttgcaaatttacatactagtacctttatttaattcaatcaaaagcactctgatcctaacattaaaatacccaaaaattttaaatgcaatgtacatgattatgaattcactgaggagatttacactattctcattaatttggggattcagggaaagttaaatgcataacttcagtattggcatatttgacttgacaatttttctgctcgacatctgtaatagttgttaagtctacatctgatttttgattaaattatcagaaatatgctaagctccagactgatcatcatatatacatatacccacacacatatatatgtgtacacacacatacatatacatatatgaaatataaatgttatatcttctatagtaaacataaacaccctgctttgatctcacattctgtgtagctactgtcaccattttacagcactaaaaattattgttaaaaacaagaatctgcatttgatcttataaactgtatctctcctttctttgctaccatgtccagtatggcttgtctcactttcattatacacaactttctgttttcaagtttgtcagttgtttacattttgcctttttattttcattttttgatcttcatattgacatatatctcagcagcagttaacctatttgattccttcttcttactttttttttttttttttttttttggtggggtttagggttgactttcatgacttcacactctcctggttttgtccctaaatggctggcttctcttgtttcattgctggttcctcgttttccatttggtctttcaatgtctcatcatttttcttagttgaattaatccaatgaatccaattacatggctccctataacatctgtgttctaattatttccaaatttaattttacctgaacctttcccttagccacagatggcttattactttagcctcttttattattattattattattattattttgccagtggaattaactttaatattaccataaaaaagcaacttcataatgcactgtgtttcacattacccttgtttctctgtccttaaaatgaagggcaacattcacaattttaaaatatgagaacctggtaatgaagactaaacaatgtatattctggtaattgaagtcgaattttatagttggtcaaaagtatgtcacttttattttaatttttaagatgtttaattataataattttaattgccacataaagattctacatatttgagtacagtgtgatatttcaatatatgaatgtaatgtataaatatcaaattaagataattagcaaatatatcatctcatttatcatttctttgtgttgacaacattcaaaattcattctcctagttttgaaagtataaataaattgttgtttatcatagtcaccctatagtgctatagaaaatgagaatgcatttttcctattcagctgtacttgtgtatctattagcccacctctggctaacctccctttcccctacttttcaaccttctagtaaccatcatcctactctctacttctgtgagtagaacttttttagctttcacatatgagtgagaacatgtagtatttatctttctacgctggctcattttgtttaacataccacaaattcttaacatctcaacttggatgcccaagagaaatttcaaaattatcatggccaaaatatgcagccatttcagtaaattatagtgacatatacacattagcttaagacaaaaacttagaagtcgtccttggtaactctctttgcctcatcatcacccttatatttaatccgtaagtaaatctctttaacctaacttccccaaatcagtccaatacatatagttctcttaattccaactgctaccaccgtaatccaagctgctgcaattttgttaaatgaagaattctgtttttaatattgattatgaacactatcaaacaatcagggcaggaaagaaaataataaaattaacttcattataaccacattcactttaatcattatcaatattttgccacttttttaaatttttccaccattatttgtgtaccaccccttcttctccactggaatattttataccaattactagacatactatgattctattcattaacactttagaacttcaaacaaagcatattgcaattacaaatttaaaaaaataagaataattcatttatataatttaatatacaatctgtatttaagttctttgagaaatatgactattgatttatttaaattaaagtctaaacattaaaattagttgacatttgtcacttattctttaagttgtaagagttccaccacagctcttaggttttcatcaagataagttattgaagaaataaataactgccagtgagatgctatgatcctaagaaccatctcaattatatgcaccatgaacactttttctctcccacttccatccttcatcaaaacacaaaaaagtcgctataactagtatatacttctattgctgtacttaatgttttattataacttctttgcttacatagtaactttctgtaatatagtataaattgcttagaaggcaattaaggtggggtagtgctagcctaacaggcagttcaaatgtaataactaatctcctatagtttcaagatgaataatagaggacctgactctgttctagaagttaaaatattaaggtttcctaattatataaatacttcagattatttagtcatgcctttgaatttttaactataattatattatcaggtaaattgtataataaaacctttcatcaagaaataacatcagacaaattttgataaacataaatcttaatacagtcttaattatgctgacattttactttcttaataaaattagatttcctgagggctacatcttctacagtcaatttgttctttatatctaacttgaaaaatactaacatcaccagacagaaaagacagtgctgtataatcagagctttccattttaaattccagagttcatattgcctgtatgtgtagaatatgtatactcaatgattttctcctgtctgtgaatttccattggataccccctccctcacaaacaccaaaagcaagatctttccctctggctttgccaggttgttaattgtcttttaagaagcttgattcaattctgtgtgtgggaagttccacatatttttcttttgtcttctcaggcattgatcagccattctaaaagtatcggatcttttttaactttgtactaaagagttatatcctacccattcaactccctttatgttgccatgaaattgatattttcatattcatttatttatttaacaaaataatacttgcacggttgtcttttccttggtttcacttaaacatgaaacctccaacgacctaaatcattttatttgtctttcaaactgctttcttaaatttttcttctgacgtactttcaaaagaatatgcttggaattgaaaatattttgttctcctgatataaagcatgcaaaagtaaaacttatccttgctacttctgttatatatcctatttatcttttccctcctttattctcttaggggcctttcaagaatctcttttaatacttagtaaaacagtaataatttgcttttgtacgagttcttgtgctgccacttaccagctatttgggacaatctatttcaaattatttgcctcgttctccatgtgcacatataaaaaatccagcataatatcttctctgctgaatattagggtatattaaataatatatgtataacccagtcacttaacatatctgtgctcccttctctatctcctcaacatgacccccgtatctttctgctgcactgtgttgtgaaagccacagggacagtaatcactccttaggctcctttaaaaataggcacttattcagataaaatacagcaataaaccttctctaagtctaaataaataagctctgtggaaatgataaataaattgtttccctttgtatttacaatttgttgaatccaggtctccaaatcttttcagtgtcttaatgccaggcgagtgttggagttttaagttgtttcatcaagttgatgtttagaatagatatgttcctattattccaccactttcttgaacacttctgagattaaaaaaaacaaaatatgtatacatatacatgcatataaagagatatatgcatatatatacatacatagagagcacataaatacatgtatatttccatatagagagagagcaacaagctctttctatatatttacatatagaagatgacatatacatttctctacatatagaaagatttctacatatagaaagattacacatacatttctctatctagaaagatagagcataagctattttgtaggtatgtaaatatatagaaagcatatatagaaagcatatatagagagatgtatgtaaatatatagaaagcatatttatatatagagagagtaaacacatttaaaaggataaagtaaatagtcttcagtaagaagataatttaatattgaatatgtttctaaactttcttgcatgtagtaaaaatagagattccacctataaattccttagcagacttatcaaaaggagaaacacaatatttctgaagaggaagagaattttctacagcatttagttagaaaaacaattgtcatataagaccttctttagttgttttgaatgatgctgtgcataatgtgcttaataaaatatttataacgataatgtgactattttgtggtccttggcaatgcaggtccttggttgaaacttttaaaacttgaatttctaagagcccatttagagattttccaccataaacatagaggcctgtcttggagatattgtgggttgggctccagaccacttcaataaaatgaatattgacataaagtaaagcacatgaacgttttgctttcccagtacatatagaagttatattaatgctctactatagtctattaagtgtgcaatatcattatgtctaaaatgtctagggttaattaaaaaatacttcattgcttaaaaaaaaaaaaggtagtagtgatcatctagatttcagcaattcctaaatcctgttttgctagtggaaagttttacctcaatgttgatggctattgacttatcagggcggtgattgctaaaggttggggtagctgtggcaatttcttaaaataaaacaacaataaagtttgttttgtcaatttaccattgctgtaacaaaagacttctctttaacatgaaatactattttatagcattatacccatagtaaagcctctttcaaaattggagttaactatctcaaaccctgccacttctttatcaaccaagtttatgtaatattctaaatcctttgccatcatctcagcagtattcataatatctttaccaggagtagattccatctcaagaaatgacttgctttgctcatatatcagaagcaactcttcattcattcattcaaattttatcataaaggtgcaaattcagttgcatctttagattccacttctaattttatttttcttgcaatctccaccacctcagacacaccttcctccattaaagtattgaattccccaaagacatccatgagggttggaataaactcccaaactcctgtaaattttgtagtttacaggattcctcataatttgacctccccactgtgacttacaaatgttcttaatggcatccagaatggtgaatcctttcgaggtttaaaatttcctttgctcatgtctatcagaggaatcactgtctatggcaattatagtcttataaaatgttttttttaaataataagactcaaaagtcaaaattactccttgatccctgggctataggatgaacgttgtgttagcagacataaaagcaacgttaatctccttgtacgtgtccatcagagttcttgggtgaccaggcagtaatattttgcaagaaatcttttgttctgagcagtagttctccacacaagtcttaacatattcaggaaaccattctgtaaacagatatgctgtcatttgggctttatttttgtatttttaacatgccggcagagtagatttagcatacctcttaagggccatgagatttttgaaatggtcagtgaacactggcttcaacttaaagtcactagctgctttagtgtctaacaggagagtcagccagccttttgaatctttgaaaccaagcattgatttctcttctctagctatgaaagtcctcagtagcattttcttctaacagaagaatctgtattgaaaatctgttgtttagtgtagccacattcatcaatggtcttgcttagatcttctggataacttcctgcaccttctcaatcagcacttgctgcttcaccttgcacttttatgatatggagatggcctctttccttaaatcttatgaaccaaactctgctagctttcctctgaagcttcagcacctctctcagccttcacagtattgaagagagtgagggccttgctatggattagattttgatttaatagaacattgtggctggtttgatcttctatccagatcattaaaactttctccatatcagcaataagtttgtttcactttcttatcatttgtgtattcactggagtagcacttttaatttccttcaagaacatttcttttgcattcacaactttgctatctctttgacacaagaagcctttcagtctaactaggcttttgacatgcctttcttactaagcttgcttatttttaagtttcgatttaaagtgagatacatgggacagttcctttcatttgaatatttagatgcctttgttgggttactaattagtctaattccaatatgactgcttctgaggaagaggaaggcccaaggagggggagaaagacaagggaacagctagttggtcgagcagtcagaaacccacatttgttagttaattttgcattcagtcttccatggtgtggtttgtggcaacccaaaataattacaatagtaacatcaaagaccactgactacagatcactataatggaaataataatcatgaataagtttgaaatattgtgagaattaaccaaagtgtgacacaaacagaagtgagcctatactgttagtaaaatggcactgataggcttgcttgatgcatagttgctacaaactttcaatttttaaaaaatgcaacacttgtaaagtgcaataaatcaaaatgaaataaaatgaggtatgcctgtatttgagaataaaactgataactttgtactgagcttcttcaaacaagttaatatgttgacatacacaagcctactgatctaaatacaactctcgaatcacgtaagaatgtttagaaattcttgtagtgttttctaaacaatattgaaactatataatgaactgaattcaagatttctatactaaaatgtacgtgctatatttaaataaaacacatatatattcaaatcaaaggttcttttattttgtagaactatagaacagggactaatagaggcccccttttttatagctttttaccacttctgaagcaaaacgtgttaaattttgtaaaggtaattttaaaaattagtttcagtctagtctgtgaaactaaagtgaaaagccttttacaattttttacggataccttttgcatatattattatatcatgacattttaatgcaagaatctggatatttgctatgacaaaaactaccaaaaaatagagctttatccttaaacaaacgtttcacctttttatgtacatatgctatattttactgtcttgctttcataaaaaaaataaataggctaagctttgttagctggcagagacacagtattgagctatttgtgttgcttgtttttcttaagactaattacttataatcaatgaggtttttatagggccacttctttgaagagaaggaactagtacatttcctccatgagctcaaacattacacaaacacacatgcacacaccgcaagatgtgaataggcaattcatagacgaagatattaaagctgaaatcacatttataaatatatacataaagttattcaatctgtgttgcccaaatgaaaggaataaggtcataatttttcaactattaagatgagaaaattaaaatagtaataatgaactactagatatacacctgtaaaagaatggatttgggctatatcacactatattaaaaattagctccaaatgttaataggcataaatataagtgataaaactatacaattataagaagaaaacatggaaataaatcttcatgaccttggattaggtactggtttcttaggacataaaaagcataagtgagagtgactgctattgggcacatactttcttcctggggtgataaaagttttctaaatattaatatactaaattgtacaccttaaatatgttactttttggtatgtatattttattttaataaagttgttaggtaggctaaaatgaactattctacaaaatttctacaaaactattctacaaaatacacacatatatatgtgtatttatgtgttttttatatgtgtgtgtgtgtgtgtatatatatatataaaactttcaaaaaaataagtccatttctgataatttattttgtaaaaataattgtgagaaagcagaatcacgtaagtaaaatatttcacagcactttcagcaaatgaaaagaaatagattaaatattcattagtggaaattgattaaatacattgtgctcttcacattcaaaggacataacaatttcacaaaatcagtaactctaaaggttctcacctagatggtgtccatgacacatattaaagaaagaacaatttgaagattatatataatttttcattaaaaaatgaatgtatacagtagacatatagacaggcacttacccacaatatccagaagtatatgccgtagtctgttaatggcacttacctcagtataatattggttttgtgaggaggaaatatttcactttttatgtcatatgttctatatatttatttttaaaatttgcacatatctgcttttgtataattttaaaacattggatctggaacaaaaaatgttcttctcttgttagaacacaagtctttgttgttctagaattgattattcatatctacctgtaagtcttttattccaattatttgtgataatagaataaagctttaatggtgctaataagtcctcgttgccacagataatttgaatatatgtgtgctatctgttataattatgaataactctccacttcactctcaaaattattttagttttgataataaattatatggtaatgctaattataataactaaaatccacatcctatctgatcttctctaagtacagatgtgtaaggcaggaggatcagatagtttaagcagtatcaaatcaagcatacactatgcttttataaatactctcctcctccccttaccgattttgatgaaaatatgccaggaagtaaatattcctgcatcacactcagaaactcgttgaatattatttaaactatctatggacataaggggaaaaacaagtaatcaatagtgacagaagtacatatatataggaagcaagtcaatacatttattaacctacaatgccttttagctgttacttaagccaccattttgtgggagaaattattaccttagtcaccagctaaatgcctaaacatttagaaactagcttctgaaaattgctcaattcaggttcattcatataaatatgtttagagctgtatctgacacatattaaatgaatcaataaatactagcttctgtcattttctttcattgtctcatcttcatcaccattattatgatatgtatgtatacatgtgtgtacaaagacaacatatatatatatattctcattacatgaattctttaacatttccctagttagggtgatgtgtatgaaaaatttaatagaaacctaccataaatctgaaagttttattaatattaccatatgaaacttgcattgtggggaaaagtacaccactttggattttcatatttttaaaggaaacataaaagcatatcaaggcacaaaactaattaaaccatgtctctctttacaattacgactcttcaaatacgttagaagcccacaagtaggggagtgaagtgttatagattgaatgtttgttatgtctctcccaaatttacttattgaaactctatccctccaatatgatggtatttggagatggggcctttgggaggcaattagggttagataaggtcattagaggggatccctcatgataggtttaataacctaataagaatagactttggagagattgcttgctctctctctgtctgtcatgtgcggatgcagcaagaaccaagactaagacacctacaagccagaaagtgccctctcacctggaaccaaatcagcctgcagcttgatcctggaccacccagcatccagaagtgtgagaaaataaatttctgttgtttgaaccactcagtgtgtggtattttattatgttagcttgagcagactaatatagcatgccaactgtcctttagaagaatcctaaaataatttttaccttggtactaagttaactctggaaagatggaacatgggggaggatgtacttgcagattaaaattattcagccaccagcagtatcttttatatgctgatacttatggaataatcgttatggataatggatgcagttatgacagacttttaatagaatcatatccctaaataacacaaaacaaaaaaaaatttgaaacaaaatagacaaaacataatttaaataattgcttagctattccaaagatgtaaacgtgacactttaagaaatgaggtgatggccggctggccatggtagttcacctctgtaatcccagcagtttgggaggccaaggcaggtggatcacctgaggccaggagttcaagaccagcctggccaatatggtgaaaccccgtctctactaaaaatacaaaaattagccgggcgtggtggtgggcgcctgtaatcccagctacttgggaggctgaggcaggagaattgcttgaacccgggagacagaagttgcagtaagccaagattgcaccattgcactccagcctgggggacaagagagagacttcatctcaaggaaaaaaaaaaaaaaaaaaaaggagtgaggtgatggcattcgcctacagcttcttcagcccaaaggattagatatcgtatcattgctggctgcttgaaggagaaatattaagtaagtacatcttaaacataatttggcactgtgtccctgacagttaacttggtgactgttggcatcctatattctatttataaacttaatttagatccactgtgagaacatccttggggctgagaaaaagaagtagtcactttctcaccttttaccatcttcattttcagtctaacctttagatttaatgtgtatggatgttttgttgaattctcagcttgagatttccacatgcctgtatatttgtccacaaaacaattgattatgttgactactgaagacatggaaactatgctttggatgcaggttgggggaagaatattaagactaaaaacaaaacttttattattcaaatgctgccttatgccacataatctcagatgtcaagtgattactgatagtacactgacaagaataatgataagaacctaagctttcagaaagacaaagcatgaagataagtacagcctaaaattccaaaaattctaaaattaagcaactttaccatcctcagcataacttcttacttctatttatataagaaaaaaaaaacacctgttagtttgttgccataataggaagttctgttatttataatcacatatttctgagacagaatggatttatgttttcacagaattaatggtataccaaaaagatgaattcttattgaacttagtgtcataaataagtcagatgtccatgccaaaaaatgtttccctaacagtgatacttattggaaggagagtctgctaggaagctagagataacctgaacataaattaaaattaataagtgaaagagtgaggacagagaaaattaaagatgagatacagcaaaggaactacagtattactatcctcacccccccatacacaaaccacgtgttctctttggtagaagagaaagtttctgagttacatttcagaatcatggaggagcccagtgtacatgagagaatagaacatgtatgacagtcactgctggatttcagaagtcatgaggtcatacccacacctgatgctttagacaagatcagcccttaagacacaagaaaaagggaaagtatgtcttcaggattcttatttttttatgtaacatatactcaacttagttattactgaatgttaaatcaatttggggaattttccagtgtgtgaaaaaaaaaagctacttcttcctatcatgaggagtgtattggggcagggacagtggggtagatctttaattttcataatcaatgaaacaaaataatatgggtgaaaactggggaaaaagtctttatttgagtgctagccataattatacagaagattttggcagtatgctagtttgctagtttaacaataaatgataatcacttttattcaaaaaaaatagatgttcttttatgcttttgaatgactgtgtcacttttttggtgacaatcaatgcaaaagactacatttatgtatcagcgacacttcagaaaataaatctgtagctatggtttccaaagtattatggggtttgttttctttgaaataatgaacaaaaagaacagcacacacacacacagaaaaaaaaaaaactagaaaaatttagaatggaattgaaggtgaaatgaggacatgtgaaacaccaaggtttactacaagtaaattaaaataaataaaagaaggaatctttattaccggtgtgttcataacactttggggaaaatactatattaaatattcggggagatttggttttatttattttcaggtgtgcatatatttaattgtaggacagataattatattaggtggtttcaatttgtatataagaaaactgatactttaggaaccagaaaacgtgtttggtttatttaaaatataaataatacatctgcgaaaggtataccttcacttactccagataacttagcaaccctgtgatatttctatgggagaacaactgtagaatgtaggtcccttgaaagaatactgtgccatttttaaaactgaatgcaattttattttattctcagattggtatgattgtgtctatgtgaccatgtctctgaaaaaagctatctcagactatgtgcattatcccaaaacttcatgatggcttcccaagagatgcagggcttctcaactttccatttgaaatatggccttgagacatacagtttgtattgctatgagcgaggaaatagagacaaatggaatcaatgcccagcactttgggaggccaaggcgggcagatcacctgaggtcaggaattcaaggccagcctggccaacatagtgaaattccgtctctactaaaaatacagaaattagccaggcatggtggtgcgtgactgtaatcccagctactcaggaagctgaggcaggagaatctcttgaactaaggaggtggaagtttgcagtgagctgagattgcaccattgcactccagcctgggtgacagactgagactctgtctcacaaaaaaaaaaaaaaaaaaaaaagatggatcaagggactgcaatatttccgggtagctatatttaggtattgttaaagtgtttcacataaagatgaagatatgtgctgagacatcattgagcagttcggtcattgtgtaactggctcaagtctggctgcttgccactcagagcctgaaaacccaagaagtgaggtgtgatggaaaaaaagcagccttattcagctggtagcagttgagatatggctgggctcatgcctttaaaatatcattccaacttccggtgctgagggaagggatctaagaaggaaaacttggtgtgagaaacaactgggggtgatgcaggagtgtacaggtctgtgtgtctggttccgatgatcatcttcagtaattgcctgtccggaggtccagtttgcgtcatcctgatttcagcctagtagtggtaggctaacattctaaataaaaataaaccttttatgctaagttcagaggtacatgtgcaggtttgttatataggtaaacttgtgtcatgggggtatgttgtacagattatttcatcactcagatataattaagcctagtgcccattagttatttttcctgatccactctcttctcccacactccaccttccaataggtcccagcatctgttgtaccctactatgtgtccatgagttctcatcatttagctccctagtaaagtaagaatatgtggaatttggttttctattatattaatttgctaaggaaaatggcctccagttccatccatgtccatgcaaaggacatgatctcattttttatggctgtgtagtattcaatggtgtatacataccatatttcctttattttgtctacctctgataagcattaaggttaattccatgtctttactattgtgaagagtgctgcaataagcactatttgcctgcatgtgtctttatggtagaacaattcatattcctttggatatatacccagtaatgggattgctaggtcaaatggtagttctgttttttaggtctttaaggaatcaccacactgttttccacaatggctgaactaatttgtactcccactaacagtgtatacgcatccctttttctctgcaaacccaacagcacctgtaatttttggactttttaatagtagtcattctgactggtgtgagatgatatctcattgtggttttgatttgcatttctctaatgatcagtgatgttgaactttttaatgtgacttttgggcacatgtatgtcttcttttgaaaaatgtctgttcatgtcctttgcccactctttaattttttttttcttgctgatttcagttcttaatagaagttggatactagattaggtctttgccagatgcatactttgcaaatattttctcacattttgtaggttgtctgtttactctcttgatagtttcttttgctgtgcagaagctgtttaattagacatcatttgtcaatttttgcttttgttgcaattacttttgaagacttcatcatgaattctttgctcctttttatttccagaatggtattgtctaggttgtcttccagggtttttgtggtttttagttttacatttaaatgtttaatctatcttgagttgattcttgtatactatgtggtgtaaaaaaggggtccagcttcaatcttctgcatatggcgagccagcaatcccagaattatttgctgaatggggagtcctttcattgttgcttgctttttttttttttttttgacagctttgtaaaagatcagataggtgtgcagtcttatttctgggttctctattctgttccattggtctgtgtgtctgtttttgttccagtaccatgctgttttggttgctgtagcaccatagtatagtttgaagctgggtagtgtgatgcctccagctttgttgtttttgcttaggattgcctttgttattagggctcttgtttggtttcttatgaattttaaaatagttatttctaattctatgaagaatgtcattggtagtttgataggaatagcagtgaatttgtaaattgctttaggcagtatggtcatattaacaatattgattcttcctatccatgagcatagcttttttatttgtttgtgttatttctgatttctttgagcagtgctttgcaggtctccttgtagagatttttcacgtccctggttagctgtatatcaaggtattttatgcttttttagcaattgtgaaatgggactgcattcatgatttggctcttggcttgcctgttgttggtgtataggaatgttatgatttttgtacattaattttgtatgttgatacttttttgaagttgcttatcagcttaaggaccttttgggccaagactatggggtttcttcgatacaggattatattgtctacaaataaggatagtttgacttcttctcttcctatttggatgccctttatttccttatcctgcctgattgctctggccaaaacttccaagacaatgttgaacaagaatggtgagagaaggaatccctgtctgttgccagttttcaagggaaatgcttccagctcctccctgtttagtatgaggatgactgtgggtttgccataaatggctcctattattttgaaatgtgttccctagtttcttgaggttttttaacataaaaaaatgaattttatcaaaagctttttttgcacctattaacatgatcatgtgggtattgtttttaattctgtttatgtggtgtgaatcacatttattgatttgcttatgttgaaccaactttgcatcccagggataaagcccactttactgtggtgaataagcttttgatatgttgctggattcagtttgccagtattttgttgaggatttttgcatcaatgttcatcaaagatattggccagaagttttcttttattgttgtgtgtttgccaggtttttgtatcagaatgatgctggcctcataggatgagttagagaggagtccttcctcctcaattttttaaaatagtttcagtaggaatggtaccagctcttctttgtacatctggtatacaattcagctgtgaatctatctggtcctgttttttgttttgttttgttttgttttgtgtgtgtttttgttgttgttgttgttgttgttggtggtggtggtggtggtggtggtggtggtggttggtaggctatttattgctgattcaattccagaactcatcattggtctgttcagggattcttcagtttctttctttcttgttcagtcttcagagggtgtatgtgcccaggaatttatcagtttattctagattccctactgtgtgttcataagattctctgatggttatttatatttctgtccaaaaacattctttacagaattagaaaaaaaaaaactatcctaaaattcacgtggaactaaaaaagagttcaaattgccaaagcaatcctaaacaaaaagaacaagctggaggcattacactacctgacttcaaactgtactacaaggcagcagtaactaaatcagcatggtactggtgcaaaaacagacacatagaccaacggaacaggttagagaacccaaaagtaaagcttcacacctgcaaccaactgatctttgacaaagccaacaataacaagcagtgggtaaaggactatttattcaataaatgatgatgagataactagttagtcatatgcaaaagattgaaataggaccccttccttttaccatatgtaatacaaaaatctacttaaggtgagttaaagacttaaatgtgaaacctaaaactaataaaaaccctagaagaaaacataggaaatatcattctggacataggccctggtaaaaccttcatgacaatttcaaaagcaattgcaacaaaagcaaacatttacaagtgcggcctaattaaagaccactgcacagcaaaagaaactatcaacagagtaaactgacatcctacaaagtgggagtaaatatttgcaaactatgcatctgataaaggtctaatattcagaatcaaaagtaacttaaatcaataagccagaaaaagaaactacctcattaaaaaatggacagacacttctcagtagaagacatctatgtggccaataagcatattaaaagattctccacaccactaatcattggagaagtgcaaattaataccacaatgagatatcatctcatacaagtcagaaggacaattattaaaaggtcaaaaaataatacatgctggcaaggttgcagagaaaagggaatgcatatacactgctggtggaaatgtaaattagttcagccactgtgaaaagcagcctggagatttcacaaggaacttaaaatagaactaccatttgacccagcaatttcattactgaatatatccccagaggattataaatcattctaccataaagacacagacatgcatatgttcattgcagcactgttcataataacaaatacatggagtaaacctaagtgcctatcaaaggtgggctggataaagaaaatgtggtacatatataccatggaatactatgcagccagcaacaaaaaatgagatcgtgacctttgctgcaacatggatggcgctggaattaatggatgaagagaattaatgcaggaagagaaaaccaaataacacctgttctcacttataagtgggagctaaacattgagtacacaggagcacaaagaagggagcaatagacaccagtgactacttgagggtggagggtgtgaggacgatgagaattgaaaaactacctgtcaggtactatgcttattatctgggtgacaaaattatcctagtgtcaaactccagtgacacacaatttattcatgtaacgaacttgcccagctatcccctgaaccaaaaataaaagttgcaaagaaatagataaaataaaaataagaaaataacatgaagggagaagtttttaaaatatactaaaatgtctgttaaaattttgtaaaatatagaaacatggaaaatgcccaaaattaaatatcaaatgatatgagaagtatttcatattctagaagtagatgtttgctaattggttaatttattgtatatgtttcatggtaaatacttttcttctcaattttaaaggcctaaaacattaatgtatactgctatagactttacaaatactgtatacttaccctatgttaaatttattacaaaatttgttcttcaataagaaattaaccttggcttactgtaactttttttactctatacacttttaattttaattttttgattcttttgttataaaatttagtttaaaatgcaagtatattgtacagctgtacagaaattttttatatcccttattttataaccttttcctgtttttaagtttgttatatattatttacattttaaattttttaaattaaatacaaaggtactaacacaatattggcctaggccctcactgggtgaggattatcaatatcactgtcacgcatctttacgtcttgtcctactggaaggtctccatgggcatcagcacacacggagctgtcctctcctacgataacaatgccttcttctggaatacctactgaagggcctgcctgaggtcgttttactcttaattcttttttaaaaataagtctacggagtacaatataaaataacactaacaagtataatatagcaaatacataaactagtagcatagtcgtttatcatcaagtgttatgtactatacataactgtatgtgcaatacttttatacaagcggaagcaagtaggtgtatttacaccagcatcaccacaaacatgtaagtaatgtgttacaccatgaagttacaaaggctacattttcactagacaataggaattattcagctccattgtaatcttatgagactaccatcgtatattccatcttttattggctaaaatgtcattttgttgtgaatgactatagataatttgaatgagacaaattgtatcaatttaaatacccccaacgttaactaaaaccaccaaaatgttcatgttgctttctatggtcatttatggacatgaattggaagattcaataaaatataaagaaataaaattactgctctttagaatggaggaataagacacgaccatcatgtcctaggctagaaaaagacttgttagtacatatcaacaggagaaaacccaccaccctcttctgaaatggaattctaaaaatatgtcctgagtgactattcttagaaatattcctacaattatgtgaaatctttacatggcttgggatttgagaacatttatgaatctgttttactgttgtgtacagtaacatgtcaatctcactataatgactcaaatgtgctagctcttctgatactaattgctataaatgtcagtgtgttagaaatattttaaaatagaacctaccacatttatgtattaaaaacataaaactaaggcataatttaaagaataattttgaagtttaattttgtcttttaacattgtatcatggtttaatgtaagaaatcaattacacacattatttcaagtttgactaatacaattataaaagaaagacttattctgttagctgggttggttgttagaactgcttaacaaaatattatattctacaactggaagagtaattaaatatcttagagttcaaatttctacctgttttttgaagtatttgaatgtaaaccagatggccaggcagcccaatcacttatagaggcaggaaatatattccattattgaaacttccagatattagcaacttgaatctttctaatgggttaaaacaggtcaccactgtagatgtccttcctcaatggatctatttttgtcttttggaacaggaatgaatgtaccttattctccatgtaacactctttttcttgttgtctaaatgtttgcaattgaaaggaacattgaccttccaaatggtttaactctccaccaaaaatgcataatacttgtccaggaacagtggcttatacctgtaatcccagcattttgggaggccgaggtgggagaatcacttgagcccaagagttcaaggctgcagtgagctatgatagatggggccactgcactccatcctgggcaagagagcaagatcctgtctcaaaaacaaacaaacacacacacaaaatgtatgttttttatactttaattacagaataacaggtatgcttgtatctaaatttggaggtcaataaaatttatacatttagaagaggggaaaaatatcttcatgtacactaaaatattacatatgagtatacatttattcctaagaaaatagttttttaagcctatgtttggaaactataacatatgttaaataacttttagataaaataaaagtcataaaaatgtgaaattttaaaactaagtgaccaaatgtaatatatacgtactacaaaatattatttgttaatttaaagaataaagtactgatctatgttacaacatggatgaaccttgaacacattatgctaagtgaaagaagccagtaatagaagacaatatattgtattattcatttttgaaaatatctacaatagccaagtccataagaatataaaatgatgatttgttcagcagcaggggcttgagtgggggaaggagaatggtgaataactgtttaagggtacagggttccttttagtggtgttgaaaattttatataattagattacggtaatggttgtgcaattctgattatgctaaataataccattatactttaaatgagtgaatatgatggtgtgtgaaatgtatttcaaaaatttttttaaaaacccaagtgacaaaagcaacaaaaacaaaatatatcaaaatttgacacagtcatagtaattcataattggaaatatagaggaaaatcaaagaaacaaacctaaaatataataaaggtatggaagaataaagtaggtaatagtaacaacaaaataggctattttttaaaattgctaagttcctgcaaaaacatgcaatactagaattagctcaaggagaaataaaagtcttgaataaatacatctgtaattcttaaaataggaatcacatatgtcacctccccatacccattaaacatacacacatacacacacacaaacagaacaactacaacataaacaaaactcaggcaacaggcccaactggctgtacacataaattctgtaatactgtacaaaagtaattcttatataagcccctccagagaacagaaaaaacccaaaaactaatcagtttaatttataaggctagtgtgatatggtggacaaaacatgatatagggacatgaagaaagaaaaactggcctattttcttccaaatgtagattcagtatcttaaataatatatcagctaaacttacaaaaactgtgaaattatcacaatcaaattagtgtttaacctagataagtgaagttattttgtcatgtaagtatatgtcatctgcagaaacataatttgatacatttcaaaaatgttttaatgataaaaattctcacaaaattaagaatagaggaacacttccttaacttgataaaactttgtcaaaacattataacaaacattaaataagcaaatatataagcccaccatgatgcctactgttttatatagttttagaagataaagtcaaagctataaataaacaatattatctagactttcagtactttaagagaataagtaaagctgtcattatttgcagctgaaaagatcatctacccacaaattctgaaacaataaactataagaactactaaatgtattcagcaaagttgatagatacaagatcagctgggtataagagcaattctctataacagcgaacataaaatgcaatagaaataataaaccgctctcaatggcaacataaaccatgatatctaggaaataatcaaataaaacaaacaagaaaacaaagccctctgggtaaacatttaaatcctgacaaggactataaatgatatatacgctgttagataatatgacagattaaaaaagtcttttatactaataatctataaattatatgaaataaccaataaaaatttcattggattttgaaaattaatactttattttaaattataaataaatatgaaaatgaaggaaaatattttaaattatatataaaagaaaaatacctaattaaaatatctaactatattaaagaaatgtgccttaccagacattaagacatacacatactgtagaccttgaggtcacaataataactgttacgttatttttgcaaagacaattgagtcaatgggaaataacagagaatttagacagtatatctgtatatataattatatgtatatatgtgtatatatacacacacatttctgtgcgtgttgaataattcaaaacacaagaaggaaggggccaaaaacaatgtgaaagtgatattatttataagtttgttagagaaagtagcttatatgaagacaaataacaccgaattcctttctaatacagtgtaataatttagaacctacatggattaaaaactaagggtaaaaagtaaatgtagaggaatattttgtaatgtaagggcgtaaagtatttctttaagaaaagctgaaaaaaaggctaaagcaattatgagtatttgacagctgatagaatggaaaaaggtattttgaatgtttaaaatcaattagaaatttatatctagaatagaagggtatatatataatacacattggcaaattagataaatcatagccacaggacctatgagcaagaatccatataaagccacttctcaaatgataagctgatgtttaaaataggaccgttctctcttccttcttaggggttcaattttcccttagagtgagttttgttatagactagagatagaggagaaaaagctcactcttgagccaagctatggtacgtatctgtgcccacatcatctttggcaggtgtttctcctttatatttttgtaattaaaattttattttcatacatgctttacatgggcaggaaaatcttcttagtggcaacttcactatttgtgagaaaagatggctaaaactgccattttcatgagtttccttgagctctcttggggctaaaaagactttgaaagtatttctctctaaagttccgcgaaagaatgcctttgtgcagcctacgtgagggctgggaaacggactttcctcctggcacattttctctctgctgcgctgaagactgggagtttgatatttgcttttctttataaatgtgaagctgaaaagctgatggctgagttttagctcccatatcccgtctacggtgctaagagagaagatgtgaaaagcataatttgaaaattgcaacttcagaaaactgaaatcttctaggtagacacattccgattttctaaggagctgctttcttccctcattgttctaagaatacatgtatgatatgattttaaacctgtagggcacattgatgaactaaagagactattgtcttatatattcagaataaaatatgtaattttattaaatgtatttggcatgaaagtaataaaatattagttttcatatttatacatgctaatatttaacatgattttctgaaatatactatgagttgcacaaataattttaaaacttcaatttagattttataacataattataagaaagttaattttttgccactttcaatgcagcttgttgtaaaatcctttgaaaataatgcgtaatctctagatgtcctttctatctactgagaaaattctcagcatttttgttaaaatgtttcatgagtgaatgatcattattgattaattatatgaaaccccactaaaacgtatgtgtttgtgtggtataaggcaggagacttatccttggttatttaattttttttttttttggtaaggactaccagattaaaaatctagaaagtatacaacagactatattgaaaatgggtcaattctaaagttatccctaaagtttatttcattcaagtccggtaatgatggtgtaaacagtagcccagttagaaaattgggaagatgcaactttgcaagtggaagattaggggaaccatccttataatcttagtcataaatgcagtaagatatcaatacaatttggtttcccaaaaagctactatggtgtcttgaggcatgaaggcatgaagtactgcattcatgtcaaaggaaataaagctcctacttgcctggccaaactatcattgatgcactgtgtagatctgattgcttgtttgtaaggctgataacccaaaaccgagcccagtcaagaccacgaggcaattttaaacagcttatttcgagaaatatttgatgaaaaagctgggcatgtttagcctagaatatgggagatttagaagcgatatggaagaaagccataagtattagaagatagtatgtagaagtggattttcctcatctgcagaagtggaatagtaaagatacataactcagagcttttgtatgaaaaaatgatgacataaaacacttaaagggttatcatggagtaaatcctcaataaatatgcttgttgtttctgtgcttttataacaaacttacaactgcatgaaggaaaaatctctagcaaatttctgcaacacctatcagccatctttattatacaaatacgctgtgttcacattgcagatgaagtaataagcagaagttttacagaactggactcaacctctctctggtacctccactaactgtcatggactagtttagttcttagcacctaattacacagaaggatcaaactcagagacattgcatgaaataaatgtactgagtccaaagatattcattcaaataactggcttcaatcattgttctaagaaataaatgttatccaaggctggccatggtggcttatgcctgtaatcccagcatgttgggaggccaggtgggaggatcgcttgagtacagtagttcaagaccagcttgggcaacatagtgagaccctttctctacaaataaagaataaaaaaattagctgggcataatggtgtgcgcctgtagtcccagctactcaggaggctaactgggaggactgcttgagcacaggaggtcaaggctttagtgagccatgatcgtgccactgcactccagtgtgggcaacagagcaagagcctgtctcaaaaaaaagaaagctatctgaaattagcttccattacccccttttgatcctgcttttatgggtgattcacctaccagtttgtataatgttttttagtctctatatgagtgactgatgatgctttttcaactgaaaaacacctgaattctagtttcagtggcatcacctaaatactaaaagttttgtggatatacttccacccctgccatctcacacaggattgaaaattggggaaataatgcttcattgtatatatgtttttattacgttgaaagttttgtgaagaactatgccattcactttctcaattttccattgtggcatataatactcttctatttaacaacttagtaaaactgtgtcataaaggatgctaaaattattgtctaatagtttccctcaaagatctggtccagtgagagaatctagatttacaaatatctgtatgtcaaggaagattctgacatattatatcaaagaaaaataacattatagagatttagaaaaaggagaaactgtatttacttaatgatgaaaagaaagacttcatgaagggtgtggtatatgtggtgaaaagaaatcaaggaatatgtagagtaaggcagagcatgagaggtccttccagaaaggtagaagagtatataatattctcatcaaatgttcttccttgagtagactacagctcatttatttgcctggaaaactaatagcatagtggcaattatcagatttcttcaataatatttaggccatgatgatctctgtcctatacatattttccaaagcccagaagggtttttctccaaccctattttttgcctctttctgtcttgcaccctcaacactaacttacccagaaacactcaagcatacatgacacacacataggctctttggccatatggtactaatttcacttccctaaatcttccacgatcattttggcctctgggcttttcgattggttaatctgtcaccctgcaatgttcagtatttcatccaggccatgcactctaccattattaattaatttcctctctttccatgtcttattctagctaccacttctctcagaaagccttctctcatgtcctatctaatgaagcttccgggtatttccatactatcctgaatttccacaatagcacattgactccattgtgttatagctgatgacttgtctttatttgccttcacactgcaggtgctgtgacaacctgagtcctatctctcttgcctccagaattcagcattatcgttgctaaaaataaataataatatacattattgaatcaatgagtagaagagttaatatgtaatagagatgtcagcatcttgccaaaatgtgaattaatagaatgtaaatatatcctatttaagaccagtgacataggagcaggatgattatggttttgagtaaaattattgccatatgtacagcagtttcttggttatgattacacttagaatttgactgaatagacatatcttatgaatttcagtcaaatagaagcaaatagaaggcataaatgagtggacaaactataattaagtaatgcaaatgcaagggaaagagtcattttgtattaaatactcacaaagccataataaaattccaaatcttgatcagaaaaagtcaaaatcaaaacctgagaagaaaacaatgttgccactttattttattccattaggggatatatcaaattatcatgtctatgtctaagttacatctaatatttataaataaattttcaaataaatctgttacatttttcatggtagtttgtactgcatatttagatagtgcaatgggtgaatctgaatgtcaactttatgggattagggatattcagatagctaataaaacactattatgcttgattcttcagtatgtgctgagcccgtttctcttctgctgaaaggaaaacccaggggatttggcatttcattcaaataataaagctgccccatgtgtgtctgtgagggtgtttgcagaggagattggtgtgtgagttggtaaacttagtgggggaaaatctgccctcaatatggataggcaacattcaaacagctgggagtcaagagaacaaaaaagcagaggaagggtgaattcttgctctctcttctggaacaggaccatccttctcctgctcttggatgtcaaaattccaggttcaccagcttttagactctggggctcacaccagtggcccccaggattctagggatttcagctttagactgagcctaacactgtcaacttgcttggttctgaggcctttgaacctgagctgagccacactactggctttcctggttctccagcctgcaggcagtctacaggtgggattttttcggacttcataataaagtgagccaattctcctaataaatcttttttgtttttttttcatatatctctatatatagcctatcagttctgtctctctggagaactctgactcaaacagtttttaaacatttgtgaaaaaaaaaattatgttcatcacatttgtagatagtaccaaatttgacatgcttattgatatcctgaaacgcaggcaaaaatgtcaagacaatcttgcaaattagaaaattagtcactggtaggatttgaaaattttgtttcttccaaaattcttgttgaaactttatctctagttcaatagtactaggaggtgggccctttaggaagtgattaagtcatgagagcagagaactgctggatgtcattagtctttataaaagtagttgaggaagcagctttgttcttttttgctctttgattcttctgccacatgaggacagtgtttgtcacttttgtccttttgccatgtaagagcagacaccccgttggatcattgaacagccctcactagacattgaatctgatgatggcttgatcttggaatttccaaaccccagagtgtaagaaataaattttggttgtttataaattacccaggctctgatattttttagcagcagaaatggactgagacggtttctatctggaataaattttggaaggaacatggtcgtaaaagtagacttcagaacaagcaattcaactatagcatataaataactggctgagcatatattaggaaactcctgtagattacatttgaccactattcacattataatgtatggaattgaaatgtattacaacactttaatcagaatttctttgaaaaaatatttttctaaatagaaataaaaaataagaaaaaacaagtagatttgtaaaaattttgtgttaaattataaagtcctggaaacattaaaaacaaaagagagagaatgaaaaaatcacctcaaactaaaacctaaatggtaaaaataatgttcattcacaatagaaagtgaagtgaagatggttatcataaatttagttatcagactggaccttctacccacttcagtggctaaaagacaactgtagatctagggagttttgaaagcattaaccttgctcataaatattctcccttttatgactaccaataaagagagcaagtttataagcagacactataggtagacaggaagcataatcagaatatattctcacatcttttccatgccaagttacctgcaagtgattaaattttttatgacaaactgctgtgataacctaaagtacataaagtaggtttaaataagtgacagaaactatgcaattatcttgtgacttttctgaaaaatgaatatggaaagtcaaaattttctccttagagcagaataaataaaaaatcagagttacagtgtgttagatgatagttgaatttagtgtgagcattgttgtgtctctaaacttatagaaagggataaacatttggattttaccttgtaattcactacataatgcttgggaaacagtgaagaatgaaacacagtagttgtctccaagactggtgtttttttagggagggtagaccctttaggctgactctttagggaggtagataaatcacacactgggacctgtcggggggtggcaggataggggagggatagcattaagagaaatacctaatgtagatcatgggttgatgggtgcagcaaacccccatggcatgtgtatacctatgtaacaaacctgcacgttctgcacatgcaccccagtgtgatgagtggtatgattaaggctatgcagacagtcctgctggactacataagagaagctcttaacgtgttatgaaatgatgggccatagtgaaggatggtacagcagttagtcaagaaacagtttctgtgttgagttacaatagatgaaaaggttgcttggaggtccagagaaatgatccaataaaataagcaaaatttctgattatgattctacttttaaaacatattgtataaagcaaatacaaataacgcttgatgtgaagggttaagctggggctaaacaattaaatatgtgacatatcatgatttattctgagagcaaagaaccccattaaaagaataaagagggtgacaaggtgagctttacattataaaaaactcactatggttgtgtaaagaaaacctgagagacaagaaaaacaggcagcacgacaagtcagattcaactctaggtgcactaaagaacacataggtagcttgaaaaatacagagttctttgccccatccccaaagactcttttaaatcgtttggtatagggttctcttttaaataatttgatgtaggattctggaacaggtataattaaaagctctcctatgcgcttctcaagcatagccacagctcaaaaatactaatttaagggagtattacaacagtcctgttgaaaaactgatgatgccctgaactaagataactgtagttaagctggagagatcaagaccaattaagacatagtttgcagattaattggttattgaggatagcataggaatggagtccaggatgccagcttgggcacatctaaaactggtaagagtattccctgaatcacagaaaagaggaagagtgtagacttgggatatgagcttattagaactatctggagtagagacatttttccaaaggaaaaaataaactgcacagctctaaaggaaatacactcacttcaaatttgacaaacaatgttgaaaaattctaaaaccttttgttgaaagcctattatatatttcaggtactgtgctagactctggagatattcagatggatagcacacattccctgtcttgaaaagcttataacattattgggaaagcagatatttaattaggtcattttaatatgtcatgttaattgacaataataattgcaggtatcatatcaaagatattttaaaaactgtattacagccacaggttgacaagtttacttcgttgtccatagtgttctaataacttatgagaaatattttattaattattttataaaatttttatgaaattggtattagaatctcatttcacatataagaaaaatgaagcccagcatctcagtacaagaactagaattcaaactctgctccttttcactgttcttaagaattacgagttcatgtcctttgcaggaacatggataaagctggaaaccatcattctcagcaaactaacaccagaacagagaaccaaacactgcatgttctcatgttctcactcataagtggtagttgaacaacgagaatacatggacacagggagaggaacatcacacactggggcctatcggagggtggcgggataggagagggatagcattaggagaaatacctaatgcagatcatgggttgatgggtgcagcaaaccaccatggcacatgtatacctatgtaacaaaccagcacgttctgcacatgcaccccagaacttaaagtataataataataatgataataataaagaattatgctaaggaaagcactagatgtagaaaaaagcacttaaagaagtcttaattttgttttggaagatgcataaaatttgccaaatgaagacagataggaaaggcagcctagaaagatgcaagaaagtagatgttttttatatgaaacaatttgaattatgtgtggctggaaagcaatgtaagtgggacaacgctcaaaaatgatgagtggagatgtgagggaacgttaggcgatgaggattttatgtgaggtatctacgttagtttttgacactgaataatggaaaaaggtttaaaaacacagagtaacagagtaggtaccagaaaaaattaaaaatataaaaaataaatattttcttgtaatccttttgaaacgcaaagagacattgcccttatatatgtaagttggcagggcttcccttataccacaatataaaatgtggtaaagaacagagaattgaaactataacatcttgtcctatgggtcaagattctagactgtaacttaatgataatttctgaatgaaagtgttacttgtttgataagaaaggcaccccaagggatatagttcactctaatttttatttcaatagtagattctgttcccaaaaatgagtcctaaggaaaaaaaaagaaaagaaacccaggtataagagaatttcgagatagatgtaagtctatcagggtaaggacccattaaatagggacaataaagaaaggttataggccgggcgcggtggctcatgtctgtaatcccagcaatttgggaggctgaggcgagcagatcacaaggtcaggagaacgagaccatcctggctaacatggtgaaaccccgtctctactgaaaaaatacaaaaaaaaaaaaattacctgggcgtggtggtgggcgcctgtagtcctagctacttgggaggctgaggcaggagaatggcatgaacccgggaggcgaagcttacagtgagccgagatcacgccactgcactccagcctgggtgacagagtgagactccatctctcaaaaaaaaaaaaaaaagaaaggttataattaataactgggtcatgaatgagataagcaatgatgaaagggtaagattgtggggcctaggaagtagataagcaactaggcttcttgcatttctgcaaactacttgcaaaaatggcttgaacggaagaaggctgacatattgactgtagctgacgaatcagctttgaataaaacacttgtgtttggaaaagtgaaatgtgatgaaactacatatgcaaattaactagcttcacccattcagaagacaaggcattcggaagctacgaacaagaatgggtctgacaatttcctctatttgaaactgggaatcattaggaagtcagagtagcaagtgaagaatgtatagggaccaccaaaacacaatttataaaacatgctttatattaagaaccaagcagtttctttccatgaaaaaggacaaaatgttggcttatgttttatgacattgagaattttcatgtaaaatcaatttattaaataactattaattgattattactatttgcaagggtttttaaattgaaaatttaatacacaagcaaacttaagagaccttgctttcatagatcttacatgttagtatgttttcatttcttctgttgtaaattaagaataaaattactatgttattggatataataagtacgattctatcaaatttcgtatagtttagttacatcatgctttctttattttgtagtcccttctatccttttgattgtcggcacagtcatatgttaacatggattcctggttgttattttatctcaacctcaattttagagaaactaattcatctttcttagcataggaaagtgggagaagatgaggaaacaaatatagtatgtgaacatagaaacatttaaaaaaaaactagtatagtaattaagacaaaccgctcctgctatataattttgctcttcattttatatcttcattttattttatttttatcactttattaattatgtgttttataactaaactgtaattagagggatttttgaagcagagtaataattaaatgaaatatatcttagtctcaagtcaactccacttttttcttagaagttaaaaattaaagcctaggaaaagtaagttagctgcccaaggtcagagttacagttatatccaagaaatatttcagtttacttgtgtcttagttcactgaactgccccattacctgcttgacactcctgtgattttactgcaagattttaaagtgtgtgggcttcatgttgtttgaatacataatcttccttctcaaacacatgtattcaaatagaaaccaagctttgtattctagctgtgaactccttgcatgccctgtaaaggctttaaaatacaaatatcctagttctgaaaatttttcttctatctcttttaaagagtgaaaccagtactgcatgacctctggtgatctggttttaggatgttagctcaaaatatatcactaataaagtaaaatttgtttttaatataactgaaattttaattcaggcttatagaaataaggcaaattactatcacaaaaataacattattcctcttgaactattaagataatgcaaaaataatcttaatggagcatacagattattcatttttcaaggtgatattttcaggcatattttgatatagaacctttcactatagttgtatgtaagccatcaaaaagaacagcacatttgtatgccccaagccagaaacccaagtgaaattgggacaattttccatagctggtcagtctcatttatctagaagctactgttgataaagtgtttgaggggaacaagagctttgcttttaggtaacaagcagatcaacaattatatttgtaatcagcagaaagtctctcacagtttttttaaaaaataacatttgatctagtcagctaataatatcctctgagactgagtaaataagagtcactttaaaatttttgttaccacagataaaccttgttagttgattcttacgagtttgaaaaagtatatgtttgagataaattaggtctagtaattcaaaaaggaatggatcccttaaagaaccctggaaaaactgtactaaaaccatctactttagtgatcccagatttggggatagacacaggcatggagtaattaatggggacatcgtatccacaaaatactatttttgtttgtagtgtgctctatccttagtgaattagtaagatcagttctttaaatgacaaggaattccactcctaccaaaaaattgggattgtcactgatgtaccaggcagttgaacatgaggaaggctggatgtagtcgccctctgaactttgtgtctaggactggctgtaaagaaggcttgatgtatatactggcccccagaaaagcagatgcattaaatagaagaaatggcctcaagacaggaactatttttgaattgtcctttatatttagtaagacccaaaagagaaccaaaacacaccttgcaggcagtgagtgcaaatgagaaaattctactcaacatcctatgagcatataagggacgtgaaggtaaatatttgcctgtcagggacaaagcagtctaatctgagaaaatttatgatgggctagaaggaacactcatgttcaataccaaaaaagcatctgttatgaccatttatacttgataggggcattaaaataaaggaaatagaaagcattatcacatatgtaataaaatctagctttactgagttaaagctgtgattccaaaggtttcactggttgtcacctaatatttttaaatgaccaaactgataatatagctagaagaagttttaatatcaagaatacacaagattacaaacacatagaaaagaaagtgccaacagcaagataatactaaaaagtgccttaccacaaaccaaaagtaaacaaaaaagtaaacagtttgtcttcttataactgaaaagcaacaatctaatattaggtggtttctttatagcattaaaacacagaatatttgtaaattatggtttttatggtaaagagtttttaaaacaataattctatagctagtgaaattgttcaataatattttaaaaattgtattaatagtagaattcaactatcagtatccataaatataatacaaaataattgtaatgtaaacgatagaaaatatccagtttttagcaacaataataaaaaaaattacaaggcatgtacatatagaaaaaatgcgacccatgcacatgaaaataaagcaggcaacagaaactgtttttcaaggggcctaaatattgtgcatagaagacaaagacttcatgaaaagctattagaaatacgttaatataaccaaaagtaactgtattaaaaaattaaagaatagtatgatgaccataattcattaactaatgactagcgataaagattaaaacattatttattatttatttatttattgtattatttatttattttttttttttttttttttttgagacgtagtctcactctgtcgccaggctgaagtgcagtggcgtgatacggcttaccacaacctccacctcccaggttcaagtgactttcctgcctcagcctccctagtagctgggactacaggcacgtgccaccatgcccagataatttaatttgtgtgtgtgtgtatgtgtgtgtatatgtatacacatatgtatatatatatgtatgtgtatatatatctatacacatatatatgtatgtgtgtatatatatatgtatgtatgtatagatatacacacacacacacacacacacaaaaattagctgggctttagcctgagatcctgtgttttcaggaattcactaggtaatgtgtgtgtgtatatatatgtatatatacatatttatatataatgtatgtatacatatttatgtataaggtatatatacatatatataatgtatatatacatatttatatataacttatatatacatatttatatataaggtatatatacatatataatgtatatacacatatttataacatatatacatatttatatatgttatatatatatatatgtatatatgtatatatatatacataaatatatatatatatttatatataaatatgtatatatataatgtatatataaatgaatatatatatatatattttttttagtagagacaggatttcaacatgttggccaggatggtcttgatctcttgaccttgtgatctgcctgcctcggtctcccaaagtgctgggataacaggcgtgagccactatgtccagccaaaaaattaatttttaagacacatggcaattttgtcgttgaaaggtacaatcacctaaatgaaataaaattggttagagaggctaaagagtagatttgaaaaaaaaatcagtaaagtaaaagttaaatataaacagagataatacaatcttaataatagagaagaaaaaagcatagagaaaaataaacagaggcttaatgaaatttggagcatcagtaatacaccaacatgcacatgatgaaagtgccaaaaagtaaaataaatgaacagattttttaaataattaatagaaacctcccaaatgtgatgtaaccattagtatatacattcactaagctcagtgaatttcaagtaggataaactcaaatagatccaaagccagatacaccatagtcaaaatattgaaagccaaagttaaagagaaattgaaacagagagagaaaaatgactcatcatgtataaggtaaccccaataagattaacagaagaagacttcttatcagaagcaatggtggccaggaagcagtatgaaaagactttcaaactgttgaatgaaaaaaaatagtactctcaaataagaatcttatgttcaacaaagcttcatttccaaaatgaagataaaataaatgagactttatataaataaaaactgagaaaatgtgttgctagcagatctgcctgaaaaagagatcctaaaggaagttcctcagcatgaaaggaagtgatacaatacaggaattataatccacacaaacacaaaagaacactggtaagaaggtaaatataaaagacaatatttacatattttcttctttcttctcaccaacttaataaaattgcataaaataaaacatctaaacaatctaatcaaaaggcacagattgttggactggattttgaaaaagtcaactatatgctgtctacagtagacattttagattccaaaatgcgaatagtttggaattaaaaagatggaatatgttgcaaattgcaattgcaaaaaagtattaggagttcgagaccagcctggccaagatggcgaaaccctgtctctactaaaaacacaaaaattagctgagtgtgacggtgcatgcctataatcccagctactcgagaggctgagacatgagaattgcttgaacccaggaggcaaaggttgcagtaagtcaagattgtgccactgcactaggctgacagagtgagaatctgtctcagaaaaaaaaaaaaaaaaaaggactagattattatattaacatgagacaaaatagacttttttaggagaatcactgtaacatgagatgaagaatatttaataatgataaaaaattaatctattaggcagatataacaatgaaaaacatgtatgcatctaaaaacagagccctaaaatttatgaggtaaaaattgacagaattgaagggagaactttacagtttagaaatatgctgtaatgggcaaaagaaaataagcataaaataagaataggaaaattattataatataattatttcaccaggacgaaaagtattactcaagcatttacaaataggttttattctaagttattatgcaaatgtttcttaaattattaaaaagaaagatttataatattttctgtgtccaaaatttaaacctatataaattcagctggaggggtaggatgatttgaaagttgttaattttctttatttgatggagatggtaaatagccgttgcttctttgaaattttgacctaagagacatagtaatacatatgttttcttttaaatttaatgacagccataattagaattaaaagcaatgtgtaaaccttaagggaaaaataaataaaatcagacataacatgcataacagtggaggttttaaaaagacaaaacaaaacagaagttaaagtttctaaaatcaataaacaaaatgacagaaaagcattaactattgtaataaaaataaaacagttaaatgtcatattaaaagacctttgggttaaaatattcaaccttatgctttctttaagggagcctgttaaagcatgattaaggttaaatgcaaaaaggaaatctgcatttgtatctacatctacatttaatctatctatataaatacgctgttatacaaaacaaaatacaaaagcaaaaattaattcagcatatagtattttcaagcaggaactcaaaataaaaatggtatattaaatcctttttatattgataagtaatctaatggttatttctgaaatgttattgttgatataaatcacacaaataccttttaaaatgtagacttctattcagtaggtctaggaaggagcctgagatctgtgttttcaggtagtcactaggtaatgttgatgctgctactctgacaccacatgttgaatagcaaacttatatacaattctctttcatcagataactcacttctctacatgccaatgaaaataggaaattatgcaaaatagcatattatataaaatgtagcagaagaaaatagttgtttgtaatgctgatcatagacatatttacttattttctttttctaatttcacattctatatcctattaattgcatacatatgctgaaaaaatattagaatgtagcttataaacaaacaatagatgctgaatgagcacctaaactgctgacataactacttcacttggaaaaagaaaaatggaatagtatggggaatctgtataaataatcacttttttaaaaaaatttaaaatatttataagtaattatggctttggaagacatcaaaatcaatgttttaccgtatccacaaatatgctattgtacacaaattttcactcagtgtttcaaaattttttcacatcatttacatactgacaagttactaaagcataactaaaattaccaccctgatacaactctatcagaagactactacacttcttaacaatgagatgaacataaccttttttgtatccaaattactctttattcagatatttttaagcatatcagctaaggaaaaacaaactagggcaaaattccatgtatatacttttcttattgaatcatagacgagaagacggtgatggtacatggttcattcagtaacactgaaggatctagaaagagatgtgttgatatttcatagaattttctgagatttgagggggaaagtgcttttcttaaaagtcatcttttatatgcaaaaataaattttttgatgagcctgatatttgcaccagtcatggctcaggcaattgaacatgtagtgtttactgtattattaaggcattaaccatttatcataggtttatttatttatttcctgtaacaaaagtagcaaaatagcctttatggtaaaatagcttgtacatcttgatttcaattttgaagttgactgattttttaaattgggaaatttattgaagactaatcctccatttcaacacactggggcatgtccagaagagagtgagcagaattagtcatcttcagcaacggctttaataaatagatatttcactttaagaaatggtacagaaacttacagatggaagaatatgcagcatccacatattcttatgatttgcagtctcttttctatggagctttaacttccatagatgttatgtgtctaagaaagctaatggggaagccaagaggtggagttctaaattttccacctacttttcatatataaaacattctatgaataaatgcttttaaagttttcttttcataaattagaaaacttaaggccagagaggaaatgatttatctgaaatcatacagctagcagagaaatgaagggtaatatggaaagcaaatacctatgttcaaatattgaaaaagttaacgtgaaagtaatagaagttattcaatgaaatatcctaagacagcaatactatgtggatggaagatgaatgttatagaaaaatagactactattccacaaaaataatcttgcaacttaagctgcctgaagatcagatgggttgccacaagaagcagcgatttctccagctacagggatattgagaacaaatccagaaaggcagtgttgctggtgatgcagaggagatgaaagcacttgatcaaaggaaaaattgaatgtctcttaagaacgttccagctctaagaggctgtcatttttgctttcctggctgtggaagatgttgctaaaagcaaattagaatgtgtccttgtgctccttgtccagacagctctttcaggttttcctctggtgaatacattttaccctcccacaatgtcctaggaaaaggatgtacatataaatattagtatatttatattttccctgcctaaatcttgtgtttctcatagcaactaaatttaactcaaatgccatttccaaattaaagttagtggatgccttgaaggttgtattattaacaattctcatatgtcatttgtgttcaaaaagaagagtaaaatcccttaatccagttattaagtgtcactgatgtaaatcaataaagaaattaataggtaatttggtgtatggaaaaagcaacatggtcaaatgacttaatcgcttaagaatatctaaaattgccttagaaatgtatttgttttaactctgtgatttttgaagtttaaaattctctttttaatttcttgagaagtaacgactgctaaatctatttgtatctgctgatttttaccaggtttaggttggctttatccacctatttacttatatagggaaattatagcttgtgattactataatattacataaccccaaactttcctagtaagataatgtacttctacatcctctatttgtgttactctttccatatttctctgtgaaattgtgcaagattgtcttataattttatgctaataagcaagaaaaattatgtacattttcactctggattcttaagatttatgtgtatgtggagcataaaataatcattggatgaaataaaaaactacaaccaagagcagatatatgggacggaagcccaataaatagtgaagtgatgatgtcaggccatcatgcttactctgcttagaataagcatatagtaagatttattgtcaaattccaactattttaaataaactgaattatttcagtttttagaacactgtaaaaatttattttatccttattaatttatttaagatataatctacagactcaatttgttagtttagactttaccaaccttcttactatttcaatcatattatataagccgtgatagtaatacaggtctcaagcaattcagtttatatactttttttttgaacacagaagacattttactccaaagactcattagagtttgtttttgccatgtctaattatggagttcattattctttgtgtaaatatagtactactcaaagtagaatggaaagggagaattctatttctaatgtgacaatgcacaaaccatggacagccaattttcttttcacagtttatcaccacatatgtaaaactactctgtgcaaggatagtggcatacaaaagctggaaacaaaactgaggggtgaagcctggagactgtgagacagcttgatgtctctctgcatcagggattttggattataatatcctcagtgcctaatcattcgtaatttagactgggtagttcttaaaaaggtctaattgctcatccgcacaataattttactttatctaaagacgaaatattctgttttctgaaacttgtactgtgcagaaaattttattttatttttctgagtaaagaagaaaaatctgttttttcattctggattctgagcgattcagtcccagagatgcaactgatcttgagaaattcaagcttagatatcacgtacaatttttataagtagttaattccaaatgaaaggctgtaatattctttatttgacttccagctgatatgtaagcagaaaacagcatgagaccatgataggtgggtaaaaaataaacagataaatgaaggaaattattgtaaataaaagagaaattgttttttcaagcatggtatttaaagcaggaagataccagagtaacaagcattggtatgtaggaataaaagagcattcaaatcaacacctcatattttgtaaatgctcattctttcacactcctccagcacctaagagtctcaagtatgcttcttcgtggttcttacaaggattgcaaagccagtatattaactcagagcttgtacatcactgtcacctggattttcattccagctttgcaaattactagctctttgcccatttctaaacttttatttaaagttttaaaatgtcaataataatcagggcttcccaaagttttcatgaggattaccttttaaaaaatgcatttaaagcacttactatagaaagaatactgcaaatgggtcctcagcagctattattattatctggcagttgcatattattatactaataggaattctaggtttcctccatatttagagtagttaaattctggtactttacatactcagtgccccattagcgtgctctgttaggattaggaatttgaaagtgttgagaattttcattaaataattcagcataaaataaaagacacatggtataaaccatctaagacaaaataatttttgcttccttatgaatattcccaaggatacatattcaccaggcctagaaactttaaaaagcacacagattacctgtttcagtcttttattacacaagagaatcttttttaaaaatgtaactgaattcttgttttattttttttatttttttaattttattattattatactttaagttttagggtacatgtgcacaacatgcaggtttgttacatatgtatacatgtgccatgttggtgtgctgcacccattaactcatcatttagcattaggtatatctcctaatgctgtgttttaatttgtgcttgaggtcttttatttttctttccttctctctttcgcttctctctcctttctttccttcctccctcctttgtttaatcccttccttcttcctttcctttctctttctttccttccttcttccttctttcaattttctttctttctttcttttctttctttctttctctttcttccttcctttctttctttctttctttctttctttctttctttctttctttctttcttgctttctttctttctttctttctttcctttctttctttctttttcttttccctccctccctccctccctcccttgcttccttcctttcctccctccctccctccttccttccttcttttcttctttctttcatctctctctctctctctggtgtgtatgtatttgtgtgttagttagtatatttgtgtgagtatgtatgtgacttagaaactaaacaaacactttgctatccaggaaaatcaataatgctaataatgcaaagaaaaattgcactgttcaagtttaacatgcaagggagactttatttaaaactactacaatagaggagagattgaactgaactccctctaaaacaaaagacaggcatttcttgagcactggggtgagtaagtgaaaaagtactggagaatgttagcagggagattggtcaatgtagttggataatatgtgtttgttaaagttatcctatcctctcacagagactgggagttggggattttgtctttcttgatcactgcatttcaaaacgatggcttccaaattatttggtaaagactttgctgagttgtaacattgactagatactgatagaaaatttatatcttaaaagggaagagaaataatttaaaattgcaagtttgtaaagtaatcctcttaaggggagattaagtgaatatagtcagaaagaaactgatgtaatgtttagtcaatttgaggggagagttgaggttgtcttggtcactgcttatagattactctttgcaaagtaaaacaacttgaaacatttctgtcatttcctcataaacttttctttccattattctctcttacctttttaagcttcgaccatttcaaatttcaagtcattttaaaattcagttgaccaaataggaaacaagattttattaaaggatggctatatttaaaaagaaagaaagaaaaaggacagaagaaaagaaggaagagtaaattttcagggtgttttcttagtcctttctaattctgcttttcttattgtccatgaagactctatgtgtttccttcttgatatctttggtcagttattgtttcttttcctatatttgcctggttgcttcccatgttagagaacattatttgatctgcatattttaggtgaaattatctggcatttataacaataagctcacttaatgtgacatcattgccatatttcactggcttggtcttgatgtatttattcatgctatcagcatagatttagaatgattcatgattcctatgattcatgattcctgtgatatattctgccaaatattagcaattgctatgtgtttttttctttttcaaacactattttaagcactttggcttgataatctatttaatccctgaagtcttcaatgaagcacattctgttattactcatacacatgagaaaatgagacactgagataaaaacatcacgtagttttttaatatgagaggctgcattccagatcaggtttcttttaaccatattccatgcttctaatcacgatacaacaaccacatctttgcttaccagcatttttgcctttctctcttctctgcaatgctgcatccctttttatttccttctattttcctccatttttttctctgtaatgtttttctctttccctgtaatactctagaagttggagatttaaagttcatttggacagatagcctgcattcaaataattgaaaatcttcatctttattttagcacaatgtcatatatgttatttgttacatatgtatgtaacaaattgaatcaatgaatgaagtaaaggaacctatactcctatactttacctaaaaggggtttaattcctctattacatttttctaatttaaaaaatggacacctggcatggtggctcatgcctgtaatcccagcactttgggatgcagaggcaggtggatcacgaggtcaggagttcgagagcagcctggccaacatggtgaaaacccatctctactaaagatacaaaaaaattagccaggcatgatggcatgtgcctgtaaccccagctattcaggaggctgaggcaggagaatcacttgaacccaggaggtgaaggttgcagtgaaccgagatcatgccattgcactccagcctgggcaacagggcgagactccatctcaaaaaaaaaaaaaaaaaaaaaaggaaaaaatactaacttatcaagccatatttgacacaggtcaatttttttctataatctaaaaggtttacttgatattacaaaagttaacttatatagttaggagaggtagggaatgagtaatcaacaaatttgagattttctaaagatttgttaaagaaaaaacacgcgtacagacagtgccgaattgccaatgccaaacattctatttttggaggtaattgacaaagtgaaaattaaaaagtagttgtccaaacagaccaaggatagtaattttcttttataatgaattgtagataatttttagagtgtatatataaaaatagaggaatgggtagaacagttgatatcaaaggaaaaagtggtaaatgcacttaaccaccaaattacttgttatatatatgaaattgtttgacatattagatatgagtattgcaatcaacttatttttaacttccatggctacttataaatataattgaaataaatatagtaattttttaaaagaatcgtatgttcaatcagaagaaattgatgggactggttaaagaaaaacaccctataagcaatgaatagatgctttatcttttcacagaacatttaagcatccatgcttttgctatttatttgcttaagtcatttttacttaaatttgcctcttgaaatcattaacaattttactatggtgaatagtataattaattgtttatctgaaaaaaaaatcagctggtgcctaaaatgataacacttctgctctttttcagagttttatacaaattaaagtgttattcatttgtaagtacgaattcttatattactcatatttttttaaaattatgacttcatgaaaactgtagtataccttatttaaaggcaaacattattttatatattttaaaatgaacagatatgttaatttggggtttttcaaggctgcggaatcagaccaatttctagaaaaaacagtcctttcaagcaaatgcattctgtgttactcccaatatgctagaggcataacatgccttgtaaattctgtatttcatgattagttgtattactagagttagaaatagaagaaacatgcaacaatacaggattaaggctatctttgaattaaattatcaagtatctgaatgtttactttgttctgtcagatgtaaaataaaaagaggaaaaagaaagaaaaaaaagaccctcacttttaagtaacacataagaagaaataaatgtaaattctgtgacaggcattataataagtaatttacttatatgtatatacatgtttattctaatttacccccaccccagatttatgaactaatgattgctattacacctactttatagataatggaactgaaattcagaggtattttaattcatggtcatgctgtgattatacagttagcgtatcagaaattgcagttacaagtaagaaacttaaaaattgatggctttaacaaatggggttttattttgctcaaatgatgaaaagtccggagaaagtcatttcaggcccacgatgatggcttcatgatgccatcagcgttctgtacttctttgtttctaagagctcagccatcgctcagcatgtgtttttatgctcacaataaaatctttcatacaatgttttctttctagactgggagaaagaaaatggaaaaactcaaacataaatactgttattttactccttaattttaaaaagctttttcagcttactttttaattttaggaagctttttaaaattacttatttcttgaggagtaagaaacttcttaaaattaaggagcttcttcttaattttaagaagctttctcagaaatcctaggcaataacttccttttacatcttactgtccagaaatatttcatgtggttcataatatactttttgttttcataatttgccactagcaacagtatcataatactttatgataaagaaaaatgtgaaagtatattattcaggtaaccagaaatcttatccatagtcattaagaggcaaaggtaggatttgaaacttggtttgtctaattccacatgcatgcatatgtttattgcagcatcatccacaatagcaaagatgtggagtcaccctaggtgcccagtgatggtgggctggattaaaaaaaaaaaaatggaaaagaaacacacccatgaaaaagaaagaaaatcatccaggttttcctttgcagcaacatggatgcagctggaggccttatcctaaaaaaattaatgcagaaacagaaaaccaaatactgtatgttctcacttataagtggaagctaaatatcgggtactcactgacatagagacagaaacaatagactactagaaggcagaaggagggagggggacaaagttttaaaaactaactattgggtactatgctcagtactttggtgactggatcaatcacacctcaaacctcagcatcatgcaatatacccaggtaacaaacctgcacatatacccctgaatctaaaataaaagttgacattatttaaaaaagaaagaaacttgatttgtctgatttctaatccagaaattgtaatctttatagaaaaaattttcattttcttggtatatagcaccatttaaaaccttaaatataattaataccatagagtgctttattaatgctatattaaatgtttgattacataagtttgaaaaagatgcatattcattaaatcaataggaattagaaaaatcttgaaaatacatataaatgtgttgacacagagcatatagaatattttaatttcttacttgatttttattttcctttataactaaaacccacaatgtatttgcaattaatttaaacaattagttttaaaaagttattaatttttcttgagtgaattgcaatttattataaatagaacctattttgaaacttcaagactaggagatatatacactatagatatgagacagttgacttcaggttttggataaagttaaatactactatagcaatttttatttctgatgatttccattcttctatttttatagagcatagaagcccacctctgcacaattgcaaaggacaaaattgttgtaactactcaaattgcttatggtttcaacttttgattctttgctctacaaatacctattctataaaccaatttacttgactactgatgtatagtagaaataaaataattctgtgatcatgatcatatgaattgtagttcttaatccatgtctgaaagtcaattggttcatataatacattgattaggtatattgagcagtagttaagtgtcatctggaaatgagttggtaatttacacagaatacaaagatatatacattgcaaaccttaaaaaattatcaaatcatacattataattcttcatgtccaatactaactgatgacatattttatactaggcagtagtcttttaacctgatactgtctttatcccagaaactgctgaaaatatttgctacaaaatacatctaagcaagaactatggtaattatactatgttcatggaatttaccttagtgatcagtatgaaacagggataaaataagtgtgaatgaattagttaacagatttagtaaaatgaattggttaaagactatttaaatatccaggtttttttatgattcttaaaagtagtacaggatattctagttgctattttctgtttaataggattaagatatccctagttccctgatgtttaatgatgttacaatgtaatccacagatgtttaggcgcacatctgcaagtctttttttaattcagttctgggagaccagttaacttactgaaaaggaactttagattttattacattctggtgctgtttaaggacatcattgtttaaatcctttctaattgtttcagaagttgtagatcaggcaattagaaataaaacagctgtgtatcagttgcctacaatactgaaaaggttccttttccttctctgttgctgtcccatcaaataaataggctgagagtttacctgtgataaatgcactgtatttaatacaatggggcagtcccttaatttgagcacctagcatagcgtcaacctaaatcttctgctgatttaattagcaaaagctccatgttaatcactttgcaattaaacttttggagtctcacattgaaaaaagtataatcctttcacaaaacaaaaaaaaaattaaaatgagctcagtaataatttgcatttttttgcaaatgtgataaacagctgatgaattattcaatacttaatgttcattctgcagacttaatgagcctctctaatttgacttccataccacattataaattttattccatgtttatgaatagaaaagtgttcattaccaaaaggcattcatcaatatactatatgtcattaataaggaaagctcttttttaatttagcagaaaattttgttctagcattacaaacagaatttcttccactataaaaatagttttatctctattattcattttactgccatatatattatgaaccaagtataagaaaaaaactattttgttataatgatttgggatgttttcctagattgcatttgttgaacaatctcatagaatccagttatacatatttctcaaagctctgaggcagttttagtccacctcagtcttgtacagcataatctaaagttctagcaagttagatccctgtatatagaaagcctagcaccattaaatttcttcaaaagtaaagaaagaatttctcaatccttggatgtataccctttcactggccaaaaaaaaaaaaaaaaaattctccccacttattattgaatacaatcctgtcataaaaagaacaaacaaacaacaacaaagtaaacaaaaacagtgatcctagtttgtgcatctccaaaactctacatttcatttaaatggtaacaggtatactaataatctaacatcaatgggaatatgcaaatatttgagggccgggtgcggtggcttacgcctgtaatcccagcaccttgggaggctgaggcaggaggatcacttgaggccaggagtttgagatcaggctctccaacatggcgaaatcccatctggactaaaaatacaaaaattacccaggtgtggtggcgctctcttgcaatcgcagatactcaggaggctcaggtgggaggatcgcttgaactcgggaggtggaggcatcaaagagtcaaagacatgccactgcactccagcctgggtgacagagtgagactctgtctaaaatataaatataaatataaatataaatataaatataaatataaatataaatataaatataaatgtgctaaccttcattgaggatttattgtatacttgattttatttatatgcttaatgcacatttcttatttaactctcacaacaaagttagcagttatgtgctatcaaatcatctcattaagaggaaacagaggctcagagaattgattcacgttccctgatagtcatcaggtcactgatggagcaaatacttgggctttgttcagcttgactccaaagcccacattggtcctcctaagcaccgccacctcctctaaaccacgctggacatgctttcttctgtgctgcagccatgattctattttgaatcatttcattttgggcgatacaaactttgtgctcttctaccacctaatgttagtgaaatggttcataaagaataagcaagttctgatttcttctaactacaacagtgagaatgatgtggttatctaacataatctgattatagtttatttgtatgtaataaaaatattctttttgcaagaatcttttccaggtgtgtctgagacagacagttctcacattttttaaaaggagtgtggctctctgtaatccctagctgattttttttttttttttttttttttttgctgagggagacatctgagagattaatagaaataaatagagagatgaatagaaataaatagagagatgaatagaaataaaaacctattaaagccacagtacataggatgtatgtcgcacattttactataaaatttaaacgtaagattttcaaaaatgaattagactaaccaaaatatcttctactttctcaactttgtatttatgtaaagtaaaaatgaaataacttttaagaatatatctcaagttttttcatataataggagctcaataaatatttccccctgccctcatctaaaaccttataagtggtacccagcagcagagtatacagttagaattatgttttttctatgaaatgtgcaactatcactcatcacataggtctagaagaaatgtgtgcctggttccagcggttttgtttttgtttttgtttttgttttttttgactacattggtaattgggaatttaaaaattttttgaacatgtgtctcatcttgtatgaagagttataagtatgaaaatcagcctaattatgtcttttacaatgagagaataaaaaggaatatacacaactagggtagatactccaagtggatttacatttggaacaagagtctagaagagagaataggacaaattctatgcagcaaacgatatgcagtcatttcttagactagatgttaacaaggtgctttcatggatttttttgtagtcaactcttcattatcattcagcccttttcttggtctttcacagagttttagtaatgaattatgtatagtttttgtaatgatttacatataatcattctaacacgtatgtatgtacacataatatcacatatcattatatgtaatatacatgaatattatgttcgtatatatattcatatatacattcattctcctgggtctattttaacttattttagtgttcaaacaagccagcatacaatgtgatttcttaaccagtttgccagcaaccgacttacactctgtccctttattctctgctaggccaatgggctctgttctttttacacagggatctggattctgaaaagaaggtcaactttaagagacagtgtagcattttggttaagagcagggacactgggaggtcgctgggttgtgtgaggaaactatcaataagtaaatgctatcatttgctgtcataacataacttttaatattccaaataaccagactatttggcaccccatgcccaacacacctaaaccctaattctaaattttgtttccctcataagggaaagtagacacttttcatctttctcatattcagtcttgtttagaagaaaaataaagcagattgtaattttaagtgaagtaaccaggggaagtcgatgtataccttactttttttttttttttgagatggagtctcgctctgtcgcccaggctggagctcagtggggcgatctcggctcactgcaaactctgccttccgggttcacaccattctccttcctcatcctcccgagtagctgggactacaggagcccgccaccatgaccagctaattttttgtattttttttttttttggtagagacggggtttcaccgtgttagcgaggatggtctcgatctcctgaccttgtgatccgccggtctcggcctcccaaagtgctgagattacaggcgtgagccaccgcgcctgacctaccttgcttttaaattgtttttaattttgttattttattctttcattaattcaaatatatatctatatagagagaatgcctatcatattctagacactaacaattaaagatgagttagtgaaaaaacaaaagtcctgccatcattgcagtagccttattgagataccaacctctggacttgtatggacagaccaaatgaagcctgccagcttctttgtatcttttctaccaccacgcataaacctcatgtcttctgtggtcttctcttcaaccccacctccactcctcctcaatcacttagtagcctaaattctggcataacttctaattatcctccagtatttgtgatgtttggaagttgttctttttatttaattatgagttcttgtgctgaaattgtcaaccatttatttctgttcaccaaagaagtaaacagctggatactttccattctgtaattatatatctgatctattgcttcccaaagtggttaaatatagataaatgacttcatacctcacaatcagagagccctcagtaaagttttgttgcagtattgggtttttcccagttgtttagatctcctaagataagttactaaatgaaattatctttatattggtaatttactgtgctctggcatgtgtgtgtatgtgagctccttgatgacaaggttggtggtgacattagtatccatggcacctaccctccagcctgcaattacacaaaagtgaaaatggctttaaaacaagtacaacttctaaggaaaatttagagaattcaaaactatgattgagaagaccaagaaagtacataaatacttgatcctaactggccagcaacctcacaaccacattcagagttccagatagaaaaatagctaccactaacagaaaactaaaatgagctaagcacttgtgtgccttccacctacataatctaacttcattcttctgaaagctctgtgaagtagatgctatcattcctttttatcaataaggaattattttctcacagcccaggaagggatagggcctgggtgtggaggttgatgactcctactttctgtcttcagcacctacatggaacacttagatgttctctctgggtatccttaatgccaaaaaattacaaggacagcataaacataggtaaatttactgaaaaatggagaaaatatgtgcctctttccctgcctcatcttctattcggtgtttatttaactgacttgcctgtttttaaacacagtaagaggacctcactattgtttttaatgaaaaagttctcaagcatacatcctatgaaactgtatttgactggacctgtccagctgccatcagccagaattcagaactgagacttgcttgtaaatcagtagccagtgtcaagtctgaagtgaattttatatcttttacttttgtgagtcatcacttttatgtttcactgaattgcttaaaccaacagaaaatatttttccagcttagcttttttttatttactctcatgtttgcacttcatatgctgttttacttatcacactctgttttaaataaatgatatatatttttctactttaaaatttagaatgttaaaaaaacaaaccaacccacaagaacaacaacaaccacttctgttcttttgtgttggctgggtctgctgaagaaaaaacatttcttaagagaccttgtctcttaagagactgatgaacatagcagtgacatacaggtaaggggagaacaaaactctgaatgagccgctttcagacaaacctatgcctattttatttaaagttctgtcttactcttacaaggaattaaaccaatgtaatatgatttcagaatgatgattctaacactgcacgttagatagttaatgaagataaaatttagccaatttataattagtcttgttcaggggcagagaaatgaaccacaaggaatttataaatgcattttttgtattgatctataccttttccatgtatattaaattttcctttcattttttacaatatgcctctcaatccaacagtattagctccaatcacttttctttctcaattaccatttgtggagatgtaaaagagaggccaaaccacagagaattgatgtgagaaaggaggcaaagttttaaagcagttctctgtactttaaatagaatagcaagtcaacagaagcatgtatgttcaatcatagtctgtagaaacaaagaatctaaatttttcctattcaatttcaaacataaaattacatatcacattaccccatctctctcacctttgctatctgctcttgaagccattatgcttctgtttagtttttcattttgttgtgttttttagagttgtattttttatttttagaaaattcacatacatattttctttctactaagacacctgaagagtttaattttctaaataaattctaagaaaaatatataattttctcagaaataacaaagactctttttcagatgcattcagatcacctcccaatcaacttattatcttagtttttgttacctaaatttcaaagaagtaatgaccattaaaaagtcatacattttaataaaataaatcttgaatcttgattttcccatgcttaataaaatacaagtgaccttgttttggattattaagtttaggtactccattttgaattagatggaaaactgtgaatggtacaagcaagatgcctttagtgttaaaattcaaatgcatgaaatttacagacaataattaatcctcactaggaaacccaattctgtattatctacatagaaagactaaattacaaaaatgtttttggggcctatgatttttatatttattttctagaatattattaatgccagaacagattcttcattatatatctcattatgttaatttaaaggcaaattatatgttaggtttgtactatcaaaagtttctactcttaggtagtataaatagaaataagaacatagttttattaactgtctcaaataatttttttaaaaaattgctagggagattttcctctgatgtaacacaaacaatttttattatgactactttccttgcagaaaattggctaaatgggcaacaaatatacagtctaattctttaatgtgtaccttgtaatccaattagcataaacatagatgtacgtaggatctctactcaggctcaaatgtattttatcatagctttgtcgttaacagtatacacaaaatattttcccagtaacaggacccagaaagccttggagagagattcagtgggaggtattaatttgggattgtacaaaggagaatacagtgatggtttcacccaaatgtctcaattcagaattccctatctggaattatttttattatttttgctaggaacaatcactcttccaaggtgagagatgggggaggggtcaagaagcctgagcgagcataagcacaatgtctggacggaaaattttcttcttagctttctgatttttagagaaagtttgtgatcagcctatgccatgggcttttccacctataaatcctagcactggtggtgatagtctccttcagtttcatgaagctagctgtgaaatacaatatgaaggttactggaaattttttagagttattttgaaaactcaaaacatcttgtgatgactacatattcaataactattttttgagtgcctagtaggtgcctagcactgggattaatattggagacatagaaacaactatgacacaatctctgactttaagagtttttcagtctagacagttttttttaaaaaaagtaaatgaaatatatgtgtttaaggcaaacagctgtggtgagagggaaaaaaaggcatattatacagatgtgtcagagggggtaggtttcaaaatgttccatggatgctggacattatagattcattttattttccttttagaaaatggggagagatcatccagtagagatgttcacccctgaccacccctattagttcaaggtctgatatgtagagaaacacagaaaacttgagtatgggaagatagaagatacctttttattttattttttagccattttattattttggtattttttaataaatctatttacatctttgttctttcttgtctttaattatatttttattctagtcacttactttatcttgaaggaagaaaagtcaccttattagatgactcaaaatttatcccttagttttctgagtcatccttgaatcatagatcgtgcagttcacacagaagagaaagtcaggaattaaagaagtaaatgagagcctcctgcttgtcagtgaattataaatctcgccatgggcaatgacagtttctctgaagctgcgattgaccacaatgcatgggctgagtggtcacttgtgtcttcatttaactagccctttcaaagtgtcaagagcaatggatttatttttaagtaaaaaatgattgcaaagaaatgtagacaaaggcaaaagtatacgtttggaagaaagaacctgacttccttgtctgtctctaatgaccttggataaaacatttaagccatcagggaaataattcagcctattacccatctctaaattccaagcttaggctcatttagaaacaaacaaataaaggaataattttttcccaaaaagattatattttaaaataataatagtaatactaatatgaataatagcttctttgtgttgagcatttatgggagtctaggccctccttaataacaattttacttttcttattgaagtttcaccattctgtgaggggactactcttatagatgaaaaactgaggcctagagagattaaataactttcctaaaatctcaataatttttttttaaaaaaagaagatcctcacttcatattccatgttattcttgcttcaaaatgcatgtaatgactgtttcatagccaccttgggtctcagctaaggttcaagtagcaaacaactctgtttctcttcttgccggtggggtgtatttccaggctaacctggacgtcaattatcagtttggtaatttatccatctcattctgctcttccacttcatgtgaatgaatttatacccccagcaatctcagagctcacaatgtcctggctattggacatcccctctggctgctttctgggaatgttctctagctttctaatcattcctagatctctaattgatcaccaaagacacctgcattttctgttcctgtttttgagatctcagtcgtgccaggtcttctgcttcctccagtgacctatcacaaaatacctcttctgtgtggtttccctagttaccttgttcctacctcacaaagtggctgtgagaataagtgatatgatgtgtagaaaagtgctttagaaatttaacacccttaatttcctcctcactgaaagagggttgaactagatattctttaaagttcctgtggctccatgacttcattatctgtgatttattaacttgcaatttaagtgcaaattatttctgatatcagacttctaatatcttagtttattgctaaggcagattctagcaggcattgtataaactgaatggagcatagaatacactcgaaggaattgaaaagattctaacttactctcaaactggtgcttaggttacaatttttttaaggaattctttgaattttcttcaaaccatgtgcagtagatacataattataggttagcattaaagaagtcaggccactgcttgaaatcatatataacggagaaattctctcttctgattctgaccttgacctgttgcctcatttctttttcttcaatttggcttataattggatgttgaacaaggaccttttcagctcatctgatcccaaacggaacattttcagttctaacactgaatcttaggcatgaagtgacagcagctatgttcacaaccgaagtaattggggtttgaaaaaacagttgagtgctttatcctaagtttgatattatagttatggtttcaatatatggactattttttgtgtaatgtacgtgcatttaaaattgttctattttctcttttgattcacaagtataaaaacttcacacttctggtatgtgtacttggtattcaacctttcttcaagacatgtgaatgttttatataatatcattacagtagaatcatctcctcacacttttgaatcaacacttaaaggtgcataactgttgcagtttctgaattgtgacttgtcattcttaatatgaaaatataaataatgcctatcaagtatagggtttttaaattatttactttttaaatttacacattgcagttgtacatatttacggagtacaatttgatgtctttgtgcatatctgtgttgtataataatctaatcagggtagttagtttatctattacctgatgcatttatcatttctctgcagtgagaacattcaaaagcctctctgctagcaattttgttgcatatcctcaattagaaatgggattgctcatttttattagtggttttaattgaactttataataatgacactattatcacttttagagaaacagataaagtataatgactaataattttttactaatctgtaaagatttgtcctcttttgctttataaaatgccacttaaaggatatccatggtgttaaaaaattaagtgtgttgccttaatactaaatgtagctatcattaaggcagcacttcaaaaaggtagcaaatccagaataggaagtacattaatcatttccatgccttctaaaatcaatctcaggatatatgtgttttttttcccccatgaatatcttgtccttaccttcccttattttcatcatggattgcacatgtggagttttgtagtaacatccctcctttgatttatgtacagatctgacatgtaagaaatattaaacgtaactattttctgaacactgatgctatttgcgctagcaaatagatttacaagatcctggccgagcaaggtggctcacacctgtactcccagtgctttggaggctgaggaggcagatcacttgaacccaggaggttgaggttacagtgagctataattgtgctactgcactacagtgtgggtgacagagcaagccccaatcccttaaaaaatagtaataataaaatgtttttaaaacacaaaaacaatatccttagttcttcataattgtccgtgttgcaatattttcatttggaaacatccaagtgggtaaaaagcaagttcatcaggaagatcacacaccagttgaagggcagagccatgcccttgggtgggagagcacttgagcccaggaggttgaggttacagtgagactctggtccacccaagaccaaagctcaagctcttctcatatcccaccgctgatgcctttctgaagtcaaggattatgtattcatagttttagataacagtggattcaattaccttctacttctctaacttctgaagttatgatatcatagttataattgctttttctctgcattcctttgggcagacaaatacaaatatgttgtggtagcagaaaactgcagtaagaatagcctttagagtcaactttgctcaaagtctgactttgcctgttaatatgcttcttgaagcagaataaatgtgaaaactttaaaacctagggcctggtcacagtttcagatcaattgtacgaccttgagcaagtcatgtaacctagcagaattactgttttgccatctgaaaaattgtgataataatagataacatctaaacaccattctatgaagttgaatgcagtcacctccacaaggcaggctgtgctctgagaaagaaagttatggcattcaataaaataaaaagtaataataaattcttaaaatatgcatttctaagatattcactgaaaatgtttggagcaattattgtccaaggtatattgtcctttaattaaaaacaaatgccagccaggttttattacagtccatctcagcgaaggatgactttcctgtaatagacctgttatattttgtgcagattaacaaagagccattggggaaaaggaactgtgcagtgagggtgttggtaggaaatggaaaaacccaccagggcacattctgtgtgtgggtgcctttcagatgacagcacttttcactgtgagttgtattggttttactctaagcaaacactaactaccttaactgggatattgttccaggatctttagatttatctgcctgacaacaggcattcctaatatgccatgctataattttcttgatgtttcattcaattacagctactcttttcatgaatcttggtaattagaatttgaggaatatttcacatttgatttgagattttgattttttcagcaacttggtagcaggagtactgtcagcattaaagtatttgtaatactttatgtaattgtttatttaaaagatagaataaaaatgatatgagcaaaagcatgtggcatgctgattaagggaagttgcctgttacatgatatttttccagttacattttcctcagttctcattgtctcagtatagttgtttacattatgaatgacctaatatataactggaagactttcctcagccttatttattttcctcgaatagtcttctgaatgctgaaccctaatgtgagatccattatgcagcacagcttatgtgatcctactgatgtaatggatgtgtgttggagaaaagaaaaaaaaaaagcttgtctgaatgtctgagtatcacgctcttgattgaaatgacataaatttattggcaatgaaggtattacctaatgttaggagagatagtaaaatattttatttaaaagtcagagccaaataatcacagggataggcaatgaaaactaaaattacaaagaacaaaggccagtctttaagtagaatgctctataactgtaagaacagaatccattacagacatctattggtgatgcacataagtcaaacaataaccattccttaatgtccccctgaagggacacaaaatggttttgtgttcttgtttattttgacacctcgattctttctttccccatacactatacctgcaatactttacattctttgtctgttctcaatttctacacattaggccttgaggagagtgctactactctcaaaagcttagacagtccatttttggcccataagtaaaaatcaactttcctctgctccgaactccctagcgctgtatttccatctttgatatagcattttattactctctatcttatattgcaaatgtcttacattataaatgtaaattttgatcactaatttttgtcattgtatatcattattcctgttgtctttagctgagtggcaaactttcccaacaataatttattattaatattaatcttgatgattaagctgcatagtacttctctaaggcctctcacgagatttctatcagatgtccactgaaggctgttcaagagagctcgagcttactcacatagctgtcagttggctgagaactcagctaagcctggtgtccacagtactacaattggcttttcctttggggtgaccgatttgtcttggcttgcccagaacatctcaaatttagcactcaaaatcacatgtcctggcaaccctcacagtttgggacacagtttgctgtttagtcacccactgcagcttaggcttcccacagcttagagtttaagttccttagaacagtacccgcagtgaggatgttccaataggctcttacagaagctccaaggctttttattacctaaatttagatatgacatgacatctcttctgctgtattttattagtcaaacaaattcctaaggccagcttcaactcaagaggagaactaaagtccaccttgagggagtgacaaggtcacatttcaggagagtaattggaatgagagatattgttgtggccacctttggaagacacagcctgccaaaccatgtattacttaatcttccggagggcaggatttaaatagaattacattgctgttgtatatacctgccagagtgcctggcacttagtaagcactggataagtgctaaaaaataaagaaacaagaatatatttatcctaaatgcactatcgtttcttacttggattaaaaaatacattttacttgatttgtgaaggattactgcctaatttatgtggttgaaagtgaaaaatttcaatcaagacagagagaaagttaaagggaaaatatcctagataaaatccatatttgttattccaagatcaatgctgagcattctggaatatgtcaatgacttcagatcttgggcagtgttttgacagaatcataggtaatatttggaaggacagtaactaatagtgctcttaagaaactcaggcagtgtactatctatgcatctacaactacaggaatcaataaaaattagactaacagggagccaccatttttgtttcagaattttgtttcactcttttgatgccctgtgaagaagcatactctcaagttattcagggatcgatactttgatgacccaatgagacatgtcatccctgtagataaacagcctttctctctcttacttaacataccttggaggttatttttccaaatgaactgtaataaatccaaggccaaattctataaacaaaatatttagttgtcaatgattcacaattatatcatgtgttaatgtctcctaagtaaatattcatatggaaacattggccttgatattttaacatagaaaattggcattcaatatagcggtttgggacactttttttttttttttttttttttttttgaggtggagtcttgctctgtcgctcaggctggagtgcactggtgtgatcttggctcactgcaacctctgcctcccgggttcaagcaattttcctgcctcagcctcctgtgtagctgggattacaggcatgcaccaccatgcccggctaatttttttgtatttttagtagaggcggggtttcaccatattgttcaggctggtctcgaactcctgaccttgtgatccgcccatctcggcctcccaaaatgctgggattacaggcgtaagccaccatgcccattgaccactcttacagatccttagaagatatttttcaggcctgggaattgctgtgcttctcaaattcttacacagaggcaattttaatctttgtcaatatataagtccaactctattagattctgaaaaaaaaaaaaaagtgtaggtcacagtttgcaagcatctctgatggtttttattacatgggccgaagcacagaagttcagctctgttgagtatcaacattaagtatattttacagatccggataccctctaattgctttaaaatgtcaggtgttccaagaaggagcaaaggagcacaggcactggggaactaattggtattgggacatgaagcttttctaggttagcggtttacattagtctcaggtcagtaataactcaaattcattctcttcgggggcaaagcgctctatgagaaatcaggactggatgcagtccaggttctgctggatggtatgtgaacatcaaaaccaaagtgcacctgtcaatttttttacattagaggttattcatcattgagatatttaacttcaatgttcaaatattgcattttaggaaatgagtttatgcctccccatagccagttacaaaagcaagatcatagctatttataaataaatgaagctaggatcagaacattccagagacttctgcagagatgatgcaggactgtaaaacagcttactgctttgcctattcaatgaagagatggcaagtgagactgacactgaaatttaagccagtcaatatttattgcttttgctttcaagaagcttacattcaacataggacaagcctctgctcctggggcaccctggctccagactgagacatggagtcaatttgataagtttaatcattaagaatgttgagaaatttttagtaacatatttatctcagtttatctaagacagcaagttccatgtgcatatggaagtgttacgcatacctcctcctctacatgccaaagtgactcagttttatccatttcatggagaatttttaaactgcagtagtagaaccttatgggatactgggaaatatctcccttttatccgttgcagcttcaaatgttacaacacacaggaatataatcccaaggcaccagctttatatttcttgaagcatcaattcagtaacctcccacctatcttgcactttacttttcctctctatatcaaacaatacagtacttttaaaactatttcctatgtgtctacaaatactcatagataagaaagaataagatgtaaaatcagctttcaagttttgtgggtaaattaagaaaagattaatgctgctgaagataggtaaaattcatagagggttttcatttgaactaaacttaatgagagatttgtaggacttttatgcaataataggatctaaggagggtatttccagtttagggaacagcagcagtgtaatcaatgataatagaatacagtgactatataggcaaatatactgtttattactgagaccaagtggtttattagcaagttaatggagtttggttaaagtagactggtgccttataacagagtgcctaaaatgacatctagatatttagtcaggaatccataaagacagtggctgtaagcaatacgttctaattctgtgttaatcaaaaacaaattttgggtaggattttagtgcctcagagagtctaaaaaaactacagttcttggctgaggaatcatcaagaaccaggtgttctccgaggagtggaatgtaggaaccaaaactatgtacagtcacaggaataatctgctattgattgctacgatatgctgcaaaaatttaaggtccaccttttctgaataagtggaactccagcaatttttaaatctctgtttttcagctgaagtgtcaaaatatgaagaggttatgtccagttggtctatgtgatcatgctatgctgtgattaaggagaaatgagactatggtttatagcttgttttagggatgaagtagtaatttcaataaaagagtgccattatgagtgctattagaaagataaaatggttagagtcaaaaacaacacttgtgcattacgaaggagtaattaagggcagacataaagtgaagtgtaaaaatattaaataggtatactatatgtataagcatgtgtatagatatatacataaatctatctttttaaaattttagttattagcatttgtcttaacagtttatccagtaaactgttcatatgtgcatttgactttattattcaatgcatacaggaatctcctgcacagtaatgcactctattgatatacagtaagtcttccctcaaagtagttccatatgggataaaacacactttaattttctctaatcgaaactcgtagtcagcgtacagcctatacattcaaaggttcagtgtttcccaaagtatgttgtgtgctgtggttttaaagattgttgagtgcagataaagttgtgcatacaaatgtaatcagatttttgaaaagaataagacatgatatgcttccagaagataataactactttttgtgacaaaaattagctaagcatcagactctagatacgtgataggattgcccttgtagttcatggttagatcctatgataaataaagcaataaaagtgcgtttttcttgcagtgttatttttgttaaactcctgcatctgtctcccattggtcttatatggtatcacattagaaatcagtttagagtgtaaggagttatactcacttattctttagtcacatagaagatactcatcaccagccaccatggcttatatgcctgtaatcctagcatttttggaggccaaggcgggtggaacacttgaggtcaggagttcaagaccagccttgtcaacatggtgaacccagtctctactaaagatacaaaaattagccgggtgtgatggcaggcatctgtaatcccagctgcttgagaggctgaggcaggagaatcgcttgaacctgggaggcagaggttgcggtgagcagagattgcgccattgcactccagcctgggtgacatagtgagactctgtctcaaaaaaaaaaaaaaaagagagagacatttattaagcacctgctttgtgccctgtagataacaaaattgttggattgtgccctgtagatgacagaattgttggaccatcccctgggaatgagaaaagcaaaatgagagttatttcccccaagaagtgagagacaattacataaataagactcattagtaaaatataagcaatcaaaatgttttttgtacaagcttctgtacaataagaatataaagaaaaataagagccttattttgtcagaaacttttatctgttgaaactccctaaatgtaggagagtttcctaaaagtaggggaagaaaaggcagaagatgtaatagagggcttctatagaagctgctgcatgatttagatttttaagcaaaattagatgattaaaaaaataagtgcatcagcaggttaggtgcaagtgaagatgaggagggacgattgtgcaaatatctatatctcactgtgttcagaaaaaacaaaaatgatgctttcatatggtccctgaaaataagctaatcatatcccgagaaaagagatattattaataaagatgactccaaggcatattattatgccatcttcaaaaatagaggcttgcaatagccaggaatcagtctagttttgtgtctacctaaagcaaatctttatggcaaatggaaaggctgcagctgttgacagcacaatgggatgtctttgcttccagaaaaacaattccaaagataggcttgttgccaacactacaagcctgctgacaccagaaagtcagggacaaatgagaggttggtgtagtaattatggtgaaatctctgggtctattcaaacggccaaatgttttgttgttgttgttgttttcattctctaaaccattcagtacatgtgggaacctttttctaagtcagtaatgtaggtagataacagagggcaaaatttccctggtgctgtactaattggattatgtactgtgtgcttaactgtcaaatgctgaacctcccttggagctagaaaatgttttcttcatcaacaacgtgatgaagacatgaagatagtcatgctttaggtcttgaggcacttaggtttaagaaaagatgctgaaaaagagattctaaagagaaactacttttccagagtcaaaccaggaagatgatttgttatagatgttatagatcctcaagtgtgaaatgtatcatcatcccagttctgattcaatttataagtgaattcccaccataccatcactgccccgagatcatctgaccatcgttcttgcaagtttactctccactcatgctcaagtagaattccttcacatttgggccaattcaactgtcagaaaattcttactttatttgcaattgacaacccttgtatgtatcctccacatctccacctatttcctagtcattgttctgccacagtatcttcctcaattcaaatatagcaagcatagataatcaatcacacctgtccaaactaagcagctaatgatcaattgaccttactcacatctgtagtattttggttgttattttgtttattgtcttttctttctcctcagttaccatatttcacagtttttttctgtgttgcctttaaaatacagaaacatctgagagtctcatcgaatagctgagatatactgagatatttgttaatatattcttactattttggtgaaactactaaatttgaaaagtacgtaaaaaaaacaagattttcctcattcatatggcttgtgtaacattgcaatttttcacgactcaaagttctttgcatcttattttcacacataagcatgggttacattttgttgatggggaacacatttcagtgctcttctttgttttcaagtaaactcatattattaaaaacagcagctataaaatattctccataaaagatatgttgaattcctaacacctggtacctgtgaatgtgaccttacttgaaaatagggtcttcatgtaaattaagatgggtcctactgaagtaaagtgggctcttaatccaatgactggtgtctttattaaacaagaggatatataatgtagattacaacacacacacacacacacacacacacacacacacacacacacacgcacaatggggtaacatcatgtgaagtcacagacacacagaaggaagaaagccctgttgcagcttaggccgagatcaggattatacagctgcaagatgagaaacaccaaggaatgctggccaccaccacaagttaggagagagagcttgatttcagatttccagcctccagaactttgagagaatacatttctgttgttttaagccaccgaatttgtggtgctttattatgaagcaataggaaactaacagagggggaatggaaatttacaggttaaaaaagtttcgctgccatttctggttatttcatagagaggaaagcttgtaactcagagacaccctagttcaaattctagtaatttcacttggaagctttgtatttttccgcaaattatcaaactctaactaaaacttagctcacttctgttcataaagatcgtgattgcttcctaccatttttaatattaagtaagattatgtgtcttaaaggcctagtgctttatctaggcctaaggaaaggtagtataaacgtaagcacaggaaaaaagagaaggatgtgctcatggtatgcatttgcattacctattatagctgtttaaaaagaaggtagacacgctagactcaataaaaaacaaaaacaaaaagtaaaattactgtggttatacaatgtcgttggcaggattttcaccatggtgttactcatatgaatatgttacctgaaaatagcaaaacagacttcacaaatgtaattaagagtactaatcagttcagtttaaaagaaagatattatttagatgatctgattgaacccaatctaatcaaataaacctttctcttagatgaaaagcagaccttttccttaggtgaagacataaagggaagtcagaaagacttaaagtgtgagaaaaagtgaatatgtcattgctgacttgaagatggaggggtacaaatatcaaagacatggagatctcagttctacaaacttgagatgccaaattctacccacaaatggaatgaatttggaaatatatccttctcaaactactcttattaatttattattgtttatattttgaggccctatacagaaatgtcagctgtgtggtactcaatttctgatctatagaattgtagataacaaatgtatgttgttaaaagccactaaattggtggagttaacaatttttttaggcagaattagaaaactaatgcatataactatgtaaagatagaataaagatgatagttctgattctctttattggtttctttttactttaccagctttcttaatagattacatccacattttgagttgacttaaacaaatacatttctaatgaagttgaataagaaaagtcatgcattattttatcgggtagcctatccaaattaatttgaattttctctgcccaatatattttatggaaacactattttaaattttaaattgtttcaatggataatatgagaaaaaattaaataaattccatttactgctagcatttaccagcaaccaagacacaatacctcagaatctcttagaatttctgacttaaccaagtatattaattcttatccatggcagcaatacaagactgtttagatatagtttatcacaaataaacaggtatatatatatatatgtgtatatgtatacatgtatatatgtatatatgtatatatgtatatatgtatatatgtatatatatgtatatatgtatatatgtataaatgtatatatgtatatatgtgtatatgtatatatatgtgtatatatgtatatatatgtatatatgtatatatgtgtatatatgtatatctgtatatatgtgtatatatgtgtatatatatgcgtatatatgtgtatatatgtatatatgtgtatatgtgtatatatgtatatatgtatatgtgtatatatgtatatatgtatatatgtatatatgtgtatatatatgtgtatatatgtatatatgtacatatatgtgtatatatgtatatatgtacatatatgtgtatatatgtatatatatgcaaacatatatgtacatacatatatacacacatatatatgtacatacatatatacacacatatatacacacacatatatatacatatatatgtataaatctcttttaaagtgtgtgtgtgtatatatatatatacacacacacacacacacacacacacacatacatccctataaatatggggaaaataaataaatgcactatgggcacatgtgatctttaataaagttaaaattggacctaatctgaataaattaaaatgctaagtgagcattttcctattagaagatttagactcagaattttgaaaggggatttttgtctcacaaatgctttatttcagatatcatgtgttgaattttgagagtgacaatttcattcccctaacctagaatcaagtaaaaaatataagcagaaaatgcaaatatcaactcatttctattattattatattattattgaaaacgccaaactgaaaagcaccttggatgtatgggcacaatcaggttctttttcatttcctctgttttcaagcttgctcaccaatatggcttcccatttgataacttttttctttattcctggagggaagaagtacagtgagattaagggaaggtggaagtctattactgttatttcacaaagaacgaaaattactattatatggcagaataactatctagggtagaacaatgtaaatgtttatattaaaatctttaacattggcagaatatctaagtttcataatgtacacatgttactgtgatttccaaatttctaaagtaaaatgtagttattatctatttttgtatagcttctatacggctatggcacattcaggtcccaacagtctataacaagcagtatatttggtttcaaatggtatgacaggtagcttcttttaggaaaaaacaaggtcctgagaattaatgtgaaaccccaagatgaggatgaagtggagaggctatcaagctttcaagagtaagattttccatcctgccgttgcatctgactccacaatgtattatttcaaaacttatttctgagtgacccaaaaaggctcagcttgactcatcttttgaagagaagacgattttctaggagaaggtttaattcattaacttccaggtcaaaggaatctttatgtaagccttccagatgttaatgttcttttgaaatatttgaatatcatccaagtgagaaccagaaatttgacacagaaatgacaacagtaaattcaggagaaattttatgtttctgaaaatatagaacaccatttttctcataaccatacttttccaaaaaaatattttataaaatggtacagatataaaagggaaaaattcaaatatctagatacatataaatataagtatacaatcctgtatgtaaatatgcattgttgttctgtgtctacactacattagcctaataaaatgaaggtgtgatctaatttacaaaataatttattagcagaacatgtggataagtattgcttcaattaacaaagtaaagaatttatgttcttgtccagcttacatgatttgtataaaaccttcttgtgaggcagtaaaagaaaaagatacaggaatacagggtttataatcacctaaaaaaagtcatatcctgttattgtcatttatttttattattgtgatattatccacattactatattatataacctcttcaggcctgagttttaaaaattttagggtaagattcaaaagatattatctacagcacattcaattgtgggcataaatttagatctgtatttgcaaaattctgtgtaatttacaatgcaataattgaatgttagtttagctttccctcctttaggatcaaataaaattagaactatcactctgaccacccccagcatactatattctgtgttattttgtattttctgccatatcttaacagtgtagtctgcttttttactaaaatgtgagtagaaagcataaattatttgattcatatttttatccttcattgcccactgcatataatcctgcaagcacattactatgtgatggataaatttattcattcaacagatatttcttgaagatataatatgatccaagttgtgatatgtgctaataatacaaggttaagcaatgcagagtcattctttctactcctgagttgagagcttcaagatataatgaaacaaaaataaattaataataatattaaaacaccgtttagctttctttcctagtatgcaattttttcttctatggaaaatataaaatataaattacatgttattctattgagaaagtgaagacaccagataaaaaacggtggcatagactaaaagcatagggacagcagtatggtctctgacactgactgcctgggttccaattttagctctgtcatttaccatttgtttgactttgtccggtgtatttaactttacagtcttttagttatctcaaagtaatgaaatgaagcgaacaaggagtaaccttacatttttctcagattatcagtcatgagaatcttcacttgtttgacttttttcttcaagaattccaagcactaatatttagatagatattctccaaatacccactatgatttggtggaagcagcacccagttggtgtgctatgtctaatatgcaaaataactattttatgagattttaaaaaactcatagttatctcttttgtggggagtggcttgtttatagaaattccatcatgatcaagctagaaagatcaagaccttccaaacacggctggatatagttaacatcatatgtgtaataataataacaattattaatcatccccaaaaccagcctctaaatttgtcattggtgcaaagaagaaagtaggtctcttctttgtagaagtttcccaatgagttctgattattaatggtgactttgaaattatatttcacagagagtggcatcagtgttttaggaccatgctgagttttagagatttctgatgtagatattaatctgagccattttacataaagagctcctttttaaaagtaaacatgtcctctaattaaactcaagaaattaaatacaaataaaagaatgataaaaaattctgaaaatattaactttattacataaaacttttgaggatatgtcatttggggtattacaatgccttgaatctgagctctttaaaaacaaaacaaaaccccccaaatttgtttcctttttaaaaaatgtgacaataaagttatataataaaatgaatatatctcaatattttattttcttatgtttttatttctcttaagaattatggcataaaataaaaataattattttattgaatggacattgataattttcttacggtatttttcaactttattgaagtaaaattgacaaaatacaactgtgtatattcaaggtatttaaagtgaaattttgaattttgaattcattgtaaaatgatatccacaatcaagataattaaaacatttgtatacttaagatatactctcttaggaaatttcaagtgtaccttacatttttattatcatgcaatatgttaggtctccagaacttatttgtcttataacttcaattgtgtgccctttgaccagcatatccccatttttttcacccttgacctctgataaccacctttctattctctttttctgttaattcaagtgttttagattacatattaattgaggtcatgctgtattagtctttatatgtctgacttatcccacttagcataatgtcttccagttgcatttatattgtcacaaatgacagaatcttcatattttttatagctgaataatactctactgtgcacatataggtatatttgtatatatttatacgtatatatgcatatgtatacatatatatataccacacatttatgtgtatgtgtatgtgggtagacacacatacacacacacataaagatgatctctaacttatagtggttcaacttacaatttttggactttatgatactgcaaaagcaatgcacattcagtagaaactatacttcaatatagtattattatatattactataaaacaggctttggattaaatgatcttgcccagctgtaggataatgtaagtgttctgagcacatttaaagtaggctatgctaagctatgaagttttgtaaaaatgaatttttgtcttggattattttcagcttaagatgggtttatccccattgtaagttgaggaacctgtaggtgtgtgtgtctatacaaacacagacactcactatcatatgagtgacaattcttttttcatcaatctttccaaagatgcttaggtgttttcatatcttggctattagaatagtgctgcagtgaacatgggggtgaggatatctctgatatttctctgagttagtgattttatttcctttgtatgtatgcccagaagtagagatgccacatcatataatagttgtattttaaatttttgaggaaacttcatactgtttttcgtattgattataccagtttacacttccatcaacaatgtaaaggttcttttttctccacctacttgccaaaactcattatattttgactttttattaataacctaagggatgtgaggtaatatctcattgacgttttgttttccttttccctaatgatgactgatattgagtagatttttatatatctattggccatttgtatgttttcctacgaaaaatttgagttcaggtcctttaatcattctttacttggttttatagttgttttgctgctgaattgtacgacttccttatatattttggatgttaatctcttatcagttaaattatttttttgtattctataggcttccattttattttgttgaatgtttcctttactgtacagaaacattttagtttcatgtacttccaatcatttattttttattttctcgcctaggcttttgatgtcaaatccaaaaaaaaaaattgtcaaaaacaatgttaagtagcttttctcctatgttttcttctaattattttatagctccatgtcttatgtttgaacctttaatccattttcagatgattttgtgtgtggtataagatggggatattatgtctttttttttttttttttttttttttttttgcttgtggatatagtttttccagcaccatttatcgaagagactatcttttatccattatgtagtcctggcacctttgtcaaaaattaaacatatatgcatggctttactctggacttttttttatattccattgtctgcttttatgtcagtgtgatactgttttgatttctatcacatttaaatataacttgaaatcagaaagtatagtgccttcgactgttattcttgttaaaaattgctttaaggggtcaggtatgttgtgattccatacaaagtttaggatttttgtgcgtgtgtgaaaaatactgttggagcctgataaggatcgcattggatctgttggggtagtatggactttttcatagcgttgattctgttttttcaaatttctcttttagttaaaatatatctacctaattcattgtagtacatctgttggtacatctatctctattttatttttttttttcattttttattttagtttttatttttgagacggagtctcgctctgtcacccaggctggagtgcagtggcgcgatctaggctcactgcaagctccgcctcctgggtttatgccattctcctgcctcagcctcccgagtagctgggactacagatgtccgccaccacgcccagctaatttttttgtatttttagtagagacggggtttcaccgtgttatgcaggaaggtctcgatctcctgacctcatgatccgcccacctcggcctcctaaagtgctgggattacaggcgtgagccactgcgcccggcatctattttatttaatagaggtattaagggtacagccagcaaagaaaaagtttaataatctctgtcctgtattcaccttccaacccaactgcaacacccacttagagaattcacagcattgactaccaatttaacacagagtgagtataattctacaaggcagacacagaaggtcatcagacactatacaattatatggcatagaaatagtggttttaataaaacttttgatttctgttatgtttaaagtaataatttaacgaaccatgaattgtaatggtttagaaaattattttgggtagacttttatttcttctggtaaagatatgacaggaactaaaacaataacaaactctctttaaatgtagacaatcctgtgaatacattttgaaagacataagagaagtaagaagaaaaagttaagatttttagagttagggcatgaactgcttctccaaggaagagttgtgattgtaagtttagtcaaggggaaataacctgaattgagaatgttcagtttatacatatgcacacacacacaaattgattttttgtatacttttgtgaaccttgttcaacaaatattataatgataaaactaatacaaactatagacttaaattttttaaaaaagtatttcagtatgatacaattatcttccaaataattacattataaaatagcaaaaattttgaggagggcaagtggtcaaacttctttcagattttcatttttcaaatatatatatacaggagttctccaaccaaatactttgggtttagatatctagtggtatttgctgccatagatggaggcctttcacaggtgatagaggagattattaaaaatacaaagtggagatgacttctgaaatggtaacgtaacatccagataacatcatctaggagggctccctaacattctacccagcctggacttgtaggttggaaactatcccatttgtgataggcttagtagactaccgaggcactgaccaccatagcctcacttaatgcataaggcagaattgtatgatacaagcaagctttaaaaaaaatagtgctaccttaccagcctactgcctacttctaaagaaggagtcattttgagagatgaaccccaatcctagctctgtagcagtggtgtagtgtgtttgccaagttgacagattgtgaaagcaaagaactctgaaactctccacagttgtagaagaagcagctgctttcatttgaaatagtgtaggaggaaggctacaactgagtgctctaggaaacataaattgtggcaattaataaaaggctggggcggtggctcacttctgtaatcccagcagtttgggaggctgaggcagatggatcacctgaggtcaggagttcaagaccagcctggccaacatagtgaaaaaaccctgtctctactaaaaatacaaacaattagtgggatgtggtggcatgtgcctgtaatcccagctactcggaaggctgaggcacaagaatcactttaaccctgggggcggaggttacaatgagctgagatcacaccactgcactccagcctggatgatagagcaagactccagctcaaaaaaaaaaaaaaaaaaaaaaaaaaaaagagatggtagcataatttgagcagcaagttaaattgcaaaccagctagaaattcatcagagaactaaggaaaatgcatggcaaagagcctgctggaggtcacagcaaaccaaaaagactggcattaaagattatccctttaaaggggcccagattttattggatcagactgtagagcaatttatgccccagggaactaaaaatatatgatgcaatcagctggcaattagccaaggctaacctgggagtaacaacaactgaggcagacaatttaacagaaagatcaagaaagagacagtcaaagaaacaatcactcaaataaactcacttgccattccaacgtaactgtgtaaatacccaagtctgcactgactgaagaatggcgttcgaagaggaacgtgatggggaaaaatagactttgctagaatagtccagcaaagttgctaaatgaatagagacacaaatagtgacattcatcagttctggaggttgtgggggaaaatcagtatccaaagttgctatagtaaattattttaaacatctaggactgaagaaaacattatgacacatgcaaagaaacagaaaagggtaacttatgcagaaaaaaacggtaggcagcagaaactgccttttgagagggcccaaatgtcaggtttaacaaagacattttccgttaaggaactgtgattagaaaacattgctgaataagtaaacatttgatgaatgattgaatgaacaagtgagtgaagccatccaaccatgcattttggcccttgtttatggtggctcaaagagaatattcaagaaaataacatctcacagaatccagtggttctaattatgttctatgagtggttctacttaaagagtaaacttttctattttcataattttcaagaattcacgggcatgccacggtggctcaggtctataatcccagcactttgggagggtgaggcaggcagtacacttgaggccaggagttccagaccagcccggccaacatggtgaaaccctgtttctactgaaaacacaaaatgagctgggcgtgggggcacgtgcctgtagtcccagctactcaagagactgaggcacaagaatcatttgaacccaggaggcgaaggttgcagtgagtcaaagttgcaccattgcactccagcatgggctaggaagaataacttttaatgatattttagggatttaagactcctttttaatatgattaaaccagagttatacctacatgatatgttttaggtcttaaattgttataatgtaccttacatgacatagctttgtttttttttatttttattttttgttttgttttgttttgttttggctatccgaagtaacatataagtgacttttatttatattacatttataaatcttgtgaagttaaaatgtttatattattcattcaaaaatagtcaacttttactttgtgccgaggttgtgctagctactaagactgtaatggtgcctatatttgccctcaagcaactcaaagcttaagggagcaaaataataacaaaaatgcttctacagtccattattcaaaagaatgtatatatctaattcatttgatcttcataaaattaactgagataagtaccatttaccccattatatatacatacatacagctatataagatatattttgcacactaataaaagcataaatattcatgttgcaatgtgatatacactctaatagatataggtgatctcagacagggcttgttagattgtgtgaaaagatacattgagtcagagtttggcaattatggaactagggtggaaagggaggcagttactggaaagtaaaaatggaacttacgagactatggagatggttttcttcatcataatcattcatcgtcatcatcatcatcatccctggcgtttattgagccctccttcaacacatgtcctgcatattattaagtgccagatattaactctttcactcctcacaccaagccaagatataactacctcatttatcaccattatacaaataagaaaagggatacaaagagacataaccgtaatttatataaactgactctcacaggagcatgacatatctaggaactggttggaatattaaaataatcacaggagataatataaatgtagtcttgagtcagacaatatgtgttatgccaagaagtttaaactttgaaaaacatgtcattgatgacttcaggaagaagcattttaggatttatgtttttaaaagatcatgtactgaaaaaatgtgagcaagagagaccaattaggagaaaattatgaaattctaaggaaggaagggagttgaaatagtgagtagttatgaagctagaaaaatatattaaaacccaattaaatttagcatagaattgacagatgtaatgatcatttggatggcacagggttaaagggaaagaaagaggaattaatgtggattacatagttttacacttggacaaattagtgatggggtcactatcagagatagaaaatgcagtggaggaacaggtttgatggaagttaattttagttttgaaaacgttgcattttaaatatttgtggtagaggaataaaacaaaattctagagttgactaaagatttctttatttgaaaaattaggccaaatcatgactttacaaattgatactctttggaatgaagactcattttgccatgatatgctcccattaaatgtgatttacctttagtttctattaaaattatgtttatattgaaagtaagctatcaagtaccagttttttctttctgaagtatggtttggatttagatctcaactttgctcacacactcttacaattttgtgaatagggctagcctcaccctacttttaaagataatagatgattagcagaatataaatagatgaacatttgattcttatgttttctgctgggtataaagtggataataacattgttcataatctaatccattttctttacatgattagttgtgtttaattttctctgtgcagacagattataagagacattttaagtcatattcttgtaaagatagataaagtgtccattggacatatttctttaattttctttagggaggtgcatcttttcctttctccaatagacatctacccacttttgaagttctttcacttgctctttgcttcctgctcttagggaaccctagtggtactaacaaatgtttagcaaacaagcagttacagcatctttgtgaagaatccacaggaaacaaatgtccatgccaactcttatgtagaatttcacaataaacatttagagagaagatcttcttcagtagctatttctccctctctaacttcctaaaaccaaaaaacagctactggatagtgaatctacttgcattgctggtagtgttttcctgttctacagactctaagaacaaatgaaatttcagatacttggtaaaggggtgaattctatctgacatagaggtgatgcttttatatttgaccaggaaatgatgttaaaacataaacagattgtacttgtgaatgcaggtgtgtgtgtggatgtgcatgggtgcacacacacactctcatgcacaaacacacttctttctctctttcttttcctaatctatttaaaactatcataggtaagtttaaaaccataaaataaaaaatgacatagggtaaaacaaaataatgagcatatgtagttaaattttaaaagtcactacatttaacttttttttaatttcagcttggaatgtaggaaaattttgtaattaataagtcccagttcagattcttctggaagaaataagacctgggcatgttgaattggaaaagtatgtgggaggaagcaacaatagattagaattagctgaatctacatttccttgaaaaaaaattcaaatatagaaaatgtgatgatgaacaataagtactagtgacttaaaattttgagagataacatgaagttattattttttaaaaaggaaggaatgaaagagacattaaaagaggataatgctcagtcactggactatcagaaaatatttcttattctgccagaataactagctgtatattaaatctttcaaaaatgccctctctgcatatgcgaaatatctgtgcatcttaaatatcccatgaaaacattttatcagtgaatttagaggtgatcctaatctactaggcacagttaaccgccaactctttggtgtgtgttctatttacatttgtggtaggtttccatcagctgtgtttatgagcttgtttctcttgctactctaaactcattcattgtccagtaccatagcacttgtcgtatgattgacttaataaatcataatagatgcttggtgagtagatttttgaatggattctacctttaaaacctctttctttaaaaatagctaatatacagctgtctaaaaacaaaaatgaaggaattatatttgaatcctcgttcttcctaccatccagtccattccatttttggtaagtcttctctattctagaaaacatattgttaatcaacttctttgtatctctgctctctctcctactatgattcaaactataaccatctttttctgaacttgtgttactttaactgatgctcctactttcactcttgagccacgtataatcttcacacattttgaaatattcaatttatatcatttcatttaaccccctaaaaaagaatttgaaaagccttttattatcactagtagtaaaatgtacatttctacgtctggaaaatagggctctgcatattcagtacggcttatcactcagatgttgctttttaccaatttcttctgtgttctctctattatagccacagtgacctttctatgttcaaatgcgtaaaaattattcctgatttagatctttgtactgcattttccctctcttgggaaaacttttcctcgagaagggacacatagctcaatcttctgtgttttcaggaagccattacctgacccaccttaaagtagattatcttcctgttcctgtccattactatcttttgctttctttacctttgtacacattattatttaaaatcaccttgttaatttgattacttctttataatttctatctcaacctcatagactttatctgcctcatgcatatttctatcacaagcatccagaacagtgttaatggaatataatctaactagagatttatatgttaaacctcttccaggttcaagaattaaagtttactgcctgtcattaagaaaaaaggttgaaatttcaattttgaaatcacaggtaattttgttattaattttaaaacatattttatggatttagttattcaattaaatcttatttttaattttgaggtaattgtaaatatacatatatgcagaagtaatacagagaaattccatgtaccttcacccagtttctctaataatgacatttcataaaactatagtatcacaaggatgttaacactgagaccatcgagatacagaacagtttcatcatcacagtgatcctttttgcttttttatagccataccacttaccttacctatgaatgccagttcttgatccctggcaacctctaatctcttctccatgcctacattttggtcttttaaataatgctttataaatacaataatatagtatgtaagcttttgaatttgaccttttattttatccagtgtaattctctggagactcatccaaattgttgcttgaatcatagctttttctttttattgctgagaatttggatgtaccagtttgtttaaccattcatctgttgaaagatatatgttttcttacccagttttggagttattaccaatacaaatgctatgaatatttctgaacaagtttctatgtgaacataagttttcacttatttgggatagatgcccaggaatatgtaattgttggttgtacagtagtagcatgtttagtttcagcagaattttcaaacagtttccagagcagttgtaatattttacctttccatcaacaatgtatttgtgacccagcttctgcacatctttgccattttggttttatatatgtctcatatatatatattatatatataatatttcagtcattctgatgtatagtgatacctcattatgctttgaatttgcatttccctgatggataatgatgaacattttgtcatgtgcttaactgccatctgtatatcttcacaagtgaagtgtctttttgggtctttcttctgtgcatttcctagtttggttgccttttttttttcttttattgtggtgttttgagagctctttatatactcttggtacaagtcctttgtggcatatgtggttggcaaatattttataccagtatatagtttcacccttatataccagtatataattttcaccccacttcactcctttaacagggtctttcgcagaggcaaaattttcaatatttatgaaagagaacttaccattttttttcttttatggataatagttttgatgccaattctctgcgtagccatagatccagaagatttcaccccaccttttcccctatgttttcgtttgtttatcccagaaactgtattgttttacatgttacacttaacgctgtgacccattgtgagttaatttttgagtaaagtatgggctttaagtcgacaatttttaatgtttttttgttgtttggtggtattgtgtgtgtgtggtatttggcgtgcgcatgtgtgtgtgtgtgtgtgtgtgtgtgtatgttaatgttttgaccatggatgttcaattccctcaacaccatttcttgaaaagactacctttccaccatagaaattaattttcacctttgtcaaaatgcagttggacatatttgtttttgtctgtttctgagttgtcagtggtgttgcacagatcgatgtgtctgtacttccactaataccacacattatttattacgtagctgtatattaagtctggaaatctggtagactgatacctctgaccttattcttcttttcaatatcatttgttctggtttacatctcctgcctttccatatgcaggtctacctctataaaaatgttcctaagattttgataggaattttgttaaatctgtatatcaagttggagagaactgcaatctttggttgaggtttgttttatggcacacagcatggtaaatcttggtatatactccataggcacttgaaaagaatgtattcggcttttgttaggtaaaatgtcgtataaacattgattagttcctgttggttgacggcatgaactattttatattcttgtaaattttctgtgtactaattctatcgcttgttaaaacagaggtagtagatgtttcatcatatgctcaggtgttcctgatgttcatggtgaggctatgctattttttcattctattttctttatgttgtttagattggataatttctatcaatcttcatgttcactgattttttttttccctctgtactttctattctgcatgagcctatttgttgagtttttaactttgttttttctgtatttttagttaaaaaaatccaattttgccttatttttcacctgatttgtggctacctcctctcttttcatttgtttagagtgtgttcatcgttattcattgaagcattttagtgatgacttctttaaaatctttgtgagatatttctaacatctgttatcttcatgttggcattaattctctttttgattcagttgagatttcagtgattcttagtacgatagtgatttggtattaaaacttggatagttgggccgggggccgtggctcacgcctgtaatcctagcactttgggaagccaaggtgggcagattgcctgagctcaggagtttgagaccagcctgggcaacacagtgaaacctcatctctattaaaatacaaaaaattagctgggcatagtggagggcacctgtagtcccagctacttgggaggctgaggcagggtaatctcttgaacctcggaggtggaggttgcagtgcagtgagcagagattgcaccactacactccagcctaggtgacagagtaagactctgcctccaaaaatagtaataataataacaataataaataaataaataaattaaataaaacacctggatcctggatatttggggtattatgttatgaaactcttgtcttatttaaaccatctgttttaactgccttcctctgatactactctggcagggtaagagaaaatgccttattactactgccagatagtggaagaggtaccagtttcccagcagacctccactgacaccctgtggaaaaaagggaactcctcattattgctgggcatgtgtgagggttttcactatcaatgtggcctacactgataccactcaggggatgggggaatgtagccttttaacctctgggcagtgatgaaagtcccgaatctccactaggccacatgtggaagcaacacagccaagaataggaaaaatgtttcattactgctggatatgatgtaagtccaggctccccagaaggtcttcactaacaccttgaggagaggttatcagctcccataggggtgaaagtcccaactccctacttagccttctcttatattaccatatttccagtctagggtgcctcatgagagtggaggtcagactgcctactgggcctttgttggcatgagttggagtggagccaccattttttatttgctgtgcttgactagagtagagaggtggttgcctatgtttttggcattgctaggctttcctcttgtttctaatcctttgataagagacaacatgcttctgttggagcttctacttgtctatatattacaagtttctaagttgtatcttcttcaattccaagtctgagatacatgagacaaaaagaaagcttaaacaattacgcagcatttacttccttgagttctagattcatcagtcggtctgctttcctcccttcacctttcagagttttgtgtttgttttatatataatggccagggcttttagttgtatttactgggagaaacagggacaaggacctctatgccaatgttttggaaacggaatacgcctaattttataccactgattattgagcatccttgggttatttatgcaatttttcatttataaaatgaaaatttctctgtgaaacttgccatcatgcttcagctagaagttttcactatattactgaaaaattcttatgtatttatttttgtaattctaaccacttagcattatttatttatttatttatttatttatttatttatttatttgagataggtcttgcttttttacccaagttgcagtgcaatggcatgatcgtagctcactgtaacctcaaactcctgggctcaggctatccccctgcttcagcttcctgagtagctgagactacagatgtgcaccgccatgcctggctaattatttttctttatttcttgtagagacagtatcttgctatgttgtccaagctggtctcaaactcctggcttcacgcaatcctcctgcctcagcctcccaaaatactgggattatgggtgtatgtcaccctgccagaggccaacttagcattttaaatcagatttcttttacatacatttgtagcatctgctgtactagactcccaaatcctttagaaaggagaccagaattttcttatccttaaaatacctatcccagtgccatatacttgaaagacactggcacattttttttaaataactcagttatttgggcttcctgacatttaatctcatgaaaagaatgctagagctttttagaccacattataggaaaaagtagtagtataaaaattatagttagtacagttatccctcagtatttatgtgtgattggttccagtaccttccacagaaaccaatatcagaggatgctcaaatccctgatataaaatcctatagtatttgcatatatctatgtatatgatcttgtatactttaaatcatccctagattacataatacctaatacagtgtaaatatttgttatactgcattgtttagggaataataataagaaaaaaagtctatacgtgttcagtacagatgcaattttttaaaatgcatttttttaatcctcttctagttggatccatgggtatagaacctgcagataaggaaggccaactgtacattcaaaataggtagtaattcttaaaagttgtttaagcattttggatctgtacatcatgctaacataagcattatttctatttctattcttctctatttctcatttggaaggcttgccattgttttctctaatgccagacgtactttgtggattccagtttaagcttaattaaatagatatattttagtcagtgagtctaaagccaaaatctaattatctgtaattccacagaaaacagtcaactgaaataaattttttaagatgagaatttcattccattatttgtgtactttcccactgttagggaataatattttacagatttttgccataaaaattgcaataagaatttttaactcaacaaatgaaagatcttttattttaaaatgttatgttcaaataaactttttttttgcagtacaggggtattgagactcattttaagttttgtcaaggtattatatctttctacttctgacttttctaatatttaaagaagaggcaattgtcatacctgctcctttttgctcagtggtaatatttgcacctgaggaaaataacctgaagataattagtaagttattagcttcctacactgcttactttttaatgttgttctgtagatcaaatactgcaaaagtgcttggaaaatgtcaaaatcctaaattcaaatcctaaatgtcaaagtcactaaattcttgtgcatttaattttgtcaggtaacatacactgtttgaacatttgacctatctgtggacagctgcaaagtaagtcctgtgagaaacacccataagtacatgctccagaatggacatatgcacacactctcacacacatacactcacagtgggagtggggatgttgaattgctacaatgtaagtcaaagcaattaagtcatgacttgatttaccagtcatttcacataaatccagatttaatgttcagtgagaacatataagattatcatgcttgctcctaaatgttaaaaaatgtcattaccagttgaaaatagccttctacatgttgatcctccctgggcaactttaccccttccctggagctcttccccttaaaactcccatgggttaacacatatgtcatgagaagcttccgtgagcctgctcccatgctaaggtagctactaatctgatactggtgctttgttctccctctaaattttatcatccttagagtagaaaatgtctcttgagcttatcacacagtggcacaaatgaatgcataagcaaaattagtgcattgaagtttaatttataacagcttctgtgtttgactcttaacattttatcttggttaattccttgttgttagaagacaaaaggtttgagattcagaaaaagacactaacctgctaaggtcacataccaatactgcgtgtagttgaactggagtctgtttgactttaaagccctatgcttgcagcaatatcacattgcatttgtggagacaggtaaatctatttttttttatgaagtcagtgaattttaatgactcactgagcaggtcctattaatctctgacttggttctttccattgaagagctcatcccatgagaacactagcaacaaagattctcttatggacctagccatcaaattcaaatgtcactgaattcctaaattctctctgtcattaattgaaaagcctgagattcttacttgtgaaagctttatgattctgtcttcactttagctattttctgtatctatattatatttttccttaaggttttgctatttcaagcattttatgatgctcattattctcatagaagaattacaaatagagtgatgcggtatctgctttctcttcctcttaatagaacattgtcttcaaaactcttgttcttaactgcctcagtcttgcttaagtctgcaaaaagaaaaatacatgtgaattcattctggtatgccttgtagtctccttttcttattttttataatttctcttctttttctctttacatacagtttcttgtgaacactgcaaaacactcctttccacatacatctttaaaaaaaaaaatacacggtatcactctgtcacccagaggcacagtctcagctcactgcagcctctgcttcctgggctcaagctatccttccacctcagcatcccaagcagctgggactacaggcatgtgccaccaggcccagataatttttgtatttcttttttttttaatgttattattattatactttaagttttagggtacatgtgcacaatgtgcaggtttgtcacatatgtatacatgtgccatgttggtgtgctgcacccattaactcgtcatttacattaggtatatctcctaatgctatccctcccctctcccccctccccacaacaggccccagtgtgtgatgttccgcttcctgtgtccatgtgttctcattgttcaattcccacctatgagtgggaacatgcggtgtttgtttttttgtccttgcaatcaccatgtttcctaggctgatctcgaatttcagagctcaagcagcctgcttgccttggccgtggcttcccaaagtgcgggatttaaaggcctgagacaccgcaccaggcctcctcacaaactttattcaggtagattttttaggttgggaaacaacagggtcttatcacaatgataatctcagggttttatctctaagttaaaaaataactaaacttagttctcagtttcaaatctgactaaagtgcttattaacagtttaactttggataattaattttatccagctgagcctccatttactcatctggtaattaaaactaggaataataatacatcccacttcctaggattattttgaagacggagtttggaaatataaatagtttacttgaccaagtttttgagaaaatagttgttatcctctccacacacacctttcactttacaaaactgcccatctctgtcctcaaataatttttaggcaaactgtcttttttactttctaaatatatgtggaactgttttaaaatcagcattgcactttagaagaaaagagaagcaaaactgttttgcaaagttttcttgatgcaaatgttacatttcatcaatttccattccgccccgatggtatggaggaaagaatgtccaggcttcgtactgtaaatgtgctttaaagagagagagagagaaaaggacacacacacacatacacacagagagattgagagagagaagcaggcatttactgaactcccccccaaacaacataaatctattccttttattaatgaaaagtcccaccacattctcagagtaggctgtactcataaaaactcatgggaaaaggaaaaaaaaatttacgggacttaaagaggattgcaaaactcttaagccagtgctggcttaaaataataaaatcagaattacttgaggaagaatgtcagtatgcttacctactcatagtaaaagtatgttatctcttttaagttttctttttgtcatttttttgatatgacacagattcatatagaagttgaatggaattttgcaggcttttgtgaaaagaacacaaggatctactttgtgtagatggtctactccttgtgagctggaaatgtcgtatcacagctatgtccccatcacttagaaaattgccaaacatgccaggcacagtggctcacgtttgtaatcccagcattttgggaggccaaggcaggcagattacctaaagtcgggagttggagaccagcctggccaacatggtgaaaccccctctctactaaaaatacaaaaaattagccaggagtggtggccggtgcctgtaggccctgctactcgggaggctgaggcaggagaattgcttgaatccgggaggtggaggttgcagtgagctgaggtcacgccactgcactccagcctgggcgacagagtgagaccccatatcaaaaattaaagaaaatgtcgaaacactatttaatgttcaataactacttgttaaacatttgctgtcttacattcatccatatgcttttgcctctatatgatgatagagacaaattcatctaaaattagctgctgatcatcttagaaatatttattgttcatatagtgtgttcataatcatgacttgatttcatcttatgaatatcttttaaatatcattaatcttaagaatagcaataggctgatattatttttaatttacagagagggaaactgagaatcagataaataagaagaattttccaggttcactcagctagtataagaaaaatactaatcacaatgccagaatttcagacttaataacatgatcagtaatcattcattaatatatgatatgtgtctattcattaactaatagtgaacaatagtcacgagtgtcctgtgtgtatttggtgctggtaataaaaataataatgatttttttttgtcctcagaactcctgttttagaggcagagtgagaaaaataagtcaattattacaataaaatgaaataaaactcttagtcaaaaatagctggttaaacatttgtttatgtctattatttcaagagcatattaaattgaaagtcaaagtataaaacatatataaagtcatatatataagaactgagctttccataattatttccctgcaatcattgtaaggaatgaggaaggatagggagataagaaagctcttggtaatggcgagaggttattataggtgtggattatatggttctaagttatggaggtgtaaatgtatagttaaagaaagatgtttggacttttggaataggaaaggcatacctgcacttttatcctattatgttattagctgtgtagtcatggatggctaacttctctctgagctccatatgtgataatataaagtgctttatgaagtacctcgtacctagcttttcaaaaagggtagtattattataattgtgtttatttttattattgttattattaggctgtatttgagaagtaaaattgataagatgatagaccatagtaaaatgaaaagatcaaagataggaggataggagaaaaagaataaatatgaagaaggagtgagacagagggagcaattggtatgcatggtgagcacagaaggaaatcctgtcattcccaaatgccattgacatggatgaaactggatgacataatgccgagtgaattaagccagatgcagaaagacaaatactgcataacctcacttatacatgaaaattaaaataattaaacttgtgaaaatagagtggaatagtgatttccaggggtgggttggggaaggggaaatgagattatgttggtcaaagggcacaaaatgtcacatatacaaaatgaataaattctgaagagctaatgtacagaatgattaccatagtttcagtatgtattgtatacttgaaatttgacaagaggagagattttatgtgttctcatttcaaaaaaaaaaggaagggaaaggaaaggaaggaaggaaggaaggtaggaaaaaaaagcagagaagagaaataaagaaaatgctaactatataaggtgaaaaatatgttaattagcttcattgtggtgatttattactatgtatacatataaaaatcaatttgtacaccttaaatataattctacttattttcaattatacctccaataaagctgaaaaataaatttagaacatatttaataaatgtaatgttgtcaggaaattacaaagttcaaatgcattctctgtttgctgaggtgaagaagaaagtccttgaggaaaagtttaagaaatattcgtttgaaaaatgactgtattatctaaaaaaaaaaaaaatcaaagttttccaactccagaaaccagaatcacagccttcaattgaagtaggggaataactagacccacaaaaggcattgataaagaaatagagtagattagctgaatggcatggtattcaaagaatatgtttgtacaggacagtggaaatgtggtgaccaacaggagtacagcatgtttccagaaaacatcttggaaaaaatcaatgtttctagtccattggtcttagagtgtatggggagtaggaacataaatagttaccaactagagatttgtaatataagggctgccacttactaactttttaaccttaaataatttacttaaggttttctgagtctctgtgttttctagtataaagtgtcaacctcggagggttattttcctgataaatgagtcaatttccatgaagtgccaaacagagaagtgaatactggtgattcatcaacaaatggcagccatctcaactgtcttcttccagtgagaaaagctgggaatgaaaatggtcctgggggagaatcaggtttcagccaaggcaaggagtatcagggaagagcctatattgtctcaattgtgccatcctatcacctgcaaaacaaaaatgcagaaactatcattgcagcatccttagcaagcagcaggctttaaaacacctgcttacaatcaggagaaaataaattaaactgctcaactgtgaagtcttaaaatacactcccaagtataatttcacagtgaatcacaattacattttcctcctctagatattccatcaatagttcctatttccttttctgctggttgactttcatcaatgacaaggtagcctttcagtcagttgtaaggatgagatgggagaccagaaatcaatgaaacacacagactttgtaaatgacatagccaatttgataatctccatctaactgttactgaacttcagccaattgtttgtaaggaaaatactattgtgaatcaactctgtgggctaacataacaatgaaggctaatcaatatcaaaatgacttaaaatcaatactgagaagatagtatttttttctgaacctgatcaacattaaactaattaatagacatcatgaaattgagaatctgcttcactttataatggctgaaaaaaatcaagtcttgcttcatagtccaaaatggtatgtcacaaaatactacagaaagtaccatgctactccatgtgacatttgaagtgacatgttctgcttttcattatattagggatctgccaactctaatcgacagggcaagtctgtatgctttgggatgcttttggtccttatgttattaaactaaaacaaagagaaaaagttaataaacacttttgattgagtagaaagacaataataaatcagcctgtttaaaactctcctaatacaagatgtgagtacacagataatacagggagatgctcctatagtacaaaaatatgtaagatgtttctttatgggaaatacactttggaattaatatttaatacctcaaagcagacataggcaaaggtttgttaaatatatcctaagtcaacaagatttgaccataatcagataattgaacattgggaaaatgtgcccagaaaaaagagaaggtttttcagctataagaagaaagcttattgatggccagaaatgtcagtgctcattcaggcactgttgtgggggaccaggctttttctttagtactagcttgtctccccggagtggcaagtctattggtataccaaaaatggagacccaaattcattttttaaagaaatcaggtatttaactattataaccgactttctttctgtgatcccaggaaggccaagaacattcagatagcaatttgctttaccgagtagaggcagaacatgaaatccagatattcgcttgcagtatgtgaataaccagtgttctgtttgcaaaacccacctctggaaggattctcaacttgaattttccctgcaaaatggaacctctctgaagtactgacaattccagtgtttgaagctgcaggcctgagagacagactttagaataaggtagccttacaaggtcatgccacatatgacacccattggatgacaggcagtgtctcttgtcactattcagagcattccctccagcttactcttctccaaatgtaatacagataatgacacccctcccttcaatgtgtgcatatatttaactgacatttactaattattatcacatattttaaataggctaatcataatcagagctagtcaaacaaattagaccctgaaatatttactgtctggggcattttcagtctttggctccatgttgagctggtgacaattcatccatgatgaagcagttataaagtaaaatattctctggaaggagcagggttgcatggcacactgttttaagatgcgtacttttaaattttggaacacagataattcttgtaaaattatgactcacacacttgcatacacacgcacacacacacacccatgcatacacacacacacacacacacacctgggatacatgtctatctatgcctgtagctgatgtttatcattaagaaacatgctggtctttgatcattatgctgttttgctttgttcaaaacattgcaaaaatgtaacaatgtactatggattgccatggaaatgagaattggttccttctctgttatttatagaggcccactcacagatctaagacttcaaatgagatcatagctttaatccttaagatgctttttttcttttcccgagttatgtgcagttgagtcctgatttattagtttcaaaagcattttctaagtaattgcctcatactgcctggtcctttattttatttatctttttattttttttgagatggagtctcgctctctcccaggctggagtgcagtggtgccatctcggctcactgcaatctccacctcccaggttcaggcgattctcttgcctcagcatcctgagtagctgggattaaagccacacaacaccatgcctagctaattattgtatttttagtagagtcagggtttcaccgtgttggccaggctgatctggaactcctgacctcaagtgatccgctcattttgccctcccaaaatgctgggattacaggcatgaggcctcttgcccggcctgcttggtcctttatacaggtgaataaagataagagaatctgtgtgtgtgaatacatacatatacacgtatagatatgcatgtagcagaattaatgtaaaagattagatctatataatgtgcataatatatggtatattatatataaaaaagcaatgtaataaacaaggtagttaatgcaaactttctatgataaatttatcttatcagctgataatacaaattagttatttttatttctatacatttatgggatacaagtgcaattttgttacatacatagatttatagtggtcaaatcagagctttaagggtatccatcatccaaataacatacattgtacccattaaatatttgttattacccacttcaccactctgttacacttctcagtttctattgtctgttattacatactctacgttcatatgtacacattatttagctccaaattatgaatgagaacatgccatatttgtctttctgtgtctgaattgtttcacttataattctggcctccagcaccatttatattgctgtaaaatacatttattcttttttatggctgaacagtattccattgcatatatatatatgcattatacattatacattatatatatattccattgcatatatatattacatatatattatatatattccattgcatatatatatattccattgcatatatatatatatatataccatattttctttatctaaccatccgttgatgaacacttagattgattccatatctttgctattgtgaagagtgccacaataaacataaaagtgcaagtgtctttttgataaaatgatttattttccgctggatagatacccagtagtgggattgctggattgaatggtagttctatttttagttccttgagcaatcttcatactgtttgtcatagaggttatattaatttattttcccaaaatagtgtataagtgttcccttttcttcacatcctcactaacgtctgttatcttttgtctttttaataataacctttctgagttgggtatgataaagtaccactgtgattttaatttgcatttctctgatgattagtgatgttaagtatgttttcatatacgtgttggccatttgtatgtcttcttttgaaaaatgtctattttttttttgccaactgtttaatgggattactttttttgtttttactgagtcgttgaagtttcttatatattccatatattagttccttgttgggtatatattgtaaatattttcttgcatcctgtaagttgtctgttcactctgttaattatttatttcctgtacagaagctttttagtggaattaagtctcacttatctatttttgtttttgttgtttgtgcttttcaggtcttagtcattaattctttgcctaggccaaggtccagaaaagttgttcctatgttttcttcttggacttttatagtttcaggacttccatttgtctttaattcattttaaactgatttttgtttatggtgagaaataagggtccggttttattcttctgcataaagcattctaattttcctagcaccatttattacaaagggtgtcttttctacaatgtatgttcttgtggaccttgtcaaagattagttggctttaaatatgttgctttatttctgggtgctatattctgttttattaatctatgtgtctacattaatgccagtatcatactgtttaggttactatagccttgtaacataatttgaagtcaggtaatatggtgcctccagctttgttctctttccttgtaatggctttggctattccgactttttttttttttttttttgctgttccatactaagtttaagatttctaaaaattccatgaaaatgatgttgttatattgatagagtttgcaccgaatctgtagattgctttgagtagagcggttattttaataagattgtttcttctgatctatgagcatggggtgtttttcatttgtttgtgtcacctacactttttttcattagtgctttataagtttctttttgtagagatctttcctctacttggttaaatatatgtctaggtatctttttgtagctatcgtaaatggaattgccttcttgatttcattctcagctagatcattattggtgtatagaagtactactgatttttgtacatcgattttatgtcctacaattttatcaaattcatttattaaatctaaaaagttttctggtgccatctttaggtttttctaaatatgaggtcacgtcatcaggaaatattgataatttgactttctcttctgatttggaagctttttttttctctttcctgattgttgtggctaggatttccagtactatgttgaaaatgagtggtgaaagtgggcattgttgtcttgttctagatcttagaagtgttttcagcttttctccacttactatgatgttggctataggtttgttgtatatggccattatcattttgaggtactttccttcaatgcctagtaggttcaggtgtttttctttattgtttttttttttcttttcttttcatatcatgaggtggtgctgaattttatcaaatgctttttctgtgcctatagagagatcagatagtttttatccttagtcctgtttatgtgatacataacatttattgatttacgtatgttgaaatatccttgtatcccttcgttgtagtgttacatttttgatgtgctattagttcagtttgctggtattttatggaggattttcacacctgtgtttatcagggatatcggtctgtagttgtgtgtgtgtgtccttgtctggttgggtctcagggtgatactagcctcgtggaataagctagagataattttcttgatttttgggagctttaggatgcttggaattagttcttctttgtatgttttgtagaatgcagctgtgaatctatctagtcctggcttttcttttttgagagatattttattactgattcaatccttctagtcattagtggtctgttcaggttttggagaatgcaaattaatacaggaaagagggcatatgaatataatgtaccaattaccaaacctgatcaaacagcctgctgctgctgcctatttctggcattggaagtgacccacaatcaaaatgtaatatggataggcttttgctttttactatggaagtggggcatttataggtatttaggattttatattagttttcagaataactgtgtaatgtcatttcacatttgagaatatgttaatacttaccaactcactaaacacctgaaagataggcatttcactactgaatttttacacaaaactgaaggaacttgtgtgggtatcaggatgccattgtataactcaaaatagaatatttattcatatatttgggtataatgagggacataaaacctcggcatttgatagcattgtgaaagagcttgctgttttctgatccaatatgtattttttacacaaataatttgaaataatctagagcaaatgtcacctagaaaattgaacagaagtctaataaagtttgcatatagatgaaaagcttattaatttttaactagcttcccccatatcattacaatcagtgcactgcaagaagtgagttctattatcagcacaggtattacaagtatgatttttaatgtatggccttaggaatcccacgtggcaaccacagaatttttcttatgtaaatgtccattaatcagcacatgaaaattcctgtctgctcatcagggcaatcctaacagcatccccaacaaacatttaaaatagacgtgctccaaaatctcaagtcctccctagcctatgtgaaaaacataaacaattacagtggactgaacttaatctcaagaggagactggattgttccaacatataaggaaatgcaaaatatcacacagaatataaaccaagctgatgagatagcctgaagttgtcagatatatgcatcttgcaggcattatggggatattagtactcacccaatcttgtttgagagaacaccatttcaaactcctttaaccaagtaatgtattaagaaatgatatgtactgcaaccaatggatctcaaaggagtaaaacatgttgagttcctgtttgttaaggaaagatggggtcttgaagaatgataggatatagaaaggaaatctgagcaacaggagtaaaagattatcttgttttgatgtgaattgccttttctagtctgggagattttcttgttgccttcatgatgaccatatgtaaaattaccttcatatgtatgtggcatttttccacatttatttacacttatcttgcactcacattcaaaggcactcaggagtagaggacacataaaaatattccatccaaaaacaatgaaacaaacagatctgccacaatgctttcaagtatttaaaaataaaatgaggatatataggttattttgaaccaaatccaaatatataaagttgactttagctgccactatgttcttagcaaaagatacacacaagttaggccattgaaacattttaaaataattttctaaaaggtcaccttctcatgtgagttacctagccactccatgaaaatcaatcagaatctttaaaagtttacaataattgagaagaaaaagcagtggaaaaaaatgatgtgttcttctcagttgtattttagtatattttatcattgcaaagaaattcttgaaggtataagctcaaaattttaggcaagtaatataattcagaataaaatatgtttaaaataatcacaatttacttttataaaaagttttatagagaaaatatacattgttaatgttgaccttttatatatttaagtatgatgttttctatctcataatgaatgaattaatatctcaagaggtggctgcttatatttataggattatatagcaactgcatgaatttattttctgctcacaaaatgaaccattaactttctataaaagatatacattaattacattcttatgctttgtaatcatcactcttgacatccttcaaatttgaaaaaaattattaaaatgtatttttttagtctaacacacgtgtgtgtgtgtgtgtgtgtgtgtgtatatatagtctgtctattaaaggacaataaagtctaaacctgtttaactattaaagcaaataaatgaagagctgagactctgaagacagaattattgggttttctatagcaatcaaacttactagaagtatgatcttgagcaaattacttaaccctctacttcagtcatcttatatgtaaatgaatttttgtgagaattatatgagttcatgtatgacttagaaaaaataaatctaagaacttaaaggcaaaatattggtgaaacatggcaataaaaacagcataattttcaaaatgtggcacagataccctggaagtactattccatattacaagggtggtaatgtataccataatcagatacaaacattatggtagaggtcctaaactggtagctcccatctagattgtctttgtatggctatcacagaattggtccacatagtttattttcattgaggtagtggctaaaaattacatatcagaagataagccaagatatgccagctatcgataacacagagagatcaagcattttctttctggtttttcaagatctcattccctattttttcccccatactgtaactaagtatcatcttcaagttctcctagtgttttgcattactgcttttttaaagttaattttttctggatttataacttcaaaaaaaaaaaaaagtaaatgagcaataaactgaccatagagctgtttgttttgcagctgattctgtttactcgtttgcattatgagcctggtcaaggcatttgagtttgcaggtgcaaggtgaaagggcttgagttcacaaaattaaaggcggtactggattttgttatcattttttaaaaacacaacatcaaatagaataattgctttatttattttctgtgacttggaacagatacaggcttctcagtatgaacctagtaagcatggatgatctgtactggagatgagatgaacacacttgttactcagctcaaaataaatcagtctctcatttgatctctgttagtcataataataacgttaaacataacctaaagatatccttgttaccttttaccaggaagcgtgggatgggggtgagggatgagacattatttaatgggtaaaatgtacaatgttaatgagatggttacactaaaagtccagatttcaccactggtcaacatacccatgtaacaaaactgcacttgtaccctttaaataaatacaaataaaaaaaaattataaaagataatgaaataaatctaccaatttcactttttatttttgtaaataaaaagaaatatgacactatttataatttgtataggagcattaccaaaaaaatgcaaacacttgatcttatcttgacattaaaatgataaaaataattggcattaaaaaattgatttttgaacaacatgttataagcaacatgtaagattttaaacctcaaatcagaaaagagtgtgtgtgtgtgtgtgtgtattcacaagtcataagaaataaacacatttcaatctacattaaaatatattttgtcaccaaactaaagacagtcaaatgtcattttcagtacatttctatgcaaagtatgctgtttatccttaagtaatcaatttaaattaaattaaactaatgataacttggttaaagatgtcagaatacaggcatttctatctcactgtcttctataaaacaactgaaaacaaagttatacattttaaaacctcatctgtaatgaaatttggagagaaaagaagctgtcagaccctgtgaaacttgaaacaaatcaacgcagagtgctggggagaacatttgaggcccacagacagcgttgactaaaagtggatctcaatgccttaagaggccccacagcaatactttacttgaaatacaaggcctgcggtgcaggtagactttgcaagctggtctaagcacaaggtgactctgcggaataacagcaaaagtggaactggggaaaagtactgcagagacatgctatccttacatattgtcagtgtggtggcttgaagaaatcacactgggtggcaatctactctggaacttctgattattgtcagtcgagaaaaaataaattgactcagttacctgtaaaaaataaataacctaaaataagtggggtttgtctgggaaccaggaagatttttttatttgtccaatggaactacacactgtaagagaacactgatcattatctgcctcatttatggtatgatggcattctgagtcatatcatcatccccaattggagacagtttcagccacagcatatttatcagttctctatcaatactacttttcaacaaatacctacactggtaaaaacattccctattcaaaacaataagtaattaaatataatcaacctggagctaaggcatagatagcatgcttacttataatacaggggttaagagggtggattctgaacctagactgcttgggctcaaatccagagcactctgttataaaatgagtgatttctctgcacatcagattttccccattgataaagtgggggcaaatattagctcatatcattgtgggagtataaaatgtgataatatatgttaagtacttcaaacaatgaccaccacagggtgttattcatccttagttgatttacacacgtaaatgcatatcatattttctacattggcacaactaacgttgtccacaagtaacatgaatccagcccacaatcttcacttgcctggcatactttgaaaactattaaaatggtgtctacacttctttcctatcacccttcaaataattcgtcagagctcagctcacacacacttaaccagagacataagaaaatatagaaaataaagcaagattaaaaataaaattttttacatgaggtaatatgaaagaacagagggcaaacagacatgaaattccaacaaataaaaatgatataagccaatttttgcttataaaaaaagatgcttcaattgaattttaaatataaaaattatagaatatatattaaaaactatcagtgttaaggtgataaaatagaaagctaaaaatgttgattaacagtttaaaaagggaaaatcttgatgttacattaatatataatcttttggtataaaattcaaaatcttaaaaatctataaaacaaaaattgtagaggatgagcagagtgttagaaatataaaagcattataaaattgttgtgggaagtcagggaccccgaacagagagatcggctggagcctaggaagaagaacataaattgtgaagatttcatggacatttatcagttccccaaattaatacttttataatttcttatgtctgtctttaatctcttaatcccatcatctttgtaagctgaggatgtatgtcacctcaggaccctgtgatgattgagttaactgtacaaattgttggtaaaacgtgtatttgaacaatatgaaatcagtgcaccctgaaaaagaacagaataacagctattttcagagaacaaggaaagataaccataagatctgactgcctgtggggtcgggcagaatagagccatatttttctccttgcagaaagcgagtaggagagatattgctgaattcttttcccttcaaggaataaccctggggaaggaatgcattcctggggggcggtctatgaacggccgctctaggggtgtctgtcttatgtgattgataataaggactgaaatatgccctggtctcctgcagtgccctcaggcttactaggattgggaaattccagcctggtgaattctagtcagaccggttctgtgctcttgcaccctgtttcctgaagatgtttatcaagacaatgagtgcacagagggacacagaccctcatcaataattctaattttaccttttgccttgtgatcttttattgccctttgaagcatgtgatccctgtgacctacttcctgttcgtacatcccctccccttctaaaatccctaataaaaacttactggttttgcagctcagggtcaccatcatggtcctaccaatatgtgatgacacctccgaagtcccagctataaaatttctctctttgtactctttctctgtatttttcagactggccaacacttagggaaaatagaaaagaacctacgttgaaatgttgggggctggttccctgatataaaatcattttatttaacttagcccatgacaaaacaaaactatatgaaagtaacattttaaaagatagatgtctaatatgtaatgtattaacttctggaacctacaatcaaatatagactttctttaaaattgtcaataaaatagttataaaatcgattatacatttagctacaaaaaattaatttccccaaatagaaattatactagaaatttaataaaaattaaatttctagctacagaagaataacattatatattgactaaaaatatagttttttaaaaaatcaaaatacaaaaatccaaattctaggacactttaattaagaaagtattctaaaaactatatagggaaaaaattgtttgacaaaatcattcaagctgtaattgcaagctagaaaaaaataaaaattcaaagtatacagtatttactacatggctaaagcagggcttagttgataatttatggccttaaaagaaggattaacttggaattttttctaaattatgcattttgttaagaaattagggcatattgtgaaaagaaacaaataatttatgataatgaaagtggaaattagtgagatataaagtagaaataattaaaaataatttaaaaataggaactgattgtttaaaaaataaaattgatacattaactaacctaatcaacaaaacaaatctcaatatagtattagggatgagaatggaaaatgaatcacagatactgaatcaaataaatattaacaaagaaaagacaattaattctaatacatttatgaaagataattttcccagaaaaaaatatttttaacagttaaaaaaagattttaaaaatctaaacacaccaaatgccacaaggaaaaagagagaaaatgttcaaaaacttgtcaaagacctgttatactaaaagctctagactcttaccttctctacaaatcttcagtctttttggacatttcttcatttattgaaatatgaaactttttctctatagcaataaattaattttcaatcatgtcactagttgcttattttagttaatatatatttttcactaaagtagaatcattttgtttctctatttgttttcttaattttgcattttacattttcacatttctttcctgtttttacctctgcatttctatgatgggtcatagtgattttctcattaaatttttatagcaacatttggtaatacattatattcttccattgtgttgtatattttccagcttcaatttttttcagctcatagatatgtaattctctctattttatgtttccccttatattttatttaccctttacttgtctgttcatattttgttttgtttgtttgttttgagacggagtttcactcttgttgcccaggctggagtgcagtggtgagatctcagctcaccgcaacctccgcctcctgggttcaagcaattctcctgccgcagcctcctgagtagatggaattacaggtgcccgccaccacacctggctaattttgtatttttagtagagacagggtttcaccacgttggtcaggctggtctctaactcacaacctcatctgacccacccacctcagcctcccaaagtgctgggattacaggcgtgagccactgtgcccggccttaatgttttgttttatatgagtagttctgcacaaaccatctctttcctctactgtaatatgtggacattctctctcactgcagttccactttcttgaatcctctctaccttcctctcctcactaccctgtgtgtcctttcttttacacctcaatgcaatcagggagcacaagagttcaattccagctctgtgaagactttatttaaagcaataggtctgctttttgttctgacattaggttaaatgtcttattaaaaagttatccattgtttttgctaatgttgcttattgaagacaggctcctaccctcccatagagaagaggcataagaaagttatctttttgacatctgtatttcaaagagatgattcccaagtccttgagaaaaacaactctgggttgtaagtgtaaacctcaaagagctaaagaaagaatttacaactggtgtttttcgaaagtaaatgttctaaaaggagtcaaaaagactcctgtgtatgtttagtcaagctgggcggaaagttaagggcatcttggtcgttactaactatgtaaacaaataaatatgcaatattatacagtacaagagatgactggtaccaatcagatggctaattgtgggaagctgtgaatttatataaggacctctgtcccaagagaaagacaatgagcaaacattaaatagatgcggttgtgcatctgacaaatctgatggtttggtttgagcacttgtatttttgtgagatttatctggttaaaacaggatttacatgacttttttctgtctataaaaacatggcatgtatacaaaagataaaatactttatttatttagataaatgtttggcacataaactaaactgtgaaaaatatcgtgttatttgtatcaatggtgtaaaagcatgttagaaaatggtaggattgccagctcatattaaaattcttattggaatttgcttgaggattcataggatgttatgtagataagcattaggagttatgaagatgacagtaataaactattaaataatagcacattgtgaattttactgtttttaaattgctgactttcctaaatttatttctagcaaaatgaaacatagtttacagaatttccttttttatatgaaagtgtactgcttgtcctaaggaaaggtggtactacaaagttttaatatatatatgtatgtatgtgtatatctatatctgtatagatatagatatagatatagatatagatatagatatagatatagatatagatatatatttcacttgcctcagcctcccaagtagctaggagtacaggtatgtgccaccatggccagccaatttttttattttttgtggagatgaggatcttattgttttgcccaggttagtctcaaacttctggcctcaagagatcctcccacctcagcctcccacagtgctaagattacagacatgagccatcttaccctgccaacgttttctaattagatttttttctaatatcaccatgtttttcttagtgaaaaaatccctacttaaataattctaaaatataatatgatatcaacaacttgcagttgatatttttaacaatctgaatgaccttaatttgcaactttaccatctttgcatagagacacacaatcccttaagggcattaaaataatgtgtagtctcaacgaacaatttgacttttaaaattgtgtgttaatttatgaaaaagacaagaaatgtagtatctgagatttttaaaatattactgttgaacatcaaaaggtgataagatacatttagaaaggtacctcatctaaattgattgaagaattcattcttcaactcccttcaaattgaatatttactaattagagaaaactagtaaagcaacattgacatataaaaagacatatttttcaaacttccggattagtctaattaaaggccaccttgctacttctagcttacaaatgccataagtagtatcattcacaatgatttatctttgaaaacctgggttttcttgaagatacatacaaattgcagtgaataaataaattggcaaaaaattgcaattgttatctgggataacacatttcaaaatgtcaaaatcaaatagttctcgaattattcagtagttttataatcaaatagaagtttattattattgttttttgagattgagtctcaatcggtcaccaggctggagtgcagtggcacgattttggctcactgtaacctccgcctccctcaagcgattctcctgcctcagcttcctgagtagctgggactacaggtgcatgccttcacacctagctaatttttgtatttttagtagagacgaggtttcactatgttggtcaggatggtctcgatctcttgacctcatgatccaccagccttggcctccaaaagtactgggattacaggtgtgagccacctcgcccggccagaagttaatattttaagacataggatttttagctaataaacgttcatctttagcagagttacacaacaattagactgttttgtcacattctgcattttgtcctgggatctcctgatttttttttcaaaagttgtctatattaaggttaactctttacactataaaactctatgagttttgacaaattcattgtatcatgtgtataccattgtagtatcatacttaatatcatgtcccccaaaattatcctttgttctacatgttcagtcctccaccaacccactaaacttcccaatacatttttatttgagtaactcattttacatctagaaaggtttagaaaccatcatgggaagtggggaaacttaaataattttatgtgaaagcataatatacacagatttgaatttaaatagtttatttggttgacacagtggggagtgtcaaagaaaaattattctgccatttcttaaagagagtgtaaggaagactttattatagggactactgcaatgaaattttgcaacaggggagacagactgggcatgtctgtctcaactctgcatgtaagagaaagtggtttttcttttgccaagtagcagggtggaagttattgaatggaaaattactaagaggatatatcaggggtaagggaggattctggataaatcaacttgacaagattcttgctggagacagctcaggatgatctgagtgggagattgttgctaaactgaattagcaggattgttgccctggaagataagacctaaagagagagcctctttgagaaaggatgtagagaagcctgaataaagtagagtgaagaagagggtctctttcaagaggtagaaaaaattgtgaaggctaaaatctaggcaaaacgtgatgagagcctcaattatcagagttgaaaatagagattaagacgagattaaggctgggtgtggtggctcatgcttgtaatcccagcactttaggaggcggagggaggcagatcacttgaggtcaggagttcaagaccagcctggccaacatggtgaaacctcgtctgtactaaaagtacaaaaaaaaaaaaaaaaaaaaaaattagctgggcgtggtggtgcatctgtctgggaggttggggggtagagaagagattaaggagtggaagaattaagaagtacttcaaaagttaaaccaggatgatttcatggctgattgagactggagaaagcaaaataagaattatttgtagaacaagaactaggagtcaattctttccagaagatcacaaaataaggctacttaccccatgtaactattgttagggaaatgttaatttccttgctaatgcgcagtacagattttgtttcccctttaaaacttcttcctgcttcatgccaactacataaggcctacgcatcatgtaattgaatttgaattacagtgattaatcaataataagttgtgttaaattatcccgaacaaccccaagcacttgctttgtaaggctagtaggagatggtgggttagttgcatcgtctttaattcatatttaatgcacacattagtcactacctattgaaaaaaaagatacaccaaatatgaaatagtttgtacactatctttataagagtttcttcataaagacttccagtgttgggaaattctctgttttccatgactacatgactatgcatttcatcctgggataattctaattaatagagtattcttcctttattcgtaatgtaatgatgttgatacaactgatgccaggtcagcctaaacttgagagccacacagaacaaattatattctctctttcacatgataccgcttccaaatattcaggaagttttcacatttatactccatgactattaattgcttctgtaggttgaataatccccatcctaggactgagtattaaggagactaatttttctcactgctgtcttccattgaacgtgctacagttagtctaccacacttctagaaattcacactctttagccagcactctcattatcctgtttggatggaaaggatgcttgactctttcttatgtttcttataatgtcaattgctggcagctggatctgcatgcacactgctgtgttggagctttcagtaatggcctacaagaacagcatgagggagagtccttcaaagtctgctttccctagaaatcagtacagcccactctgatgctgtttacaactgcacaatgtagaggacatcctcatctgctttcctcctgttcgtgctgcatcaagtagaatgatacacacattctcctcctttccaacctctctttttttttttttcacagctacccaactgtagctagaatagatgcctaaaatgataacaaggttatttgctgtggatcatttgttttatgcacgtttaccttccatgtagatcacaaagcaaatgaaagtgcaatcaaatggaggactcaagcaggggtgggtatggaacatcaacactgatgccagtgttggaggcagctaagtcaacaagttgcagatcacaggaaactcaatcagaaatgaaggcaacagacttcttaactgtgttagcatatacatttctttatttttaaaattagtttgtctggggttcttaattttatttgtgtgttatttaaatggaattttgctagaactaagtacaaagagaaccacaaaagtgaaggccataatttttggccaagcgtttcagataaaaaacaagtggggaaaaagtacagcacgtatttatatttactaggctgaagtttcagcagtgactaatgtaaatcactttatagatcctgattccaatgccctttttgtatttttgtgtctttttgtctaacttaatttaaatgtttattttacattccaatcctgtttacgtaaaatattagttattgtgcagccttctggcattgtgtctaataatgacttgaattatcagtttactatcagactgttttgcctattgcaaatttgagaaagaaaggaaatatgtttttaaagagagagaccacaggcaatacagtcaggtctttaacaatccccacctccctttccattgaagacaaagagaaaaagagaaagagggagagaaagagagttttatgttgaacatattgtagtctaactaactcatttgtttgaaggcccttttctatcaaattagagctttgcataattatatggtattgaattatatggtattgaacatgcagtcttatagtcactcatgttcctttaaaatatagattggcatcagtttcttgaatataaaagacactagaattatgccatagcaatggggaaacctctaactcaagaagagcacttgacagctgtcaccctcctgttcaaatgtttctacaaattttggttctaaaacaaacagaggcatgctgtatccaatttatctaattagcagagtacctgctagtttgctgttaacaatctgccagtaatttttctcttaaaatagctttcacaaaaaattaaatatatatcttacttgtccattttcagtttcaattgcagtaatatctggcttgttattatggtattacagttacatcctgagtgagtaattattatgtagacagctacaaaaagtaaactgaaatacttaacttggacatatatattaagtgtgtgtgtgtgtgtgtgtgtgtatccttaaaataaaatgtacataaaatctcattagcttgtttcattaatccttgtggaatcaaataggtcattcattttaggaactgaagtcttctgaacaatgatagaaataggggtcctggaggatggcaaacctctgttcaaacctcactctgcctctcatgagttgtgtggtcttaggttggttacagttctgaatttcagattctttataaaatttgaatgttgataacatcagcttcaaagtgttgctaatgtgattatttgaccagatttaagggcttagcctgacttctcataagaactcaatgaatgttgctttctgtgtttatgtacactgggcagaagcacagtgtgcgtgtaaaaatgagaaagtaatactgatattagatatctgattttcaaaaaaccaaattattttctacaaatgcttataacagttttattattgttcaaaatataagagagttttaaatttaatatcaaagaaattccagacaacaacgtttaacacgtatggtttagtttacttacttaaacaagaagtcaggagaaatactattattgacattggtttagttgcttagtgacactatcagagactcagagtttcctatcttaatgctttaccttattggaatttacagccctgctttcctaattaatagtctcttgattgcaagatgactgcttctgctggaacctccatatccatattcaaggaagaaagactggttgagtttgtcaggtatcaatgattttcattcattcctctttaatcaagaaagcaaattatttcccacaactccccaaaagactgttgctgatgtctcattggccataactgtgtccagtagtttctccaaactgcaaggtaacttgaaatgcaaatatttcgctggataacatgcttctcatgtcactggtctgtgtcagcagaaaagaagtgtgaaggaatgagtgtcagatgagctacttttagtgcatgccagtcatcatgggaaatgaaagtattttattagacttgcatacagtaatgttataatatataatttattgttttaatattgaattacacatgaggaagaagcactgttgacttttcattacttggagaccttgaattttaaattcagctccagtagaagtattatttattaagaagttgggatttgcatgagtctttatttggaagtttctcttttgtgcagtatcttattttgttccactctttccacgcactcattgtgactttacttctgtttctcaaatatgtcaagcttatcctcatcacatggcatttgaagctgtttcttcagtctgagaagtttccctccatcttcttacattattcaattaatttagcacctacttaattcaaaacacctttctgtatttttctaccttcaatcattgctgttttttttaaattggtacagaatgtattaataaaatttatacagaaagaaaattatcaagactgtgaatgcagccagtatttaaataaataacaacaaaaacaaaaaagaaaaagaaaagaaacttcatgctgaatacaaaccacaaagacgaatagcactggtttttcaaaaagtgtttatctagacaataaattaaaatcccaaagaagttctggaaattattttctttcatgagaaatagtctgttcaacttgatgaaataaagtgaaatgtaatgatatatgaaacattttactaattggaaatcactcacacatagagaaacaaatcaacatcactttgggtatatggtttatactcttagctaactttctcaaatagaattattgatctgcttattttttgatttgtttagtttatctcaaggttgatagcctttatcaagattgcccctcatttctgaaatactcgattttttaaaatttttacctacttcaattattttattcttttgtttttattatagcatattatcaaataactatatctattttaatatcaccctctctctttttgaataccctggtattcaagagctatatagtacctaccatccctacgaacaattattttaatgaaataaggtgcctggatgaaactaatgattttaccaagccacctgtactcttttctatcattactcactggattcttacctttgaactttctttcttcacctgctgtgctagccctgttttcctctagcatgactttaattctgtaaaattttgatctctaagtgttagattcatgttcaacactgatgcaaaaaaaatgctgtttaaatgcatattatctttatttcgatattcctaaagcttgtcttgccttatctttataaacttagacacctgcctggctcttaaatttctactatcggcacatctattcatgtaggtatccatgcatacaacctggtaattataagtatctcatctcttctgtctgccttgactgcaaattgtttctagtttctcagacttctagttcttactctcctttcccctaacctatctcttacccctgtctactgtctctaatatatactacatatttagggaatttgttgcaaaattcagctgctcgggtatgtctagccaatggcctcttttcctactacccatccaataatttgtgtaaacatatttaacatcttgtgaaactgatacatgagctatttaacacatacattctgatttatagacttaatctgagctggaggatttcttccagaaaccaaagtacaaatggaaccataagccactgcacatgaatgaaccatggcaaaggagtcagattcaagagtaggagtccacagtggaggctgtgaatcagaatggagtaatgatcctgagaactgtgtggatactagaaaggaaacgataaggggtatatgcatacatttaaatgactatgttactaaatccttgtactctacaaactcagatgagcaggaaatattccacaatttattagattggtgcaaaagtaattgcagtttttgctattaaaagcaatggcaaaacccgcaattactttggaactaacctaatattttctttaatgacccctctaaatattttctatcaagccagtaaggaattaattttcagtccctattgggatttcctttttccaataagggtattctagtgcatgtgcttcctgtcctgtaactaatcttccctatgaaaaacaaacataaagcctaaacttctgcttaaattagggaaagacaaaacatggagaaaacatgcacaatttaatactttgccttttttaaaaagtaaaggcaatagacttccattttttgggccttactctccctattgagaaatagtggtgttggtggatggccagagggaggctcctcagtagaatttgtcccataaatgttgaagaacctaactaagtgggtaatggttttccagggatcccaaagaagtaactctttcaccttctttgttaaactatttcccttgaagagggtgatttttatttatgctgctccttcaaacttggaacatattttcaatctgtacaagcctcctgaatggttagggagtgagggaggcttttaatcaatgaagtccacttgagttttaaatttgtaatttaaattggtcagatgtgtaggaccccccagtgtgaattttaagtcattttctttttctaacaaagttgtcagtgaagcactatttaggagcattaatgacattgaagtctgagcttttctggtgttcgaagagtcactaatatatttttgctttaggtaatttccatcaattcccttttggtactgtgccttcagtaatagcgataggtgttataacctgaatcgggagtttaatttctgggggccaggtggtgggactgcaattccattaagagaccatttctatcagaggcaaaaggccgtcctcacatataatctcaagttgctgatgatttttcaagatgggataataggattattattaatttctggcttgctgaaagcttgggccactgtctgtccttcttcagaattaagttcatttatttttagagatttgtagagttaatgaattattaaagtcacctctaagctttatacacacacagacacagacacacacatacacacagagacacacacacacacacacacacacacacacagataacattttgatgttttcttacttctgctgatcatcctatatctgttccaagctattaaggccttcttgaaacaatgcgaaattccatccattcaaaatcctttgctattccctaaattgtagtggtgtagatgtggtaatgtttccatatacagatacatgctgtacacagatttttagccatcccagacagattccttatgaacagagatgtgagtcaaaaatatctggtgatccaaaaatatctatagtgttattttattcaaattacctaaaatcctcctctaggaccatatcccatcaaaaactagcaaaattctaatgattttctaaagcatcaaattacatttcttataattttgggtgtcttagcactacaccaacatacatgcaacaacacacacagacacacacacatactaataacagacaactgataaagtgggcaactattttgtttacattttaaaagattccgaagagccatcataacagtaattggaaggagatcttctgtggcacaaaattgaaatggcagaagccagctgtggcagaatccagattcatgaggccagaagcaatgcatcccagaatgataatgaacactcaccaatgatctcttagtggtttaagaaatactcaaaatttctttgtaaatggctgaaattcctacataatcccgtgagatttcgatctaacaaaatttgtgtttaactattgaagtaaaataacctgatatttttgactcatatttctgttcttgaggaggctgctaaagtgagagcttgtttctttgtaagttggagttctggaaacttttgcattaatatgcatcataagttgttcatggagttcttaaatacattaccttaggcagatttctgaacttttgtaagtctcaatttcttcatttcttacaaaaataaaaataacttgtgaagttcccagcacagtttctacaggtacttaataactgttagtgccttcccctgcttcttcttgtcatacaccagggccattacaccttcaggctttggcttcagcttttttcctttgtattaatattttcctttcctgttctgctttccaacaattccaagtttataagcccaggtggattttgcttcatttattttgtaaactgtacttcagtaacattactcagctgatactaaccaatgggaccataaactatactcttgaataataggcaattatgttcaacctggcatctttttatagattgctttctatttgaagcatattagttcattccttgagagctcattagctaattgacagtaggaattttatcttctgctaaagtgcccagcacagagatgaacatttagcaaagagcttaaacacatatggacacaactacaaatacacacacacagaaaccaaaacaatacttattagttatattccattccatgtgcctaaagggagaaggggcagatgatttttgttgagtgcctgttctattactgagctggataatttgcatatgctacatattcaaatattcccagtaataagggaaaataaggtttgaagaagcagaaaattaaaaattttaattagctggtaaccaaagtcatatagtatttgtgaagattaattttaaatatcaacttgactaggccagatatttggtcaaacatttttctatgtttctgtaaagatatttttagttgagataaacatttaaatcagtagactttcaataaagcagattattctccataatgtgggtaggcctcctccaatcagttgaaggctttaatagaaaaatactgaggtctcctgaggaagaggaaattctgccagcagactgcctttggacttgaatgagaactcttccctatgtcttcagcctacagtctaccttgtgaattttggatgtgcaaagcctttgcaattccctcggccagttctttaatatttttctcttctctctttctctctatctctctgtgtgtttgtgtgtatgtgtgtgtatgagtgtatatatagatatatgtgtgtacacatgttgtatatgtgtgtacacatgttgtatatgtgtgtacacatgttgtgcatgtgtgtatatgtgtttgtgtgtgtgtgtgtgcgtatgtgtatctcctgttggttccattcttctggagaaagctaatagagtactttacctgcaaagaagagatttgaactgaagtgttttttgaaaccaaagttcaagctctttgcattacaccttctgtcatagagattcctttaaaacatctcattattttgtgggagctatgactacacatagctataatttaagaagatacgtgttaaaatacttatcaattttaacaaaggggtcataagaagaaaggttattcaaaattggagaattcagtagagaagcctcaatcttagatggactatgaagaatgcttaggttcacatatatgtagagagaaataatatttcatttgcaggaaaacagtgagaaaagattaaacgtgaaaatctatagataatatttaagaaactatgtatatgtcctcatgcaaagtgaaagacaaatgaaaaaacatttactttagtgggaaataatgctagaataatattcagtattctagatgaaggtcaattgatacctaaactaagagatttataataatctcataagaaagagttgaagtgattaatttttcatgaaaaataattcagatgtcaacaataccttcacatttattcctatataataaatcgtagtaaatatttatgttttgaatgatgctgtatgcattttgacagtttttatgcctgccacattatttgataggtagcaaataatctagtatcagaaactttaataagtaatagggttcaagctagttggtgggaaaagagcaaaaatatcaaaatttaagtaacctttattggattctttttgctacaatagaaatacatgtttaatgtggaaaatttagaattgtgtcaaaggttagaattaaggtgctaagtcagaatggtagtagtagtggtggggaacaaaatatgtggggccttagtgacaaataaggagttggtttttattctaagatggtaagcacttatctgagaatagactctcagtgggacaagtgaaggagcacagaggccagttaggaggctagagcaatatgacaggcaagaatagatgatgttgtcctggtccatggtggtagcaggggatatctgtcatcatgttctggatgtattttttaagtggctttaatactattttttaccgaattgaatgttgggagtgagacagataagtcacaggaaaccataagatttctttttttggtctgggtagttaaaagaagttttcattatacccccaaaaacaggactgttgagggaaaagcaggcaggtttggggaaggcagaacattcatggatttgattttggatatgaatgttttgtatgtctatagcacatcccagtgttaagtaggcacttccctatataagtccgaattcagtgaagagatcctatttatactaatttgtgtgtctttagcttagctatggcatttatagcccatgagattagttgagatagtctagagcataagagtgaacagaatagggatgaattcctctagctgatacctggggcattcctactgcacctaccgctggggttgaggatgtgagaagaaaatacaatagagattcaaaaggaaagcacactgagacagaaagaggcacaaaagtgatccgttcccagaaggcaagcgaagagtttcaagaagagagtctacaaatgtgtaggatactgcccatgtgttacggtaagatatgaactgaaaagtgaccattggttttagtagtcaagaggtcactagcaactttaacaaaatttatttcaaaagagcagtgtggataaaagtgcaaattatgtaagtctaaaagagtaggaaaaatgttattggactatagaaatttaacagttaattggagtttgaataaagacttttaaacaattataataatttctggatataatcttatctctattacttagtaattacgtgtcgttgagcaaaatgtagaaagatatacatacaaagaggtcagcgccaagacagaagccagacaatgcacacatcgtaactggaaggatgacaatatatagatacataagccagttggtaagaacttaagagaattcctttcagtgtctacttaatattcaataaaatatccctaatatttgatttacataaataatttcatattttgcactattataaaatgttctgttaaatattctgtcagctaaaactttgtcctcacccttagtaatttcctagaagtgatgatttaacttattaaacaaatttttttttcttttttcttttgttttgtttgtttgttcattttgtttttcagacagggtctcactctctgcccaaactcgaatgcagtggcacgctctctgctcactgcaacttccacccctgggctcaagagtttctcttgcctcagcctctgtttcccaggctggagcacagtggcgcgatctctgctcactgcaacctccgcctcctgaattcaagccattctcctgcctcagcactcccacccccaccccacccacccctgagtagctgggattacaggcgtgcaccacgaggcctggctaatttttgtatttttagtagaggcagggtttcaccatcttggccaggctggtcttgagcttctggccttaggtgatccacccgcttcggcctccaaaagtgctgggattacaggcatgagccaccgcgcccggcctactttttttttttgtaaccttttgaatgttaatatgagttgagaatttagtggaaagattttttccaaaaaaataaagatgttccttggcatttaccctatttttttctcattttgtttggatacttagactaagttcctataataaacataaaatgagccaaaaaacataagttttaaaaatctaggccgtacataatcttattgcattgaaagcatagtatgttgcagaaaaaataaggtttatgattcatctggacatcagttgttttattgtgaagtggcaattaaccatgcaaaagaaaagatgctttcattgaaacatctttgtttctattttacactggtgtaattaagactttgggcttatttgtgccaacagagacttttgttacaagttaagacaaaaattggcagtttgttaaagatatgaaaatgattagaattagaattatacacgattttattacttcaagcaccataaaacccagaaggtttagaaacagctgtttatatcctgatgtagtgatatcaagatttcagctttttaaaaatagaggtcttttttttttaataactagaggtgcagtgaatattttggatcatttcggaaataaactgcaattgagggattgatcgcatggtgattttgaacattcagaggctagagatcataatctctttagattgtaggtacttaagagggtagtataaaaggtaataacatgaaaattggtaaaatagtaggcaaaatattgtacagttcagatcataaagaaatgcatgcagagtagattaataccttgctgagtttatagattacacaggacatctgaaaagaaaacaaatgcgtggtctgaaaagcgggaggaaattgtcagtgtttggaatttagtgaccagcctgcttgtccactggagtttgctgtatctaagtgatattttcatcctgtgactttttacaatcctttactatgtttcttaccaatctctgggataaggacagaaaaactaacactctgtgagtgcctcttagatgttgggcatttggtaagtgagatacgagtatgatagctctgtttttccctaactacttccttcattaaagattatccttgttttacaaatgaggttagtgacactctggaatattaaagcatttgcctactgttacaaaattgcgatttgaacaaagttctgttggacttcaaagtcgttattcatttctctgagggatgaaggcaaatatctgagaacttaatataattgtttaaaagtttctatcattcctgaaacagaaataggtaactcaaaatgaagttaaatctattagtatcagattctcaatgctgcttaggagtgtcttaattgtctaggacaaatacattgtcaagtatttactggttactagataatgtcaaaacaagtatctccattctatcaattttctagtgctatgtaataaattatcacaaatttatattcttaagaggaaaaaagacccatatggctaagcagagtaagtgaggaataaatgagttggtaatcagtttagataggtagatagaggcttggttacctaagcccgtatggattattgtatcggttttctattgcttctgtaacaaattaccacaaacttagtgtcttaaaagaacacaaatttgttttcttacagttgtgtaggtgaggagtctggcacatgtgtcactgaggtaaaatcaaggtgtctgcagggcctcattccttccaggaggctctgggaaagaatcttcttccgagctccttcagggtttaggtatatttaagtcttatgctattgtagaactatggtccttgtttccttgatggaagttggctgagtgccattttaaagggcacctgtattcctcagcttaaggctccttttctccaactttaaagccagcaacagcaggccaagtcctaagtccgctttgcgctccgagcccctctggtctcctcctctgcgtatccccctcatctctcctcagctggagaaagttttctgccagtaaatgctcatatgattagattgagctcacctggataattcagggtaatctctttatcttaatgtctgtaactttattgcatttgtaaagtcccttttgccatgtaactattcacagagtctgaggattaaggcgtggaaactaagagctggagggcaggatggagataatattctgataataaaagtctttgctcctcagatactatatcctggaaactgacttgatttgcattatttagaaagatattaatatgtagagaaaaaaacaagaataaaagcaagaaacctacttagaaggctattgtagtagtcatgttgagagataatggaggcatgatttggaatagatgttagaagttatagcagtgcttgaatttaagacatattttgaagggagagctgacaggacaaacttatatattaaatgtggattattagaaaaagtagaggccaaatgaatgctaaatttggactgagaaactgagtaaatagtgtacgtttagaactaggattcaacaaaccttcatgctaaaaactctcaataaattaggtattgatgggacatatttcaaaataataagagctatctatgacaaactcacagccaatatcataatgaatgggcaaaaactggaggcattccctttgaaaactggcacaagacagggatgccctctctcaccactcctattcaactaatgttggaacttctggccagggcaatcatgcaggagaaggaaataaagggtattcaattaggaaaagaggaagtcaaattgtccctgtttggagatgacatgaattgtatatctagaaaaccccatcgtctcagcccaaaatctccttaacctgataggtaacttcagcaaagtctcaggatacaaaatcaatgtacaaaaatcacaagcattcttatacaccattaacaaacagagagccaaatcatgagtgaactcccattcacaattgcttcaaagagaataaaatacctaggaatccaacttacaagggatgtgaagaacctcttcaaggagaactacaaaccactgctcaatgaaataaaagaggacacaaacaaatggaagaccattccatgctcatgggtaggaagaatcaatatcgtgaaaatggccgtactgcccaaggtaatttatagattcaatgccatctccatcaagctacaaatgactttcttcacagaattggaaataactactgtaaagttcatatggcaccaaaaaagagcccacattgccaagtcaatcctaagccaaaagaacaaagctggaggcatcacgctacctgacttcaaactatgctacaaggctacagtaaccaaaccagcatggtactggtaccaaaacagagatatagatcaatggaacagaacacagccctcagaaataatgccgcctatctacaactatctgatctttgacaaatctgacaaaaacaagacatggggaaaggattccctatttaataaatggtgctgggaaaactggctagccatatggagaaagctgaaactggatcccttcctaacaccttatagaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaataaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaaagtcaatgaaggatatgaacagacacttctcaaaaaaagacatttatgcagcaaacagacacatgaaaaaatgctcatcatcactggccatcagagaaatgcaaatcaaaaccacaatgagatagcatctcacaccagttagaatggcaatcattaaaatgtcaggaaacaacaggtgctggagaggatgtggagaaataggaacacttttatactgttggtgggactgtaaactagttcaaccattgtggaagtcagtgtggtgattcctcagggatctagaactagaaataccatttaacccagccatcccattactgggtgtatacccaaaggattataaatcatgctgctataaagacacatgcaaacatatgtttattgtggcactattcacaatagcaaagacttggaaccaacccaaatgtccatcaatgataaactggattaagaaaatgtggcacatatacaccatggaatactatgcagccataaaaaatgatgagttcatgtcctttgtagggacatggatgaagctggaaaccatcattctcagaaaactgtctcaaggacaaaaaagcaaacaccgcatattctcactcataggtgggaattgaacaatgagaacacatggacacagaaagggaacatcacacaccagggtctgttgtggggtggggggagcggggaaggacagcattaggagatatacctaatgctaaatgacgagttaatgcgtgcagcacaccaacatggcacatgtatacatatgtaacaaacctgcatgttgtgcacatataccctaaaactttaagtataattaaaaaaaaataagaactaggatttaaatcttttcatattctaaacataattttggcagcccgttcaagcctatggaactcacaatatatttttaaatacataaaatatgcataagatgaaaaaaattgatttattgaaataaaattattaaaatatttttaaaattgtgatgttgtaatatatgtgcttctttattagtgtattgcatataatatggtaggaaggattataacatggtcccaagagtcctgcaccctgatataaacctgttctccttgaatatgagcagaatctatgaaatatgatgaatgtcattcctgtggtgtgattagattgtgttagattagattagattagatggcaaaggtgagagggagttttgcagttgtaattaggtccataatcagttcacttggagtaacgaaaaagatcctaggtggaccgggtctaatcaaacaaaccctttgaaagaggatctaaagttcagagagtggaagcagcagagacactctcctgccagccttaaagaaggaagcgaccatgcattctacaactgcaagaaggtgaatcgtgccaataccatgtgaacttggaagaggatccagaggaacctggtttgaaggcaatcttgtaaacataggacccagtaaaagcgtgccagtccatctgacccatgtagttttaaaccaataagtttgtagtaaatgtgttatgtagcaaaagaaataaaataatggggctgacaactttcatgattttaatgtgctgaggagtgtaagctacatttctagattatctgctacaactataatgtgatgtgaaaatatctgtgtttttctatttgtaatgaagtcacaagaacttttacaatgacttgtttctagcatttttgatggaaaaaaataccaactttagttatagattaataaaaataatgatataatttttctccaactgaattcactgatatcttaaattctacccatggattgcttggggagagtgtctggattaaagcgaagaacccctgatcataaatgttcttcctgagtaaaaatgtgcatgaaatatttttagaaagactttgtgcaaactgtcagaaaatgcattcaccgtaatcctcagttaccccaaaacattcgattaagcagagttaccttttagttagtatgtttttttaacctgctggatgcaatagtgaaacaattaggtgatttttccaaaccttattttttttttacttagaccactttcataaaacaatgggcttcttatgataaaagatatgaaataatactgcttatataatgacttaaattgcaaattcatatgtttgggaggtgtgggtcatagttttatcagaaatcttgacacttaaaatctatattcttgtttcttggagaaatgtattttctgcatggaagagagccgtacattgctcagtaattttactctctcaaaagaattgaagccatatcgttatgaaagaagtatatgacctttagagataacattgactttagctaccaattcatatatgtaggtgggttttaaaccagaaatatttgacattgttctttttacatttttttttgaaacttcatgctctaatactctaaaaatacaacatgtatttttaccttatttcttcagaagtgttcttttctatctattaatacattcaataataaaatgttaaataccaggagaaatgcatcttgagctattctgcctcattgctatgtgattgctaattggaaaaagaatccaatgttggcatacaaggtagaacaaaacttggtgaggattgtgccaacttagaaacgcactcagcacctgctgcctttttaaaacaattatcatctttattagattctgtgggatctgttcaatgggctgcagacagatgcttggatcagatgttgcacttgcacagctggggctgcagagtcagcatgaacctttctgctccattcttgtctacttgtcagcagcacagttgtaattttcagtacattggatttgagtgtttctaggaccactgagctcagtttttctttgtattgaaatccaatgtattctagatattctgtttcttggctgatgaaatataggttcagatttccctatgatttgggatttagccataacattttaaaataaagcttttataaatatggtgaaatagtaactattcgtgaacctaggtagagggcatttgcagattcattatactgttctgttgacttttctttgaagttggttaataaattaaaaaataatgttaatgctcttgagagaaagagtaatgcctgaagtagacatataccacaaaggagaggggaggcagcctatttctcagagaaaaccttaatttatggaatacctgctttttaattctccacagtaacttaggcagattttccacaatcaccagatgcatttgatagtaaagtgagacaatgccaccgacaggcaaacagggaatttcaaatcctaaagcaagcagaaaaccaaccatcaccaacaatttctgggaaattaaaatgaaaattagaacaatatgtgagaagcatcaacatgataaaccaaaatataaatacttaaacaaggagttagtaagcaaataagagacattaaaacaagcactattcttagcttcagaggcatgagaaaacatcacattcataaaacaaaacagttttctgtgaaaaaaaaatcaacaattgtagaccatgaaaatttcttaaataattctttgaaaaatatgtagagaaatattaaaaggcctacacttagatgtatagatttcaaaataaatagactgtataaacatttctaaatagctaaaggaattataatatgatttacaaaataatgtccaaactaatatctctcccattaattaacaaaaataaaaaatgtttgagataagtgatggatattgaaatcgaaacatcattctataaagttttctgaagaaaaacagagaaaaacagataatgaggacataaaatattccaaaaataatgtttttaaaattactaataatgaagaaaaggcttaatcttcataaattaagaattcatacacagctaagcaagatgatgattatgacacatttgtagataacaggaaacatttctgaaaaataaaattatacaaaatcttaaacatttctgggaaaataaaaacaaagtggcttcaggaaaaaatatttaattaaaattatttgtcaaaatggtaatcctttgcagaagataatgctgaagtatatgcagtggcaagaaaaaattatttttacctgaaattctaaatccacatcaagatacaagtgtgagacagttaatcctttaaataaatacaaaaaattcattaaaatgattcagttgtttagaaaaataggaaagggaaaaatcatctaaactaaataaataataataatatgaataataaatttttagttttgcattccaaagataatcacttttaacattttgatgtattttatctagccatctacctaagcatatatttatgatattagtaattatattttataggtaatagatatggtttggatttgtgtccctgccaaaatgtcatgttaaattggaggagggctctggtgggaggggattagatcatgggggcaaattttccccttgatgttcttgtgatagtgagtgagtgctcatgagatctgatggtttaaaagttgtttgtggcacttcccctttgttctctctttctcctgctccatcatcataagacatgtttgcttcccttttgccttccaccatgactgcaagtttcctgaggcatcccaaccatgcttcctgtatagcctgtggaactatgagtcaattaaaccttttttcttcataaattacccagtctgaggaatttctttatagcagtgtgagaatgactaatacaataattgtgtagtgtgactttcttctcaagattatattttttcccatagtaaatgcattttacaatttttaaaaatcttttatctttcaaatctttgtaatatctaattctcatttctctgagtagctatgtagtgaatatgatttagccgtgtccccatccaaatctcaacttaaattgtagttcccataatccccatgcatcctgggagggacccagtgggaggtaattgaatcatgggggcagtttctcctatgctattctcgtgctagtaagttcttaagagatctgatggttttacatgaggcttcccccttcacttggctctcattcttgtctttcctgatgccttgtgaagaaggacatgtttgttttctttaccaccatgattgtaagttcctgaaggcttccccagccatgtggaactgtgaggatattaaacctcttttctttataaattacccagtcttgggtatgtcttcattgcaacataaaaatgaagtaatacagtaaattggtaccaggtagaacggtgttgctataaggataccaaaaaaaatgtggaagcgattttggaactgtgtaacagacagagattggaagagcttggagaactcagaacacaggaaaatgtgggaaagtttggaacttcctagagacttggagggctcagaagacaggaagatgtgggaaagttgggaacttcctagagacttgttaaatggctttagcaaagagactggcagcactttgcccctgccctagagatctttagaactttgaatttgaaagacgatttagggtatcatgtgtaagaaatttctaagcagcaaagcattcaagaggaaacagagtatacaagtttggaaaatttgcagcctgacaatgagataaagaacaaaaacccattttctggggagaaattcaagccagttggagaaatttgaggagccaagtgttaatcaccatgacaaggggggaaaatgtctccagggcatgtcagagaccttcatggcagcaccctcctcccccactccatcacaggtctaaggcctaggagggcaaaatggtttcctgggctggtcccaggaacccctgctctgcgcagcctctggacatggtgccctgaatcccaactactttcagttccagccatgcaaacaggggccaacatacagcttacatcattgcttcagatgataaaagccctaagccttggcacttatatgtggtgttgggcctgtgggtgcacagaagtacaaaattgaggtttgggaacctccacctagatttcagaggatgtatggaaatgcctggatgtccaggcaggagtttgctgcaggggcagagccctcaaggagaacctctagtagggcagtgcagaagggaaatatggggttggaacttcacacagagtccccatggggtcactgcctggtggagctatgaaaagaggtccaccatcctccagaccccagaatggtacatccactgatagcttgcaccatgtacctggaaaagtcaaagacactcaacgtcagtatgagaaagtagccaggagcatggctgtaccctgaaaagccacagggcagagctgctcaagacagagaggccacttcttgcatcagcatgatctggatgtgaaacatggagtcaaaggagatcattttggaactttaagatttaatgactgccttattggattttggacttgcatggagcctgtaagcccctttgttttggccaatttctccaatttggaatgggtgtatttacccattgcctgtactccatcgtacctagaaagtaactaacttgcttttgattttacaggctcataggtctgtaggattgccttgtctcagacaaaactttggacttggacttttgagttaatgctggaatgagttaagactttgggagactgttgaaaggacagaattgtgttttgaaatgtgaggacatgagatttgggaggggtcaggggcagaataatatactttggctatgtccgcatccaaatctcatcttgaattgtagttctcataatccccaaatgtcatgggagggacctggtaattgaatcatgggggcatttccccccatgctattctcatgctagtaaaaaatttgtcatgcgctcggatggttttacacaaggcttccctctttgcttggctctcattcttctctctcctgccaccttgtgaagaaggacatgattgcttcgccttctgccatgattgtaaatttgctgagtaccaccgcccctgacaccacgtgggactgtgagtcaattaaacctctttcctttataaattacctaatctcaggtatttctttatagcagtgtgaaagtgaactaatacaatagtaattcattatagtcttatcatttgttagctcgtttgtttccattttttttactactacatgtatgtaattatcattatacataatttttcaagttatttttagacagatctctgagtgtaattttactgatgcaggtagtctgatcatttatcaaacatttgaaactcaaaaaattatttaccagaagaattttactaacttacattcagagcaagtatgaagtctccacacttcacaaacaggaggagctagaaatgggggaaggtctgcttagaaaatgaggtagaagctgaactcaggagctggggcaatatattattaataaggaaagtcgatcaatgggaactatcaaaggctgagaactacagatagagatggggatctgcagggaaggaaaatcctcttaactagtgaaagagcacagaagaaatacatgggtgcctgtagttaactcctttctcaccagcttttagtcattgattttataaggaaaaaaaatgaaaattgcctgaaaaatacagacaaccattgaggagaaaattatactatatgatttatattggagaagtgaaagtttctaaagaaacatttaatcattggaaaagatggaaagaaacaaatagctaagacctccattgaaaatagctcctgagattcaaatgtgaagtcaagatgaatgcaggagctattctcagacgatttcattttctagcattatctataaaagctgtgaaattaagacaaagttatataattggatcttttttctcacctggaagagaggttcctccagagatagattcagagtttaatcatgggaagggcagtacccacagaaagagagttcattattaaaagaagtttttatcttcgatgtttggaagttaagatgatttttagtgttattactaaacaggggatgaaggattgttttagcccaaaacccaaaactaaagaaaaaccaggatcttgctgaaaaatctggaaaagaagcaaagcatggtggacagaatatatcaactgacttataattctgtttttatttttctcgtctctctccgttattctcttattcttttgcattgtgtatgtcacctaaccctttcgccccatcatcagttttcatgtgaaatagtttgtgaaaatataataacttagagaaacattccttaaaaacagtacagtgatatatacatattaagcattactaatattgcccatgaaaacctcctgacttttcttcttatattcaaaatacacagtacttcaacagcccaaatatacattttctttttttctttttttttttttttttgagacggagtctcactatgtcacacaggctggagtgcagtggcacgatctcggatcattgcaacctccacctcccggattgaagcgattctcctgcctcagtttcttgagtagctgggactacagacatgtgccaccatgcttggctaattttttttgtatttgtagtagagacagagtttcaccatgttggtcaggctggtctcgaactcctgacctcgtgatctgccgtcctcagcctcccaaactgctgggattacaggcatgagctgccgcgtccaccacatgttcttaaatgtatagatttaaatatgcaatttaaatgcaaatatgttaaagggattaaactatgcactctgtgtaatggggagctgagtggggagaaagcagagtttgtacattcaaagagctgatgtttattcctgagatttctgacttggaattcagatttctaagagcatttaactcccaaaaacccaaggacatgagcaaatatagcaagtgataaataggcttagtcaaaaatataaaatataccatctgggtaaacagaattttatggactcttggaattcagcaagggcttggagaatgcttctatttgcattgcctttgcagaattgacccctcagcaatgaaagtcccccaaaacttaagtcttctgactcctttcagagaaataaattatctaatgcaaacattgaaagaatgagggtaattcacatgatagatattttcctcttggagtttattaattcacttttatagaaatgagaactataaagcagtaaaactggcaataactaatatcatccacaggatggtaagtgctgtaataaagactatagcagactggaaagaaaatcttgtcctcaaaagttcacagtgcaagtttgattgcattattgcatagtgcaaagtgaaagtgattgcatagtgcatatgaaagtttgattgaattattacagaaaaagtgtggttttcttgcttctttaatctggtttcacatgctggtacttatctggaatctttgtttggaaataaaacaaactaatctccaacactgaagcataaagggaatttacgagtttcatcgaagattccagggtaaatgtctggatttcaggcatggctagatgcaggaggtcaaagaacgtccttggaatttgatacatgtttcttcatgtatgatagttccccatatagttttattctcaaagtggctttctgtctgtggagacaaatgacatgctgaaaggtctagaaacatatattcagaaactagcaacccttgtaaagagaataccattttactccactatcacttgaaaaactttgggacactgagcaaattgggaccatgtatccatcactgaatgaatcattgtggccaaaagtatgaaatcctccaaatgatcagctttccacatggcaaagagtcatacaagagtgacttccctaaacaaaggaacatgcttttttcctagaaggggaatagataaaacaaatgtctgttacactgcacgtctctcgctttctattatttataaatagtttaatcctgaaactcaacttctctcataagaaatgaaatatacaaaaagtagattagaagaaaatggaggcaaggatcaaagtgtggctttacccaagtaaaatctgagtaagtactagattttcctggacatttaaatgtttattacataccattttccaaacataggtttgaaaatgttgcagaaaatgtcaaacttgcactagaatttctatatttttcagtaaacggctttttccttcaaccagaaagtttgggtttaagcacctagtgaaataaaatcttactaacctgctactaggcaggcagcaaggtgcaacaccaaaaaaggaaatcaaaagaaccaagttaaagacccagctctgacagtaactacctttgtgacattggaaaaatgttctttttactttaactttctcatcagtaaaattagaaaattagcaaaagcaatgtgtgtgctcccaggtttatccagaagtgaaatgagcagtttgttccttactacaaatgaattattttttgtcttccaaattaattatttattattcttgtgcctagttgtattcagtgttactcaagcatactttatcacccagtacttttctatcttattcctggaataaaaaataaattctgtctgggcctgccgaatgctttcctaattggtattaatgatttgcttttaaattagttgtgcatttttatagaactaacctttggggattacaattaatgctacaattgttttaaaccattagaggaaactgccaatgaatcttttctattttttttttcttctttgtgttctgggctgtgaaaatggtcactctcagatatttaaacatatttagatttgtggaggagaagagagcacattgtttggattatttaaagcaggcacaatttatagaaactttcagtagctaaacttcattggttttcttgataggatgttcacgtgcggtatttgaggaattgtgcttttgtactgtgatgcaaaataggcacctggtctctttctagacttttcgaaggtgcattcttttggcttaggtcatgaatcttaaaaaatcctgtcctgaagcaaagagaggagaaatataatttctattgattactttatgatcaaatttcctttaactatctttggctatgaacatgtcacttcaaatagctaatggtaggactctaggcatctagagatgacaataaattgtatgtttatctggctacattctgaattaaaaaaaactaaaacatatttcactatggcaatatatttccgatgaataacttcaggtaaaaacaatgtaataagtttacactgaaggagtataatgtagtctagttaatgctccttagataagctgcttaatatagtcttattttctacttaaaaatatagtgttcatagaagcaacaccagaacttggagtgaaaacaagactcaagttgcagctctggtattgacagctctgtgaccacagataagtcacttcattttcattagcattaagtaattttttaaatggcaattattttatcttttcttgtgtaaggatgactatggtcataataacagtcacagccactacaagttaaccctagaatgttgtcattcccattttatggatgaaataaagcttcaaatagttaaatattaaagattagttatataagtatgtaaacttaggcccggttgacttcagaatgtgagttttgaacctgtcttatttatcacatcaaatggcaattcttttagttgcatttatatcacctgccaaattgctgccttagagttctttctaataggctgtttttttgaaaacacacagacacacacatatttatcttgggacagatttttaaatatctgtattgataaatttctaatcagttttgacttccagagtttttaattaatttacaagaaactctattaacttatatgttattttttaattcccaaaattttagattttcttttatttcatcagaaaaatcaattaagtattcattttagtttatgtaaagttggtatttagatttatatttttctcaaaaagacaaaccttttctaggattcctgacaaaataatccaaatttctcctactgatttttaattagtttctatgtagctatctatctgtaattaatccgataataatgtgaatgaatatagtttcatactgcattttcattttcttttaaagctaattctctctcattattattctttctcaaagatgtcctgggtattgtgtatatttttatcctaatgagcattagaacaattttttgaattattttcaaaaattttggtaatttttaaattatcaaatggtaattaatgtcaattcaatttatattattaatttaggtttgatagaaatgacatatttttgggcctcattccaagaaaaaattggtatttgcttacattaagaactcttctatatctgtgtagatattttttcttcctatagatcttattattgttttacttatttacagcagttttagcagttttttgtaaattttatctgaagtttttctccttgaactgaaaatattcccctcccacaactttttaattgtcatagctgccattttattgatatattaacatctaaattttgttcttctaagtaacactgccttgaccatatttgctaatgaaaacttgattttaaaatagttgttattcaaacagctataacaaaatgctaggtgttaaagtctgaaggatttctctctctttcttggccaaataatctttcacctaattatttttctctctgtcttacacacacacacacacacacacacacacactttcacaaatatttcagatatttgttactgcttacaagtagactctgatgttccctcatgaatgtcttattcaaagtgggataactttaacagacacacaagagagatggcatttttatgcaagagaatctatgaagagtcccattccttgaacattacacgaacctagttggaacgtgtactaaatcttccaaaacagtatggccttactaatgactataaaacataaaggtagcccatgtaatcaataggctaaatgagtacgggataaatattttaatttagttttcaaagtaatattcaaggacatttacttcctttttctttttctttttgcttgctctcagtaggaaaaaaaaccactcaatttgccatgcatagagcttattaatagactgacaataaatgtagtgagggaatgggctttttggcaaaatacattccagaacagctgcatttgtaactgagagatgtctctcatggtgtttgatttattacatgctgtacaatttagttctatacaagtattgaacccacttacacagtgctaggaaatacttatattattatatatttggaattgtgttatgatctcaaattttgcttgcttactgaagtagattttctactgaaacatttagtttctttgagagtagttacaaattgaccagtattgtaaaattagtctccctgagtacaatatggtactaaacatcaaaagatacttaaaattgtaatttttgtgtatttagtttatttgctattattttgggaaagccacaataaattaactttcacctttggacaagataatttatatttattacaaaattactgtatacattaacatatgctactatatttaattcattgtatttaattgtataaattcaacaactcagaaaacatttttgagataagtctccttaagatgaagcgcattctccaagattccattgaaaaccccactagataccattaaaaataaaaaactactgtctttgctttctgtgttcattgaaatatggtcatgcatctttagctacaaggatatattctgagaaatgcattgtcatgggatttcgtccttgtgcaaaaatcatagactgtacttacacacacctagaaggtatagtcaactacacacctaagctatatggtatatcctatgcctcctaggctacaaacctgtacagcacattgctttattgaatactttacgtcaggggtccccagtccctggaccacagaccagtaccaatccgtggcctgttaggaaccaggctgcaaagcaggaggtgagcagtgggcgagtgagaattattgcctgagctctgtctcccgtcaaatcagccgtggcattagatactcataagagcctgaaccctattgtgaatggcacatgcaagggatctaagttgtgtgctccctataagaatctcacacctgctgatctaaggtggtacagtttaataccaaaaccatcctcccaacataacaccacccccacccttcctccatccatggaaaaattgtcttccatgaaaccaatccctggtgccaaaaaggttggggaccactgctttaggcaattgtaacatgatgataagtatttgtgaatataagcatagaaaaggtagagtagaaatacagtattataatattatggaagcactgtcatatatctggttatatctggtctcttgttgacaaaaatgtcatgtggtacacgactatatatcctatatatcctatttttgatttcatgaagtccaatgtggcttcagaaaccagtccatgtcccttctctacaccagctttagtccttacatctggttctagaagggccctagatggtccttgcagggtgcaggggtggtcatgggtgttaagagatttatactttgatttgtttcttcagctaaactttctctcttctgtatttgtaatttagaagacacctccgttttcttttcttcctgaaattgagaaaccctgtcttgaatgttttagctcagggtttccaaattcagcaatattgacattgggccagataattatttgttgggggagcctgtccagtgcattgttggatgtttaacagatatgacatgtacacatggtcagctgcatcaaaaatgatttagacattaccaaatgtcccctgtagggcaaaattgcccacagttgagggcaaggcattagctctttctttttaaagcaaaggttcttgaaatctaggattattttattgttctcactttcttaacacatattcacttcctaaaccatctaaatttgttttctatgactatgttagtactgacatttctcatcaacattgccattgaacttcaaattgataaatcccttgagtgcctctgtgttttgaattctgaagtatttaacattgctaatcatctttcaattaatgaaactattttttatacagccacagtttataagataatttagggatgagaactgccatttatcattaacttactatgtattggttactgtcctggacattgttttctacatatttttaatctttataataactgtagagtgggaattagtagactcattttaccatgggcctcttgaaatctacttgaccttttctcagttcaaatgcctgtcatgtgtccaggctctctggttccacttttatttccctttgccactttcaggagacagcctgtgaccttctgctagccccgacatctctttcatcctttgggtacttttatgttctggttacaggatgaaatacggtaacttgattttctccttctatgaagcttttccagacaagtgtcccaccttttcattttgtcactttactgggaatcaccaggagaataacaacaaccaatgacacaaaaataaggtgaaggaaaaagctctaaagtaaatgggaagtcatggtgattgctatgatctttgttttcccactaatttaagatatggacggtgacatttcttcccctctattatcttatttagttcatatttaaagaaggtcacatgcttatatgcaacctttgtcccaaactttattcccctgtattcctaaacaacaaaatgctactgcccatggacacagagaagaaaaaaaaagtctgtgagatttcctatctgcatctttgtttctccttcttccccttttctccctctcctgcctgctccctgcgcatttaacaattccatatgtaatatgaaatggcatttcctcttatgccttttccccacagatggggttggataagaggaatttcagaaattttagatagtcttccctttttcccaatgtgcaaggaaactataatattgcaattttaacttaaaaatctgaactcagtttttacctagaaatgttgtttgtgtagcacatatatcgtggcctgactgtacttttaaactagtttctaggcagttagccaatcttttgaaatctgcctccttaaagttagaaattgtgatacagtcctatctttacagtagatgtgacgttgaagtttagaaaattagagtgtggttcaggtatgagataaatcaatgaaccccttgaagtggaattgggttgtttgaacactaattttaagccatggaccaacatctaggggaaaattagatcccattttcctaacagacatacagaatcaaacacatttggcatttctgaactttgcagtaggatgctttaaaaatctgtttgctattaagggaacagaaaaatctcaatttccttgagaatttttatagaaattttagagaacatagatgatgttgggttattggtacaaattagatggtcaaatttttgcttatttgttaaattttagagttttcacattatgcagtgtttgtaagtgcagaactgctcagcagaaaattagcttgccatagagtactttcaaaatagaactgtcatggttaaaaatggaatattatttctttactcaacctctatatttgaataaaatttgctgtacatttgaataaagtaagctctacatttgaataaaaattgctgtattaatactctagtgaacatcagtggtaacaataagaaaaaacaatttcactatttgaatgatacattcaagaaaaacctgattggtccttattattactattaatatgtctgccctacaaatctcctaattagttttcatatttcttttttttatatttatttatttatttatttatttatttatttatttatttatttttgagacagagtctcgctctgttgcccaggctggagtacagtggtgcgatctcggctcactgcaacctccccctcccgggttgaagtgattctcatgcctcagcttcctgagcatctgggattacaggtgtgtgccacaacacctggctaatttttgtatttttagtagagacggagtttcaccatgttggtcaggctagtctcgaactcctaacctcaagtgatctgcccacctcagcctcccaaagtgctatgattacaggagtgagccaccatgcctagcctcacatttcttaaagcacagaaaaatcaacacaatgctaatggcagattttactcttccttatcttatgtggcataattgaaagagaagattagaaatccatgaaataatattagatcatgaaagagctttaaaagacaggtaatttttataggctgaaattctttctataaagcccaaatgactccattgatgtagcttcggaaaaatcaaataaataatatatacacggttaattgaagatactctccttcagcaggtatttttacaaatttcttctccaaatctcaaagcattagttagaatataatccaaatgcctccaataaaagctgtttaacactatcattaaagtgtagcaatccagagattgtaacataaattaaaatgagaaaagtgagaaaaaagtgaataaaactgtctgttacaaataggatcagataatttttacttaatgcagaaatggcactaaacttttcttagtggtatgcgagatactaatatccttgattaagcctctcataatttatttttgtttttgtttgttttttttttgtttgtttttgagacagagtcttgctctgtcacccaggctggagtgcagtggtgtgatcttggctcaccacagcctcctcttcccaggtacaagtgaatctcctgcctcagcctcccaagtagctgagactacagtcactcaccatcatgtctggctaatgttttttatatttttagtagagacggggtttctccatgttggctaggctggtttcgaactcctgaactcaggtgatcagccctcctaggcctccaaaagttctggaattacaggcgtgagccaccatgtccggccaagcctctcatagcttttacagaacttgtaattccacaaaaaattctaaataataacattaaaaaatttcatggtgaatataagcaagggactaataaaatgtgtagctttaccttttctgcctcctaatgtatatatcaaatatatatcattttttgtctatttccactttgacaattgttatgaaaatctccacctgtagctgcctggcactattgtaacagccgccctcatgcttccattctattttctcggaactattcttcacttataatccatcaaaatctttgaaatcataaatttctctctacattaacatttttgcccttataataaaagaataattatgaaacaataataaagtaccaataattttcctgtgcttataaagcctgcatgactctgttcttgtctgaccttccaactcatcttgtgctacttctgtcttcgtgtaggtatggtagatcttttaatgtccttgaacactcaagattgttctgatctcagagcttttcacatattcttctctatcaggaattccaaagcccctgctctttgcaaattaggcatttttatattctttaagattccttatgtcacttttctgcaacgtctttcctgaccattctaggtaggtctgtctatatctatctttttctcattgttctttattcattttctttaaattatttatcacaatttgtaaatatatatgaacatgttcatgttacatgcattcatacatatgtgtgtatatctttgtctctatctaaagagagaaatagagaaagacagagagagggcggggtgtggtggctcgcacctgtaatcccagcactttgggaggccgaggcgggccgatcacgaggtcaggagatcgataccatgatgaaaccccgtctctactaaaaatacaaaaaattagccgggcatggtggcgggcgcctgtagtcccagctactcgggaggctgaggcaagagaatggcgtgaacctgggaggtggagcttgcagtgagccaagatagtgccactgcactccagcctgggcgacagagcgagactccgtcaaaaaaaagaaagaaagaaagaaaagggaggaaaggagaaaggggggggggggtgattactacgtagctatgtgtattattttttgttgtttttgactttttttatttgaccattgctaactccataaaggcaaggatcatactgggtattttaatcactaaaatgtatccagtgtccaggacaatcaatggcccatagtaaccattcaatacgtttttgtattatctgtggatgaatgaatgaaaggaatgaataaaagaatgcatatctaatttacaccattaggtgatgataaatcaaccctgggaatttcaatccaaacctttctgctatgcaaggatgggccacaaaccccagcagaatttccacatccttgtatagcatttccttagtctctcccttttgctgtattcccagtgtgcttgttataagtgtcctaaatcaaatatttaatttgacactctgaattaaacacctgtgaaaagaaggaaaaaatattaaaagaaaaaaaaaactgagattgtgtcttgtgttttatgttcccaactacttctaagctactcaatagcagccttcaattttagacataatttacttttaagaaaaatatcccaggtatctgacattaaagcaggtccttaggtagattctcactttaatacatgcctattaactttggaatgtatcagaagagaacaaggttgtctcaaaggcatgactttcagtccctctggaaagcacagcacgtcgcccaatgttaatttaagcttgacaaatgagaggtgaatttatttgtaagagagttcatataatcattgagaagcatttattcttccttgaaaggttattttctgcaaaataagatatagtgctgcgtccaggcatccaagcctgcaccgcaagagaacaatccttggcatttagactaagtgttatgtcctctagctaggaaatgagttgtgagaggtatttttcatttctaacttctgattataataacattgtcagtaagcttatatggagacggccactgctaagcaggtttattttcactgggtcataaagtaaaatatgtgtagaaagaattcaggtagttccttaaagaaaccttatgtcataggaatacagtgagcctcatcagtgtcaaatagataagagctcatatctcaactctgatctttattgctttatttactcaaatattagagcatacctttctcataatgtgttaaaatttttcatgacatgttaggtattcaacacatggttacttcaagtgataaaaacaataataatgtagagaagttacatttcacaaaacaccatagaactgagatatgaaaatgtaaaaatttcagtatattttcttaattatttttattttatttattgtttatttaaagaatattaactagaccttactgtatgacagacactaagctaggtacaaattgttgaataaaaccacagcagtgttttcctttttggagttacactttactttctattgcttccattttaagattttttaaattaactattttaaaaatcctttatttttaaaagatatggtaagattaatatttaacttttccaatattatcattctcattccttttcaagtgacacaatagttagaatttgtcccctacctttaagaaaatcatgggacttgtaagaaaagtgcgaaatataggtttctctccaatgtcttcctgttgggacctgtaattactcaccataatccttacctactaagacttcaatccttagttcagttgtatctgccaccagaatataaattcctagctataggaattgtgtctgccttatttgctgttacatactcataatatacactcactggataactattgaatgaatggattgctgctcactgtgctgagcgatgaagtgctattccttggataccctgccttctcccagaagatgctgacaggagaaaagggaaattaacatccccattctttgtagacattggcatttacaaacagtaggtgatcaattcataccgctttactggtagtggaggagcaaggagaaaaggacaaaagctaagggaaagaaaaaataaaaactataaaagaaaataaaaggagaatagtggccagtgtaaattctccccttcaggcatgcaaaaagaaaggcacagagttgctaatgtccttctggcagaaaaggagcaaggctcattactttcacactttgtaaagttgctcccagcttccctgtgctgcttctgtagcagcactagacttgcttagatggcaaacatgtcagaagggttttacatttttataaaagattgccctaggtcctctccacaaagcacgattaacagtaccctgaatgtgcttcctcagtgggaaggctttgtctaatccaacccagacttctcagtgtcccagtgttcctttaaccacttcatttcctacaagtggaaagaaatgatcaatgcactgaaggtaggtgtctcaatgtcatacagggaatgagagaaagatcttcagttcctctattttctgtctgcagaattgatgagttagatttcttcattgtgattggagataattagcaggaaaaattttggtgtggggccagtaataacagtcctttatgttcaacacaattataatgactggccagaaaattcatacacctgatccgaaatactactaacaaattccttacgaaatatattattatattcattttatacatataggaatcaaggctcagaatctaaatgcaattaacttgctcaaggtcaacggataatctacctgacttcaaagtccatacgttttccacttgtaaaaatgcttctcaaactttggactgctgtaacaacaactgtcatgaaaaataaaggagctgaacttgaacactctttatgagtctttaatttctttctttatttttttttttttttttttgagacggagtctcgctctgtcgcccaggccggactgcggactgcagtggcgcaatctcggctcactgcaagctccgcttcccgggttcacgccattctcctgcctcagcctcccgagtagttgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggtgtgagccaccgcgcccggcctaatttccttatttctctaagaccatgtttctaacgttctgtgatcttgggagccttctcagacattcattcatagagacattctaagaaagacttaggaggttaataattactcaagttataagtgtaagaggagatctttcttttgagcttttcaaatctaaggaattctcacccttatggctcctatagtttctatttataatgtccttacctttctttcctcatgcataggagacagtggtaggaacgaaatagatattagattttcagtatcacatattggtaaattatctaacatatctgttctaattgtagtcttaaatgtattttggatttatcgatgtctttccttcatcataaagaaatgagctatctagtttacactaaggataattagcttcatttttaacacatcttgaattaatagactggatattttcaatgcttacattaatatgaaatgttataaacttcacttttctctcttcaaaattcaatttattttgtactatacactatttacattagttcagcaagcatcacaaatctaatttaattggattttatggcatttttccaggaataaattgcatttttgaaataaaaaaaatcaccccatgctaacaggtactttggttaaaatgcaaaacatctacatgcatgcagaaacatttgtgggttttctttagccagaaagaagagttcttatactatcacaaattatttccattgattttccttatctacataacattttaaaaagtttatctcagaataagcaaaggtgtctatctcagcacatctgaaaaacagtcttgagttaatgacgattgaaaatagttctaagatattccaccttcatcaacttttactgtaaatgtggtaaagactgtgcaactaatacattatatgttaaaagagtagagcaaggctgggtgccatggctcacacctgtaatcccagcactttgggagacctaggtgggcaaatcacttgaggacaggagtgtgagaccagcctggccaacatgctgaaacagtgtctctattaaaaatgcaaaaattagccggctacggtggcaagtgtctgtaatcctagctactcgggaggctgaggcaggagaatggcttggacctgggaggcaaaggttgcagtgagctgagatcgtgccactgcactccagcctgggttacagagcaagactccaccttggaaaaaaaaaaatgcaaaaatgcaaattcagtaggttcagtgtgtatatgtatatatacacactgaaccctactgaatttatatatatatatgtgtgtgtgtgtatatatatgtgtatgtgtatatatatatatacacatatatatacacacacacacatacacatatattttaaatccatattaaggaaggtgttgatgactaagaactaagaataataatgttagtggccaggtgcagtgactcatgcctgtaatcccagcacgttgggaggccaaggcaggtggatcacgagatcaagagatcgagaccatcctggccaacatggtgaaaccccatctctactaaaaagacaaaaattagctgggcgtgatggcgcgtgcctctagtccctgctactcgggaggctgcggcaggagaatcacttgaactcaggaggcagaggttgcagtgagccgagatcagcttgggcgacagagtgaggctgtctcaaagaaaaaaaagagaatgttagtgattgtgggaaagccaaatatgtgctctcattgaacatcatatcagctcttaactactcaggagatggcagattaaagatctttccaagcttttcagttttccttttttggttttgtaaccaatatttacagaattgtcttcacttattggaagacaggccggcaggctagacaaagagaagtgttgaaccttatgctgcttcatttcactacattttttagtcatttctaaacttcttgagcaaagactaaattaaagactgtgagtacttaaaggattattttggagttgaattaatgacacgattcttgtcacatatcagtaggtagtacagaagatcagcttgactgatttagggggcttctttatttaggagtgttgatttcctgaaactcctctgataatctgacaatttactgaaaacatgttcatctaatttcactttatatttcaacattcatttctactcacttttagtggtaataattttaagatgtcattaatatagattcttaaatttgcataatttatttttcttctctttttacatcagtcttcaaaattagatgatagcttccataccatactttacatagcatatttaatcatgatactcattaatccatcaattcattcattagagacatttgcctttaactaaggagatttggtttatttgacctcatggacataatttatatttctcttcaatggcacctacacatcacctactcagcaggagtgcctcttgcacttaccactgcccctaagctgactcatctcacttcctttaataggtctattatgataaatctcagttcatgctgtttgtctgaaggttcaactggcattgcaaacacagaaaaccaaaacagaacccaccatccctttattgttacctccaataagtatgtaagatcccatactgacctcttgatctcgggggacagactcacatagcaatcatttattttgcctgatatatgttctatatcaaaatattagtcaaaccttgtgaaatatacctgtataatacctctcctttgttctcctcccctcaatttctactgcttcaatctcaggtccaatcttcaaaacttctctttataatgttttcaatagccttctaataggcctcccaatcagaccccttttccttgtattaaattcatcacctgatcatcagtctgagctttatgaatatttaatttgtttgcatcactctactgctcaaaactatcttttgatcctaattgcccataggaaaaaaaataaactttttaacctaggcctctagatgatcatttttcaatcctatttcatctgaacttccctttacttcctttagccttcacaacaactaatttacatatttccctggtttctcccaagctctttcatggatgtgcatttgcttgtagtgttccttctgtcctacagatttctgcctctggtttcttaggactaatccaatttttgtggctgtggcagataatgtttcttctgtgccctgagcactcatgattcaaatgcacgctgatggtgtgctgtaagcttcagggagctgaagccataggaaccaaaggaacggtgctcaatcaataacagatagaaattggagggaaaagtatcctggttttcttgcccttatgggaggacaactctgaagtgcctgctttgccagccagtggaggtctccagctgtcttgctctccatttgctcacaatgtcaatcttctccttaagtcaacttaattggtttcctttttcttcctgtctcacttcccagctccccaactaggaatttatgggatcaccactcaaatgattcatatcagatcctgtatcagggctaacataaagcaatagttattcttaaaagttacctccatgcagccttcctggatttcggtagctgggagtgttttccctcattttggatgcttatgtgtttctcttaaagtggatgcttatgtgcttctcttaaagtgtcaccacttactgtattttgctctgtgtgtgtgtgtgtgtgtgtgtgtgtgtgtgtgttttccatatctatccaagttttctctatgggagagagttgtctaattgttgggtcactaattggctgccttttctcctaggatcctggcctcttgtcacagtttctagggcccatccttaacttaaccttacataacttccaaagccaactttcttaccaaagctgccatcgagaaaaccaaatttatctgtttttcttttgaaaagcactttgcacattacagattgatgctgagatgaattctaggggcatggcaagtgactacctgcaactaaaaaccaacgttaaagtccttagctcttcatgatcttgcacctgcctaattactatctcttctcatctcttacctctaccccacatacaccctcctcacacagcacactgaaatgttagcgtgaccctgcaaacctgcagataccacatgttcttcccactgttcctctgcatgtgctatgtcttctggctatgacaaggtgaacatttactcctctcccacactgttactaatatcaaacattctcctcctagaaatctctgtaactgcccgcccaacaaagcctacttgggaatctactcattccactcctgcagcatctgggttatgcctcagtcatttcattgatcatgataaatgacttcttgtcatggttttcccatgaaatatcataaactaagaaatatttcaggacagagattatgctgtgttcactaatgtgtcattagtgctacaacaacaattatttatgttatttatggtagagataatacatgcttgttgaatgaataaataaatagtttcctaagaaatttaattgtgagtcttggccacctaatgtccttccttacctactcccagatatttttgaagaagcatcaaagcattattagattatcctatatttagttgaactagaaatgaggagtatcatgcttgattgacactcttatatagtgttgtaatcattcctctcaaatttacgaaatcatttcactcttctttcttgaaggactgagtaagccaaacatgctggcaattactgagatggggaaattctatcttaagctatattttcagtatgcagtaaaatactgtgaatggatatcttataaggcatttgtagtcatgcttttgatagaatttgaaggaaaaagtgaactctgcaaaaaaaaaaaaattggctaagttgcttactttatcatttgtagtggattgtggcagtttctaacattttcttctctaggtcatattctccaagtcactgtagtgacaactagtgcttggagcatgttgctcacaaggcagtgccatgacataagcaattcatagctatctttgggatacttccatgccagtaatagaatacaataaaaaagccaccttaaatatgtcctcagaagaccctgtcccccattcgtacagttaaacatcccagcaaatgcatcttttaagatcactctcttactgtgtttttattctaaatgtgtaagtatatctgttcaaaattcatctgcatttgccacaccgttcaatctcttctctgcagcccacctaaatagcttcacatctgttatttataaagggaatacctactaattcttaggagtttgttttctctcatgcttgcgtctatttctgttggcagtagaaattgtccagtgctaatgagaacagcgatttccaaaattcagccacttttaggtgaatactatataatttttattaacttacctatgctttaactttctcacctcatgactgcccttcaacattttatgttaaaggtttgaccctgctcatgctgcttccccgagagttgcttgttaacattgaaaatttatatttgaaactttccagcataattttagcaatcatttgaccactggttacccaaagacaacttggtcactggtgccccaaggcgaccagcagtgttgtgccacataaaatgaattatgattaagattttaagtgtctgagatattattaggaaagagaagaaaaacattacactacagagttgtccatgcagctaaatttggtctgttttaaacaaaaatctttatgtagagatatctgttcttactgtagttttaggtccctaacattttgatttaaaatgtccttatgtataaaatgacatatgcataaaatgatcattgatttttaaatgcccttgtgtgacaaaataaaaaaaaaatttgaaacttacactgatgactaaatatacttttcgggaattttatcagtctttgaatttcaaaagtagggaaatcattgtcataggcaaaaatcattcttgataaacaaagtatgaggtagaattacacagaatttactatgtgcttgatcctgttttaaatatgaggattaaatgaatttaatccttgtaataaacctgtgagaatggtacctttatcaggtccgttttacacactaaggtttagagaggttgtataacttgtcctaggtcacagagccgctaagaagcggagacagagtttgaactggtggagtttaactgtgatcatcatatctttcttaagttcaaatgttacaaaaggcagaacttatttgcaaacttggcacccctacttggagtaattgtgccagtttagtcttgattttccccactctatttcctggcatcattgacttcctccactcatgctcaggcataactgaaactcagtaacatctgaatgccttttccccagagctggtctgaagatctaaatatatttgaatcaattagattagtgcttgagataagaaatcactaaaaagctggtaggcattaacatatttttttcaaaagaagagcttacccaagcctcacttctctaagttctcttcctgggcacagcacccccttagtttcctgcctggagacaagtttcggcttggagcctggcttcactaagtctctctttctctctctctggctctctgtctctctttctctctctctctctgtctctgccaaacaatgtcattctccccttgagctagtcactggtcaaggtcaggtatattctctttttcagggagttaagtttataatgataataacaagagaaacattctgaaagagaaacaacaaaaacaagcattcagtgatgtttacaaagtgtcacatactgtcttacactgtcttaatgctttatatacataatctcatttagtcctcacaagaacccagttaccattgtgatcgtcatcttactaataaaagaaacaaatacagagacattaagcacttgcccaatactatgtagctagagaattgtatggtcaggatttaccctcaggaagactgttttggaagcactggggaactaccgtgagaaagtcaagaatagcattctgttatttattctgtgcctctcctgaaagtctgataattggagttcaagtagacatttgagatttttgtctttgcattataattgattttgacaagtagatctctgtcataaatatcatgataagcaggctactatccaactcccaggtatgacctttttattcactttttgatggatctcttaaaatcttatttcaggctcagaaactggaacctaccacttgctgacacttttaccactattgactcaatggtctggtagatcactgcatataattagtacctggtttcctgttttgtttatttattgagaaatctgtagtcacataagagagccctaatatcatttatattactgggagttcatctctcacgtgtcatcatacctcttgggtaccacactttgtagccatttatacaacctgaggtaggctctgctatcccattctcaaatctaacccatctcccagctagaagatctagttaaagatctcagccctccctccctgtattgtctcactgtagtcaacatactacccgtggtgaatctgtacgagtctgtagcaactcaattcttgtctccttggagggaggaattcagccaaggggtataaggcagagggagagaccgaggcaagttttagggcaggagtgaaagtttatgaaaacgttttagaggagaaatgaaaggaagtaaagtacacttgtaagagagccaagggtgggacttgagagatccaagtcctgtccagcccttgaattggggattttttatacattggcatggttccaaggtttgcatttttttccccctaattcttcccttggagcaggctgtccacatgtgcagtggcctccaagcatttggaagggacagcatgcacagtgtatttactgaagttgtatgcatccttacttgaagcacttttctcttaccaattgagcattctcagagaagggtcctatacccattaaactctgttattttgtctcttagtgcgtatgcttgagcctgctcacccagctcctgagtgcttattgggaagcggctgatcgccagctccaggtgctttctatctattgggagactgttttctcctggcaccagctgtgaccaatttctattttagagagccagtttaacaactgcttgaccatcacttgatagtggcctgacattcctgagactgggtggggttggggaggactcttttgtcttgctcatgtctgaactgctacctactttaacagacagacctttatctaactttatttttaatttcccccatgttatatgcctatagatatacattattttatctttgacaatttagaactgagttatgttcctgacccaaaactgttctttcttaagcattcactcctttttcataacgctttccattgctacctgattttttaaatatttctctctgtatcctatgtagacaaattcttacttctcaacccctttactaattttctttccagaattttataaactgtaaaaataagggtagtgaggattcttagagaatatctaagaatgtctggaaaaggtgtttagctattttcttatacatgtatttctctatttttagcagggatgctaagacactggcctaatgggaggaatagattagatgagaaatcaattatcttatctctgtgatataggattcccctcattatagtaactatgttaaatttttataagattttaattttgtagtgcaacatattacattaaattaataatcacattattatttttaattaaaatgtcagatacctcaaacttttggaaaaaaaataaaaagtctcttttccaaggccttgctacaagtcttcaaggtaagaaggcttttaatgaatagactctgcataccagggtttatttgtttgtttaaagcagttttgtttctagattttgttttaatttcacttttacaaaagctcatagaaggtgatttccagggaagttagagacctaagctctggatcctcctgttgcacaaacttattttatggtcctgagaagtatcctatcaatgtgttcacatgttcttggatttttgtaatatttgctaaagtaaaatatttaaacttcatttggttaagattacaatttatttccactctgatatccttcaaagttgcttccttttgtgtctaatattatttttgtaatagaattttggtgatccatctaaaagaagaagttgagttgaggctatataacggagtatgtgtatatagctcacagtcaattatgttactctctaccaactgtagtgagaatagtatactcctatcaccaactctaccagcttctggggttatgattggaaggtacaggctagtagactaaacaggaactgaacatgttctagatgctgaacagccaaaatttctcatagtgggagagaaataatttttgaaagatacagaaccagaaaatgtaatttgtaaactgcttcatttaagagcacaaattttaagatgataattcagttttcatcaatgtctagatgttttctgtttaacaacaacatagatgttgttttctgtttaaaaataatgcagttttcataattataaacatatagattctcttaaattgtgtcaatgggaatgtcaggaaatagaatttatcagaattcctatgtttttttacagcaaaaaatctgtaacaatacaacaaacaacatgtgtattgccacatgttctaagcagtccattgtttcagatcatgttgttcagtacctgatacgttttatcctgaagatatctggaaatctcagtcaaaattgtagagaagttacctacaatgcagagaaattacctcacaaaattagtgttcccttaaaaaaatttacatattcatctctaagctaatactaatagcaaaaatagtggtatattaggtaatttactaataaaatagtatctacttctataaatttgaaaatgcttgtggttagttttgtaaaacttgtgaatcatttttttctctttcaaataaatacccatttttccctcatattctgtttttttttttttcaaagtaacccctgtatttcaagacccaccaaatctggacttgctcctaaaatagacagataggaaggtaaagtaagtgtctccttcaggtatataaaacctagaatttggaatatttcagaattttatggaataagatatttttatgagaacaatgttatgaataaataagaaaaagagcaaagagtaccattgtattagaaagatggactggtggaaggagacttaacaagttgttatttgggaacttgtataactttggaaaaatatttatatgtgtgatgtctggccctgaacactctttgatgttaactctatgggtggcaacctgtgagctaccaaatgggactcttttactcatgtattttttgtgacttggggtcatgattcataaggccagcattcacaagaataaagagttcaaagattcatttagtagattcatgacagaataggaatattcttactgcactaattatgcaattatttttatataggaaaactaactaaaatattatatgttttctaaacttcacagataaaatgatctcatatagattatttctgaataggttatattcatgcttacatggcattttacgttttttttttctattcttatttcttgatattcactatcacccacttatgcatcagcttcttcagggatggtggaattctaaagcaatctaatattttacagagatcaaaagagttttgttgtgaagaagtaattgttgttacagagcttcacaggttacccaaatggccccaactcatcctatgcagaagcaaaaagtgctgaaaaatggccgtatcaggttctacgttcctgcaacttactaataagtgctggcaaaacaaataagtcacaagcaggtgatacaagtaaaaacaaggaaagtagtaaaggctattctaagaatatacggtcttttttagcatgaagttaagcttttcaaacccaagttttcaaagaaagaaaagtagccaaaatatgagttttctgttcactgtaaaaagaaaaagtggacacttttttgttacactgtaacattacacgtagtaccaaaaaattgaaataaatgtgatatctctgcagcatatttagtggcattattttacattcagcccagtttcttcatcataaaagtacatagctaaaaagtcaacaagttttttcagccacatattgtgccatttggctatatattgagaaaaaaataaatgagttttttcttacactatacataattaagtagaggttgacacaaattaaactaagtgttactcttaattcctaatttaggagaatattaaattattaccttaaaattcataaaacaaagaaaatacatttaaggataaaaacacatggcattttcccttcaaataactgcatatgggagtctatttgattttcacagctgctatttcatttttttctttgacattacctcatttttgactgacaagtttttttttatgtttctccctagattttacaaaatgagcctagattatatgttcttcactaaaagtgagcaaaaatatatttttgctaccataccaggtaccattgaaataactgattaagaattcacagtcttggctttctcttatttagtatattgtttgatttttacagtttgatttttcttccagttttcttcattcttctgtattcctgcattttttattcttgttcaataatatcattttgttgttgttgtttttaagcatggtttttatacagcattgggtgatttattgtatgactatgccactagaatggcaatattttctgtgaaatttaacataatacatcacagaggcagctgatctttttcacaggactatctaagaaataaaccttcataaatgataggatagagtgttttaaagatgattacttcagaagaatcaatatatgatttaagagattgagttactgttttccatatattttatcttaattaaaataaatgattattcctacaaataaaaggaaactaaatctatgtttattaaaaatacacaaacaggaagttttattttcacacaaagaaagtttaaaactcaacaataaaacaaggaaaactagagatctttgtttttcataaaagaaactatgcacttcatttattaatcctttgaacaaagacttatttttttctgtactgcatagaagcagcttagactttagtggagtatagaacttaccaaagaaaagcagagacaaaagacacaatcactgtacattatgcctgtaaaatgggagttgatatatgaatacatttaaaagctgaatagtaaaaatatgaaagaggtgtacagatggagaagatataacaatgaccaataattgtacaaaatcatgcctaccctctccagtttccagaaaaaggcagtgtagagcaaacagatttgaagaaaaaaattaaaaggattaataataacccaaatatatttaggatgaggaaaaagagatgctttcatacatatcattggtggacatataaaatgcaaaattcagagagcaatttggaaaaaaataaagtggccataaaataaggaaatctcaattatttctgtttcttttcaaaactttatatttcactctaagtaaaaggcaacagtttttaaatattctaaaagctctaagcttcttaaaccttctgacattttctcctcctacttgcctgttgctcactgcttggcccatgtagatctctttgatattcttccaatacattatgtgttgttccagttcaaggatttattttgttttcttagtttagaatgttatttccccatatatctatctgttcagctaacttcttcacctcctttggcctttgcttaaatcttactgtctcaaagagactcaccttgactaccttactcaacactgtaatgtcagtcttttgtgtttattgttttcaatgatttatctcaggtgtctagaactcactttagcaaatacttatagaattaatagaagtacttggaagacagtgtggtgattcctcaaggatctagaaccagaaataccatttgacccagcaatcccattactgggtatatacccaaaagattagaaatcattctgctataaagacacgtgcacacatatgtttattgcagcactgttcacggtagcaaagacttagaactaaccccaatgcccatcagtgataaactgaataaagaaaaggtggcatatatacaccatggaatactatgcagccataaaaaagaaagacttcgtgtccttttcagggacatggatgaagctggaaaccattatcctcagcaaactaacacagaaacagaaaactaaacgccgcatgttctcactcatcatgggagttgaacaatgagaatacatggacacagggaggggaacatcacacattggggcctatcaggggggctgtgtagggggcaaggggagggagagcattaggacaaatacctaatgcatacggggcttgaaacatagatgacagggtgataagtgcagcaaaccaccatggtacatgtatacctatgtaacaaacctgcatgttcagcacatgtatcccaaaattaaaaaaagaagtactatgtccaaaaagttttctctatttcaacattgcctagcaataaaaaatatatggatacattttaaatgtctatcagtacaagccattgttatatcaattctaggaaatattatgcaagatttaaataaatgtggaacatttatacattctcacatgaaataataccaaagacatgtgggtaagtgactaaagcaagttttagaattagtaaaatgtgatctttaaattttgttcataattgacatataataattatacatatatatgagatacagtgtgatgttttgatacatgtatacattgtgtaatgataaaattatggtactcagcatatcatttacctcaacaattggttatttctttgtggtgagaacatttagaatgatctcttctaattattctgaaatacgcactataatacggttgactatagtcaccttactacactgtagtacacgagaacttatctgtctatctcactgtaatttttttactcattttcttaattatatgaagagatgggagtatcttcctttcaactttatgctttctaaaaatgtggtccaaattaataatagttaattaccttttgggaaaggagggaaagtaaatgtgaaagagaatgtatacattgtatgagttactttcaacaagaatacaatgatgtatgatttttaaatgctaaaatacataataagatgagtgattttgacaggttcagaggagagccaaatttctttgggatgagatagcattcgagtgaaaatttaaaatatgcatatacttttctaaaaaaaaaagcctttgaggtggggaaagaatgggaaaataaggcatttaagatagaaggatatattggaatataatatatgttcagaagtagagattacttgggatcggtatatgtgtgggttcaacagaaacagaaacttctagaactgtgaagagcttatatttgggaaggacagtaatagaccttgcacacaaggcttaggatttcatactttagtttgtgttaaaggaaagccatggggacagtggtcttggtatttaaataggccagtgtcttgccagatatggtgcttaaagaaaaccagattgactatttggggaaggacaagactaaataattttacctatttcaaccagatgtggttagaatttgccaaaaaatcttctgacaaggatgtgtctctgaagttattgagtcaccagacaaacaaaaagggttactgtaaactcattaaacaaagatttatgcttatttgttatttttctcctttatagcttatcatacaatgttaattcaattatctttacaatagaatgtgaatgagcataatgttgggagttgccacaattacctatatataatcaaactccgatgctttcaaaaattgtatctttcattcctctcacatataattttatttctcattacttcataataacatactcatccattttttctattatatagttaacaaaaattactgtgcatctgctatgaactcttgactctggtaggggattggaataaaatgacaaaaagaaaaaaaggtataactttggaattcagttgggaagatatgaaatgtgacaatgaaaaacaaatcaggtttgataggttttttgaacaatctgaatacagaaaactaaaaaatacagtttagattataagaatttttataaacaacattaacagaatcttaagaaaaaaaaacatgagattgggtaagttgtagatgatctctttgatgagataattcccatactgttatctaaaatacatgagagaactagctatgcatggatgaagaaaatcatttccagatacataaacaacagtaaagaacttgaataaaagaaaaacctgttaccttgggtttggtaaagattagcatggctagagttacataaactaggagaaatatatggattaaatatgaaattaggcaaggtctaaatgattaaggtctgttaaggtcaaggaaaagactttggattttcttttccatggattgtgatgccatcatatactattaacaaactaacaaaaggaaacaagttaacaattaacatttctgaaagaaattaaccaggctacttgtgaaaaattgattgaagggagtgtcattattgtaagcagaaaagccagttaggaggttatggctttatccaaggtgaattagagtgtaaataggcaagttaagagatctatgtatatgagggagctttaaaaagtttgtagaaaaatggaatgacaagataaaaataagaagtataaacttcattttttaacatatgctccaagaacttcaagacactgaaacttcctttgcaaaaattattacagtgtaaaaaatctgacacagcagactctatcttgcctctaacctcacaagctaactacctttgcccatttttaggcctaggccaagataaccatggaagaaatttagtttgtagtttaatcttaaagcaagggcgataatagctcctttccaaaactacctccctcttcatttggaaaccaaaactgccttggtaaaactaaccaaagatgacaagattagaaatctgagaggagtctgaattctgctaatgcagttaagcaataaccagccattgtttcttagttgtcttactgctccagagtcatgtagctggatatcataagatttgcaacttctctggtttctcctacagataacatcaccattataaagcctaaggttggtcttgagatatttttcagacttttgcattctgataaactgaatgacgccacttggatccatgactcacactaaggaactgattcagctggtcctgtgacccccacccagaagctgactcaatgcacaaagaccgttctgatgttcctatgatttaatctccaaccaatcaggaacactcattccctagaccccttcctgccaaattgtccttaaaaaatcctagcctccaaggctagggatggaggtggatttgagaaatatctcctgtcattccacttggctgtcttgtgataattaaactctttcttttctgcaacactgctgtctcagtgtattggcttaactgtgcagtaggcaagaagaaccactgggctgtaaaactacttttgtaactgataaaaccagaaattcagcctaccctccaaaaatgagggtgctgaaattttatccatattaatgcagtatttttacattattaatttaatgaaatactttgagcatcccagaaaagtgttgctaggacctttgttcctaattgatgcacttttgctttgacttgaacacttcaaccttttggtagccattgatattattgtgctttgtcttcagaatcatactggcaaagccatattttatctccttttatagttcttcaaaaaaggcttcaggattttgatctctcttgtttaaaatattcattgaaagcttggctcttgtctgcaatgattttggcatccattgcataaaaatttgctcaactttaaatttttagtcagaagtgtgtaagctagtgttggctagtgtttctgctgtataattgttgattctcttcaattaggacacaaatagagaatttttttcttctagcaacttgatgcagttttctgcagctgccagcttcatcctcaacatcatctcatcccttcttaaaaccagttatccaggccaggctcacacttgtaatcctctcactttggaaggctgaggcaggtgaattacttgagctcaggactttgagaccagcctgggcaacaactggagacccagtctctacaaaaaaaatataaaaattagctgattgtggtggtgcacacctgtagtcccagttattttagaggctgagatgagaggatcgattgagcctgggaggtcaggctgcaatgagcagtgattgccccattgcactctatcctgggtggcagagaaagacactgtctgaaaataaataaatgaaaacaaaccacagaaacacacacacacacacacacacacacacacacacacacacacgaaacaataactctctctattcatttgcaaactactgatttctttgaagctttgtccccgtaagatttctataaagcatcagtgatttaacctttcttccacccacgcttcaccataaattttatgtttgttcttgcttcaattttactagaatccatgttgctttgataggggaccttttcaaactgaggtcaacaaatttttggtgcaaaaacttttgaattccctgcatagtttttttcataattcacatttttcatgaactttttgaagttccttcatatttgaaatacattttggaattaaaattgacagacattacagatgcattgaatactaaaggtagaaaaatgaatatatcagatatgagtatcttgtttgagaactaggaaggttgttttactgatgagataaacaaggaaagcacacagaagtttttggggggacatggtaagcctaagatatagatggaaatgtgacggtagatggatatatagatatggagctaagaacaatagccttggccatatatatatatacacacacacatatatacacagacacacacacacacgcacacatcataatatatttaggtgctatatatatttatacatataatttatatatatatatatctcatatataaatatataatttgggagttaatagaatagagatgatatttcataggagtgtatgatgccactaagagacaaagcatagttgaaatgaagagttttgaacacaaaggaattataatatacagagtctgtatggagtaagagccaacaacaacagaagagggtaggacctgtcaatgagggaggatagagccaggaacaattttacttttcaaatttgtacttgtcactccctctcccaagaaaactctttttcagattactctatgcctattttcctcaactttttttttttttttttttttttgagatggacttccactctgtagcctaggctggagtgcagtggtgcaatctctgctcactgcaacctctgcctcccagattcaagcaagtctcttgcctcagcctccccagtagctgggattacaggcacaaaccaccattcctggcagattattttgtatttttagtagagacagggtttcaccatgttggccagtctggtctcaaacacctgacctcaggtgatctacctgccttagcctcccaaagtgctgggattacaggcataagccaccacgcccggcttattttcctgaactttttaggtcatagttcaagcattagcagcttagtgatactttcctagaccacttaatttcaaatcaatcacacccaatactgacacttcctacgcctttctctttctagcacttagcaaaatctaacatatgtattttacggagttatttataaaatgttctgctgccataagaatatatgacccaggaaagcagaaattgtgttttttttttaaatgctatatcccccaaacttaaaattggtgctaaatatattgataatgtaccgtaattttgttttttgtgaagctgaatggagcaattttattggactattggatattgatataatattaaaatggttttatgaaagaatgggagctggggaaatgactgtgcaatcatttggttggggttcattctgacattataatcagtgggggcactaactttgacaggagtaagaaaatatgtttataataaaaattaaaagatatatatatgatgaatgtaaggattgtagatttgacttgaggaagatgaggaattttcttcatatctttaatttcctcaatgagctcttcaacttggtgtgagtaaagcaagagttaggtttgtggggaaaaagaagaaaaaacatccgatttaccagtcaacccagtgaataatacttaaaaggaaaatgtggtagtatggctgtattcatctgtttttgtgttgctatacagaaataccaaaggctgggtaatttataaagaacagaggttaaatcctgttccacctggttatcacccctccgtggaactcaggagcttggttggcagaaggagcagcagagaccaggcagtccagctttgcaaaggctcttcgtgtgctgtgacaggcaggcatccgccaatcaccatccctgctgcccagatgcccaagaggaaggtcagttcagctgaaagggcagtaaaggaataactcaagaggagatcttcatgattgtcagcttaatctgctcctgcaaaagtggaaatgaagccaaaaaggcagcaggaaaggataaatcttcagacaaacgaatgtaaaggagaaaaggggaagagcaaagggaaaataggcaaaaatggctaagaaactaaaaacgatttacctgcagaaaacgaagagagtaaaaccacggagaacccagcgtctgatgaagcccgagacaaagaaaccaaatctgattaatattatacatagtgtctcaacagtggttcctgtattccttcttgtacagtccagaagaagatttttatcaactattttataaacgcaagtttgttagtagctctcattttcaggaaggagggaatcctacctcatcccattctttaagtgattttttaagaggtgacattatttgtcaattgtttattttttggtacaaccagaaaaaactcccataatattgaattatgggaggctttgaccatcttaggtgtcaccttaacattccatagaagggattcgtttttataacctgtaatacaaagtatactaaatggcaacatggagtcacagttctgcatttaatgtcttgaacatttaaaattatttctattcccatgttgtttttcagttgcattgtttcctaaagaaaaccactccttgaccatggctctcccagtcagactcgtgcacactctgtaacatctttggtgttggtagttgtgttttcctaataacattgttaacgtgctgtgaaatactgaaaatctgagtatgtagtgtatacactattcaattgtgaattgttggtagttatgtaacagcttatcaacatgtgaagatgctggaacttgatagtctcttaagtaaagtttgactccaaattttaaccaggaaaatcactggaataactttaaaaaataattacaatacatggctttttagacttttgctatatgtgttaagaattgtgtacaaagtgaaatgtctgtggactgatcctcgacataaccaataaaatctcaattatggaagaagaaataaaaagaaaggaaaggaaaagaaaagaaaaaagaaaagaggtttgattagctcatggttcttcaggctgcagaggaaacacggcactggtatctgctcatcttctgctgaggcctcagtgagcttacaatcatggcagaaggcaaagcaggagcagacattgtcatatggtgagagcaggaaccagagacagaagggggaggccccagactctttgaaacaaccaaattttgaaggaactaaatgagtgaggcctcacttatcaccaaggggatggtgctcctacaaactaatacctcccatcatgccccacctccaacatggggattacattttaacaagagatttggaagggacaaccattcaaatcatatcagtggccaagcagtgtggatcttctatgtgagtgttgtcatttcagatttaaaatgtgaagaaccaatcggtttatatcagtatcaccaattttgctatgttgcttgagtgcaatcaaagagaaggtaatgcctgttcagctagatggattttgctagttaaatggggaaaacttaagagggatgttaaaagcatgcacatatatatcctttcttcacaagtaattataatggtaaaactaaaacatggaatctgtgttgggcaaggaggcaagttaagacagaggagactgaaagatggaaaaagttatgaatgtgaagaatgataccttgctataaagtcaaagaattgtggcagtgaaaagacaaaatacattattttcatgtactcagtccttaagccattatcttactgttcatcatttctttttatcacattcctaggaagattcctcctactgacctctgtatcagttaataagcttgtagtgtatccaattaacctgggagtatccaagcaaaacaaccaatggttgcaaagtacatcttaaaagtctgtgcatatattatgggtggtctgggtagactcttacttctgaaggttatttcagagacgtagcagtttaatacagaatcagagagaaagtgatgtggagtttggaagggaaacgtcaagcctgaatagcctgattttagatttcattcagaacaatgatgaaaaatactactaaaatagacacagtcagggagttttcaggcttcattatgcttgagtaaagaatgattcacatggccaagcacactggctcatgcctgtaatcccagtactttgggaggccgaggcaggtggatcacctgaggtcaggagttcgagaccagcctggccaacatggtgacactctgtctttactaaaaatacaaaaaaaaaaactagttaagttttgtagtatgtgcctgtaatcccacctacttgggaggctgaggcaggagaatcgcttgaacctgggagatggaggttgcagtgagccgagatcatgcctttgcactccagcctgggccagagtgagactccatctcaaaaaacaaaaaacaaacaaacaaacaaaaaaaacgaacaaaaaaaaacagaattattcacaaactattttagtttttaatgtgtctaactataaagctaaatctcttgggaataaccacatagatgtaaggtatgcttatgtaatttgaattatagaaaaaagaatgatttgattttctaaaccaactgacatattagaaccaaaataaaacttaataaaataaaaacaagtcttaatctagataagtgtttgtctaatccaccagcaacacacatatacacattcattctctctctctctctctcatacgttaacacgggaatattagattatcagggatatttctttgctttagcgtctttggaggggaaagggacaacacaggaagcaaacatgaaatggtcatttttggacaagcacagagttaaacttatatttataactatattttgctaaaaattagcttaataatcaatgcaatattgaacaattttctcttttctacaaattaaaaatatttctttccttagctactttttctcttatgtgttaaagcattatccaaattataatttccatgtgtatctggacaaggttcttaaatatactaaatcagaaaaaaaaaaaacaggattacggaggagtaacatgctttgacatatttttgtgtgtatatgtgccatggcattaattagtttgcactgacattaccttagagtcaagaatatgtcagtgagtggaatttaaattctctcatgtatatgcatatatatgcaagaatatatatatatatatatgagagaacttaaataagtgctccatgatattacaactgttgttacagaaccataagttcaaattcatacatatactaacatttcaaaatgctatatttgcaaaattgctatcaaattttgtgttgaatagagagacataaggatcatctaattctgtaaactttctgaaaacaaaaagttaaagctgactctaaagtagcactcatagtacagatatgacttatctatagtcccaggctctcttcaaatacattaaacttgaaataaaaccttcaggcagatttattgcttacattattggattaccacaaatgccttgggctcatacatctttagaatgagcagccatgtctgtctacaaatatgaacacacacacatacacacatttacttgaacaataaatcttgaaagtaaaagctctcagtatacatccaagactcttttggggtatttttttttcattcttttttttcttgaaaaacagttgatttagtaagaaaatcttcacttgagctccaataccaaagatagtaaagttttttaaaacctgtcttcctacaactacatttgttctttttatattttttatttctaaaaggttgttcttgcctctttaaaaagaaatcatgaaagagaagtgaaaagagaaaaatagaaggagaaagtaagaggatgtgtagggaaacatttcaaaatcaccttttatttgactttaattttttctctaacattattatttggtagaaaacaaaatcaatcgaggttttaagattaacagtcaagtaataagatttatgaaattccggaacagtatatagtgttctaagatgtgagaatgggggatttggtttcaatgctgctgaaattagactttcctctgtacatttattgatgcacattgataataaaggaagcagctgtgcctgttgaaaaccaccatttgaagtagcaatttggtggcagaagatgacatgtgaatttcccaggcttcagaacagaaagttggggacagaagctgaacaactgcaattaccatattgcaaatgacctctgctagttggaatgctgcccacagccactacaactcaccttgattaataaacatttcctacagtgcctggactgctaaaaagtgacattttacattttcaagattggctattaatttaatctatgtaaacatcactcataatctgtgatgcacattcccatatttcaaataaaaatgacatgcaaattgaaaatatgacaaaccggctactcaaaattccagcaatggaaaatatgtgctcatagcgctaaaaaagaaaaaaaaaaaaaaggtgtgtctgaagcttctccctgcctatttagaaagcattgagtgacagcttaaactagggcttgtaacgcccagggtgagactacctatgagggcaatgaaaaaattttcactgtgagctgtgcagtgacttctacttgatacttctttcccatatcaaggaaggaatagtcgtattctaaggtgcataaaattacctcgaagctgatgcctccattttataatatgcttttaagaagaagataataatgaagatgataatttccattttttctcatatattggctaggtgtggggtggataaaaatgataaaactgcataacgtttattgaatgccaggagctcgttacttatgttgttataacagaaatgctagctatgtgggaggtgacaaaacctctcatcttgtctttcacttgtatttttaaaaactttttagtctctatctcaccccctgggaagaagcaaatccagtgtctatttcctgttagtagcacccacattccatctcagctaataatgttaaaattcctttttccaaccaaattctgcattctgcccttgtttccattctcttcctgtgcggccttctctcagttgtctaatatctcctgtgtagagagcccagattaaagtgcagcctaaactaccataaaatggctgtcagaattgatggataatgatgagggtgggacgcgaaggtgcaaattgaaatctcgtttaaaatgtaatactttaggagccagccttatttttgaacgtttcagtcttaatctactggtagatatttcccatgttccaagtttcttttcattaatatctggtttttcaccatttgctgagtaatatatttccctcctcagatctctttattttttattcccttttctgtcatctccaccataataactccttcagggaacctctctcttctccttcttgatttctggaaataagtaaatcgattaaagcaccatttgtttctatagcactgtgatctggggttcatctttacacatccaaatagttaatcaaagcatttgctaaaaataaaaaaaaaaaagaaaagaaaggaaaaagagagatgaagaaaagagagaagaaaaaagtatatataactatttactcattcttcttccttgtcccattttactaaagtatgtacaacagtcctttgatttttatatttgaaatttagaaatatctctaaatttcaaacataaaaatgagcctctaagatgttaattatgcagcctaagtcacagagctactaacatccaaagcttatattcaaatctattctgtaaagccagagctcactctttctatctctctctctctctctcattctgtgtgtgcgtgtgtgtgtgtgtgtgtgcatgtgtgtgtctttataatattttaggccaaatgcaccatgaagactaccagtcttaaaaatatcatgtgaaaaacacagaaaagcttaacagttgtcaaatgttgttagatggacaactaaaaaaaaattagggggtattaatgtactccagagatactagaactcttagatatgatgagaattggctcacatggttctggcgtctgagaagtctcacaatctgccatgtacaagctggagaatcaagaaatccagtggtgtaatttagtctgagtccaaaggcaagacaaccagaagtaccagagtccaagggcaggagaaggtgggtctctcagctcaaaaaaagagagtgaatttgcctttctgcctttttgttttattagccctctgaatttgatgatactcaccaacattggtaagggttgttatatataaagtttcggtaccgcaaaagaaatagcactcgaatataaaattttctttttaattctcagcaaggcaaggtacttctatgtagaagggtgcacccttacagatggaataatgatgagtacaaacttggacaaggaaggggaaggggttcttatctctgacgcacgtggcccctgctgcagtgtcattcccccattggctagggttagaccacacaggctaaactaattctgactggctaatttaaagagaatgacagggtgagtgctttggagggagtcagggcagagcaggtagcaggtaattggaatgagggtggagcaggtgattggaatgtagggtggagcaggtgatcgaaaaagttgctttaggaggaagttaagtttaaaagtagaaggcaaaaaattgaaaatactgacatattaattctttgaaaagaaatttggaactcatatccaacagggtgaatattcttccctcagcctactgattcaaatactaatctcttccacaagaaaacctcatagtcacactcaatgataatgctttatcagctatctgggcatctcttagcccagtcaaatcaacacacaaaatcaaccattagaaagagtcatctggattgattaaataacctcatttatcaaaatttttatagtcttttctccccacatttttaacaaatgcctcttgtatatcattattgccaatgttgccccgaaaagcagattcttcagttttggttcaattcaacttatgctggcagactctgtgtgctggggttatactaggcacagcgagtatagtgcaaaggtaaaacacgctctcacagacccacttcttgtaggcctataagaatcacctgaaatgcttatgaaaacctggatttcttggttcttcacccccacaagagattcttattcagaagcccaaagtatgattcaagaattcatatttctgccaagttgccagacaatgatgatactgctggaactcagaacgcatgatgaataacagtgctctagaggatgtttttgcaataattaggatgagttcagatgtaattacctaaaagcctgacagagaattaaaattaaaaaccctgtataagatcacataacaaaaagtctgcatgttggagcttttagagctggtccacagcccagctctatcattaattaccaaagctgttttcacactttaaattacccagctccatcaagctatcacctatcttagggactggtgtgtcatgtttctgaaatgattgtcacatctagaagtagaaagagttaagcaaagaagaggattttcagttcagcaaaatatttctgtctttatctctatttgtgatagagaataaaacattcctgaacatgtgggagacttcctatcttttatggtctggatttatcacaggacttgaagctgagaaattatatatgcggcattttcaaatagtaatgtgtacagtttctaccagtaagggagaagaataaggctaatgattaggttaccaactatattcagaatattatagaaaaatataaagagaatatgtttatttaaattgggcctacacatcattctcaaggagagtgtatacaaagacatggggttataaaagagtacagagtattcaggaaatggaataaaaggtatttttaaaatatatggatttgatagaactacagagtatatggaaggaaattgtcaaggagaagctaaaagagaaagggcagatacaatttctggcaattgtatttacattttgtagttatcatatgcctatttagtgcaaaattattgtttaaggctatgattgaggaattccatttcaaattttccaggaataattagaagaactctttttggatataaactttatttgctaatgggatctcaataaataataataatctgagatagcacataactctactgataaagaggaatgtatacagccttccattgcacctttattctttctgccagtgtcatcgtttttgtattggggcctcaaaagcaatcaaaaaagagaaagcaggaattgcagggataatataatcaggtggttctttctgttcaccagcagtgagtttgtagacaggagctcatggatgaaaaagttaactttggtgtctgcctttctcagctgtttatcagatccttagaacaagagaaatttaaataaacatgaaccaggattcaatcctcctgttatatgctcccactttggaaagttatagaaatgtgctcctctgatgagatcctttttatttgccctcaacttaactataattatcatttgctggaaccagacccacttaacattttaataagtgcttgtcagtgtcttcagtagtgaaagtgaaaatcagtggggtggaatttctgaaccacggtgatattctcaaaggaaaaaaattaacataaatgagaggtggtgattttattattctaaaggtgcctctggagttgccctctgtagaatctgagatatcatgtaggtcttagagcttttcccccttcttttagagtttttctctggctagatacagtttgcagaatggcagaatctgaaaccactcagcataaaaggcttgcaaaatcaatattgctcctatcagtcaccaagcagaagattcatttcacacatcaaacagaatgcaaagccatggattcttgtactcctagtgaaatgggtttctgtatagatacatgaagttaataaaaaaactaacacattgatcgtatattgacagggctatttttctctgtgattaatggtctcacattctgtgccaatacaatagcaagctcttctgaatttttctactgctttctgaaagcagcctagccacaatttctctgtcatgaatttctttaatcacaacaaatttctactacttgaattatccattaagagtattatatatcacaacccccatcttgtaaccagtgaacttaatacatgtcttcagtgtaaatttatcacattttttttgcaattatgtatttgtttctatcatactttaaatgaaaaactttatgaagtcaggtacaatgttttagtcatttctgatattcaagcatagctcaaaatctggcgagaagaaataagagacaaagagaaaggaaagaaagaaggaaggaaggatggaaggcaggaagggaggaaggaaggaaaggagggagggaggggaggggaggaaagaaagaagggagggaggtagagagggggaaaaaagaaaacactgatatgcttaatcagctttaatgaagaagaaatgctagcatctaaagggggaactggcaataaaatagctccatatccttcaagggcaagccagaattccaattccatgtttaatacagaaagcattgctttaataaggattttctgggcctggcgcggtggctgatgcctgtaatcccagcactttgggaggccaaggcgggcggatcacgaggtcaggagatcgagaccatcctggctaacacggtgaaacccccgtctctactaaaaatacaaaaaattagccgggtgtggcggcgggtgcctgcagtcccagctgctggggaggctgaggcaggagaatggcgtgaacccgggaggcggagcttgcagtgagccgagatggtgtcactgcactccagcctgggcgacagagcgagactccatctcaaaataaataaataaataaataaataaataaataaataaataaagattttcttttgtaggtatagacatcaggggagtcatgcagtgactgcctggctgtgaaagatgattatgcggatggagttgtctcgctcaacgtatctcttcttgagcgtgtttacttttaaaaatctagaaattcccttttcagttactatttaaaatttgtaatttgatttctttatacacacaccgtcacacatacaacacataattttatataaaggcaacatagttttttccctaattttttgcctttccctctcataaattccctctatttgcagcccttctctgccctctgttaaatcagtctctttcaaatttttccccttactaacataattgtatataggcataaacaaacacaaacacatatgtatatactcctagaaccttattcattatgactagcttttataaatgcaccaaacttttgattatttttcttctctctcaaaagtgccacacagaaattcctccaagtcatgtggtgtactctgattgatgtattatttaaccttagtataccatagcgtgttgtcaaagaaaatcaaagcagaatagcagttaaaaaggtaaagacaaatagtattcaggaactattgaaataggaggaaagagaccttgttataaactgtgcttaatttggctggactcagttgctcacacctggaatcccagcactttgggagattgaggcagggagatcgcttgagctcaggagttcaagacaagcttgggcaacatggtgagaccccatctctgtaaaaaattagccaggcatggtggcatgcacccgtggtctcagctactcacatactcagtaggctaaggcatgaggacagcttgagcccagaaagtcgaggctatatcactccactgcacttcagcctgagtgacagagtgagatcctgcctaaaaaaaaaaatgtactgagattaattcccaacacatcatcatcaagtgaggatttgcagctaaggaacaggatgaagatctgtgatacaaaattactaggagaaagcatcagggttaaaagggattctggctaacctaccagggcacttagatatgccctgggtgatgtgggggataagaaatttgatcagatatggagggtgatcaaatattgagggtggaggttttggttaatgacttagcaagattttttttatgactaggtaatgcaggccatggacagattaccatatttggggcataattgagaaaggggcttagaagagcctgactaaaatttggccaagaagacagtctttgtcaatgtattcagcataatttattcagacctcttattttctttccaaatatttttatctatgattaatgctgctttaaacttattgtattaagggctagaacttctacagatagattcctaggtatgggattggtaggggaagagttatatatttttaacttgaaaccatcttgtcaaaagtcctctaatgccacaatctttgactacgtatgtgagagaccttacttccccagaagagacttttctagacatctttagtgagggacacaactaattctgccacacatctacaatgtctctgggagattctcttagtttgcattagcagaccttgaaagaaaaatatgcaaatatcccggtggtcacattgagtgttggctctgatacaaagaaatgtgtctgaacaagagtgacttcagatagcatagaagtcacttaacaaaattatttatggctttgttctaagtcacagaaatttttatagttttatgattttcttgtgggcaggtattgaaaatgtttcccaggaaaaaactacctgtgtcatcattttaataccctagcgaaaccgaatcgaagtcactcttattcagtctccttgattgtgaattaataggaatctataccttggaatgcctttgtcaactggggggagaacaatttaaatctttctttttgatgtttatttggattgaaaatgtgcttatatagtaagtccttcatatctatgggtccaaccatccaaagatcagaaatatggcaaaaaatagaaaataaaagttaatacaggccagacacggtggctcaccctgcaatcccagcactttgggaggccaaagtggcaagatcacctgaggccaggatttcgagctacaccacgacactctatcctggataacagagtgagaatctgtttttttttttttttttttttctgagatggagtcttgctctatcacccaggttggagtgcagtagcatgatctctgcctactggaacctctgtctcttgggttcaagggattctccttcctcagcctcctgagtagctggaattataggcgtgcagcaccatgcctggccattttttttttttttttttttttgtagagacagggtttcaccatgttggctaggctggtcttgaactcctgacctcaggtgatctgcccacctcagcctcccaaagtgctgggattacaggcatgagccaccatgcctggccaaatctgtcttttttaaaaaaagaagaaaaaaattacaaccataaaaataatacaaaagtcaatacagtataaaaactacttacatagcatttacacattgtattttatattataatgatgatttaaagtatataagacatatgttgggggtaggaggcaagaagagggagagcattaggacaaatacctaatgcatgcggggcttaaaacctcagtgatgggttgataggtgcagcaaaccaccatggcacacgtatacctatgtaacaaacctgcatgttctctatcccagattttcaagtaaataaagtaaaataaaaaaaggaaaacaaaaagaaaatatgcttttctttctatttgaagaaatatataatttttgagttgcattgcctcctcatagccacataacaaaatacacctccagacatctgaatcaattgatctgcttggggttggtgggaaagtgtatgccaagaacaaagatttggcacggagtaatattaaactgtttattctgcccataattagaaatagaaagctttgttttctgaaatgctttcagaaaaatgatagtaaaaatcttcatcagcatgggctgaatgcaccccccaacccctaacccatacgttcatctacaacagcagaagtatatgcatggagtttatctaaaatatttgcagcagaattttgacatgctcatgaatcctccaattttctgccaaaatgattcaattattcaaacattaagagaaaaacatgcaacctaagggacagcctgagaaatttgatagcctgactactagagatggagtgcccttggaggcatcaccttctgtgcacagccctgatgaagtttagatctccaccagagagactgacacagaaagctgtgcccttgccatagcatcaacagtttacactgtcagaagagcctagagagtctacagacccctctgcacactttaactaaagactctcagcccatcagccttttgagaaacagaatatctcctatcttctaaacatctgaaagacacaagcaggacctgaggagttgcttaggtaactgacatttacttacctctgctgacaatgctggtatatctgggcgtaagtggacagagtgaacaatgaaaaatgatgtgtaatcaataaaagtaaatgtttgaaaaaaagacatatgcataaattatatgcaaatactagtcattttatataaggcacttgagcatctgcagattatggtatccaattcaaggagcaactatgtgtgtgtgtgtgtgtgtgtgtgtgtgtgtgtgtgtgtgtgtgcatgcgtatttctaaatatatcttggtcggtgaagagcaattcatagagaaattcatattctataggaagtaattcaaatttctgaccatgcccttcaagagttttgataatttgaacctcaccaacttctccagattctaccttacttaaatgagctcagggagtgtcctatatgcaacttagattatattgcttgctgatttataatttgcatgaacacaacactttcacatctacattgtcattacttatattgtcacctgtgcttagacttctttcccctttacgatatttaatcatcctatgcgtcattcaaggccccacacaaagatattttcttccatgaaattttctgtgactgtttaacttgttggtgatttcttctaatgtcttactcttatcacattttgtcatgtattatcctcatttcaatctttgttctatattacagaaataaaattttgagccagttgattagggatacttcattgttaatgtttgcatatattttttcaaagagtcctccatgtagaaggatccaataaaatatatactacttcattatttgtagagggactgcataatctagtattttttcatcaatgatatctagggttgacgactattttcatcatttactatctgtctttggaaaaattacttaaattatgaacctactttcttgcttgtagaatgtccactacacctatatttctgaataattatgagaattaaatgatattgtaaaatgtctaccacatgtctgatatatgctagtatataatattagatattgtttaaaaataaaaaataaaatgaagctatagttatgcttgctataataaataattatttaaaagtaggcagaaatgttgaagacaggctgaatggaagtttgtgtttctacagttattattgttgttattctatttctttgggaaaaccaaatcttgagatgtcatggcactactccagagctttgaattttatgaaatttctatccaaagaaggcgttcaacatactcttggaggatcttttcattaaagacaaaaaacaaaaacaatgcaaatgaaattgaaacattgaaagactattccatgataagtgagtctattgtatctgcatttaaaataaacagttagaaatataaattacggcaggacagacatcaaaggagtgaaaagagtcaagaagggttccaagaatgaggaggacaagtcacagggtacaggagcctgtttttcaacacttctgccagtccaaacaaggaaagtgtaaacatcaaattaaatagtaaccactagaagctgggggcggtggctcaagtctgtaatcccagcactttgagagtccaaggcggacggatcacctgaggtcaagagttcgagaccaactggccaacatggtgaaaccctatctgtactaaaaatacaaaaatgttctgggcatgatggcaggcaactgtaatcccaggtacttgggagactgaggcaggagaatctcttgaactcaggaggcggagtttgcagtgagccgacattgcgccactgcactccagcctgggtgacagagtgagactacatctcaaaaaaatttttttaatataaaataataatgattactagaaaaaatgaagaagtacatgctttcaaaaactcattaatctataaaggctgttgtgcaatcatttttaaaaaataaaactaatgattaattataaaataaagaagtggagtgaatatatgacatgcatattaagaagaggcatgaactttatagttctaggaggagatttcatggaagaagtgaaatgaagtaatttctctaactagattgataaacagagtaggtaaaggaattctaggctgatgtaaccattcaagcaaaggttagtagttaaaatttattcagctaacctacatttattaagcatctcacaatgtgctatcaaataaaaacaatgtagtcttaattttttttcttattttaaaaaacttttaggttcagcagtacatgtggaggtttgttacataggtgaactcatgccatgggggtttgttgtacagattatttcattacccaggtattagaacccaatagtttttttttttttttttgagacggagtattgccttgtcgcccaggtggaatgcagtggcgccatctcggctcactgcaagctccgacccccgagttcacgccattctcctgcctcagctttccgagtagctgggactacaggtgcctgccaccacgcccggctaattttttgtatttttttttttttagtagagacagggtttcaccgtgttacccaggatggtctcgatctcctgacctcgtgatccacctgcctcagcctccgaaagtgctgggattacaggcgtgagccaccgcgcccggcccccaatagttatctcttctattcctctccctcctccctcccttcaccctccattagacccaagtgtctgttttcccttctttgtgttcgtgagttctcatcatttacctcctacttataaacgagagcatgtgatatttggttttctgttcctgtgttagtttgctaatagcctccagctccatccaagttcccataaaagatatgatctcattcttttttatgaccgcatagtattctacggtgtttttgtaccacactttcgttatccaatctgtcataatgtagtcttaagtaagaaaataatttattcaaaagctattgcagtagaaagaacacttcaaccatacaatctttaagcatcgtagagcaaaggctttcttttatagagagaaaggaaacaggactatcaaaaactggctgtggggaaaagagtgagcgggttgtgtggccgaacgattgaacagcaaatgtttctacaccataagccaattaattaatggtgtaaaagctaatctcagagtggttgttaagctgctgttccgtattccaatacttaatgcttgttgaaacccaaggtgagacagagttcacaggcctgagagaaggtgagaagctagaccaaaaagctcgaccactctggtcaaatgaagctagcagtcttttgcgcagattaatcagtgaagcacaagtttagctaatcattatgagacaaagagtgggaatttggagtgtctgtgagtgcatcataacaggtaaataaggatgtcatccatgaatcttatctagctcgtatggcaaggacagtattttgcattatcgcatttttggagacaaaaggtttggggaatttcttaaccattggtgatttctggaagcacagggctcagatgcagttcaacattataagtacaaaacagtgtgctagtatcaaacaacattttttcagtcaaagcattcaattttgtggtgaaacacatacataaataataaaatattataatactaaaaagagatggagaatacagaaaaccttgacagaagactaaggattgaagagactgacttgatgtatttggagattttgtgctgtgaaatcaagtgttaaggctatacagtgtacaacggtgtgtgggaagttcttaaatactaggaagaatttaaacaaatgattcctcagggaattcattttaatcttagatctagtttattcacaggaattgaaatagacaaaacacatttaaatattttcaagaaattctctttgataattaattaactgagcacagggtatataagaggaaatagaggaaagctgaacaaaggaaaatgaaggagacagattcaagccccagggcagatggccttgaccttgacatggccgaaggggctactgatattttgaactgtaagttgatccagttagaattttaagttaaaaagtataatttgaattaaatggattagaaaagcaaaaaaaagaaaatgcatataatgctattatataaacattcaaatagtgagaacctgaactaggatagtaagattgggtagagtcaaataaaaatgttcaaataattagaattggagaagagatgggatttgattgagcaaatgtttatctttcagaaataaagaaaataattagttaaatcatggccccaaaatatccatctttagtgaaattggacaaacttgtcagtcttagtgctgaccaatcttcctgctgaagtcaacagaaaaaattgacaaaattcaaaataataattccttttaaggcactggagaactatcaatgcacaatgtaacaagtactcaactggccaatctctgagaaataaaatatagagaagttaacacagcatttggcactatgtagtacattgtttgcaaatatgcccgtaactattctccttatatccatatacacttactttatgactttgaagcttttcccatcaagaagtgaagtatatttacctgactcttgaatctggcctgaacttgtgacttgctttgtaactgatactgtttgattgacaggatgttattctaaatctcagcctaaacctgaaaaatactccctgacctctgctaattctcttagatccctgaccaactggtagatgatctgctctaggctactttgctgataaagcgagatccagttgctttcactgataaactgacagcaattcaaccatagaagtagagtcattggctgatgaacaaaagatcgcaaatacaagaataagcccaaccaagtgaatggcccagctaagctcagactaacacacagaatcattaagtaaataaatgataataaaatagacaaattattaaatattatgtaatttattggcattgaaatgggaacaattagaatatttgagtatttacgtatctattaaaacattgactaactaaatgatttcccacaaaggatttgcaggccatattattttagttctgaattctcctcattcagggaagaaaggttaccagtctcacacaaattctttcagataatagaaaaaaaaaatactatccaatttgtttcatgagataagcaaaacttagataccaagctttacaagaatatgagagagacatttacaaatgattttttctatgaaaataaatgtaaaaattataagcaaaatattaggaaactgaatctagcagaagtatacatgaaattattttgatagtgtgagatttatttaatgtaatcattaatcatacatgtgagatggatcaatgcaatgaagtacattaatagtataaatgaaaaatgtatgtgaccacttgaaccaatgcatttattagacaaatttttgctgtgctgatactacattacaaattactccaaagcctaatgacttacaaaaacaagcacttatttttcaagctcatgttgggagcttactgcaagtgtttctgcttcagagtatggatcaaattcagacctgttcttttgtttgtttgttttgttttgttttgttttgagacagagtccctgtcgcccaggctggagtgcagtggcgcgatctcggcttaccgcaagctctgcctcccgggttcacgccattgtcctgcctcagcctctccgagtagctgggactacaggcgcccgccaccacgtccggctaattttttgtatttttagtagagacagggtttcaccgtggtctcgaactcctgacctcgtgatctgtccgcctcggcctcccaaagtgctgggattacaagcgtgagccagacctgttctctttattttcttactgaaaaagcctgagttgaagcagttacctacggttactttttcacatggccaatagcaggagaacaagaagctgagaaaaataacataaacgacgtttaatgtcactgataagccatgtccactagcgtgcctttggagtgtcacatgaccaaatgaatgacacagggatttctattctgcttatatttgcagcatagtaaatgtgggaagggagaaaggaattgttagcaaataataacacctgccataatgaagcaagcaacattttataacattcaaattttattcatgattaaatgattaagaaactagaaagggaacattttacatctgataatgtaaaagaaaaagaagaagaatatttactacaaaaattcaataggaaataccatatttggggtgaaatattgaaagctctttctcctacaatctggaataagacaaagatgtttatagtatcaattctgttgagcactgtagaataggtttttaattcttgataataaattaggatatagaagaaaaactaccattcttgcagaaagtatgattgtgtatatagaaaattcaaaagattctaaatgtaagcgatgcacaaatgtaagttattcacaaaaggattgtgcactgaaaactacacaatattattaagataaaatgttatgatctctaaataaattgtagtatatgaaatgtttatggagcagaaaactcaacatttttaaaatgtcaatatagtcacccaaaacccaaacaatgttttattcttgttgaaattgacaaaccaattctaaaatgtatatggaaatgcatttgaccgtgaataagtaagacaatcttgaagaaaataacaaaatttaaacttttagactcttgggtatctatatacttttataaagctttaataaataagaaacagtgacactaacaaaatgttaaacaaatatttcaatttgatggattaaataatatagaaactgacatctttttattgaaaaaatttatttataaaaaatggcactgcaaaatattgggatttaattatatgttcccgtgcaacacagaaaaatacaattccaggttgtttgcaggtctaaaatgtgaaaagtgaaataagtaaattaactaattacttaatacataggcttccagaaaatatagtaagccagcttacatttcttaaactaagtctaaaaaggacaaatcctgatataaatattaatttggtctatatttgtatcagtctgttttcatgctgctgataaagacatacctgatactgggtaatttatacaggaaaaagggtttagtgaacttacagttccactggatgggaaggcctcacaatcattgtgtaaggcaagggggagcaagtcacatcttacacggatggcagcaggcaaagaaagagatccatcagatctcatgagactcattcactatcatgagaacagcatgggaaaaacctgcccccataatccaaccacatcccaccaggttcctcccacaacatgtaggaatcatgggagttaaaattcaaaatgagatttgggaggggacacagccaaaccatatcaatatttatattatcaacaactcttcattaaaagataccattaagagattgaaaattcagggccaggcacagtggttcattcttgtaatcccagcactttgggaggccaaggcaggaggatcatttgaggtcaggagttcgagaccagcctggccaacatggtgaaacccatctctactgtaaatacaaaaattagctgggcgtgggggtgcatgcctgtaatctcagctacttgggaggctgaggcaggagaattgcttgacctcaggacgtggaggttgcagtgagccgatatcatgccactgcactacaacctgggcaacagagtgagacctcatattaaaaaaaaaagagagagagagagattcaaaattcaagcagcagaataggaaattattttaatacttttaatcataaaagggctcatgtgtggaatgtataaatacctcccacaaatcaataacaagcaatgggcaaactaatggaaaaagggcaaaagtcatgagtgagcattttataaaggatatataaaaatcacctttagtaacatcctccctttatgagtcaccaaccagggaaattcaaattatagctaaaatgagatgctattacaccactactagagttactgaattaaaaacaagtactaatgataccagtgtggataagaatatgaagcaactggaattctctacctctcctaccctgcaactaatttgaaaaattttttggctgttatttgctaaagtagaacatatgcgtgctttatgatgcggcaattccattcttagatatatacccagcataaacgtgtttatatgttaaccacaaagcatatgaaatattcattgcagcattactcataatattcaaaaactggaaaaagtcacaagtgtctatcaacactagaaaaaattgctgtacagttattcaccactacactatgcagtattaaaaattaataaactggctggacacggcggcccatgcctataatcccagcactttgggaggctgaggcaggagaattatttgaagcccagagttcaagaccctgctgggaaacatcatgagacccccatctctacaaaaaattaaaaaagcttagccctgagtatggtgatgtgtgcctatagttccagctactcgggaggttgaggtgggaggatggcttgtgatcaggagttcgaggctgcagtgagctatgattacaccattgcactccagcctgtgtgagagagcaagaccctatctctgaaaaatgaaaaatgaaaaataaaaagtaataaataaaaattaaactttgggtaaaatatgaaaaatttttacaaacttgatatcatattaaatgaatcaagcaaaagacatttgatgtatatgatttatatgtgtattaatttcaaacataagcaaataattttaagtcacagaagtctgaatattggttatatgttgggaggagggtaaaggtaatgaatgggtgccgtcaaagaaaagcttctaaggttagttttctatctcttaaatttccgaggtgtttagtttgcaatacttcaagtgtgtccttgggatttttgtttttctacatgaatgctgtatcttaatacagtttatatttgaaaacaatggactaagaaagatagtatcacttgaaaattacaaatatggtactcagtgatgaagcataactttttattttaaagtcaaagacaagccaggggtcatggctcacacctctaatcccagcattttgggaggctgaggagggcagatcgattgagctcaggagttcgagatcagcctgggtaacatggcaaaaccctctctctactaagaatagaaaaaaattagctgggggtagtgacgtgtgtctatcgtcccagctaactgagaggctgaggtgggaggatggtttgagccaagaagcagaggttgcagtaagccgagatcatgccactgtactccagcctgggtggcagagccagaccctgtctcaaaaaatcaatcaatcaattaattaaattaaatgaagtcaaggacaagacagaaggtattctatcacctcctctattcgacattgttttgaatgtcttaggcaacatgattaataaacaaaaagaaataaaactgtagctattagaaaaagatatgactggtcaattcaaagaagttattgctaccactttaaaaagtcaacagaataaactgaataactatgacaactaataaagatgttcagtgaggtatctggaaacaaaatcaacttacagacagtaactttaaagatgactagcaatatctatttagacaattaaatggagaaacccatccacaatagtagcaataagtctaacaaaaaatgagtaaatgtaaagaatttccgtattataaaaacatactggcataataaatgagagtatatttctggatggtaaggtgtgtgattgttatctatttccctaaatataattataatgcaaatgcaatttcaattaaattccctgcaggaatttacagaaaattgacatgcttattctaaaattcattcagaagaaacaaaagagaacatttgccaatgaaactgtcaacaaaaacaataggggggatgaatccaagaagtatcaaaatgttgtacacagttttaataattaaatcatgacatgtcacgaagacagcaaatgaatccgaatacagaatttaaaaacatttagaaaaaaaaatttgttacatcaaaaagtgccatattaaaatcagcaggggaagtattgtatccaatcgtgttaggacaactggctatccatatttaagttatagtaccccttcctactatacatatatatttgtatatatgtttatatgtagatacaaaaatcaattgggtagtttagtaaaaattaaaaattgatacatttttataaatgtacataaacttttaaataacatgggttggagaaacctaagaatagtccagatgccataaagaaaaaggattaatctaaataaattatttaaaagaaattggagaggggtaaatgtaaataccaataagaggtatgaaaaaaaaatccatataatgacaatgaactaaaacccagagtggacaagaatcttccaaataaattaggtaaatgtaataggttggaatatgtgcctccaaatttatgtgttgaaatcttaatctctagtacattagatgtaacttcatttggagatagtttttgcagaggtaataaagttaaaataaggtctctagggcagactctaaaccaatatgactagtgttcttatgtaaagggggaatttagacacagagatacaccgggaaggaagatgctgtggagagacataaggagaagacagccatttgcaagctgatgagagaggcctaagacagatccttctctcacagccctcacaggaaacagccctacaaacaacttgattttggatttctagcctccagaattgtgagacgaaatatctattatttgaggtacccagtcttagttactttgttatggaagccctagaaaactaataagtaactaactcaaaatttaaataggcaaaacatataaacagataattcacagagaaagaaatacaagtggtaatcttatgaaaatataatcaatctctaataaagtaaatacaaattacatcagaaagagggtatcatttttcactcatgccattagcaaattttcttttaagaaaaagggagataagacagtctggtttaggtgaaggtgtgaagaacaccagaagatactaagaaaattataggctagaatagctgataggcaatttaccagcacatattgaaactaacacaaaatatctcatgtgccccataaatacatgtacctactaaatacccacaaaaattaaaaattaaaaaaaaaataaatacaagatatgggcactgaagccagacctcccaccctactccccccaccaaaaaaaattaacatgttgacttttagtgaaatatttacacttttagaaacttatatcacagaagtactcaggaattcttttgtgtccacatatatacactttattaatttttaagagagaaagaaaaaattggaaacaccgtaaattatcagtggtaaaaatatattcaagtacaaccaaaatggatagtaatatatagacatggaaagtgctctaagacatatgaagccagttacagaacctgagtgtaggagggtcacatttacttttcatgtaagcaagagaaaattattagaagatgaacatacactcatttgtaaatggaagaaaatccaataaaatgttagccaatactttcattatggttacttccgcagtgtaatttggtttcctcttacataaggaccttaaatgtttgaatctaaagtagtactgttaattaacaattctgccaacattttcctgataacttgtgcctcttcatggttcccaatgtatttaccagaaaatagagagatttaaattggttctgttttcttcataacattatttgaaaatcaaatatgaaggtgaaatgaaacaatgttgtatattataaaagggaaatgttatttgtaatttaattaaaaataaatatagtaaacaaagtcaacatttatttgcgtaatagagaagaaagaagcaatatacagtaagttcttgaaggacgcaatgaacatttaactgataaactcatagccaaatcagtatattctttcaaatttgtggttaagatattaggctttggagactcactgatacaccactttcttaatagcatgtccttagaagttatttactactcttgtgacttaatttccgtgcctataaaataggtacggatgtgttatgcacgtcatttcatttactcttcagaacaaattcatgagaaaagcactattattaaccctatatataatatgacagcatatataataacctgtcaatacatataatctactattatgaattatggtcacttaagatgattttggagatgtgtttattgttcaggagaaacaaattggggcataaagtaaggttaaaaattggaaggaaataaaaacatgccttgctgtttattatttaactttgccagtgagactgaatggaaatttggggcattaataattgtctgattactggttgactactgttcatcagtgaaattcacaaggccagcgagaatattgtggttcttagcaatgggccattccgatttccttttaatgagaagaatgtgaagagtgctagatacctatatttagcaaatgagaaaaagaaaaaaattgtaatagaagtctattctagatgagatgaacgtattaatcatcactaaggccattaggagatctagttcctttatatttctgcagaatgactataaattcatcatatttcttagtaatagaaattatatatgtatatattttcaattaattacctatcatgggttcaatgctttacacaaattaccctatttaacacatgaaaatgtgggtaagttaactgttacattttacagattctcaactaaagctgagagaatttgagccgttttcccacaattttacaattgaacttgtcgacccatctttcaccaaaaacactgttcttcctgacttccctctcagtgaagggctgtgtccaaaaattgcctaagccagaaacctggcatcattagtaaatagctcccttctacacttattccacaacatacaggcaaaagaattaaacacaaacacacacacacacagttacacatacagatacagtatactattaattccattttgtatgttttgctgaaatcaatccaagtttgcctgcctcccctgcttctgctctagttaggccagcgtaatcttttgtctggactattgcaatggtaactttcttaacagtcacctgttttcctgtttttttccctcctcccattcactcctgagttttcagccagggaaaattttccaaaacataaatctgatcttgccatttactgactaaaacatctcatttactttcatttgttctcaaaataatgcccaaattcccaattatcacttaacagtcttctgaaatgagtagtcatttcacatttcagcagcaaatctcctgctccccagttagaactccaaaccttctgatatttattcactttttgaaaaattcaacatttattttctttagtgtctgtatgagtccgtttcacactgctgataaaggcatacctgagactgggtaatttataaagaaaaagaggtttagtggattccacgtggctggggaggcctcccaatcatggaagaagacgaaaggcatgtcttacatgcagcagggaagacatagatagatgtctatgtctatgtcatagatatctggagtatagctagccctcactgggaaatgaaacttttgttataaaatggggttttcaattttccccttttatatgaaatcatgacaacaaaaccatcttagtaattgaggttttaacttctctagatttcactgaaactgtgagtgttagtgattatgactgatgccaagtggaaccatttggggggctctcatgcctgttctttctgtgttagacaggactatgaagagctagaaaagcagctgaaagaagtctttaaggagcgaagcaccattcttcgtcagctgacaaagacatcaagagaacttgatggaattaaagtcaatcttcaggtgagatgagaactcattttccgagcagtaaaagaggagcagtcatctgattttctgagtggattgacatgcatttttaaatagtttttaatgtgtttctgggcttgaccatggtggttgttacttactattatatgtgccctaaacggaaatgtcatttgaaatatagtctaggaatctgtgtttaacaaatacagaaatgggaaaattgtgttcttggcagagccatcaattcctcaagcttctaagatcagtttgacccctgtgtttttggtattataaaatgacaaattatgatcaagacttaaataaatataggaatgactcctagaagagaattttaaattccccacgggataattcttaagattctttaataaaccacattactgaaataggtaaatgcctttaaaaggcaagtggcatctgtaaaaaacatcttaacatactgaaatctttaaaaaattctacatagggtaaaaatagtttcataaatatttgataatatattgcaatatttgacataaacattgtatttattatatcctgtatgctaaaagctttgtatgtgttacatggtttaattcttgtaatgtatctatgaggtagatcctattgtgacatcccttgttacacatgagagataatgtttaggaaagatatgttatttttgaatgttacaaaagaagccagagtttacatgtagacaatctagctccagacactattagttactgaactgaaccatgtttttaaaccatgtggagtcgcttctgtccacactcttctccttagctttctagtcccattaagatgataataatgataatgatgatgatgatgatggtggtagtggtggtggtggtggtggtggtattagtagccactgaggcttattgaacatggtcaaggtccagtgctagatactctttctacaatttgtatttaattttcacatgaagactgttagtcacatttcataggtgagaaaacagaattagagaaaagttaacaaactaagagtgcacagatagttaagggacagagctggtatttaaagtcaatatctaagctcttcttccagaagatgtgttacatatggagaagatggaaacgagagcaaaaaaaaaaaattatacacaacccagtaggacacagagatggtatcagaatgaaaacagcgcaggaatcatcgtgttatgatggaagcatgcacagagcattagggaaaactcacaaggatgaaaagaagtacagattgatttctagtgaagccaatgcctgagtttgtggttaagtgaaaattcaccaagtgaataagactgggaagaatacaaagaaacctgtaccttctcagaggcatagaacacttgacacattgagaatattgaaagcatatcgtgaaaggcccagatgtgatcagtatttacaatattcccagaatactcagcctttctatgccagtagccaaaggcaagacatcttataacagtctagaaagttgcttgataccaatatacaattttatggagctacatttgctgaaaggataacaatcctaccactaaacataactgcagttcttaaaatgccttttgcttatttttttggctgccattgtgcaaggctgattttgtgacttgtgccaggtcataagaccatgatacactttgaactttaactcctgtgaatgattattttttttacattttaattcttctttttgctttccttgtatttatgtgaagctactgtttcatataaataagattgtttattgattgcttcccaatgataacctcagccagttacagtagggaagaggtttgtcttgtaaagttcatcccacttcattcctgttataatacttatcatactacattaaaattgttgattttcaacattagattaaaaaatgtatgaaggcaggtaccatgactttgcgtaggtctttgcatgattcataatagatatttgttaaataaatattaagtaaacaagtgtttgccctttttgctattgtcagttccctaccagtcacaactattcttttgcaaacaatattcttgcctcttagttttgactttaatgccaagaatgaccggttaccctattaattagtttattgaatataaataagaaagttattagagaaggcttaataggatagattctcttgcaagaaaaagctcaggagacttttctgctgtaattcatagtctctgaattctgaatttgccagagtatataaacactaaggactgaagtagtatacataatttattgttaatattctgtctatagagaccagttacaattttacatggccttgtttttttgtgtgtgtcttaatgtattactcataaataagaaatcaacaaaacctaacaggtgcatgccctttgactattttaatcttgaattgtgttatttcctgacttatgcagggaggtttgctatgttccctaatatttgtagaagctgtgccagacctggtctaacttgcctgcagagaacacagtaaaacttcaaagaatgaatagaagatatgttttttattcacttttaaagagacctagatatttggagagtagtttctcctccatcgaacctctgaaagccaagactgctcaattcctttcagccactgtgtagttgggtgtcataaatttctgtttacatccttggagccgtgaggaccatcatagactcatttttaattcttgttccagggcatatgtgcagtcctatctagtactctagaaccaaagttaaagtgagtctcaatttctcacctgaataaaacttcatttttccacttttcttatcagtccttaaaaaacgatgagcagtctgccaaaactgatgttcagaaacttctggaattaggacagaaacaaaggtaagacttttctttttttcttagttatttctgccatagtgtcaagcaacattcagaaacttcacaaaatttattgattctaaatatatgaacctatttatcttttcacttatacttaaatatgcatgcaattcacttgggaatcttgttcaaatgcagattcttacacaactggggtgggcttgagattccacatttctaagaagctctttggtgatggtggtgctgatgctttttgtctgcaaataacaatttgaatgttagggaggtataatactttcctcagttagtaagatggacccaggtaagtctgaccatcaatagacagatttgataatattgacctaaatggaccatgtttaatacaatccaaacttgatcatggtaataatgatgtggtggtaaagaatggaattatcttactaacaatacaagtagaatcagtacaatattattagtattggtttgcttatttttgagggaagcatattatgaaatatacttgtgtaaattataaaaagccatacgatttttaaattgcttttccaagccaaaaaaagaaaaacaagtattttaatatggaaacaactttacgtctgctatacacttactagcagcccttctagtaggtttgtatatattttcttgtttcatcttcacaactaccttgtgaagtggctattattcccattttgtagatggcaaattgttgctcagagtgcttagtggaattgctgagaatcacgttaattggaatttagatttaaaatctgctctgtcttaccctacagctccaccttaccagtttggctcactgatcacaacgcaaaaaactgtttcaaagtttacacacaagatagcatgtggaatagattctaagtcccttctcatcagcctatatgtcctccattgaccttggttctaaattcaaaactctattattgacatgcatttggattgagccaatgatatctattaaaaaatataaaatcaattgttttacatggactcttattattatttatagtgacatgtttattatttatttaatgtgaaattctctttaaagtctaatattaagaaaaacttgaaaagagcaatccgaacatgtttctgaaacaatattattttaattatttcattggtttgaaataaatcatgctcaatattacaccagtatttgtggctctgtgaagtagtgatagaggacataagcaacattttgaatagcaatagtagaacattattcagtcggaaaatagaaaatcttgtcatttgtgacaacatggatgaacctggaggacgttatgttaaggtaaataagccaggcacagaaagacaaataccacctaatctcactcttattcggaatctaaaaaagttgatataaaagaactggagattagagtggtgattaccagggtcagaggtagctggggagagtgttggtggtgagatgttggctaaagaatattaaatttcagttggtaaagaggaataacttagatgaaattagtacatgatgactatagttaataataaactgtattttttaaaaaaaaattttaaaaaaaccatgaaaagagaccaagagatgctgaaaatgattactttatttttatagagtatctcaggttaggaatggagaataaacaaaaatagaaaaacaaaaattgatttctgcacaatacatgtgcagcacccagtgagagactgaggaagatatagtgagtttgagaagattagaaaataaatctgtatgtaaagacaaaaataaaaatggctaaaagatggcatatactggatttcagtgataataaatagggaatcccttttaggtagctccataagaaataatataattaaagaaatcttttaggggaaatattgtgttatttcctggcttttagggaaattactctgtcaaacccattcagggtagaaagaaaaatgtagaccagggtgagaaaacactacttagagacaaggacagggagatctcaagagttaagacaatggagtaaaagaaaataaagtcagcctttccttactacaggagggacgcggatgaggagacggcttatgcatgatgtgaatgaaaacctattctcttagtttgttgatatttttttaaaatatctatgtctgattcacatgacaccaaaaacaacacaaaaatcaggaaaaaaaaatgtgaataggtgtttaagaattttaatcatcaagtgtacatgtggtaaagtatataaactaccagatgatagaacaagtctttcaaagagagggtaaaatggagaatattttggtcttactaattcatagttttatctaaaattaaaaacttgtttaaaatgcataacttgtattatatacacaatcaaagttagaatggaagactcaataaattataataaaaggtaacttctcaaaaggatataagatgtgatgcattcgttttttgctgtttacctaaaaagagaaatataaaaattgtgtgtatattatggtaaaagagactgtgtgtctcatttcaaaatctgacttattagtaaacattaaaagagaaaaaatatcacctttggttatcaaaaatactgatttattgcaaatttaaacatcttctccgagtttgaaagagtgcagtgtgcttgccattgccatttggtcacatccctggctctcaattattaccttgttttctgtttgtcctcagatccttgtcatctggcttcatctggactagtgatccctagaagccaggcttcttttatgtgactctgaaaccactggtcatagctgatgattcagaggtggccaccgaaacaaaaaccaatcaattagtgtctccctttggaactgtaacgtagaggcaactaataagtctttctgtgtagctggagctaggctgtaagtaaattcaggggctatgctgtggccacatacaactatgtggagagaaagtagagtgtctttctagcaagacaaacagagaaaggagtgtgtttgcatgtatgcacttatgtgagagaaagagtgagaaaatgagagtcatgttggcttgagcgtcacgtttcaggaatatttacacagccttgataatattcataggagattccccaggtgaatggagagattttaaaccataccatgccaggactgagaatatataaccacaacaaggagaataagaaataggacaggaccctgaaatgtctgaaaatttgaaaatgtccttgagcaaaagagaataaaaccttttattctttaaggtggttggttggtagattcccagaaggcagttttggactcggtatactaaagcactttacaataatgttctcgaaaactaaaacaaagcctggaattgtggcaagttcttgatctgtgatgttattaaaatataagctgatagtcactagaaagaaatgcctttttgtagagtgattaaggtgagggtgtttttatagctataatttgggatgaaagaggtgtggaataatggtcctttaaaattctttgtaacacaaaatgttatgctgaaatatttcaatatttgagctatctatcacaggtgtcactcgagccaggaattttttagaattaaagtttcagtttagtaccaaacagagccctagaatagcagatatagattgggcaaatctcagttggtattgggaagtggtgcagaggcaagtcaggaatcatctctataggaggataacttagcaagtctttgaagcagaaatctatagctagctaaagcactagagcagtgagcatgtgaagacataagcctagaaagaaggcagaaggagagatgaagagatatagaagacaaaaagtctactttacctttctgcctgatagtgttctttggcaggaaaatattcagaattctctatcttttccagattttacaatttgttttttgtcctgttccctagattgcctctagatgtcagaatgggggatttttttggaagaaatatatagatagatacctactcccacacatacattatctatctatctatctatctatatttgtaaaaatattcatacatactcattgtcattttaataaaacatactttattatttaatttttaagtgttttatgaccatcttttaaaaataaaaatgagaattttaaattaaaattgcttaaaaatttattattttgtcattttaattataactttattttcagtaggaaatataattttattgtgtttcactcagtgcttgttgaagatttgagtgtttgggataacatgtaggtccttccttccttccttccttccttccttccttccttccttccttccttccttctcagtagagatagtatagtaactctttatagtttgagcatatagacactaaaacacaatttcactacccctctatgcatttgttatctgtcataacatgaagtcatagtttggtgtggggtttacaaaagtgtcttgcacattgtaagcctacaatatatgtaggtatatattatattatactacaaacactctatggaaaatatcagaaataataatggaagcccagattttatatgtccatatatgaagaaagtctgataaatgaaaccagtttgagacagtgatggaagctgtcactcagaatccacttcaagcacattaaaagcatcacccaagaaggcataaatcatttaaaaaccaaagtgactgtaattattctataacttgttctcactatattttgatttgtcaaccaaagtccaaaatgattacaaaaaacagacagactttctttctcattcttgaaattgggacttggacatcagtctcaaggctaattaagctggcagccccattaagtcctgctgggtgaaagagcagcttatggttgtgtagaacatcatggtcagagaatgaacataagggtgtggagagatgtcagtggttattgccatgacctaacatttgttaaggaattctttcataggcattgtgttaagtgctttgcttacgttctgtcgtcttaatatgagcacaaacctataagttagttctaccattgtgcccttgtttttggatgaagaaattgagtatgagagggtgtgtcacttgctcaaatatccagagctaatcttttggcactagattggaagttttaaattagtttaggtgctggtaagactcaaataggtttctattttgttgttgctattgctttgagagaatttctgtagccaggaattgccacacatacaaacacaaacaagtacactagcctttatctaatatctgatctatttgaggtgatagctcgagtaaaaaaaaatcaaggcacagaaagataatatgatgtgttataaataaataaatcctaaatccttaagagaaatgcaaatttagggaaacatcactctttttaaaaagggagacaggatccttatgtgctactgagcttgagacacaatgagtatatatgcataggcatgcatttttaaattatcttcattaaatgagacaggccttaagttaaaataagtttcttttccctgtttttacaaaagatgtcaggccttacaaaggatgtataaagcacaatgctttagaattaattaattaagagcatcagaagggaacagtaattttatcctatcagcaagtctatggtgactttttctaaccagcatgttcataccccagtatgctgttagtgaaattatcttttcaacttgaattatatattgctttgatttaacacatcatgtgcctcacagatgattcaaacgtgggatttttataaagcataatagtaaggttatttaaaaaaaaatcaacttgcttttaatatttgcatgggagagaaagccttttattaccagaatctttagacacatcctgtatgcttaactgtggctttatgcacttctagttgtctatgtcctaaatgtatacagcaaagctccttccttttataatgttcataggaaataatggaattatattattttctcacttatgctctgttttctactaaaatagagaagaaatgaagtctcttcaggaggccctgcaaaatcagcttaaggagacatcagagaaagcagaaaaacaccaggctactgtaagtgtgtttcttctttgtgccttttgcttttgggctgggacattgttactttctttttccaaaatcactatggaacaaacacacctataaaaaataaaagtgaaaagacaataaaagaagcatcagtcaatgtgaacagaatagtacttggtcagctttcattcctggaaaaggttagtgttttatttcattattagggggtcgtctaattcccagcctactttaaagaatgagaaactaaaggacagagtgggacaagagttctggtgtcagggcttcatcagtggctctcacattgtgggacgtcactgactgtgaagtaaattaagctaagtgatagttaagtcgcaccccacatccactgaataaggatctctcaggagcagggccatggaatctatttaatccatcccacgggttattctaatgcatccccaaagttgatgaatcaaactcctctcctgacagcaagaattgtgagaaataaagtatgaaacaaactttctcacccgaaatgatgttcccttgaccccaccgtttcagctcttactacgaatatttaccacaggcaggagggatggtgtttctgagagccatgctgaaaactaggtttctactgtattccccaaagccaccttacgcaccatgtatagggattggaccttatatcttgttttcaagatctgagtctgttttaaaatatagtgtgttaattgaacatatgaggtatggtaaggtcaacagatcaggaaagactcccactgaaaacatagcttatttctcacagttctagctgcacaccacagaggggccacacggggaggcacccaggctgttcatgaggcagagggagaggaggaaactgtgggtaagaggctttgttgtggtttctgaggcaatgaacaagtgaggcaggataagtgggcttgggatcggataaatgggcttgggattggccagtttgagtgatttttggttggctttggggcatagcagctgtcctgacttataacctgtccctaaggtgattagggcaactccacagtggcctgagataataaaaggggggcagttaggagtgttgtttttcgattggttgtttgtatttgaaaagtgtgtctctgggaggaggacttctcacctctgagacgttggagcatcaatgagagagtccagaactaaggcagggtggctcaagcatatgattgggttgttcagagcaaggctgatccagcacatccatgaagaacaaatgttaaagcatcagatttacagaagctaaaaccgtggtgaagcctaaatctccatttaggtcaattacctggaatcctaggctctctaaacacagtcagcctgcctttcttttacaaaacttcctttaacaaccttgattaaaatgtggagttttgcttctgaaactcagtccagtctgtcatctgcaacagctgatttcaggaacagcctttccaacaatgattgttgacttttcaaagtacaaaactgtttcatgtaaggattcactgttatctgttctgttcacctgttaggacgggcatgtgggttcattgctatgccacggcaactctcactgctcacctgaaatgtggcctaaagtctggctcactggataccaaatgttacataaaagaatagacatatttttagtatcagcttgtcgatccctcctcccaacaccggacctagcttactgaatggtcctaattgcaatcacatttctgccgtgactaatcatatttaatctgagtttcttcatagcctaatgacaaacaatggtagagcagaatagaagtgctcacacagactattttctctggttctcataataaaactacattgtttgtttctttactgaaaaagagtaattcaaataacgtgtttctagcttgtatttgcacagctataagctaaggcatgaactcataattattccagtagattatgcaaactgtctgagatccgaaaagaagagagttataacttttgaaagagcacaaaccaaagttagaatatccaagtatgacaaatgtcatggacaaataatgtagactgagtcacctttgccttcatctcagcgtgctggcagtgccttccttatggctgaacactggatcttgagggaagctttctctttccccccaaaattcttcactaaaccagaaacttcctaaagaaactcataacttaatatgtgcttcagagtaagagtgtttgggatttaaatttctagtaggccatgtactaattctgtaaatttactagctcattaccagacttgatcaagctttttaacttctgcaagtttcctcattatcacatttaaggggttattcacattaaattaatgtacataatctctctaaaattatatctggcatgtagttgatagtagacattaaactaaagtcattccccttccttctgcacttcccattttaatttcatcttcatccgttagctgaatgaatataagcaagtcatttgatttctctgaggctttttcattgtaagaagtatgtcaatggtactaatgtaacaggttatttggtggttatatgagatgatgcatgcactgttgagcagaagatgtaatcaattataagcaacttctaagttgtatcacataatcatcatcattattagtattttttcttcctaaccatttaaaacctttgttatatgataatattgtggtaagaattatcagcgatgacagaatgcatacctaataaaaggactattaaaataatatattcaattgttcatactttaggatgttctatttcctcaactctatttacattactattcaaaataattttgttttgcaatttctgcatactgctgcatagattttcaatggctattcttaaaagccagcattgaaatgtttgagagtgacctcgggttctcagagacttacaaatggtgtctttatgggaatcagacatattacctgtctgtcagtgatcaggggcaacacagtgatatttttactgttattaaaaactactagatggtgaggtttttcaccaaaggcttgcattttcttaaatgcagactatttcttttttatttggtattcctgttaatttctttttttattttccataggtcattagggtacaggtggtatttggttacatgaggaaattctttagtgatttgtgagattttggtgcacccatcagccaagcagtatacactgcatcctatttgtagtcttttataccttgccccccagtcacactttcccccaagtccccaaagtccattgtatcattcttataactttgcgtcctcatagcttagctcccacatatcagtgagaacatacagtgtttcgttttccattcctgagttacttcacttagaataatagtctccaatctcatccaggtcactgcaaatgctgttaatttgttcctttttgtggctgagttgtattccattatatatatatggttaatatatatattatggttaattataattatagatatatatttatatatatttataaatataaatatataaatgtatatatatttataaatatatatttatatacatatatatttctatataatatatacatttatatattatatataaatatatacatttatatattatatataaatatatacatttatatattatatataaatgtatatattatatataaatataattatatattttatatataaatacataaaaataaatataattatatatatatatatatatcaccatttctttatccacttgttgattgatgggcatttgggttggttccacaattttgcaattgcgaattgtgcactataaatataagtgtacaagtatctttttcatataatgactaattttcctctgggtagatacccagtagtgggattgatggatctaatggtagttctacttttacttatttaaggaatcaccacactgttttccacagtggctgtactagcttacattcccaccagcagtgcgaaagtgttccctgatcactgcatttatgccaacatctacagtttatcgattttttgattatggccattcttgcaggagtaaggtggtattgcattttgattttgatttgcatttccctgatcattaatgatattgagcattttttcatatgtttatttgcaatttgtatatcttcttttgagaattatctattcatgtccttagcccactttttgatgggattctttttaactgatttgtttgagtttgttgtagattctggatattagtcctttgtcagatgtatagattatgaagattttcttccaatctgtgtgttgtctgtttactctgctgactgttccttttgctgtgcaaaagctctttagtctaattaagtcccaactatttatctttgtttttattgcgtttgcttttgggttctttgttatgagagccttgcctaagccaatgtcaagaacggtttttccaatgttatccactagaaattttatagtttcaggtcttagatataagtccttaatctatcttgagttgatttttgtataaggtgagagatgaagattatttcattctcctatatgtggctagccaattatcccagcaccatttgttgaaaagggtgtcctttccccactttatatttttgtttgctttgtcaaagatcagttggctgttaagtattagggtttatttctgggttcactatgatttccattggtctatatgcctatttgtataccaatactatgctgtttttgtgactatgggcttatagtttgaaatcaggtagtgcagaacctcctgatttgttctttttgctcagtcttgctttggctatgagggctcttttttgtttccatataaattttagaattgtttttttctaattctgagaagaatgatggtggtattttaatggggattgtgttgaatttatagattgctttgggcagtatggccgttttcacaatattgattctacccatccatgagcatgagatatgtttccatttgtttgtgtcatctgtgatttctttcagcagtgttttgtagttttccttgtagaagccttttgcctccttggttaggtatattcctaagtattttactttttttgcagctattataaaaggggttgaatccttgatttgattctccacttggtcgctgttggtgtagagaagagctacagatttgtgtacagtaatcttctatccagaaactttactgaattcttttatcagttctaggagcttttcagaggagtctttagggttttcaaggtaaatgataatatcatcagcaaacaatgacagtttgacttcctctttaccaatttggatgccatttatttctttctcttttctgattgctctggataggacttccaacactatgttgaagaggagtggtaaaagtgaaccatctttgtcttgttccagttctcagagggaatgctttcaacttttccccatttagtattatgtcagctgtgggtttgtcatagatgccttttattacattgaggtatgtcccttgtatgctgattttgctgaaggttttaatcataaagggacgctgggttttggagaatgcttgttctgatgagcattcaacagagaatgcatcatctgttgagacgatcatggaatttttgtttttaattctgtttatgtggtgtatcccatgtattgacttgtgtatgttatactatccctgcatccctggtataaaacccacttgatcatggtagattatctttttgatatgttggattcagttagttcgtattttgttaaggattttagtgtctatgttcatgaaggatattggtctgtagttttatttttggctatgtcccttcctggttttggtaatagggtgatgctggcttcatagaataaattagggagggttccctctttttctatcttgtggcatagtgccaaaaggattgttaccaattcttctttgaatatctggtggaattctgctgtgaatccatctggtcctagacttttttgttagtaattttttaattaccatttcaatcttgctgtttgttattggtctgtttgtggtttctagttcttcctgatttaagctaggagggtggtatttttccaggaatttatccatctcttctaggtttcctagtttatgtgcataaaggtgttcatagtagccttgagtgatcttttgtatttcagtggtgtcagttgtaatatctcctgtttcatttcttagtgaggttgtttgggttttctctcttcttttcttggttaatcgtgctaatattctatcaattttatttatcttttctaagaaccagctttttgtttatcttttgtattggttgttttttgtttcaatttcacttagtcctgctctgatcttggttatttccttttttcttctgggtttgggtttggtttgttcttgtttctctagttccttgaggtgtgaccttagagtgtcagtttgtgctctttcagtctttctgatgtaggcatttagggctatgaactttcctcatagcaccacctttcccgtatcccagaggttttgataggttgtgtcattattgtcgttcagtttgaagatttttaaaatttccatcttgatttcattcttgtcccagtgctcattcaggagcaggttatttaatttccatgtatttgcatggttttgaaggtttcttttggagttgatttccagtttttttccactgtggtctgagagagtgtttgatataatttcaatttgtttaaacttattgagacttgttttatggcctgtcatatggtctatcttggagaaagttgcatgcgctgttgaatagaatgtatattctggggttgttggatgaaacgttctgtatatatctgttaagtccatttgttccaaggtatagtttaaattcattgtttctttgttgacgttctgtcttgacctttctagtactgtcagtggagtattgaagtcccccactattattgtgttgctgtttttctcgtttgttaggtctatcggtaattattttataaatttaggaactccagtgttaggtgtatatatgtttaggattgtgatattttcttgttggacaaggccttttaccattatataatgtcccactttgtctcttttaaccactgttgctttaaagtttgttttgtcttatataagaatagctacccctgcttgcttttcgtgtccattttcatgaattgccctttctaccactttactttaagtttatatgagttcttatgttttgggtgagtctcctgaaggcagcagatggtcaattggttggcaagctttttgttgttgttgtttgatttgttttgttttgttttgttttgagatggagtcttgctctgtcacccaggctgaagtgcagtggcacaatcttggctcactgcaacctccacctcctgggttcaagcgattttcctatctcagcctcctgagtagctaggattacaggcacaagtcaccacacccggctaatttttgtatttttagtagagatggggtttcgccatgttggccaggatggtcttgaactcctgacctcaggtgatccaccagcctcggcttcccaaaatgctggaattacaggcatgagctactgtgcccagtcagttcttatccattctgcagttcggtatcttttaagtggagcatttaggccatttaccatcaatgttcgtactgagatgtgaggtaccatttcaatcgttgtgctgttatgtacttggtgttttttgttttaagtttttgctttttaaattgtatttttgttttataggtcctgtgtgatttatgctttaaagaggttctgttttgatgtttccaggatttgtttcaagatttagcattccttttagcagttcttgtagtggtggcttggtagtggcgaattcactcagcatttgtttgtccagaaaagactgcatctttccttcatatatgatgcttactttcactggatacaaaattcttagctggtaattgttttgtttgagaaagctgaagatagggccccaatccttctagcttgtagggtttctgctgagaaatctgctgttaaagtaataggttttcctttataggtttcctggtgcttttgtctcacagttcttaagattccttccttcatcttaactttagataacctgatgacaatgtgtgtagtcgatgatctttttgtgatgaatttccctgtgttctttgtgcttcttgtatttgaatgtctagttctctagcaaggctatggaagttttcttcaattattcccccaaataggttttccaaacttttagatttatcttctttcacaggaacactgatttttcttaggtttggttgctcagcataatcccagacttcttggaggcttagttcatattttcttattctttttttctttgtctttgttggattgagttaattggaagaccttgtctttgaactctggatttctttcttctacgggttcaattctattgtgagactttccagagcatttgcatttctataagtatgtccaatgtttcctgaagttttgattgttttttctttggctatctatttccttgaatatttctcccttcacttcttgtatcactttttgaatttccttgcactgggctttgcctttctctggtgcctccctgattaggttaataactaaccgcctgaattctttttcaggtaaatcagggatgtcttcttggatccattgctggtgagctagtgtgattttttgggggtgttaaagagccttgctttgtcatattaccagtgttggtcttctggttccttctcatttgttaggctctgtcatagaaaaggtccagggctgaaagctgttgttcagattcttttgtcccatggggtattcccttgatgtggtacttttctcgttttcctgtggatgttcattcctgtgagcctagctgcagtgattgtgatctctcttctgggtctagccacccagcaagtctacctagctctgggccagtactgggggctgacttcacagagtcttatgatgtgagccatctatgggcctctcagctgtggataccagcacctgttctggtggaggtggcagttgggggtgaatgcactctgtgagggttcttagctctggtggtttcatgttctatttttgtactggttggcctcctgccagcacgaggccctttccagagagcatcagctgtggtagtatggagacaaaccaacagtgagcagggtcctaaaactcccaagagtatatgccctttgtcttccactaccaggctaccagggtgcatagggaaggaccatcaggttgctgcagggctaggcatgtctgagctcagactctccttgggtgggtcttgctgtggctgttgtgggggatggggatgaggttcccaggtgactggagttgtgtacctaggaggattatggctacctctgctgagtcatgcaggttgttgggtaagtggagaaaagccagtagtcacaggcctcgcccagcttccacgcaatctgaagggctggtctcactcccaccgtgtcccctctaacagccctaagtctatttccaggtggtaggtgagcagagcttaagaacttaccccaggctacccaccttccagctttgaaagaaaagggctttgttcttccccttcctgtggagtctgcaagctggatttgtacccttcccccagttctaaccaggaggcttcttatccaattctaattattacagagttcaactggagacttcctacttcctgtggtgtttcccctgacacccctcctgaaggttctctgtgatgccaggcaggaatggcctgcttggggacgcagtgagctcccagggcctttcccactgctttctctacccctatattttgctcagctctctaaattgactcagctccaggtaaggttggaaacctttcctgcaaactgctccttcagtttccacagtcagggtgtgtgttcaggagccgagggtctccctttcccaattccacggtttgggtactcacagtatttggggtgtctcctgggttctgcgggagcagtttgcttcctttagagggtgtgtctattcttgttaacttccttttttttttttttgagacagagtcttgctctgtggtcaggctggagtgcagtggcacgatctcagctccctgcaacctccaccacccaggttcaaacgattctcctgcctcagcctccctagtaactgggactactggcgcgtgccaccacacccagctaattttgtattttcagaagagagggggtttcaccatgttggccgggatggtcttgatctcttgacctcatgatctgccccccttggcctcccaatgtgctgggattataggtatgagccactgcacccagctgacttcaaaaaataatttaaaaatcacatatcagtatatatttatgtatgtaggtatctataaatatacacacatacacatacgtaagggaatatttgtgtgtgattttgcgtgaggaaaatgagagaggaaaagaagagtaatatatttcaacaaaagagtcttctttatccattatgctttttagaaaattaaaacattttaaaaattacatataatttgtaacccttcaattagaaatggaaatcttgatatagatagttgatataaagtaataccagagggcatatctcactcctttcttgacgttaacaaatgtacatagccatacccccttctaaggatgtagttagaaaatgtatgtattactatagaaacagcttacagtagaggccaaaatttccaagtaaccaacttcaaagggaatcggacctgggctggcacaaagtgcaaatcagaagagaccactttggtggtctttggtctttgccataagaagataaaaaaggagatgagagaatggagaatgaagagcagaagtgagtacatttaaacagctttaaagtcaaaagccttgttttcccactaggagcctcttctggttatttggttatacgcccctgtgatggctaatattaggtgacaacttgatcggattgaaggatacgtagatagctggtttaagtattgtttctgggtgtgtctgtgagggtgttgacagaggagactgccattttagtctgtggactgggggagaaagacctaccctcaatgtaggcggcaccatccaatgagctgtcagcacagctggaccaaagcaggcagaagaaggtaggataagctggtttacagatacctacatatacagatatagactgataagtgatttcaaaattatttttagaagttaataggaatagacagacccttgagtcttctaactttcacctcctcctgggctggatgcctcctcccatttctcctgcccttggacatcagactccaggttctttggcctttggattcttggacttataccagtggtttgccaggggctctcaggccatcagccacagactgaaggctgcactgtcagcttcccagcttttgaggcttttggattccgactgagccgctactgcttctctcttccccagctttcagatggcctatcatgggacttcgccttgtgatcctgtaagccaattctccctaataaactccctttcatatatacatgtatcctgttagttctgtccctctggagaaccctaatacagtcccttaaaagaattatctacttggaatcttctagaccaagaggctgataaaaactttatctgacttgtcagaatactctggatgttattcagaacctggggaagtgaacatcagaactagaaaatagattgttatccctttcttacccagatgaatgcccactcttttacttaatactggggcatttaatgagacttttcttaaagactccacagagatctctcaggtctccatcttgacttccacagacttagtgtcttcctaggaggacctttgtatatggtgcagtaacacaggcatccctatgaatactgcatcatttgcattatacttgcctctttatatcttccaataggggaaagaaagaagaatgaacacaatttttaaaatctgttgtagaagcaaggttttttgaccatagtatatcttcatattgtaaaacacagctgatgttaaacaaattaagaatatagaatcatcattataattactcaaatattctaccagttggtaacttataataatgtattcaaaaaccaatatgaagacaaaatattaaataggctcactttggagtcattcctcaagaagggtatttaaataaactgtatattcagttgtttggcaactttttttatgagtagaagttaaaaatatccctcaactttctcttctctctacttaagtcttccatgcctactagaaccattattgtagaaatgcattttaatcacatccagtacaatatacacatacatgtataaatatattaatgtttccatatactgtcaaccaagaaaaagataagtgacatatactaatcttgtgcatgatatatattcatactttctactctaatcctctaatctatttttaaatgatattcttgactttctacacttttataatcaaaatatatggaaagtggccatgtccgatgctgtgattttaccagaaacttacagcttatcattcattccaagaatacttattaatcctcattaagaactagaaaatatggaataaaccattttctttttgactcatcatcatcagaatcattcattaaatgcatatttatattgttactaccaagatgagaaactgatgccattgctaactcattcccccaaatgataactgctaaaaaatcatagcagttaaaggaaaatatgaactgaagtattaaaaaagaagcatgcgaaaaacccaacaaacgaaataatgagtgattcctggaaagaaagatgactcacagaaatgaatatatatgtctttggaagagatcgttgtgattagttgagtcagggggccgcagtaggaggcatgcaagagtaggctgaaggtcatctgtagattctgctctccttttctgcactcttccttgagagtatcaccttctgtcccttccccttagaaatcaatggcaacagctcaggcctctcctgtcatcaaggtaacatcagtgcagtacaaaagccctgctagaatgagaagtaatgggagtgaggaagggtggagtcgtagtacccaccccatctcccttagatcccctaagagcattctatgctttcaaagttttctatcctgggtttttcattttctccccaggacagcagccatcattggcccttttcctgtacccattgccacacagagcaattgaaaattaaaaaaaaaaaaaaaaatcagataagggctaaaatgacaagatatttgagtacagagctactaaaaagaaacactacacattgcactacatacgcattctgaagcagaattactggagtagataaactaacaatttagttaagcatgttaaatatacccaaggagttaacctatacagtaataacacatagaaaaacaaaacaaaaaatcataaaaaaactacttgataatgttaactgtagacaatagccagtagttaataggtaaaataaagaatacactaaacggtgtaagtataagaaagaaaatagtaataatgacaaatttatagaaagcatcagggaacgacaaaatactgagatagaaaatataaaatatgcattaaaagctatggagaatcagagtaaaattgccaagtatctgagtcacaaaataaaagcacacatataaataaatagaaactttatcgtgccatcgtgaaattttaaaatatcaaaataaaagatacaattacaaaattttccaagggaaagaacaggtcacccacaaaagggcaataatcagatagatatcagacttcttaagattgttaatgaatttaagaagacaataaagcaatgttttagtacactgcttctacattgttctatacatataaactggcattcaaatgttaaagcacgtaaagcatggaagtgttgccagagaaagctccattttgaaaatccttttggaggaaatactgtactcaaaaacagaataaacagcagactgcaagtgatatgaggattaatagtgaacaaataccttggccaatttagtttttcctttaggaaacagagccgaagaggggaaaatatgattggagtgaggcagtgcaacaaggggacatatagtacataaccaagactattataaattttctatattttaacttagaagcaattatggtgagaacaaaattagaatgtgtaatattgaaactcaatgcagaaaaacttgatttactctgttaaaaaaataagatggaaaaaattaaattaattcctataatggaaaggaaaaaaggcaaaaaattcaagatggccaaagttccaatgtattagaaatcatgagaaattaaaatgggttaaatttaataatttaatttttaaaatgagacagaataactaaaattaaaagaataggaaaatatatacaaatgttctaagtttaaaaattgaaaatattgcatatgtaacataagcaagataggaaaatacagacaaaagaatataaagaaaagaattggcaacaacattaatgtctgccacataaaatttaagaaacagatataataagggaagacactatatactcgcaaacaaaataaaataaagtaaaaccattataaataagtatatacctaacaatgtagcttcagtattcatcaagctatatgtcatagaacatgaacataagcagatacatagaatatcttaaaaatacaattgataattttattttattttacatccaccagtttgttataaaagagataatgaaggatacagaggaagagatgactaaggcgagaaataggggaaggggcaagaagcttccatgcgctcgctggacatgccacccttcagtaatttctagtgttcatccatgtaggaacccagtcctaggtttttatggaagcttcattacttcagctttatgtcccccagggtatagggcaagattctctttagaatgagagttttatgatccacaaacagaaaggcagggaaagattagagtcctatttagtatgagttattaaaattgcttgaggggcagatgtacacgccttctgttttacagtactaggtagatgaatttcccaatcagatacaacgctcattcccataatacaatcagataaaagtgaccaaactgcttcacatgaggtgtgttcaaatatatcaacttttataatcctatccatttttacatttttaagttcttgtcccaggaacttctcttcttctcttgcagactattttaccctctcttgtgcgaaagactttgggccctcagccagagattaagccaagggaccctggcctttctgtcaatctttatcttcattaatcagtatagccattaccccagacaatgccacggatgggtttctcattgtaatcttttaaaatattctgactttttaaatttattcagactggggaaaatagagcaaactggtttggggccctttagtattgggggaccagccaagtctccctttgatctactcagcctttgatagtgttgtatttagacttttgttttaaccccattaatttccattttattcatttaatattttaataaccatctaaagatttccaccttgtgagatgaatcccatgactctctcttctctttttctttgtagtttcacctcatcagtgttttttgtttgtttgtttttcttaattttttgtagagatgaggtttcactatgttgcccagactggtcttgaactcctggcctcaagcaatccttctaccttggccagccaaagtcctaggattacagttgtgagccatcatgctctgccagtgttttctttattcatcttatttgttaattatttaaaatttttcacctttctgggatgagttctttcactctcctcactacccttcactgttctctggttaatttacctgatgttttattagcatctgtagtgacccatgaggagaagttgagacaacaaatttgataaggcttctctgactgtctctgttttgtatcaacagggttacatgaggtgttcatgaaaatggggctcccctaaccacagcacttaccataacctgagtaacaggcatatttagccagtgaatgtccctgacatcataaaagcaatcccatttggcttgcatatgaagcatatcaactgcttcatctggggtgctccacttggcatttataggtggagtctgacagtcccacttcagaactttacagtggcttttatccaccccaccagactggccatttcttcaggaataaattcctatgatatatacacatctgcaattactcagtagtgagctgtaggtcctgcatcaatgcaaacatgttcttctactctgcatcatttaaaaccaaagacactggctgggcttggtggctcacatctgtaatcccagcattttgcgggggcgaggtgggtggatcgcctgaggtcaggagttcaagaccagcccgaccaacatggtgaaaccccgtctctactaaaaatacaaaatttagctgggcatagtggcggggcttgtaatcccagctactcgggagactgaggcagaagaatcacttgaacctgggaggtggaggttgcagtgagccaagatcatgccattgcactccagtctgggtgacaagagcaaaactctgtctaaaaaacagaaaaaaaaaacacacacacacattagtcgcaaattatttactttcactatccattttagtaaaggtacctcagagagctgataataccaatgtacaaagtgaacaatttcttcgcacttcgcattctgctaagttttagtagttacttgtttttgcccttctcccacattgaccacctttttggtgaccaaaggtcttagaagtgctttctgttttcctgacataattttcccctttgcgggtggctttgaggctagtggcctgagctcagacagactcacatctgagcttggtttcccctaaaggcctgactcagcactctatttaaattctattttagctattatagataaaaataaccaaggattcgaacatgttgcttttctcttattagtttcataaaccaaaaatgaaattctaagcctccggatggattgaatggactcccctctcagccaacgggattccaaagaaacctgaaaaactagttcaggaaggggatgacagacatgcctcattacactctttcttttggattttagacacaactgactaacattaacattaaaactgagatcttaagactgacaaaacagactctttgtagcaattaagaagcaacattccaacctgactttagtgtaacatcgcatgacaaataaagaaggaaatcaaattattttacctcaaaatatgttttcttaccatattttgaaatggctctttttatctgtaaagagtctttattaatgtaactcaatctttccccttccaagccctccaatcctgaagacattaactgcgagcctggcacattttaaggcctgataagagacgtttgccatctattctctgtagagtcagcttctgtggcggcttcatctatataataacaaccttggctttcaccaccccccttatgttaaccccaagcatttctttctgctggcttcaactgtaggcaaagcttaactgttttaatcaattacctatgacctgaaagccacatcttctcccacctttgagatatcttacattttcagaccgaaccaatgtgtacctcacatgtattgatacactgattaattccacatgtcttcctaaaatgtataaaagcaagctgtaacctaaccaccttacacacatgttctcaggatctcctgagactgtgtcaagaacgattgtcctcacaattgtcttcaaataaatcttttcaaatattttacgaagtttggcttttgtcatcaacagtttgcatttccctgtgcatccatatctaaattccactgatagcttttaccttgagtaaccaaatgcagcataactgcagctctataccatgggggaccatgtggccacccaggaatcaaaggttcttcaccccctgctcttttattatttctctttccgagctgtgtttccctgagcctaagcagtgctagcaaatctcattcccttgacacaaattgttttgggaaaaactgtcaaaccatgtttttcttctgctcccataccacaacaattaacacagaagacttctgtgaccaaatgtatggggatttgttctactaagaagtagcagacaccagctgagtctcctccaatttaattctgacactacttagctggagatagtgtcagatcccacaggttgaaggctcagtcactaagattgcttcccctgctcagacaccagtctcaagtcatggcctatagaacttctgacccaccagtttcaagctgaggttcccataaccacctgctttgttttgattagttttctggagtgccttacagaactcgaggaaacatctacatttactagtttattataaaggcaattaaaaagtatacgaagagatagataagacaagttatggggaaggggcatggggcttccatgccatccctgggcatgtggcccaccaggaacatctgcgtgcttagctcaggagggcctgagaacatgtgtttgtgtgtatatcatgaagctctacaattgataattttaaactattagtatatagtaagaaatcaccgacaaactgcctatatttctttaccacacccagtagatttacagaaatgatatacaaataaaatatgtattgaaacataaatgaagttctataaattcaaaaatattagtagcacatatgttattaaactctattttaataaaagtaaaaataatttttataagaggtcaaataatttcttgtttaaaaatatgttctaataaccattggattagtgagaaatgatcaaacacattgtcatacttggcacttaataataatgaaaatcatacatgtcaaagtaatacttactggataatgaatagctttaaatacattttcagttaaatgaaagatagatgacattaattcaagaagttggttaaaaagcagaagctcaaactcaatgtactaacgaaagagaattataaagactagacaaaaaacaataaactatgaaagaaacaaaaatcccctaaatccttagttctttgaaaagattatgctaaagaaaaaaggttatgataaaaattgaataagaataaaagactcaaatgttaaaatgtcaaatgtcaaataaaaaagagaaaaaggccatattcacaatttgaagtatgatcagcaactttcaactaattaattttaaattgtaaacaaaagtcctaggtcatattaatataaaattccaaaatttctgcaattagaaatataatacttgaatagaccaatgcatttggaatttcattgtactaaaaggcatctatttccccaaattctgaagaaggattttaatgatgacttttacctaattttcaatgaccaattaattcctaataaatgcaagtattttgtggaaaataaataactctcatctcgttatgtgagcatatgcatttattattgcaaatcaattcataacaatatgactaaataaacttataggcatatttcattaatgaatgtagatgtaaaaattctgaataaacaaatctaagagtatattaacaaaatacacatcatgatcaatgaaggcaaacatgtcttatctcttcaggaaaatgtgttctatgttttgaattgaaagagtgatatgttctaactcagaaaccataaagagatgacagaatctttaactaatgtgggaatgacttgcgtgtgtgtgtgtgtgtgtgtgtgtacatgtgcttgtgtgtatatcatgaatattttattttataatgtgcatctggttgatggtggaatctagggaaagattaatatcactgggatcaacacttaaaaattttggtaaagattcaaataaaatcctttgtagtttttctccctatttgaagattctaggttaaataaggattaaattaacacatatttataacttttttattgtataaatcatccactaattattttcactgaaaggaagactatagttgtaattgaagtttggataagtaagggagattaagatcactgatgctctctctcaaattggggcaaattttggatttgattagagaaatattgtgctattttagatttaagagcagataatcttatgtattgtccttgactaaacatcaaattactatggatttttttctatcaagataagagattgtttgtttatgcacatatggtgcaaatgctcacatttggtaagtctatagtaaaatgctatgaaacattgatttatttatcattttttcattgattgaaaaaagatgatcttcctcattgaatttaaaaaatatgaaaaaagatgtatatctgaaaaaataaattaaaaaacagtgtatctttcttgatctaattctgtttaaaaatactctttatggaaatagaaacatttatgtttattcctaagcaaataatgaaatggtaaatatttcaaacctgtgaccctaatggaaaaccctaacagacagcagtgaagaatgggctctcaggtgtgaccaggataattaaagattttaatgattattgaatgcatttccctactcttgttaatttttatggcttaacttgtcctgagacataattagtctaaagcaagagttttagcttcaagctttgaatctcattaaaaataaagaattgttatgttctttcaatcttattcagggtaaatacaatgtattttctgtttctgagaattattgtataactatcaataggaatgcttattctttcatgggtgttaaaaatctgttgggattctaaatccatggcctaaaatgctaatatatttttaatgttcaaaatatattttatgtcttgaatatttaagtattgcattctcaagtttttctgtccttgtttaacatttaataattatagtcttgacatggtaatgtattttcattatactttaattaaagttaattgttaagtatgaacaatgcgtgcagtatccatatatggggatttgggggaaataatggtatcagtgaaagaacaggttattaatataagtaatatggctttaagtagttcgtgacataactaaagacaaatctgtacaaagcaaaattttctggagctaataaaatgcttgtgtagaaaagaatgtaaaagctgttttttgggggatgcactgttactctgcatacgtgtttaattttgaatggggttaggttctacttggtgtaaatcaaaaagtatctgagacagatctcaatcaatttcaaagcttatttcaccaaggttaaggacatgtcagtgacaaagcctcatgagggtctgagaacaagtgcccctggtggtcgggctacagcttggttttatatgttttagggagacagaagacatcagtgaatacatgtaagatgtacattggtttggtccagaaaggcaggacaacttgaagtggtggggagccagtagggtggcagaatgtccagcttccaggtcatagttgatttcaaagattttgtgatcggcaattggcaaagatattctgattggcaattggttatctaagagttagaatcaatagtagggagtgtctgggttaagataagtggttgtgttatggagaccagggtttttattatgcagataaagcctccaggtagcaggcttcagagcaaatagattatcttaaggtctccgttttaatgttaaattcccatcatggcctgaacttgtgtttcaggttaactttggaatgtcgttggctgagtggaggagtccattcagttgattaggaggacttagagttttacttttgggttacagtggtgataccttggtttttctatcaacttgaactatctacctaatggacaatgaggactagtgttttggggttactgtcaatattttcaaaattcaagattactttgaaaattaatatggctaaaacactagacatgttaattctcaagcttctctttctgtattatgtgttcttttgccataaaaagtgtttggtttgggttttctgtaacaactgaggaaatggtaatgtctggaaacttatacaggcctgaaagaaaaaagtgttaacaggtgttgtaaaacttctgatggattttatggaaagccaagcccaggagtcagatgtgatgaggctgttaggtggtactggaactattgcagctcttgaagatgtcagaaagaggaatccatggattttcattcttatagtcctctagataaatgactcagctggctttccattgactgtttctatttctgtaacaactgacttcctctgcatattacttatgcaacacttgacttaacacagtcttaataataccttatgacatccttaacctatctcagctgagaactagccagttttctctagaggttcccagttcaaatctcccaaggaaaatccaatagcctagattttattttagagtcagaattatttagttattctttaccctggactttccacatcctgtgtattaatctgttcttgcattgttataaagaaatacctgagactgggtaatttataaagaaaaaaggtttaattggctcaggttccacaggctatacaggaagcatagctggggaggtctcagggagcttttactcatggcagaaggcaaagctggagtaggcagcttcacatgggcagaacaggaggaagacagagaagggggagagatgctacatacttttaaacaatcatatctcataataactctattataaaaacagcagtaggatggtgctaaaccattagaaaccacccctatgatccaatcacctgccaccaggtcctagctccagtgttaaggattaaggattacatttcaacatgagattagggtgggaacacagacccaagacacatcatccagtaactgggaaatgatgataatgggaaaaatcattcaaaggatgattgctaatgccagagctgtatccaggctgtgggccactcacctctgggctccaggctgcagacacctatatactgctctatgagagaaaaatctatctcatttaaaccactgtatttagggatatgtcagttacagtgcctcgttcttcaccttgattaatttagtaattgtttactttcaactgtggttactaccataacaaattcactagctacaataaattaactggtattacataaaataaatacaaataaatctcataaagttgattttctcataatttaggcaaactttaacataaagtaatagtatttatttttcataagcgcatacacaataaataaaatgtataaaaatatgcatgagacaaatatgtaagttcagtatagtggttacctgggggggtgggggtgaagaaaggaatagaagttagctgaaactttaataataaataatgataaataataatatattacttataaaagggtctgaagaaaattggacaaaacattcatatctggttaatgtgtagggttagcccacaggcattttacgtattcttgttcttttcttcatgtttgaaatgtttcagaactaaatattttttaaagttgtgtatatggtaaaaattaaccttcttcctaaatttagcttccaacccaatgactcagtctatcttcagagatcacctggatcgtgagtctcttttatcatttcaggaaacttctaagaatacattgttcaatgcatgaggctattgagcattagaaatatgactaatccaaactgagatgtactgtaagtgtaaaacacacattggaatctaaaggcatataacacaaaaagaatgtaaattatgtcatgaataatccatgtccaaataatattttgaatatatcaaattaagtgtattagaaaaattaaattcacctgtgtcattactttattaaaaatgtgactacaagaaaattgaaaattggataaattaaatgtttcatccactgtcatagttattttcttattatagggaaccctcagtgactataaagtctcagtgactagtgtactctcagggattataaagattataaattctataaaaagtcttgaccacttactatactaccattttttacaaagcactcgggcaggtaatgctatttttaggaaatacggttccaataagtggcataaggtgacagatcctgatgatatcttgttcagaaggaaacatcatggtgtcttcggtagactattcttaatgtcccgtagttttgaggtaagggatattattatgtaattgctctgacacttggcgacaggtcataattacctggagtgttttagaaatagagattcctaggttcaactctagaatctattttttctttttttaaagaaccacatttttaaaaggaaatgaagtttatccaggcaagagaatcacagtcataaagtgtagggtttctcaatttaaaaaaaaaataataaatagtttgttaaatgaaaaaagatattttaatataatcaatgaatatatgtgtgaatttagtaatgaaggttttgattaaggaacagtgtaattctttgttctttttcaatatttgttaataaataatttattatttctcaaaataatgaaaaaaataatgaaagccatggtaatgagtttggaatgtgtctacataatagtctattcattttcagattaattttttaaagactgaagttgaaagaaagagcaaaatgatccgagacctccagaatgaggtaagatatatttcatcttagatacattttatatagatcaaataatatacataaatgcacatataaagttgccactagtttggagtattaaacacttgcatatttaattttcagttataaactaatgtagagaaattgtaaggtgaagaatttcaaaaagtagataatccttacgtttatatatatttgatcatttcattagtccaaacttctctagttcatttttctttctaattatattttgtttagggtgatattaaaaatcaattttcatttaatacatttacttatttgtttaataaatgacattacaggcactgaagaagaaagctagctagaaattggctgcgtgctagaaagggccaatctagaatgaaaaatgtgtttaaggataatctcaaaataatgtaaatttaaacataaacaagttgtaatcatttccatgatagcctttaaaatgtaagcatcctattaaatactgcatacatttttcttctttgattctttatcttgttatacaattactttaattttttataatttctccattacctatttctaccttttcatttcctttttattaaatgcaattaattaagaccattgagccatgactaattcacgataagtcttccttgatcaatctcactaattatgttttattttgaatcctgattatgatggaaaatatcaacataccagagtaatcagaatactgggtataatggataatatttattttgttggagtcatttagggctcagtgagaaagccagcttactcaaatcaaaaaatgctcacatacgatttaaaacaaggaaaacattttaaacgagattaaagtcagttttaaaatagggtagggagtacatttatatatgcacatgcacacgtgcgtgggcgcgtacacacacaatcagcaatatgaacccagttgtatgattataagagaatttcaactttatttttatctttacataagtagcatcagttcacttttaatcttagataacttcttaaaatctagaattcaactaaggaggaagttctttcaaaaaaccactaggctgggcacagtggctcacaactataatcccagcacttagggaggctgaggtgggaggatcgcttgagcccaggagtttgagaccagtctggacaacatggtaaaatctcatctctaaaaaaaaaaaaaaaaaaaaaaaaaattagctgggagtggtggctcacttgtagtcccagcttcttacgaggccaaggcaggaggattgcttgagcctgagaggtcgaggttgcagtgaacagtgatcatgtcactgaatttcagcctgggtgacagagcaagaccctgtctctattaaaaataagtttaaaaaataaaaattagaacaacaacaaaaacctaccaggctggctcatgcctgtaatcccagtgctttgggaggccaaggcagcagggttgcttaaggccaagagttccaagtcagcctaagcaacataatgagattccatctctaccaaataaataaataaacgcaaaactatgaattattaataacaagtaacaaaatactttgtcttgggaggttatttttatagtgaaattgcactttgataactacatagactagaataattcagaaagaaatacaaccctacagaaataatatctgctaaatatgagttttataattaaatttgctactattcactttaatactattaagaacatatgaaatgaaaattgataaccaaaaaagctttggtctttttacaaaacctaacggtgaacatatattagcaattaaatgttttcaattttactcctttatatcaaattatttaatttttagtaaataatcagtacgcatgtagagattaaggcagatttatttaatgaaataactggtgtatacactgtacagtgaagttatatgggcacttcatggaagattttccgttcaggcataagaaaaaaacaggtaaattgattaaacaaaatacagtggtgagggagataaaacagatacaaataaatttctggaagaagtttgaaatccactaagtggttacttttgagtgagggaattagggaagtgccaaaagatgaaggctaagtccctcctatgcctattttgttgagggtttttatcataaagggatcctggattttatcaaatgctttttctgcatctattgagacaaccgtatgggttttgtttttaattctggttatgtgatgtaccacatttattgaccacatatgttaagaaatgagatagacagcaacacaataattttttccttttttttcttttttcttttttttttttttttgagacggagtctcactctgttgcccaggctggagtgccgtggcttgatctcggctcactgcaagctgcgcctcccaggttcacaccattctctggcctcagcctctgagtagctaggactacagatgcccgccaccacgcctggctaattttttgtatttttaatgaagacagggtttcactgtgttagccaggatggtctccatctcctgacctggtgatccgcctgcctaggcctcccaaagtgctgggattacaggcgtgagctaccgcacccggccaatttttgcattttttgtagagaaggggtttctctatgttgcccaggtgggtcttgcattcttgggctcaagaaatccactcacctcagcctcctaaaatgctgggattacaggagtaaaccaccatgccctgccaatcagagtatttcaagcacctttatttcatctatttccagttacctatatcttctcatgggcaccacttttaacctctgaattgtactgttatgacttaacaaaagctctattgtgattgatgtggtctctaagtttcagttttgggccgtctgcttttctctttatatttttttttatgaaatattcaagtcaaatctattccgcaacaatgtgtatttccttgcatcaaataatcatattaacaattaacaaggggtgaaataatgtcagcaaagctttaaaaatcattttgtttttctttccaatatgttgagttttgaagcattcaggcaaaagacttttcaaattttaaagaaattgttatcaatacaaggacataagaaaaagattgaaaatgtatgaaagggcttccttttagtggttgtagtgatagttattgcattaaaactcttatgctttttgctgggtaagatgtgaatacagaagtttctgttaagacttttcccctgcattgaaacaagagatttaagaaaaatctgcatcaaattttaattttgatgatagtgtgctttgttagaagtcaattccctcaaagatctacatcccaaaggaagaacactaaatcctgaatataaagcttcaaagaatcaaatgattatgtttgagataaatgctaaaaaaaattgtatttacacttttattagtttctttactgtttttcttagtctcactttgttgcccaggctacagggcagtggcgcgatctcagctcactgcaacctccacctcttgggttcaagtgatacccctggctcagcctcctgagtagctgggactacaggcatgcaccaccaaacccagctaatttctatatttttagtagagatggggcatcaccgtgttggccaggctggtctgtaactcctgacctcaggtgtgatccacccacacccacatcagcctcctaaagtgctggaattacaggtgtgaacccctacacccagtttgttattttttttatttatttttattttttatgttctggtaacaatgttacctagtaagtggtcttccccaatcccattttccctccaaaatttctatttttagtgtgtaatttgtagaatataagatttcctatatgcaaaattggactcataattcatatatcagcagttttccagtaactttgtaatctaagtctctagttctaatctctcttgtgtaatccttctgttaaaaaggttaactgagatataataccatttttgaagagtttatttgagcaaacaacaatgcataaattgggctgttctgaactagaagttgttcaggagcttcactaaggaaatacagtggaaggtttttatgtgactaaaatagaagtgaagcaaagaaaatatttgtttggttacagttagacagttgctgtatttggtcgatcccactggaaaatctctagttataaaattacaagtttgtttcttctgtgtgtttaagctcaagttttgtttttctttaatataggcatttatttacaatggcccacattaagtttttcatatgtttgcaaatcaagcaacgataacgtcacttacaaagcctaactggctttgtctggtcaaggattcttcagggctcatctccattttaatttactttaacacatccttgtgccttcaatgtttattttgcattttgtgtttgaatattgtttggttgcaaaaagtatacagttttgcaccagaaaataaatcaaaacaaggaaacgaatgaaaaattcaacctcccttctctaacttccatacatatggcaactgcctcatcatgtagtcaatctcccatgcttcaaaggtcagaatttattctgactttcactttcaaaacaccctttctatagtatcatttcttttttttttgaattttatttattttactcctaagataaaatcaatttgtctgtaatggtctgagatataagacaggctcaaaaatgagtaggataatatataagtctaggaaatattaggcaaatcaggcactgggacaagcatctttaattagttgaaattttttttttccttttttgatacagggtctcactctgtcgccctggctggagcgcagtggtgccatctcagctcactgcaacctccacctcctgggttcaaaggattctcctgcctcagcctcccaagtatctgggactacaggcattatatttttagtggagacagggttttgtcatgttggccaggctggtcttgaattcctgacctcaggtgatccacccgccttggcctcccaaagtgctgggattacaggcataagccatcgcaccctgccaaaatttttaaataaaggtgttagttggataatgttcagggcttttgaaagaattacatagttggaaatacttcatgaacactagtatttaaacagtctatgctcaaggggttaatatttaaaatatgtaagaaactcaagcaattaagtagcaaataaataatctgataaaatggacaaaatatctgcatagacattcatcagaagaagatttacaaatgcccaaaaggtaaataaaaaaatactcccaacatcactaatcatcacgaaaatgccaatcgaagctatgataaaatatcaactcacttcagttaaaatggctggtatcaaaaagagaagtaaggaatgctggcaaggatgtggagaaagaactgttatacactaggggtgggacttcagtgagtacagccattatgaacaacaatatgaaagtttctcaaaaactaaaaatagaactaccatatgatccaataatataactacttgttatatatccaaaggaaatgaaatcaatatgttgaagagatgtctgcacactcatgtttattgcagcactatcacaatagctaagatatggaatcaatgtgtttatagatgaatggataaaaatgtggtatatataaacaatgaaatactattcagctattaaaaagaatgaaatcctgtcatttgtgcaaacatggatgaacctagaggacattgtgttaagtgaaattagccaagcacagaaggacaaatactgcatgatgtcactcatatgagaaatctacaaaagttgatctcaaagaagtagagagaatagtggttatcagaagctggagaaagcagggagtagaaggagatggaagaagttttgtcaacaggtacaaagttaaagttaggtaggagaaataagttctgcgtcttattgcacagtaggatcactgtagtcaccaacagtgtattatgtatttcaaaatagttagaaaagaggattttgaatgttctcaccacaaggaaataacaactctttgaggtgatagatatgctgattactctgacttgataattacacaatctatatgtgtattgaacatcacattgcagctgataaatatgtacaattatgtgtcgattaaaacctaataaaacaaaaataacttaaaaaatttaaactagtttctgataaaataatgaaaaacacattctgtcttgaattagtcagtagatagacatggaagagaagggaaagatggaggagatggggcagatatttttttccttattttcttctatggtggtctatttttttttttttgggattataattgatttgtttcctgagactcattcgatagctcaaggtaaggatgaaatagggaatcacactaaattctcttttttgtttgtttgttttgttttgagacagagtctcgctctgtcacccaggctggagtgcagtggcaccatcatggctcactgcaacctccgcctcccgggttcaagcaattctcttgccccagcctcctaagtagctaggactatagacatgcaccagcacccccggctaaatttttgtattttcagtagagatgaggttttgccatattggccaggctggtctcgaactcctgacctcaagtgatctgcccacctcaggctcccaaagtgctgggattacaggcgtgagccactgcaccaggacactaaattctcaaagttcagaatgtattctttcactttcaaaacaccctttctgtactatcatttgtaattttcttgaattttaattattttacttctaggataaaatcagtttgtctgtaacggtctgagatataagaaaggcttgggaatgagtgggataatatataagtctaggaattattagacaaatcaggcactaggacaaatatctttaattagtttaaattaggtcagtaatcataagagtgggtttgattctggtcagtggtggaaatcagaaattaacccagctactctatctcagtggcatccttttccttttattatttcatgtctctattttcctttctttcaagtctctcagttatctttctcatctgtttgttatatggaccatatagtttactacaattctggcttattaatatgtcttcttcagctcctgttatcaactgatttaatgtccttttatattttgttttaatgtcattgctctaagtgcctgagagaaaaatcttgcacaattcaagtcactggccaatatcggattcccaagtagttccaaatagccattgacacatatccaggaatatgatgaataaaacatgatttttaggggcaataaagcagttactattcttggttatggcaaaatttgttcttttaagaaaggaatttattaattcctatagatatcttacaaaatcgtttgaagagctaaaaatacagcttataggttgtaccttagaaaaaactctacaaacacaccactgatttggctgtcttgagaaagcactacctccgcctgaatcaggaagttgccagcctgcctgctgccctgccactgcaggctccagcaccacacaccctgggccttctgcaacagaggatggatagcatttagcctattttctcaagtaacaaattcctgtatccacatattgcacagatcatgtctgaatagtaaagcctaagtcatatctgacctagagccgcaatgaattttcagattttgtttatttttatttgtctgctttaatttttcatgggaaatatagatttgatactatagaaagctttcacattgcagaatctagtcctcataaattagtaacctgtgtattaaaggcaacctttcttaataaagagttatagtccatgataaccagctttagtagacagtaggtcatcattgaaggctattgaataagtgagaaacaagttgtgagtaccaatgatggagtactcaatagtgtgtgcatgtatgttatagtgtcttatgtatatacatggcatcgtatctattcatgtgatttttaactttgcatttctcagaattattttcttaacatgatgcaaatgccttgaagttagaaacctaccttccatagcacatcatagttcacatttttcacaaagacaacacagggccaggactttgcatatattgagaatatattaagaccatattcaagtctgttcttactagtactaatgaattacatgaattaagaaaaagacactacctccaaatttggagataaaagcttaattactgacatggtttggctgtgtccctacccaaatctcaccttaatttgtaataatccccacgtgtcaaagggtgggggccaggtggagataattgaatcatgggggcagttttccccgtactgttctcccagtagtgaataagtctcatgagatctgatggttttataaattagagttaccctgcacaagctcttcttgcctgacctgacaccgtgtaagacatgactttgctcctcgttcacctacctccatgattgtcagacctccccagccatgtggaactgtgagtcaattaagcctctttcctttataaattacccagtctcagttatgtctttattagcagcatgagaagaggacaatacaattcctaattagcaatattccttcataggaatgcttaaagaccccacaatatacaaagactgatatctgagaatcactggccatcctgaaatgatgcagaaaaacagtatatgtgttgtgtttttcaaggaagagggcctagattctcagaagaagtccttgactaaaataaaaaaaacaataaaggtcaataaccaatgatctagggaaaactctaaattttaagaagaaaactcactttggttcaactcttgtggctgtaaatctttctaaaataaattattctaccttcttgcctcaataaacacactgaagtgaagatgatgggatatttcttaacatgatagagtgcttcagggtcactattctgaaaatgaattcttatgcctgcctacagatgaataggtgtaggagtttgagtcgaatatttactgagtccaggacacacccaagaggtttttaagatatttaattataactttcttttttttcactttattgctggttatttgcctatcttaagtgatgatttctgtgaaatgttagtcaactgattgttctggttaatttcgtatccagcatgtgaagctccctataaactatccatataaggttctaaggctactgttaaaaagtataaaaaagtatgtgtcctaaaacaacaggaatttcctgtctctcaattctggaggctacaagtctggatccacagtgtcaacagggcctcttcctggcttctagtgtctcctggcaatccatgtcactctttggcttgtagtggtatcactccaatctctgcttcagtattcgtatgcctctatgtgcctcttattcatgtgcctctatgtctttgtgtgtcttctcctcttcttataacgacatcatttattagattttgaacccactctaatccagtatgaccttgttttaacaatttcatgtgcaaataacttatttccaaataagttcatattctgaagttctaggtagacatgaattttggggtgatactattaaaccactccaccatctgtggcattttgtatattcctcataaacagtgtagtttttttttttttttgaaaggcaaggagaaagcattttattaggtataaatctatcaatggaagtatcctaaaattgcttatttaaatgcatatgtaatatttatctgtatatttatttctggaatatattacttaattccaatattgtcccaacattgtgctagattccagaggcatacaagtattattaaaatcaaattaagtaaaacaatcgctaaccatgagaaatgtaaagaacatttaatactgttaccgagaagtacagatctccttggttcttgtctaacttggaaggaagaattcagccaagagatgaatagcaaacgttaagtagcagagtttattggaagaagataaagtacattcctagagaggtgtggaacatagccccaggctggtctagctggaaaaataatcataacagtgtttacttagaggtagtaactctgaaggatgagacagagtgggctgttcaaaagaatgagccatcagcagccggtgttgggagacttattatgggaatcttacataattattcacaaaggtgtgtgaattattcatggcttgggaggtcccttagggtgcacatgttctgtggttgtacatgctattacacatgtctcatgtctcagtagcatttaaaatctccacctaggagtatgttctttactattataatcagcaaaaggctactctccagtgagttttggaggagtgcacatgcttgccacaagggaaaatctctagcatggtcatctcccactaaggactgttaagcccccttcagtgcccgaggaccctaaccacaaagccacatgtagccaatgtagccattgtccttttttctgtcagtgggcagcctctgtgatggttaatactgagtgtcaactagattggattgaaggatacaaagtattgatcctgggtgtgtctgcgaggttgttgccaaaggaggttaacatttgagtcagcgggctgggaaaggcagacccacccttaatctgggtgggcacaatctaatcagctgccagtacagccagaatataagcaggtagaaaaatgtgaaaagagagactggcctagcctctcaacctacatctttctcctgtgctggatgcttcctgcgctcgaacattagacttcaaattcttcagctctggaactcggactctttgctcctcagcctgtgcagatggcctattatggggccctgtgattgtgtgagttaatgagttaatacttagtaaacttctctctctctctctctctctctctctctctatatatatatatatatatacatacacacacacatatttataaagaatatattctttatatatctgtagggagaatatatatataaagaatatattctttatatatctgtagagagaatatatatataaagaatatatatagaatatattctatatatatgtagaatatatataaagaatatatatagaatatattctatatatatgtagaatatatataaagaatatatatagaatatattctatatatatgtagaatatatataaagaatatatatagaatatattctatatatatgtagaatatatataaagaatatatatagaatatattctatatatatgtagaatatatataaagaatatatatagaatatattctatatatatgtagaatatatataaagaatatatatagaatatattctatatatatgtagaatatatataaagaatatatatagaatacattctatatatatgtagaatatatataaagaatatatatgtatattcttttagttctgtccctctagagaatcgtgactaatacggcatctctagaacttcttttcccagagggatcccttgcctgctcatttctggctacctacctactctaggaatattacataacaggtgacatatttgccatataatataaaatacaataataatttctaaaattgctcaaaactacagtaaaaatcattgaaatgagcgttttacaatataacctggaaagggggaagatgacgacaataacccagaaaagtgtaatgtctactgaaggcttcatctaaggggtagcttttgaaaagtataatataatttgaatttatgactatttgctcactacaaagaaagtaaacaggaaaatgttgatacctcacaagtcctcttgtaggtgaagaaattgttacttgtttattaatgtgcataaagttcattttgatagtgcattgtggtggaatccaatttcaggccagcttacttgcaaagaaaatatttgtggttcccaaatcaatgctgtaagtatctgttataaagagacattgggacagccaatccaattgttacagccaaagcataatataaagaaacataaatctgaaaagttctcttagctgatacgtcagccagctttctacttctcaagggtgttgtagactttttacttagtattccagaggtaagtcagggtggctgtcttatggaagtttgcagcctactttaattttcattttatttgctgcttttatcaattaatttcactcattaatttcctgcagcagaatgttggctaggataacaccattgtatacaatcttagacgtgactcagttgaaaccatgctccttataccctggttgcatctgggtcactttttcggttctctgagagagagatagctagtgttccctgaacatgcttcaagtaaaggagaaagtttagctctttactcttatgcctttggtaaatattattttatgtacctcaaaatgtggttaatttagtacaagagaaaactatgcatgttagacatttagtacatattaagctgtcaccaaatggaagctatcatcatcctccattattgttattgggttctgagttaaaattagttcatcaataagcagtgttatgtacagataaatatttgcttagaaatggttctaaaaatcaaacaaccaatcaaaagtttcttaagttctaaaaatcagccaatcaacaacttcataacttagaaccataagttaaacttatcaataaaaatgcaaaggtaagaaaggactctaattatcacttttagacagtctcatttcatctcttaaagcatttctttccacatgtcagacaagaagactaacaactgtgcaattcatattttaattagaaacaatagcctatggagaaaaccttttcaaattggactaacggaaaaatcccagagaagatactgaattgatcacattcctgagtcaaccaccatggtcagggaaatgggcagtttaattgctaagcctgagtcacatttctgctcttatgttggatgaaatttaccctactcaaaacacagatttcccacaggaaagaagagttcattatagaagagtacctggactgataagtaaatatatccagaaaactatcaaatacttttactactccctgccatcctcgatcattttcttaatatccttcaaatcatagaatgcagtaataatgtaatcattgctgttcccaagtcatatgtgatgtattcacattgccatatatttgttagcaatgtccccttggctataattctaccattgctccaaacatattgaggatcttcactcttcatcttttatatttacttactacattcagatactccataaaatggcactaaagaagctctagtcatatgatggtaggaaaatgatcatctccatttctgcacctggaaggaaatggaagaactgctttgtttccaatcctcagagattcatcatttcattgtatgtacttgacacccacctttgtgcctcatgtatccagcattatgactggaactgatggtgcctatacagccttcattcccaacagggcaagggttccatccccttggtgacactgtaagtagttttttttttttttttttagacaagagttttgctccgtcgcccaggctggagtgcagtggtgtgatctcggctcactgcaagctcagcctcccgggttcatgccattctcctgcctcagcctcctgagtagctgggactacaggcgccaccaccacgcctggctaattttttgtatttttagtagattcggggtttcaccgtgttagccaggatggtcttgatcttctgacattgtgatctgcccgcctcggcctcccaaagtgctggaattacaggcttgagccaccgcgcccggcctgtaagtagtctttacttaagtatagagactggatttgggaagtgtaaggagctacaacttgttagaggtgtgagaaaagtaaattcatgcggggggatccatttaaacaagttggaaaaatagaaagaatgctgctttcatgatggacagagaagaaacaaattcaaataatatacttaagacttagtataaacactataaaaatcagatatgcatatattatcctagtggattcctaatgaaaatctaatgtatcaaaattggtaactgtttcaatgacaaaatagtaaacatatttgtactaatctcaagtataaaagttatacttctgtttaacttctatataaaatttatacaatttttgtacaacttatagtcttattctaaaagccatgtgtcatagaaaaattggacacttcattttattttctttacagcagttactagtctttgatattatagtacataattcattgatttacttgttcattttcattcttctcttctgtggtttttattttttttggtgtggtgatgagtatacaacatgaaatctctcccgttaatacattttaaagtatataatacactatacaagcattattttcttaaagttacaagaaaaaagtctttttttaatattatatcttctccatgttttctgtaatatagtaggcacttgataaatacttgttgagtgaatgataaatattcattgaataggttatatttctataagtatcataaaatggaccactatccataactcatagaaatgagagttctcaaaatggtgcgaagattttctaaatcaaacgtatagtaagctgggcacagtggctcatgcctggaatcccagcagttttggaggctgaggtgagaggaatgcttgagtccaagaatttgagaccagcttgggcaacatagtgagacctcgtctctgcaaaaaataaaaaaataaaaaataaaaaaatcagccgggcatcgtgatgcatgcctgtagtcttagctattcagaggctgaggtgaagggatctcttgaacctaagagaatgagaccacagtgagttgtggtcataccactgcattccagcctaggcaacagagcaagatcctttcaaaaaatgaataaacaaacaaacaaacaaataaaatttatacaatttgtaataaccttaaaaatcatagaaattagaaaatctcatattgattagaaccagctaaaacttgaattcttagatttttacataaggggctgaaaggcaagatactttactcctggttactgcgacatgctgcacagaaagaaaggataaaagcatgtaagaaacaaacaatcaataaagaagaaagaaactaaatgaaggaacataaaaaggaagaaaggaaggaaagatgagaaaagaaccttgagaatgaagagtagaatttttgctagcatttaagacttatttgctgcatcatctgggaaaagtcaaaacttttgtgaatatcactggtaaaataagaggtttgcataaaatgatccccatgattttttaatttcagcttcacaattcaaaaactataaattcttagtctgtagagacaatagcacaccaactgataacatcagtaatacctgagtactaaactcaatgtaaattccaactgagtggtcattagtatttcaaacaggtgactctaaaatgtgtttggatttgcctagagattttctgagcatttcagaaatgtgtgtgtgtgtatttttaaatgtcaaagtatggtattctctagtacatgccatagaaaaatacaccatgaacaattaaccaagattatttaagaaagtttcatcattgcacctatatttacattaactatgttaactttaaaagaagttgatttttttaaaataaaacattattttctgcgttatttctagcaaatatgcacattcacaaagtgttggagatattcttgaagcaatcacttaagcagttatcaactattttctccctcagacataagaaaatgccagtgcttagaagacaaaaaataaatgtcatgggtagtaagaaagttgacatagtttgcaaaaatctgtgtatctataccagcttttcatcatacatgtcacacttaacatttgagatacttaaatgctatcattgaaatagaaacatcaatactgaccaccacagttgggagggtaaaatgagataataattacaagaataactatcattgtgccactccttgtttttcataataaatgtaaagtgttaattaatggctggccacaggctaaatattactcgtggcatattctttaatcagctcttacatggaaaatacatgtagtaggctgaaaagtagcccagagagatcatgtcctaattcctgaaacatgtccatgcaaacttataaggcaaaaatatatttgtatatgtgatacagttagggatcttgaggtgatgagattatcctggataatttcagtagaccctaaatgtaatcacaactgtctttataagagaaaggcagagagagatttgacacacacacataggggaggaattgatatgaagacagggtgagagaaatttgaagatgccgactttgataatgggagggatgtgaatgtgggctgaaatccaaggaattacaacagccatgagaaagtggaagaggcaagggacatattctcccgtagggcctctggagggagctcaacacagcttgctcctgattctgggctggttacttctgacatgtggctttcaaaattattaaataataaatttctgttgttttgcatcactcaatctgtggtaatttaattaggaaactaacacaggtggggaagaagtagggcaggtattcaggttatcattaatattaattacttaagtgtgttttatgatggtggattccatttccagctattaattctgaaactgaactgaaactctggcaagcattcccctttgaccattggatagaatttatagatgattgtaaagtacccatgtgttttatcttcaaccattatttatcacactacttctgagtcctgagcaccatattaagcagagaggaaataaaatcaattcgatcttccacgccttgttttccacctttgctttgtgtggaaaagacctcttaaacatgtaataaacttatatgatagttgtataatgtatacaaggagccaggcatcttactcatttacttcacacaaaaactattgagcaggaaatttgctagcactgggatatataacaacaacatgccaatcatgatgaaggtgataatgatggttgatgatgatgatgatcgtaataacaacagtttaccagtatttactctgtgataccagacagggccagactccatattaccaagagttttacatgcattatgtcactcaatttgaacaactgtcttgtttgtctgttcatttttaatggaatgtcttcaggtgtgcagaatttaatcagtcattatctgtgattctgtggtttatatcacatcttcatcatataatattggttttgcacagtctttaatcttttaaaatgttatttttaagaacactactaaagacaccaacttaaatgtgagctagctaggccttgccaaaaatcccttttcagcatcctcattcacagtttttatgtgaagaaatagagggaaagagaaataaaagtcatatagtcaatcatacagttggagtgtgatgccagactgtctaacacaagagctaatattctctccttttaaccaaatcttgtaaagtggattcaagttactatgttcaatctttatcactttgcattaagcctaattgaagacttaaactgactacctcttatttttatttcattatactttaagttctagggtacatgtgcagaacatgcaggtttgttacataggtatacatgtgccatggtggtttactttctacctctttcaaatgtaatttcaaccatcagctgaaacatttcaccttttgtcccctttttcctcctcctctcttctataaatattcatgttgatatcatcaaaatagattgacaatatgatatatgataatataatcatagttttggtttaacctcagagatatttcttactgcactatttaccattgttgaaatatgttgactctgcagtaattggcccctcaaaacaatattaggtcctttcctaccttatgtctgaaagttgcagaagacaacactagatggagtaattttctccatcagtcatgaagacctgtgtttcatgattttttatagccacaggtactttcatttccattaccattttccattttctttaaaaaatagacctcataacacatcatggtaatactagaaatcaaaaactgatattaagaaattgcaaacgagctgctattttatagaaaggaagttttttttaatatacattaggaacccttctgcctctaaaaaccacatgatttaaatttagcatttcacattgacttataatatcttccttacccaatacattaaaaaaattagatgtcctcccccatgattttgaaactttaatatgtatgaaaagcacctggggatcttacaaaaaatgaatattctgatgaaggatggggcctgagagtctaacaagttcccaagtgatgccaataaaatcaatgcatatgccacggtttggataagaagactctaagtaagtgcttgtcaaatgctgctgaatgggtaggtgctgactggctactaacaatcattcagagagcttctttaatatgtagatttctaatagctgtttagagattcagaatcaggtgtgacttgaggttggcaatctgcattccctaaatttaggtgaaagagattttattatacaactgaagagttcacagaaaagcctggcaatctgttgactgagtaactttaaagtgctggtgaaggaagttttcaagagtaacctttgtagcattagaagtatggtcagagtgcagctgtgaagatacagcacagtctatattgggcctcatgcacatttattagacagggaagagcagaaccactgattaaatggtgtgctcaaactctgtactatgagcaggagataatttctcaagtactaaatttggaggtgctgccaggactcaatgatggattgcaaagcaaccaatggtcatggtataacagagatttaattttataaccacagaaaatagagcatctgaaaaaaaaattcagattggtaagcactgctcttaacacataagctcctggtcccctgctatacaactgtcttgctttaatattttctcactttctcctcttcctcttcctcctccttttcctatttttccttttctatcaccaccatcactacccttgaggaacccagtgcctgtcaaatagtaggtactcagcaagtacatgttgactaattgctagcttgatgtatttttacaataaaaatagctcatcaaaaaggaaataaaagctctgcctctgccattcttgtcctagaatgttacctgtgtaatttcacttcttaatgacaagccttttatatacataatttcagttatctttgcacaattcagtaaatcagtcagaacacattctgaaacgaaatggaaggaagagataaagaaaatgaaatattaggggctttccaagttgcttacttgcaaagagccagaagagactagggaatgaatgaggcactcaaattttcctctccttttcaggtgcttttttgattacctactgttctcaaccctcatgactatagactttgaaataaatgtgacatcaaccacataaataactgcctcttttaatctttgtaactatcacaagcacatgtccattgtctaagttcactattcttgtcagagctgcaagaaaataaacttctctttgtattctttataaagcattttgttaagttggatgttacagctctcatatttccatgcatttcttcttttctagataagattatgcctttgctgacagagtggaaaactgctactaggggctttcaatataattacacttcattttttttttcctaaccaagacaacacaattttataaatttgctcacaactcaagcttacctggtaaatgtatttgctaatcataatttaaaaattaaccctattttgatttttaagagataaaaggtttttttaaatctcagttatcaattaatactgtttcttccaagtaaggttctaacattttccaaattagaggaacaagtttttatatcaaaatgattcctctggtatgcattttaaattattttatttcatacatgaatctgcaaccttcaacttctgtggaggactctgatttgttcttgtagcaactgaaaactccttgtcagagctagagaactgaccctactgtttgctccagcagtgcactacccttcttataactcaaaagttatcacactgcaatgcatttctctgttgaggaggggaaggagtacttatttgttctgtttattccaagtttgaaacagtagtgcatgatacatagtaagttcttactgagtaaccaaacaaatacctacctcaaggtatttgtagcaacaaggtctacctttgttgctgttgctgttgttgttgggaaatgaaaggtgacacctatttgggtagaaagtagacctcctgaattactaagaatttcaattgaaactagtgccatttgtgcagcttctaggcctttcttgcgtggcttcattaaatacacccctagacacggagtttggactattgatgcatcccttcatgttcaatttcttgtgaattaacagaatatagcataactgttatgtaaacagatacagaacttccttttttcagtaatgtcagaggcaaacattttaagagttgaatcccttaaatgaaaataaaatttatcttgtttttattctactttgttttctttatatatagctaataagcttagatctttttattttttattaccattaatgttgaaaaatactaccaacacttatttcacaattaagaatcattaaaaaatgtttttttgaaaaaaaatggtgacaatacccgataaattataagggtatattgtcatcagtctgtttatttaatggtgttggttctattagaagatttttgtaaatactcttttcttccatcctttggaagttgcttattgattctgtcacaaaaaggtaaatcacttacctatttcttttcaaaaacaagatgtattcattatctagcaataattactcagaatttccaatctgtttttgttttcatttttgtttgttttgcaagggaagtgtctttcccaaatgctatggagtccaattcatgttcactcaaagagtgagtcctccagtaaaacaaggcaatagtgaattggtgacaatatgaaaggaatgcttcttgccctacatgctgttaactatagcaaggtagaatctgcatgaaagtttaattttgtgtcacttctattttctaatgtattattattgatgggaacatatattgtatatgattagacatataatgtgtatgatatacatttatgcatatattttctatgcctaatcacatgctgtacatgtaaatacatacatttgcatatataagtatccagatattagaattcacttgggattagccttttgggaaactgattaaacttgatcccaatattaattccacagatctgtggaagtgtgaagccccattcatatttctgtggatccatacctcacacataccttcttccctgtagttacactatttatgctcattcctctttggaagatatctcttctatgataccttttcagacctctcctgcataaactgattgactttatcatctgttcccatcacatttagtacacatatctatattgtggctttcaccagattgctggctagtttttactaatgaggctgtcttatctactacactaaggaattactacactctaagttcttcagaggaaaaaggagaggaggaaagaagaaactaacaatctaaggcttaaatacaaaatagcaggtggatttatgattaatggtgtgttaaaaaggtatgccatcttcaattgcaagtgtcaaaatgtgaattattaaataaagcatggaccttgcttggaaatgtttaactgagtcatttaaatagcctgtgacctgtaaagacattgatacttacttgggaatattaatgacatatttatattgtcattatgaatataatgacaatataaatataagaagagtatgacatttcattaggaagtttaatgagcttgacaagatgaccctggtagtcaattccaataataacatgttattataatatgattaaaatgaaggagaacaaaaaactcagttaagataaatcgttatatcaaacaatacaattatggctaggatgctacatatgtgctattatataaactgttagagacagaagagatgtcagacagcatttagcccacacttctcctttcacagatgaaaagttccaggcttcaagaggctatgctgactctgggaaattgctctgtttctccctaaaaatactttgttccaaattggcagcagttataactagcaggaactatagatctgacttcctacaagcagtcaccaaatgtaattatttgagtttggacttacaagcttcacatttgacccttcaagtggtacccagagttggggcaccgagtacatcaatgtattaactcatctttgctggtgggcacatttttcatcggctggcacctggtatatgactgtatttttaatttaggccctcacaaatccctcaaagttatgaaggcgttgtaaaatatatgtctcagggaaacctaaaaccaagaagcatattatatattttataattttatatttttaggttaacttaatttcccatcgtaattgcatgcatgcatgtttgatataaaaattataaaatacaggaacatagaaaatagtatgttttattattttaccacgggaaaaaagtagtcagaattcatgggcatatctaataaatacattcctgacccttctatataaataatatgggatgtttttctttccacttagtatacatatgcaatttttcatggtaccaaaaattctgcgtaaatatcatattaacgactgcctatttgtaacaccttcccctaatgtgaagaataaaatatgtgtatatttgtatatacacaaatatataatatataaacaggtgtatataattatataatatataaaatatatatttgcattatattatataatattaataaattataatatatgcatttatatattatataccacataggtatataatatataaatatgtatattatgtatttatatataaatatgtatattatgtatttatatatatatatgtatgccattgttttgtgttgttttattttcccacctttgttttaatgattagaaagactatctttatgcaggaatgaattaaacaattgcctatgttttctttcaggtatttttataggaagccaaattttcaataagaaagtactgtatcagtaaatagaatgatgctatctgtgcattctttagtaggtattgtacacttgaaaaataataactgccactaaaacagcaggattgacaacttttcttgcccaattcaggcccagttatcaattcaattgaggaatgagtgtttgagttaattgaatgtttctgtttagtcaagtgacaaaatctctgttccctgctccttgatctcctgaaatgatttaaaaagaccttattatttcaacagctacgtttgggtacccttctgaaacactggacaattaacttctttaatttaaagtaagcttatttaaatgtttcaaatcatctagagcctgaagctgaacattgaagtatcagttgtgttgtgccatgactcaagctaatgatgttaaaaaagattgagctgattgtagactgattttataagttcaaaaatttggggcagcatattcttatttccttcagctatagcaaagacataatcataaaatctactacaaagatttattgtgaaaactaaggtcagaatagtcactgacacaatgttagaatctcattaatgttagctataatgacgataattattattatcattggtaattaatagtaaactggacaaaattgtttcctattgtcaggtgattgtttttcatttatacctagtaaagcaatcagcagaggcagtgattgactgtagagttaaactcaatttctatttctgctatgtttgttttcatttagtcacaactttcatgattctacctccaacactcacctctatttattttctatgcaagattttttattctctcacattaattttctttgtggtatattaaataccaacagaagcatcaggtttatatataatagttgttcttgtaattcacaaagctaggtcatcaatgcaatacacataattattatttcttttttgaaattagttacacaatgttgacctatgctagtcttgaatttctgggttcaaggaatcctgcctcagcatcttgagtcactgggactacaggtgtgtgtcaccaagccttgctgtcttatcctttcttaaagcaagttttccatttgaaaactgctaatttctttggggcattgtccccgtaaacttttttgtaaaacatcattggcttgtgaaactcagataaacatgctgacccatgtctacttaaattcattatcagtaatcttaagtgggcccttactacttcgaagcaatcctgaaattctgtaaatttaacagtaccttaattctttcactgtaacagatgcctatttctttttgtttttaatttttttttttttttttttttttttctgagactgagtctcactcggttgcccaggctggagtgcagtggcacaatctcggttcactgcaacctctgcctcccaggttcaagtgactctcctgcctcagcctcctgagtagctgggactacaggtgtgcaccaccatacccagctaatttttgtatttttagtagagacggggtttcaccatattggcctggctggtcttgaactcctgaccttgtgatccacccacctcggcctcccaaagtgctgggattacaggcgtaagccactgtgcccagcccagatgcctatttcataccttcttctttgtcctcaaactgaaaattctgccttgccttctaaagccacactgtcagttgatattcctgtgtattaatcagaattatccagagaagccaaaacaactggaaatatatattcatataaatatgttataatattcataacatataaatactatttattttcaataattgcttccttgattatggaggctgccaattccataatctatatggcaagcaggcaagctggagacccagagaaaagctaatactgcagttcagctctgaagtgcatctgctgctgaattccctcttgctcttgctcttgctccaggaaagtctgtcttttgttctattcaggcctttgaatgcttggacaaggcccacccacattatgaagggcaatctctttacttacaagccaccaattcaaacgcaaatctcatcaaaaaatgccctcataggaacatccagaataatgtttgatcaaacttctgggcactgtgtccagccaaattgatgcataaacctatccattaaaccctgctttttatttcatcaagaaaacagaaggcttccatgctgcatagtgttcatggacccttggtggtgtacatttcacccattattactctgctgtgtgcccaggaattagtacgctctatggacaacatcaatttgttctttcatcatttggctttcatttgagtttgctaaatgctaatctttggcagcagatagaagagggctggtagtgaggtcaatatatgtttatcctctatatatggtcaactagggatgccaggattttcagccaaagttcatagcttctctcaaggtgtgtctctttgtataactttcttctcttgaattcatgcctattcccttcattacttaagtaatccaagatactggattacctcttatagtttctctttactccctacatgttagcaaatagtttttcaattaaatttgctcaagttggtattattttgattgcttcatctgtttcctgatggagtcctgattaaatcatacaaagtaattttttacatgcttctagccacatctaccaatctatcagcattgctacctgtcttagtctattcaggctgccataacaaaatgttgtaaaatgggtggcttataaacaacagaaattgatttctcacagttccagaagctgggaagtccaagatcaagatgccagcagtgaggtctgatgaggactcactttctggctcaaagatgacacctcttgctgtgtccccacatggtggaagaagcaaatgagcttccttgggcttcttgtataagggcactattcccattcatgagggctctatcctcaggatctaatcatctttcaagggctgcactttctaatatcaatgacattgtggggttagaatttcaacatataaatttaaaggggatataaacatttcaaccatagcactacccatttactctgctttctcaacttatgctgaatgagttatccatgctcttatctcaagttagtctttccacctgtgctttgaatttatactccactcgtatgcaagaatatctaataaccattccttctctcatgtatcataaatttcactctctctttcataaatatatgctgttgtgtcactcatctttgaaatatcagcactctagcctacattgcacacagctactgcctttttttgtgttcctttttacagtaaaatgctttgaaatacagtatatttttattctgcaaattcatatttgcattgaatgtgaatttgaaaaaaatacattttttctgtttaagatcagtaactccctactgccaagtcaaaatgatagttcctagttttcatgttaaattattagcagtatttgaaacagttgactatgctcacattttttaaacgcttgctttacttgtctttcataactccatatttctagggtattttcctgtttatctcactgatcattcttctttcattctttatttttatttatttatttatttatttttctgagacagattattgctctgtcatccagcctgtagtgcagtggcacaatctcagctcactgcaacctctgcctcgggggttcaagcgattctcctgcctcagcctcttgagtagctgggattacaggcatgtatcaccacgcccagctaatttttgtatttttagtagagtcggggtttcaccgtgttggctaggttagtctcgtactcctgacctcaggtgatccacctgcctcggccttccaaaatgctgggattacagacgtgagccatcacacacagccaatccttttattcattgtctttgttagatatttcttaaatttttagctatttattgttcaagtgttccagacctcagtcttcaaacctctcacttttccatttatgcatactgtaaaagtgatcttttttgtcttaagtttatgagtgtcattgaccaatgtatacttttcctatgtgtatattctgctcagaccactccagatatgtatgtgcaaatgcttactcaatatatttacctgtatgtttaaatggtatctcgaactaatgacatccaacatcagtgtctctgattatctcatatgtggaagttattgagacaaaacacttcgtaataattgttgacacctttctttttctcataccccacgtttgaaattcttcttaatgttgcaaaagaaataataaaatattacagatccaagctatcttcatgattttatgtgctatctaccattttcattattgttaatattagttgaatgagcaaatcttattcaaagtcagataaatctgagctatgtatttgaatatcgtattttcaacaatttttcccattataaatttagctttaaaggtataccttttatggaataggagaacattctgagtggagctctgatggagtggagtggatttagtacatgtacatgataatttgtaggactagctgataaacatatgttaacaatattaaatgtttcaatccatacaacttctatttaaggtttatgagagtttaaaagctttttttctttttttgaatatcactacttgcatgtaaagcagcttgtatattttattttcatctcttcaacatgttgtataattaatataattataaactaaatttttcattggctatcaaaaagggttaaattagttctttgattattttgaataaataacttaccagttattttcttttataggacagaaggagattatttaagaagcaacattttgatctttccaaattgtagacctgttatttacagagttttgcaattatcagaaacatttgaacagaagcttagaactttctttctgtggtccaaatttcaaacagtgaaagcagtaaaaacagtgagcagactctgatactgtaaatgtcaagaattttctccatttgctcaggcccttttcttagtgagagtctttttttttttttccattcaatccaaatagcagcttttttcttccttttctttttaaactttgagagctttgaaatggaattcttcattttaaaattatccgatcatttcttccatgtatagagaaatgcatttagctcttgtgacctacctatcttgcatttctattttcaaagaaatataactttatggccaggcacggtggttcatgtctgtaatcccagcagtttgggaggtggaggcaggcgggccatgaggtcaggaaattgagaccatcctgccaacatggtgaaacactgtttctactaaaatacaaaaaaattagctgggcatggtggtgcacacctgtagtcccagctacttgggaggctgaggcaggggaatctcttgaacctgggaggcggagattgcaatgagccaagattgcaccactgcactccagcctggtgacagagcaagactctgtctcaaaaaaaaaaaagaaatacaactttatgtgatataatgaaactgttttgtaccatttattggacacgtactctatgtggagtgctgtgttggttttttttgcttatattaccacatatctttataagaacttagtacggcactgttataatctctgacctacaggaaaatgtaatgaagttcattgaagttcgtatgcctaattttagccaagtagtaaaaaggagagactggatttgagggaagcttcattgggatttaaaatccagttataccactaaacaaaaatcttcttttatgaatttttcttatgccctgaatttcctcccattcacaatgaaagctgtactgttgttgttcctactcaatccacaccctggttctccctgcatgaacttggtgtcaggattgggatttgttcctgattcagccaaagatgtacacgagctggaatggaaagcctcccttgaggcaatttctatgacttgtattttttattccttttcccccattttctcaccaaaagatcttctagcttcctggaaggctgatttattttccagattcattgtctttctttgccataactggtgaatttctgttagatctgcattttaattttagctgagcaaattattaactgtggatttgtttcttcatagtactttatttagatgtttagtagagagtttagtgtcccatattcatctaatttccatgctggaacaggtcaggttaccttttctggaatttccctgtatgattgctgatgaactaactcttgttatttcaacctttccttgtgtcaaagttcagccttaaaatatggcactattcagctttgtagatgcatcataaatgatatggttatttgatgtacaattttttgttgtgacttatttctaaacaattctgggtaatcccatgggcctgaatctgcactctatgggtctttccttcacaaataaacacactctgttaatgtcaccacctgcaaacatctgtggatgtactctgctcacagatgggtttgcagtgaaaagacttttatggatcctcttgatgctcagctgtaaaagaataaagaaaagtctgactaaatcttgcaaaagaaaaattgcacctgacaaaattaaactgctgtttatctgagaataccatgataagggagagaggacagaacacagctgatctcaactctgctgaaacaaaagataggcggcttgttagtcatgagggaaatattaaggcagtcttgccttataagacaagaaatataagacagtcaatgtctttgtctgtaagagactagtaattacgtataagtctttttctgtatcattccctcagtctcacctattaaacagctcttaggcaacagcagctgctttaacatggttttgttagctgtcttgagtggttttatctttttcaaacctactcacaaaatagttatatttatatacatttttctttatcttttatattctgactaaccaattattatattctgactaaccaattattaatagaaagtcagaaaagtaatctttctaatattgagtctgagaagatacaaggatctattttccctaacctgaccttgtgtttctcatttcaagtaacaggtagataaatataatgcctttaaaatgtaaaattctccaactgatcctaaatagaacattaaggatctaactaatgagcctggccttgttagccttgtcagatctccttatctaacttatacagattttagaaggaagtgccattaaaccttgaccaagcagaaaacaaaaattcaagggttcattgcacaatgtaatactccacatattctactgatatattctacatactctacatactttgcacatggcatactactctttatgtacagagatgagtttcttactgtttaaagtttgtattccaatagtggagaatgaatgtgtgcagtctctgctaatctttactcctaatcctgatggtgtccaacagtgcgtattttcagaatggctgtgattgccattccttgaaggcgaatcaagagatatagcaaacaaaaggaaaattaaaaccccaacctcagactcctaagccatgggaaatattaacttattaaaacacataagctaaatgttttatatattttgatatctgacactttagaatgagacaagctatgactgtataaattggttatggattaaaatgattttgtatgccataattggacaaatgaaaggtgttcttttgctgattgtgtcaattttgcctttcttttacatgtaatacaaataatattttctaatttattctctcataagtttctttcaagactgaaatgaagtgtggtattaaaaaatgtacttgtaaataaaagatataagataccatatcatcaatcaaatagaagaataaatatgacattcaaaataaccttgttaacaaggtagttaattttaagaattataggatttcatgtgtaagtgaatttgagatcatttggccatgaataacatcttaatttggttatttatttgtgttgaagatagagggcagatggaagttaaatactgttaaaactcacttgcaagtagaattcaaacatagctccttaacttcttaacccatttcactttccaaaatgttcgactttactgataagatggctcataattatttatgtttgtttcataaccactaacatagtaatcatatggacaatatacatggtttattgattaaaacatcattattaatgacctttttattttgaacaatttgtcattattcttattatgtatcaatgattttagatcttcagaaacactcttttttcctttttgtttgtttactttttactccacctagagaaaaattggcaaatggtcagcattgcaatatttatctttatgttcagaaagttcactaattattcactgagtatatctgattcctacagcattaaaacagtatgagaaataagaagaaaaggaaaatagcaataataatgaacaactgtgaagggaatgcattttacagagtattttcaagagttttattacatacaattctcctaatatccatgcagaaattaaggtactgggctcatttcatgattaagaaacaaaggccctgagaatttatggaagttagtacaaatctcacaactaaaccagatgtaactcccaaacctgagctttttaccaggttctcctctgttgctttgtcagcatgtcagtgtcccacagttcctctcctctgtttttacggtgtgcttatgtaatttgggtttagtcttgagatcagagagctaaaggaaaacacagaaccctagtctatagtaagatgatatgacttgctatcaatctcttgtctccaagtacttcagtgttatgcgcctcactgagatatacacttgcctgcctaatcctgtctgtctatagagagcactggtgtgtagtaactgtgatcttgtttcagtgactgcaagtggttatgaaccaaactccctactctactgtccaagaacttctcaggtgatccgttcccttccacagatgacagttttacctttagatactgtataaacttattttgagtgttctcaaatgtagcataaattaataataaataaataaacaagcaactttgttttttgagtgcaaatttgaattttggacccagccagaatttatctgaagcacaatttggtgaataaccttctgaacacgcaggggtatacgttttaggggtcaaattgctctggggctttcaagaccttaagcaaatggcatatgcaaagcaagttctattcttctgaaatcacatgggttagtctttttgaataacccgattagagttttctatgtttagcatgttctactttcctctattctctgccactcttccaattatagtgtgttcttggttttgttggcaagaggtgtaacgttattattaaccacaaacaacttgtaattgcctttttcaatttatataggttgcccataaaaaagtcatataaactacaactataattttgtatggtaataataatctgtgtgtgtgtgtgtgtgtgtgtgtgtgtgtgtgtgtgtgtgccacagcaagggatagaggaaaaaaagagccaaagagaaaaaaaaaaaaaggaaagtgagagaagaggttcagaaggtttataccagggctggcttgtgataagactgctggggaactctggtcagattcaatattcttgtggtctaattggaccaacatctttaaaaaataaaaatgcagatcatataatacgtttttaagtgaagtattgcttcacacttgacatgatttagatactacacaagttttttttggttttgaagaacaaatctagcaaagcttagcttaatggattatacagacacacagataaaataaatcctcctcattaacagcagaaactctctgcatatgcatgttttattttgcatagtgaaccatccttacatgaagggaggagggcgaggtttggagacaacaaagcatggtggacaggggttcaggctttccagtcagaacatctatgttcaaatttcggctcatcattccctagctgcgtgaccttgtgcaagtaattcaaatactgccagcctcaatcctgcatgaataacagggagaaagtaagagtactaaatctgtagggatgtggccagaattaaatgaattaatatgtatcaaacacataagataataagaactgaataactgttagcccttatcactatcacattacgatatgtcataatgaagcattctgaatagtcaaacacatgatatcctgcaataagagtcatttgactcaggatttataattaggtttgataatccaagggtcgtagaaattctgaaaaccacaattgatgtgatgccaggaagatgatgaaggcaataaccttttcttgaatacctaatgtttggcaaacactgtatgaatttgcttttatgtcaataatctccttttatcctagaaacaattttgcaagggacataattatccctcccatttcacatgtgaagaaactgtaactcaaggactttaaaaatcgtgtacaaggtcggagagcaaatgagtatcaaagccagattcaaaccacagaaaacttgcctcctggtgataaacctgccagtagtagaaatgctctgtagtagaaatgctactgtagtagaaatgctccccatctattcatacaggataacttaggggaaacatattttgtcactagcatctcaatttcctattgctaagataacaacaacttttaggattcatgccagaaaaatctatgaaacagctgacatagtttaggagttctatttattgataaagttcttttataaatctgctggcaagatgctaatgtgggttatggacaaaagttgagtacactttaccaagttgcaatgttttcctcatttgctgttttcaagacatttaaaaaccttcactatttgtgagagaaaataattagagcctgtgtctgacatgatactaagaaaaatacaaagtaaaaggagctgagaacaggacaaattttccaaatatataataatcgagtttggttttagttttcttttgttttgtgttattaaaaagaagtccttttttggctctgatgctctgtaaaatacacaaatactatgttttgtttgtttgcttgcttatttatttatttaaaatttgaaatataattagcttctttctttgaagctaggggcatcttatatttctttttttttattatttatgtatttatctattggaagatgggatctcactcttttgcccgggttggagttcagtggcaagatcatagctcactacagccttgattcttccacctcattcccaagtagttgggactaaaagcacacaccaccatgccaagctaatgttttattgcttttagagatagaggcacactatgttgctcagcgtggtctctaattcctggcctcaggccatccttccacctcagcctcccaagtctttgggattacaggcgtgagccactgcaatctttttatgttagtttaatttgaaaaactaacaatatatttgcgccacaaggggaaggagtcccctaagttcccatctgccttgtgtgcaataccaaatcagagcacacaagggacatttagtctagagatatcagatggagagtgcagaattatctgtgcagaatgggcgtataggctgtgggagactaggactgtctatcttgcatgctcaacttcctgcttccccctgcttgccattaagagaggagaagggattccctagagcctgtgggagagttgacataagggaaaggagcagctgcaggtctggcttttggagtggactcaaggttatttcctgtagaaacaatgctgtgtacagtggacagtagtggccaaagaagtgccaccagtgcaaggagttcaccacatagttagatttattttggctgggtgagcttccttactatgtgttcaacattgctactaagagaaaaggagtttttgaggcacacaaaatttacaagctcagttttattatggtagtggaagcttcactcactgtagagaaagctgttttatactagaagcactgtgtctcactgtcattttctctttctgctcctccatcatcattgtcatcatctgaaaataagtaatgctaaataaaacttttgatgttctagcacattatgcattatgtgctgatgaatagacatgagctcgttcagttatcaaaggattcccacaggtaggaaagtattaccttaatatagagagaaaactgagtaacacataggaggaagaaaccagtacaacttccacagctattaaattcaaaggggccgggtgtggtggctcacgccagtaattctagcactttgagaggccaatgtggggggatcacgaggtcaggagttcaagaccagcctggccaacatggtgaaaccccgtccctactaaaaatacaaaaattagccaggtgtggtggcaggcgcctgtaatcccagctactcagaggctgaggcaggagaatcgaacttgggaggtggaggttgtagtgagccaagaccacaccattgcactccagcctgggtgacagagcaagactgtttcaaaaaaaaaaaaaatgaaaaatgcaaaccaggaccagcaaaagtgagttcaagtattaggtctgctaaacaccaacttcataactctagtaaactcacctagcatcttgagcctaagtttcctcatccaaaaaaggtgataaataattatagctatctcctagtaatgttgtagatattaaatcaaatatggggaaatgatttaattccaggcagtggaagttactattagaatacaaaagtaatattttagtagtagtagtattttttctatcagaaagaattaatcacaattaatgttcccataagtttaggcattgagcatatcttcctgattgattgctgcaataaatgataattgtaataaaagtgcttaattcttttagctaaaggacgaaacaatcctaaacatcgttggaagtaaagcaaggcaaagtgtagatttgatctctttaattacattttagaacatttcagcagctctctcggtcctttgtcttcctccccataatttgctatccacccgcccccacccttgtttttttagggttggatgctggcaagagagaatatttcactttccttatcctacacacgctccatacatggaagtgaatatctgaaggtgataacggataagctttttctcttgcagaattcttggtgatacttagttgggaaattctcatgaaagactccgtggccccctcctcctgccttgccacgctagattgtctgtcacattgtgtaggactgtggtgtctgtgatgtagcttagcattcacttgcaactgggtatatgacattgtcactatcaagaattgcaaaacagattagatgcaggacaacagtctgagcagaggttactgaattccctatataagcatgttcagagatctagtgaatgccaggtcaacctcccacattacattcacatgcctatcatttaactcaaaaaaaaaaaaatacaaaaaaacaaaaaaacccaaaaaactcagggagggtgaaagtggatttgctttccaggtcatatcctcacttatcttcctcatgcatctctaatttgttgtgtctaatgggagactgagcagcgctggacaaaattttttctctggaactttatttaaaacacactagaaaaatcatgtaaattttactataagccccaggttgaaagttaagaaaacataagaaagataaacgaactcctccttcacatttgctttccctagaattttttctaaaaccctgcaaatggcattttttttgtttcattgtaacctattttatttgtacacttttgtggcaaatatatgtccaaaagctattatgagttctatttgtatttgacaccagaacaaactattgtaatttgtagcaaaaattccgagtagattaacctccctaaacttcttccatttcacgttacatcatgaagcctgtttttgtttcattcttaattgtgcttggctcaaaagtggaaatttgctaagatgaccataatttttaaaacaattttctctaagggttcaagtatcataagggaatgtggatcctgctgaatcaacatataacccatcactttaaagacgtgctgataaaagaatttctacaaatattctcagcaggggtaaattttaaaatcattgttggtgagggaataccatctcccttttccaggaatcgatctgcctgcctctgcaaccccaaccctcaattcattctcaaagctttctgaatgctccattaaagacacattttattcaggttttccagtggtcacatgttcactaataataataatttccaggttttggtgatgtattgtgtttggaggaaatcgtgttaaccatttgaaaaatatttatttatatgaatactataatattatgaaatacatgacattaccactactttattgtgattattattttataaatgaggcttagtattgatccaaggaaacacagttaatgaaaaagagatctaggaaaattcttatcacaactccatattgcttcactaaggagattcggaaaatgctacgttgaatgtttattaaaagaaatttttaaggatttagacaataatattctaatagtattatcatttagacaataatagtctagtaggggatgtaggcaaaactttcctaaatttatttattgttttttcttaatataaggaatagtataatctaatgacagcatcctagattttagggacatacttggctctaccacttaatagctgtcccaattttgaaaaattactaaacagttatgagcttgttctgtcatttgcaaataggtttaatatccccaatttttttttaactaaaattttttgaataatatatgtatgtacaaagagtacatatgtgtacatatgtttaatgattttctgaaactgaggacactcatgtaatgtgcatgtaatccaaacattactacattaccaaaatcagaagtctccctaatcctcccttcattcattacccatcaaagataaccactatctttacttctaacagaatagtttcattttgcctgttttgaattttatttaattagactcatacaatatgcagtctattatatctggctcttttcactcagcatttatatttgtgtgatccagccatatggttagctatgatatagtttgcttgttctcattgctgcatagtgttttatcctgtgtgtatactatatttacccattcctctgttgataggtatttgggtagcttccagtttgggactatgaaagatactgccatgaagaacattctactacatgagttttggtgactgtatagacacatttatgttgggtttctacagtctgttttaacagatatcactgccactgttttttttttaatttaaaaaatttgctgaagtacacataagataaaatttaccttgtataccatttttaattgcacagttcataaatattaaatatattcataatgttgtgaacccatcacaaccattcattttcatcatttcttacatcttgtaaaactgaaactctgtgcctattgaacagttactccccattccccatctcccccagggccctggcaacaaccactcttttatttgtctctatgattttgactgttttatgtaccttgctatggtttgaatgtgtgagtctctgtaaaattcacatgttgaaaattaatacccagtatgatagttttaagagttggggctttttggacagtgattaagtcatgagtactcctccttcattaatgggattaattatcttatataaaaggttgaagagagcatcctcatcctttctccttcttctaccagacgctgaatctcctggttcctttatcttagacttcccagcttttagaattgtgagaaataactttctgttatttataaattacccagtctgtggtatttgttatagcatcaaaaacagactaagacacatctcatataagacaatatcatcagagtaaaaaagtaacccacagaatgggggaaaatatttgcaaattatgtttgacaagggattaatacctagaatataaagaactctctaaaactcaacaacaaccaaaatctgattcaaaaatgggcaaaagacatgaattgatatttccccaaataagacatataatggctaagtagctggtgagaagatgcttatcattatgggaatgcaaatcaaaactattatgagatactacttcatacgtcttagccatcccttaggatggctattaccaaaaaacaaaaaacaacaacagaaaacacataaaataacaagtgttagccaggatgtagagaaattggaatccttgcacactctaaagtggtacagctgctgtggaaaatattctaaaaatagaatttccaaatgatccaaattttctgcaagcagagtctcaaaaagatattcatacaccaacatttatagcagcgttattcacagcagctaaaatgggaaaacaacccaagtgtccattgacagatgaatagataaacaaaatgtggtgtatcatacaatggaatattattcagccttaaaaagaaaagaaattctgacatatgccacgacatgatgaactttgagaacattatgctaagttaaataagccagttatgaaaagacaaatgtggtgtgatcccaaactgttttttatatgcactaaattaaacaatatatatggaagactagcatagtgtatggtaacttatcaataagtggcacaataattctatttatataaaagtatttctgcctaatgttgaaggtgaattggaagaacttatggtaagtgagtttttcttagatattgatcaaactggaaacataggagattagaataaagcagtgagacattgaagtacaaacaagcaagtgccataaaggaaaaaaaaaaaaaaaaaaactaggaataactgttactttgctcctaacacttctgaaaccaaatatatgggttttccactagcaattccttaattttctgtggacactaagtgtctacaatttatttcaattttcacactaatttatctcttagatgctctgtgccaggaatgaggcacaaagaccaaatacatttttcttattatatcacaaaatcactaagacaaaaagacaggccaagtattggcagattgagaaggcagtagccatctaggaagttcagataaagcctatgtttctagttactccatcaaaggtaggaatgttatagaaattttaggggagaaaacgtatcatcttttcctaacccatcccaaagttcatggcagctacccctataataaaagacatattaacaagagaaaaacacaccaattcatttaataattactgacacaggagccttcataaacaaagaaccaaagaaaaagagaggtttgtttacttgtttggacagccctgcagaagtatgattgaaagacaaataaggatgatctaatggtaacaaactggggtaaacttaggcctgtttttcagattcatcttagcatctctctatcttagagaataaagatgttcatttcctccaggtataggagggctacttctgaaatgaatctcatgacctgttttagagaaaggtcagaaaattcttttattgcctgcttcaggggagaaggggtgaaggtcagagggaccctcttgcttctgctttctcttcagatgccaaggtgacatattttggtgtagcatgttctgaatcttatgagaagaaccttctttatctatttatttatttttgagatggagtctcactttgttgcccaggctggagtacaatggtgcaatcttggctcactgcaacctctgcctcccaggttcaatcaattctcctgttttatcttcctgagtagctgggactagaggcatgtgccaccacacccggctaactttttttttttttttgtatttttagtagagacaggatgtattagacttttcatgcttctgacaaagacacacccaatactgggaagaaaaagtggtttaatcaactaacagatccacatgactggagaggcctcacaatcatggcagaaggcaaggaggagcaagtcacatcttacatagatggcggcaggcaaagagagagcttgtgcaggcaaactctgatttttaaagtcatcagatctggtgagacttattgactatcatgagaacagcacaggaaagacccagccccatgattcaattacctcccaccaggttcctcccacaacaaatgggaactgtgggagttacaattcaatatgagatttgggtggggacacagccaaaccatatcacagggtttcaccaggttggccacgctggtctcaaactcctgacatcaagtgatctgcctgcctcagtcattgcgcctggccagaagcaacttcttttacttcatactctttcctttgtcaacattctcttggatttgccctacagatttgttcagcagaaatctgcttgttgacttacataagctaagcatcataaatggtactggaagttttcagcctgaaaatgtcagaaataatccctggaagtattttaatctttgaaaattagaaccctgagtggccattgaggttttctagcccatcgttttctcaactgtttgttttaggttggatttcccctgagacaaaaattcaaaactaagtagtttgggaaaaggaatgcatggcagcagagtaatggagaagtaagacgagaaagggaaggcagccagttgaggatgatgtaggttaatcatcctacagaaatttttggatgacattgtaagacttctcttaaatattggctggaggcttattgcaggggttttaattccacatttctgtcctgcaacaagagtaagaaaagtgtgtcttggcagaaagcctgttgcaaagaaatgtaggagctagatgttggcctgacttgctttgaaatactagtgttggaagatatgaagagaccaggaatattacttgtaaaagtacattatgttgatgttagtctataaaaagtatttcatggtcaaaaatcttggggataaaaagccaggttacactgcaggacttttcttattttatcattggtaaatgtgtagcttcagggtaggaacatacagtgatgctctgaagttggagcttaccactcggtaaatgttaattgttaaatattcgggaattttgtgaatcagttgttaagttgatggtagcttgaaattgggcattgtagtaatatttacatcacggaatttggtatatgttactaatcagcctccactattgccagagtttgtttattagtgcatcaccaacattgtgcacatttttgtaaactatacgcaccatcaacccttaagttactaagacattgtataggatcagtgctgtatgtgggattcactaataaaatccaattgcttatttttacaagggaggagcattaagttcatgtaggtagtaatttatttagaaaaataaaattctcactacaaagaaaaaggagattgggaaggtaaacttggaatttgtatgtgaaatgaggtaaggcaatgtggactcaaataggtagttcccagttatttacaatcctgttgataaagttctcctgttatttctatcaattctcccaatagcttttattatttttgtttcctgaaacaagactttggaacacagaagagtttacctcagacaatctttgactattaaaagccttagttctctcctcagaagggtaactctgataaaataatctccttttaccgatttctatggaatcacatataagttggttggaggataggggatgacaaaaaaaaaatcaaaaaattagaaaatgaagtagaaagggttagttcattaacatttttattaatcacatcagtgggcaaaccaatttatttactatccctcaaagaaaatccaccaaaaaaaaaaaaaaaaaaaggagagatacggtctagatactttagaccatggcaccctctggttataggtcattacaaaggaaggaaaaagtaatatctcttccttacccattgtaaggatcatggctgatttttaaaagacaggttaaggccgggtgcagtagctcacgcctgtaatcccagcattttgggaggccaaggtgggaggtgggcagatcacctgaggtcaggatttctgaaaccagcctgactaacacggtgaaacactgtctctactaaaaatacaaattagccaggcgtagtggtgagtgcctgtaatcgcagctacttgggaggctgaggcaggagaatcacttgaatccggaggcggaggttgcaatgaactgagatcacaccattgcactccagcctgggcgacagagtaagactccatctcaaaagaaaaaaaaaaaaaagtcaggttaaacaaattatttaacaaagttatacatagcacaggaggctacagaaataaagacccagggaaagctgtatttttgtgctcaggttccacaaagaatgaatagttgtgtagaaatgtgattgggcaaaaaagagtgtagcttacagtaatgaattgggggtgtgtggagagattcagcaagtcccattttcattcagattcatgttggcctctctgtgtagcattcattcttcccaagtaagagaaagaactcctctagaatgagggtcttatgacctacttttcaggcaagcgaggtcagagaatttttttatggccatgcttcccataaaaaagtggaggaaggtcagggcgaccatcttgctctttggctttctcagttgccatagtaacatattttgggggtattgtgctctgtgctgtgatagaactaagatcagaagaaaattaaaagcgtcactatcaaatagaatccaagtcatttcttaattattttggggtgtgattctgtaggagacttacattctgcattgtcaaattgatgggaattgtgaaacagtgatcacaatggaaataaaatgtaaataatagtaatagaaataagaacaataatgtatattttagagtttatacagcactttcacttacaagattacttccaattttaaattgcggagttacttgttaatttaaataattaatgtaagcggatgataacaacataggtgctagcatcatgtccttaagcccaatgacttccaagaatattttgggttttagacagtgtaaattctaataaagtttaactcatgcttttgtgaaggtcactaacatgttttcttttatttatttaagcttctgactggatttgcaatgaactcgattctgaaggttggcaaattccaatacttacacaacctttcctgtaggtgttatctgatacaatgaggctgagaaaatttaatcttttctctgccaatctgtagaattgaagaaacagtttttccaactttatattccaaagcccaatgttatattctccaatatagataaactataagaatcaaagttaaattttttatactttgatttatttaaatttcttatataaaattattttatactgcacattgcaagaataaacctatctggcccatgggctaattgtgaaacttaattgtgcttactgtgcaagttggtctccaccttctgcactactcaacatgtagttaaatatctatagtccttaacccttggtgtactggagtcacatgtaacaaatcccagctatcaactctaaaattaggaaaaatatttttagtttaaattctatgtgtgcgtttcaagattaggtaactcattaactaaaatgacaatagctataatataatcaattcatcaaatactattaaaatataaaaaccaatagtttatatcaatttagaattactctggcttagagttaaacatttaaataacttatagttatttaattttcttttggaagataggtgaagtcagttcatttggaaaacacagattgttaatatgctattcatatgtggtcactgtcatattttcatattaagaacttatgacatggctcgcctggcaatgtggaaatgtataatatgtaacaaaagagatctgtattccaaagtgagctgtataattgattaaatgtatgattctaaaaatgtttcatatcactttgccaaaacaaatattataaattaacaaatgaataaataataaataaaatgtatattagcttgagtaattttattaatctcaagttattcacatgtggagtgggaagggatagcctgattttgcagaattcctgcagaaacaaacttgttgacatgtcacagatgatcattgagttagtttcctttttactgcacactctttcagcatgccattctattcccatttcagcatctcacctaaatctgccgccccaagttccaaggacatgtttcctctttcatcatacctcctataagtgcaagtctcactttgccttagtgtgaacatactttaagtttatggagaaataggcttcataagactggcatagccaagccttaaggtatttagggaaggagtgaataatggaagaaaagtgtgtgagaatcaactttctgaaaatgagggagtttttaaaccctaatttaaaaaaatgtttttaaataacatttctttctctattttctcctgtaataagggataaaatagatttttttccttatgcatttgtgtgtgtgtgttagatttatgtgttacattgtgttacattatgaagtggttagatttgcttaggagaccactatataaatgaattatgatgatacaaaggtataaatgaaaactttactcactactgaaaaatacttggcacattacctagaattttctttatatagttatataatagggaaatatagctattaaataactatcttatcataatgctgcaaaagcatagtgaagtccagaggtgtgttttccccactaaaggactgagtaacgcattcaacctgcatgtaactgcagaggagcggttatgtttataagtagttgtgttccaggtagttaacagccttctttttgtttgttttactgaagttactggtatccatttagtttgtagatttcagaattgggaactatagttgtaaacctgaggaagtcaaagaagaaatgaaatcagtacacacacacacatatacatatatatgcacacacaggtaaattttatacatatatttacccagattactgtgcatttttcctgtcatatttagcatataagttgagccatagaatattgccatttttgtaagttagaaagaataaaagattaacaattacatatggctcaacctaattgaagaaataaacacatctgttgtcaaggttctgtataaagataatagccactctttctggagggtattccacataacctggttaacaaaatttaaaatattaggccatttaatttaattgagaaactagaatttgtccattccgtccgacaaatgttattgtctatcatgtgaaacaacacagttaatgtacgtgctcttataaagcttacttcctcgtgggtgagatagaagttaagatacacaagtaagataggtgtatagtgtgttgtaagataaaaggtggtatggacaaaaataaagcagggaacaaggagttactgtcaagaacagagttataattttaaaagataatctgggaattcctcaaaagaataaattaggtcataaaggaagtaaaggataagccatgaaaccatctgtagaaaaacagcctcattatactccgaagaggtaccaagtgttgctgttaccgtgtatgctcagtgtcactgatttgcctttatcctgtggagatgggtcagtagcaagattgtagctcctacagctcccattaggtcttctctttaatttctctgagtcctcaactgggagttcatgacaagtagtatcagtgtcttctgcaggtcacactcactgttgaggttacagaaaataagaaataaacttgggcctcagtttgtccacctgtgttccagtttgttttcatagacttcaggttgttattgaagattctatcttatccttgcttcactctgttttgcttccagtttttcttattgactgccagcccttctgccctactgtgatttgaggctagccaccaaatttagaagtgatagacttccatagatttctccactagccctcagaatcctgcaagccttaatccacaggatacattccatattccatatcacttttaccggttttgctctttaaattcaacatgaatacactaatcccccccttaatagcctctgaaatataacatatccaaactgaatttctgatattgcttctagcacagatttgctagtcgctgtcttatctgacatagttaatgtcaactttatcctccttcttgttcagccaaaaatcatggagtaatccttttttttttacttttattttagtttcaggagtacatgtgcaggtttgttacatagataaattatgtgttgcagaggtttgctgtatagattattttgtcgctgaggtaataaacatagtatctaataggtagttttttcaatctcgatggttctctgaggcacatcccacattctgtctttctggaaattatactgctctacctttaaaatgtgttcagtatgcagccttccaaggcatttcactctagcccaaactatcttgtcctgcctagattagataaggtatcacgtccttcctagattatattagataagattatctgtaggaagtaagtatagataaaacagagaagaaatccaagggctaccctagttttcaaaggtcagcgaatggggccaaggaaactgagaaggaatagccagagggtgggaagaaattccagtgagtatgggaacctgagaaactatgtaaaacaaacaaacaaaaaaggtggttgaaggaagagaaagtgatcatttgccatctcaccctatgattgaagaattatttcatcgacaatatgggctgttgtgtttcatcagagtttctcacctggatataaaaaataatgtatattagaccgtttccctatggcatttgatggtagaaatgtataaaatatgtattttttatgttatgaggatgcattgcagaatgatatttgatgtaaacataacttttacacaacattttcatccatatttctatgaatacctcaatgatgttcaatatcaccttgagatccttatttactgaaaacacaggtcagttgaaaagctaacagtgaattaagagatacatgggcctgtcttgttaaaaaaagaaaacttcttcaattccccttctgcttctcagctcattgtttactagtaaatacatattctaacaactcaagccacctgaaatatcaataacaatttgccagttgctgtacacataaagaactgattctagactgagcttttatttccagattccagaagagccacttaacctctctttgcccgttaaaaatagggctaaattattccttagcacatgccataatgtaaatattggtaagataacataaataaagctatttaaatgtctcagaaagagacaaaaatagattcttcctgtgagtttccaaggattaggtatgaagggagacattatgtgggttttgctctgtgttttttgtttgtttgttttattttttggactgcaaaagagaaccaaatgatatattgttgcctaaccaaggaattaaggaaagtggcagccactgtcacagaaaactctagtaaatagatgatgctttcatacaggctcgctaggcatattcacatcttaaagatgcacatggaattcttaagtacagcaaacctagagatctggctccttggaaaacaactttcatttttgccctggtttgtggtgcacttaataccatgccactcatgccatatgcataggggtcactctagtcttttccctctttgctcaccacattcagtctttctctaaattttatccactcttcctcttaagaatcttgataattacttttgtccagattgatactgttttatttcagactgacaccattctctcatgtttacttaggtgatcatctcccatctgatctcctgaacaagagtcttataattccctattctttcctcagtatgcacagaatacaaattccttcttgtctggtagttctctattctcttcagttatattcctgccacttcctaaatagagcctgtattaggctgttgttgcattgctgtaaagaactacctgagatgaggtaatttataaagaaataagtttaattggctcatggttctgcaatctgtacagaaagcataatgacatctacttctgcggaggcctcaagaagcttccagtcatggcagaaggcaaagggggagcaggcacatcacatggcaagaatggagcaagagagagagagaaagagagagagaaaaagggagtcaggggtggtgccacacactttgaaacttccagatcttgtgtgaactcagagcaagagctcacttgtcaacaaggggatggcccaagccattcatgagggatccatccccatgatccaaacatctcccaccaggtcgcacctccaaaattggagattacatttcaacaggagatttgggtgaggacaaatatccaaactatatcagagcctttgctccagacatgctaaattactcagtgtggtgatgcacctctagcttttgaatgtttattctctgagatgcccctcccttcttcacctgggaggcaggatagaatagtggtcaatgatcccacaaacttatgttcaaatcctaaccttccagtacatgatgatgagcaaagttcagaacttccctgtgcctcagtttgtcatgtgcaaaccggaaataataacaacaccttcagtggctgtcatgagaaatgagattattaatgtttgtaaagcacttggcacagtgccttgtacacagtgaacaattggtagtgttagctattattatatttgcccatttccaattcaacattttgtaagttaaaacttgcttatttattttctgtggaaactttcccaccatctttctcttcttatcttcaggcgaattaataacttcctcctttgccctatcttttccattgtagagaataattctgacacatagtagaagttgtttatgtgtctgccttgttcactggactgtgaaaaattatttcttcatcctcgtttttcctgtgtagatcctagaacataagaagtacttcatggatatgtattgaaggggtgaatgacaagtgagatcaagtggtttctaccactaaaaaagagagagataaaagagaagtcttcatctttattcctagagactatgtatgtggtccttgagggctttatgaaagagtcttccttctgatatatgtaaatgctttctttccttgtgctgtgaaatgaattttctatggagaacagctctttttctttaagttttacttctagagaaagtccttcctttcttgcaaatggtttctttatcgacccacacagctaaagttccagatgacttatggtagttacagcttagtatgctcacaagaagatatttaaatcctagtgcgtttgaagtttctcagtgttattaaacaatcagtatgtgccgggagcggtagctcaagcctgtaatcccagcactttgggaggccaaggcgggtggatcacgagatcaggagatccagaccatcctagctaacacggtgaaaccccttctctactaaaaatacaaaaaattagccaggcgtggcggtgtgcgcctgtagtcccagctactcgggaggctgaggcaggagaatgacatgaacccgggaggtggagcttgcagtgagctgagatcgcaccaatgcactccagcttgggcgacagagtgagactccgtctcaaaaaaaaaaaaaaataaaaataatcaatgtgaaagcaaaattgattattatattattattaagtagaatgtcctatactatattgatttgctaggttgagaatgggaaactgaatctgtgttgttaaaatgtaggttttaatttgaagtagaaaggtgttcaattcttcataattaaacccccatacacaaattttcctataaatgaatctatatcattatttttgtaatgtaattgcaaaatgcaaatttattacaaatttaaataacagtactgtgaatgaatcatctatgttaattcttatatgcaatattgatcttactctttctaaaaatgtttttatattgactttgatgcatatggaaagaaattacgaagtatatctcaaatgataatcaaaagtttaaggagtttagctttaggcattttgaaaagtggctatggaattggatgttttgatacctaatactcgtctttagtgaggaattttaggaagttaccaataaaaacaatttatcttaataatataactctccaagccactggtgtcatataagtaagagttgaaagtggactgattctagaagatacttgctttttcctgcccagcctttagccccttaaagcagtagtatctctcttttagtaagaacagatgggttgggtttgttttcagcctccagacctctcagcctccactttgctcagagaatcaacttccttggaaagctgaaatatctcttcatcgtgggttttcaagtataaaatgctctgagtgtcattaaagtagcttgtcaaaatgtcccttataaaagagagtactgatctcagtctccatcccagaatgagcaataatcagagccataggatgaagttcagatgtacttaaactgtttaatcactgaaggaagtgcaatggagcatgtgctaggtgggaatgctgaagtctcgattcaggagtgggtttggtttgtattagtgcatctctttcatctcttatcttcttttttttttaaaaaaaaaaaaaaaagacttttatcacccggctacttttgcatgattggtgacttatgtaaactttataagccttagttttctttgtataagaaggacattatatttagcttttataatgataaaaaataattttgtgaatctcctagtcccatgcctggcttgcagtaagcacaccccacgtggtagttagaatgatctgaacaagtcattttcctctgtgaggctttttttcctctgtaatatggcgactggatcatcttatttctaaaatctttttttttcagctttaatattctgtatctctctgatagtgtcacctcaacagtaaaagtttagattatagcaatgcatgataaattaggtggttaaaaagtgtttttaagctccttaaagcacaactaggatgtgaaaaaatatagtcatgcttatccaagataagagctcaagtgaaatttagtggcacttatggaattgaaatgttggaaaaatattttgatctcatttaataataccaattatatatactaatatattaatatataaccttgacccagtcaaatcttgattttaattgatgccataaggtcagatatctggattcaggattttctttgtcattcagtaatctgataagcaccatgttaaatgttttacaaacattagttatttcacttaattctcatgacaagcaccatgttaagtgttttacaaacattagttatttcacttaattctcatgacagccactgagggaggtactattattgtttccactttgctgatgacaagtgacatataagacatataggtaactcagtttttggagtgattttcacattctttttctgggcggtatatttgagactttttttagtatttgatattcagtttatttacattttggccgaaaccaagcaagaaagaattcatttttttaatgttccattacatattttaagacataacccattaccctcagggattaaatttagaagcgtaaattcttaaaataaatcatttgagaacagtaaatgcagtggttttgtcctgtgaagtcagacatctggattcagagtaggcatcattctttggtaatttgattattaacaatgctcctctgaggatcattttcatcatctgtaaaatggaaataataatatatcaattgcacctgctttattatgagcaataaatgaatgctatcattaataacaacaagttattaataacaacaagtatgtgtctagagatgcatcaaagtgtaataataactaagatatttcggacccggtgctagagagatttatgcaaaaactccaatttgtataatactcttgaaacttatacaaaaaatatatcgtatttctagttggctcatggttgagttggataagtatcttacataaaggtgtataacatccctaatttacaaatgaggagcagtctcagagaggtacaagagcccaatgaaaattatacaactgatgaatgagagagttggaatctgaaatccaaatttcaacagatctgtttgtcttcaacgcccacatattttccaaataatctacaaaaatgatgaatacaagttcttgaaaaacaaaattaattttccaaattctctgatagtgagaatttactttcctcgaagtagatgaatgaaatgagggattggtatttttttctaatctgtggttcaagatgcagatttgtcctcagtaaagacaagacatgacagtcatgtccaattgcacagtgaaatgcagtaaaaataattgttcaggaaatggtattactaagtgcatcacaatttcttgtaccagttatttttctctttcccaggggtagcctgtcatacactgtgtaatattttcatgtattatgaacatatcttccagctgatttttgcaaatatgtagataataaaatttattagatttttattgctacgggaaggttacatatgcttatgaattagttctttagaaatatagcaagcatggggcatcttgtaatcaaataaactatttagatactaggctagaaaattctccaagctctttgagttgcagcaacttgatttttttaaaaacaactttggtgctgtctctttaaatggattggcaaaataaagtaagctgtcagtggaaatgttttcaaaaaatatctttgcagatggatgacaagatggatgatccgtcttttaggtagataatgtttaggtttcttccatcaagaagcaagacaacaaacgtggtttcctctgtaagaaagtttaaatagaaaagttttctttgcttttatgagaatgtttaattaaatttattagcccagttgaaaactgctgggcatattttgtttctgtaccatagctaacaaatgggtttttagaaattggcatggttctggaaacttgacatgtcacttactcttctgacattaataagcagtgtcctagaggtggtatgtgaagcacggcggggctgcaattctaataaattatctatgttgaaagcatgcgtatcaatctttacaagaaaaataggaggctttaaactttcaatttctttaaaaaagtcagaagtttgcagaaattatatgaaaaattatgggaagttttactttgtcatttatttgtttattcaacaaatatttactgtgagattattatatatcatgctctatgttatgcaaaggacatttcttctgcttatctatacaggttcaacttaaacatcactttcacagagacgctttcatgaccccttacttggcttgatcctctgcaatatattcttatatatttttaactcctaatcatacattttattgttattatttacataatgtccatcttatccaattgtctgtaagtttgcacagaccaaaagccatatctgttctgctaattattttaactacaatgttcatagaaggagctcaatattttttgaatacattaaacaggatccatgaaaatgagttttaataaacttgaaatactattaatcttatggttaatgatattttgtttaaaagtataatagatatacagggaagacacaatctgggtgcctgggaatatcaggagttggcgactctgagaaaacgtttgtttgttactgagaagaaaagggaagggaggcaaatataatgggaagtgaaagaaagtcgtctagcacagcgtgtttggaaaattgcaagctgtggagagtgaggtatagcttgccaggaaatgatgttagacaagtggtaggaaccagcttttgaaaagccctccataatacctaagggattttcatttgtgtttttgttgatgggaagattttgaggaattgtaagcaagagaatgataggacttaatttccatatgagaaaaaacactagtagtagacctttgagtgaacagctacttgtagcctcaaatatccacattatattcctgggatatttggatgacttagtgatttagacgtttctgttgacgtatatgcccagaaatctctataggaatacacatttataattatgcctgaggtttaaaacttttctgttttttgaaatatattttttactgctttatcaattcacaatttgaattagttttcacgttttatattttacagaccataaaacatttatggtacatagtgtgattccattggttaatcaaatttgtatcacctgcctaaagactggatttcccatttacacattaatcaaataatttttttctcacaataacttataataggctagttatttttttaggaagcaatagtatacattgtagagttaagttttacagttgtgtacatttaaatgtttctatagtaataatttttcccacaatgaggctcttcattttatgagcaaaagacactaggcacagaaaatgaaaatgacaattccttactttatgttataggcattaaatttcaattattcatgcattttattcattggagaggaaagctatatgaaggagtcatggcagttgagagtgacagtgaatctaattcactctttgacatttactgagcgatatacacaagaaaaataacagtctgtatgtactctcaaggaatttttagcctagtgagacaaaagaaaaaaatatttgaaataaagtgtggaaattgttataataggtgaacgcatacagtgacaaaagagcatttaatctgtggactttagataacatttcgtcagggaggtggcactggtgccatgtcataggcactcacaggagctcattattcagagcctgaaaggaaacaacagagaagagcatgtttgacactatgggcaagtgaaaatccatgtcacttttaaggaagcaatgaggatgtatttgtgtggatgtgtatggtggggaaagacaccggttcaaggagtctcaggaaagaaataagaaatgagaacatggagttaattttgagctagagtttatgtaaatccaccaggcagttcagcataaaggatgcccttgtttagatttgttttagaaagggtaatttgatactcatgtgaagatggattaaggggaacagaaactagtgatgagatctgaaaaataataaatgtagataactgacagtaggattaggggaaaatataaggacttgaaattcatgtccaagattactttaatgactcactggaaaaggaaatatggaaaaatgggggcaaatatgattcagagattgctcaaatctttggatttgggtgttacggtgttatgtcacaatccaagaccataggatgtgtattaagatgagccaggctgatgatgtggaaggcatagtgtaagaagaagacttggaagtcacttagacaagtctcctcttcagatgctgtagtctattctatgatagagagacttttttgatgttcaacagtcagtggtgacatcagtggatgatctgagcttgggcaacatatatgaacagtcagaatcatgtttcacattgcagataatcagtggatctgaaaagcaacaaattggagtgtagaatattttggaatgtctttttcaagagtgttattaggaaaaatgatttatcgaaatcactgtctcatattttaagaatatgtagtcttaaaaattagtaaaatttaaaaagcaaacataacacagcatatagtttgctttatgtagctgtcttcttgttcgataaggggctatataccaaatgtttagctagtttaattgtcctattaattagcatttttctgatatgttgtacccacaaatatacacattcttcaacattaaagtagtgcctagaacacagtgcatattcaattactacttgtagaatgaatggatgcgtgtataaatgagtaagtacattccgttctccagatgctatcttcaaatcagttagtcaatagcattttgagttctaaacattaacaccttattaatttaagatatatatctattaactattttaccgacttcattgtagtttcagctgatactgagctttatattaccttcttatcacattattctctaacccatcttgaccctagatcttgcctcatgctgttaagtaagattcatgttagtaaacataactgagtagtttttatgtggaactagctgatttctgtcttctgtcagttactggcctccttgggggtaaaattaccttcaatgcagactttcttcttgcacatttcaaaaagcatgatgaaaggtttaaaaaataacatattttcagatactttgaatgtataattgaaaaacagtcaagaaaatgatgggaactgtagttgaggtataaaaggtatagtaaactacagtccttccaaacctttttcactggatgacaatgacattatatgccagaaatatttatatatatatatatatttaaaagcttctgatttattaataatagaaaaatagaatatgaattctgtagtaaaactaacttctgttcataacctggtataatggtgatttcgttgtgttactattgacagtttacttaatattatgcaggggtttttttttttggcctttgaataattgggttaggatatgttctttgtgaaattgtcatgagaattaaatgtaaaagcatgtacagatgctttgtgcagtgtagcacagagtgaatcttcagtggacaatatttctctactgaaagattatttcccctactatagaagtctaaagtcaaatgatggtctttctaattttatttttcatttctgtgatctgctaatatttatcactgactgtcattttctcttccatcctgagctgaatggatcctaagaagtttttgttgctacttttagccttctgagcaccagacatcccatacagaggtgaaccactcttagatttccctctttgcatgttttgtatatatccttttgtgacgtattctcatcactagtgtgtgggtgtgggtgtgtgttcattgtgtgtgcacattaggtgaaagtccctctttaaatgacattcattttaagagtgttagcttttagttttttttataagaatgtcattacacatttccccattctttgtgatggttattgttcttttagggtcctaaattgcaggaatccagtgctcccttcgcttccttcatgatgtttattcgtggatgaattttttgtccagggtctcagcatttctgcctccctgacttgtttacctagtgtttggatttccatctagggtagtatttctcaatattgcttttcattcattttgagatataattctgtaacatgatttaaaaaataaattcctatatttaggtgaatgatgttttcagtagcattaatggtggttaatatgacattcttaattatcatttgcctatatatgcaagctttaaaatttacaccacaaaattcattttcttcattttttctataagtgaagaaaacttgaaattaaatattactcatctgttgcacaaatgtagtaataatcattcatatattcagcaaatatttgtatgtatttccagtacatatcaggaactattatggagctggaaatacaatgaagaactagccagacaagatctctgttctcatggggcttatattataacaagaatttcaggtgttgataaacacaatgaagctaatacggtaaggttatgtgatacacaatagtcagtgggaccagctgttgtagcaggtttctctaaaatgcagcaacattttagctgaatcccaaataatgaaaagtaggtaaacatattgaaatttgtggaatgagtttcaggaagaattaaaagcaagtccaaaggcactgaggtttcaagtcttggtgtgttttaggaatgtctttgtgactgaagagtagtggacaaaaagggaataggaaacaaatgaattcagaaaaaaaaaaaaaaaagacagatttgggccatagaagaccttggaggccatagaaataaattttgacttatattgagtgtaatacaaaatatttaagaattgtaagcaggcctgtattataatcagatttacattaacaaaatgattctattcatttgtgaagaatggattatggaggggcagtaggggaagcaataggtccaagttggtgacttcagcaatattccaggtgagaaagactgtgccttaggctatgccagcaatagtgaagatgaagaaaactgacaatattattgagatcgaatccatagttataatgcagatattgaagggatatataaaataaattaatgattttcactaagtttgtaggcttagaaaatgagtggtacggccaggcatggtggttcacacctgtaatccgagcactttgggaggctgagacgggtggatcacaaagtcaggagatcgagaccatcctggctaacatggtgaaaccctgtctctactaaaaatacaaaaaattagccaggtgtggtggcaggtgcctgtagtcccagctattagggaggctgaggcaggagaatggcgtgaacccaggaggcagaggttgcagtgagccaagatcacgccactgcactccagcctgggcgacagagcgagacactgtctaaaaaaaaagagtggtacctgggtgggtgtggtggcttatgcctgtaatcccagcactttgggaggccgaggcaggcggatcacctgaggtcgggagttcgagaccagcctgaccaacatggagaaatctcatctctactaaatatacaaaaaaattagccgggcatggtggcacatgcctgtaatcccagctactcaggaggctgaggcaggagaatagcttgaacccgggaagtggaagttgcggtgagccaagattacaccattgcactccagcctgagcaagaagagcaaaaccccatctcaaaaaaaaaaaaaaaaaaaaaaaaaaatgagtggtaccatttactgtgataggaaaaccttggaggtatttctgttagggaaaacatgtaatatttgagaaggaaccgtcaagacaactagaaagatattagttatggtttttattctatcttaataaacagtgagctaagaagtaagtcacaaaattacattgatcttagtttcattatgtgaacttgttcacatggttgtagaatttgcttccaaatctaaagtcttataatattaaaaaattgaataaattacaaattcccccaataaagccctacacatatttattttatatgatcacacatatttattttatataatcatctgtttcttagaaattaaaaatatgctttttctgatattttaatgtgtgagttatgtgctttcaaaaatctcattttgtgttcatgcgtggtaccatgttattgaataataaatcactatcaattattaactaaaattttgacaaaataaattacaatccatgttacatttttatgccaaataaaatttttgcttactatatattatccatttgttaatgaaactataggctctatatttcacgtgagctttatctagtgaaacaatgttagatctgatgcttggaaaacataaacacaaacatatatgtagatctacatttgtgtacacaaatgtgtgtacactatgtgtaaacacacccacttcaaggcagaatgtttatgtttattaattttatccaagatatttagtctaaggtgacatctagtttttcaatctatttaattctaatgtaaatactcaggttttaaaaaaattatgtttccatgaactgtctgttaaaaagggtgtgagaaaatgtacattcttactatattcttactcaattaaatgaaacaatttagtaagaaaacttttattgtcacaatatagctttcccaagattatcccaatattggtatcaactctctcaaattgaaaacccaatcactttgtactccattttcctcccttccccattttcccctcttctgatcctctctcctcctgctttccccacttggtctctcagaaaactgcatttaatctggtcttcagtgtctttgtacacaatgatctttttataaacacactagatttgacactgttcttggtcttgaaataacattagtcaaaactattgcaaataaagtatgagtagggtctcaaggtgaaataaggtagacttttattttgttcaaaaaataaggagaatatttaagaaaaactataaatttgtcttgggtgaggactttttccatgctcatgaattttaaaatatgatagttttttatttacttatttcgacagaaatcccacaagcttccctcctcaccccctgatttttctccttcttgaatgggatcagtattttggaagcctgctacatattttcaaatagattccattttccttattgattagaaaaatagtttgcaactccactattagtaaagtgaatttttaaaaattataataaaagttggccgagcgcgatggctcacacctgtaatcccagaactttgggaggccgaggcgggtggatcacgaggtcaggagatcgagaccacggtgaaaccctgtctctactaaaaatacaaaaaattagctgggcgcggtggcgggcgcctgtagtcccagctactactcgggaggctgaggcaggagaatggcgtgaacccgggagacggagcttgcagtgagccgagatcgcgccactgcactccagcctaggcgacagagcgagactccatctcaaaaaaaaaaaaaaaatatatatatatatatatagtaaaagttaatttcagggaacagtttaggacgtttggatctttcattacatcttgcttgtgttactaaactgatgctctgtaattattgtcttatagatcttgactatgatatggtagttgtgtctctgagactcaggggtggtttaaaagaaaatgaaaccgaattgactgtcagtgaattgggagattacactactcctattttatcaaatgtcatacagaagacacacactatgtcgagccttcctcagagttgtaaattcacagaacactagaaagcctttcttcttagagagtattaaacttttttttttttttttcctaatttcactgcccttccaaaacagtgttaaaagcaccctcaccagatgcctggtatatcagcagcaacttaaataataaagcaaggcaaaccaattttccactgcaatattcactattttgattcactctaaacacttccctgcccacaaatggaaatgtctagagtttcactgaagatatactgcagtgaatagacccaactcttaaataattgaacagtaaaatcattctaaggcagtaaatgaaaaatcttttctgaaaagtttaccttgtttattttaaaattaaaggcaaaagaatacagcatgatttaaagtagaactacagaaagctgcagtattctcagtcctagaccaccaagatttctcatgctggtgtttaaatgaggagttaatatgcaacacagaacaattaaaaacatctggacataaaaaacctatcaacatctcatagaatccttttcaataaaattataatgtcattgggttttcaatttaaaaaataagacagatacaaatttccaataaggatacagctatgcaaaagaaatacatagtgtgggttttgttactttctaaaaccaattatgtataagattgaatggccaattttaaatctatgcagtatggcatattcagttgagggaccttggatttgtagcatttaattaccaatgaatgtaactttgctaggagttacagttacttgtcaaaccagagtgggtcagaattcaggggttatccctaggaacaaggcatatttctgctttcttcaggcccaagataacttacaatatcttttcaaagttttatttgtagatatactacaaaaagatcactaagaaatcttaagaaatattttttattattaatttattaccaacatttatggaacactgatgacacaatgaggagggcaaaatttctacctgaaaggtcactgcaatcttgcagtgaaatcagatgttaactaaataatagcataccgtgctattcttaaggaaaagtacattcaaaggtcttgaaacttgagggaacattttaggtgaaaagaattatagcaggacaatatgactaaaatagaaggggcgtaggggcatgatggaagttgaggctgaagaggtaggtggaaaccagaccaggcaagggcttgtggtctattatcaactctgtcttcgaatcagtaatctctgaggatgggacctggggctctgcatttataaaaacattccagtggttcttaaccatattaatgtttgagaacactggcctgtgaacaactcttagtgactgtctttagaagcccaggcttcattgtggataacccatgatcataaggcacaaccagagagggatggaaatgaatgtcactctagacaacagaaaatttccacagagatacatgcattagactagaccaagctgaatgacatttagagtttgctgtaggtctgcaacttacagattttatcccagctccacaaactttaggagaaacacacacacacacacacatacacacacacagacgcagacacacacacgcacaaaagaattaaaggagaaaactatagaaaaaacaatgaaagataggtaagtgagcaatattctggtgacttcttttgaagacatcaaaggataaaacttaccaaaaggccagaatctaaatagtcactttttcactttggcttttctgtgaggtcacatttccttttaatctctcacaatgatagggtatttgggtcataacacataaatattactggaatgactgatttcattaatgttcaaagacacaagcaacttagagcctactttagatagtttaaatctattttaaattgcatttgtaaaaattcactatgtttactacccattgaacatgcaaaaattcctgtgcagagagatttagaattaaaaaagtgtaataaaattctgattagtgattaagaaaaatcacaggtatcccagttactgatctcctgcactacagataccttgcacagctaccatccctgtggcagaaaaaaaaaaaaaaaaacatatctactaatattacccatattgttcagtggattttttttaaaatcaacttctgaatgatgtgtcataacctgcgtgaataacaaggcaaaattcgaaactgtgatgtctcagtgctgtcccagtcttatgttctgtaagctggaggtggaggactggcagcttctcagagatcttcaagctgggctggaaaaactgtagacaggcatcaaggtcaagagggtcacaaagaaaagtgaatttgcttttagcttcttcttagttggctgtgtacagttttaacttaggatttctaaagaaccacaggcaggagagaaatggaactctgagatctctgcaggtaggagagggaccagggagtaaccctgggttccagcttaaaatcaaagagggaggacaaggacgttgatatgtcctcctgtgcctttttcaaatggaggcattggcatgatgaaaccctgttagtttccttcaggaaaaactagccaactgctgagagaagaaaagctctgctgccaactattttattccctctgaaaagataaacaggaggaagcagataagcctgaataacctgcttcagagaacaaacaaaaatgaaatgaagaatgacaaaggagagaggggagtgaagtaagacagatgaaggaaagagagaatgattagcaagaccttaaccaaaaataaagagttctgggtgtgggcaggggtcattacaaaatgaagtcagaagagaagtaaatgaaaaactccagagtaggaaaagtgtgcgtgcatgtacacctcccccacagtgcacacacacaaagaagaggaagcacagctttctgcaaacacataaacacagaactttaattttgaaatttagtattttgaaattgctcaacttgtagtgatatgtaacaagtgctcaaagattgtgggagaaatatatgtgattatatatgtatatacccatatatacatatatagttactctgttgcacaaagagggttaaagctggaatcttaacattgattggctatagccattgctgcattgctgtgataagggtgttggaataaatgggtatctatcaagataaactgttgataaattgcagaaataaaatggaaggaaaatgttagattgttgtctttttaaattttccagagagaaacttgagtatgctgtgaggttctagagagtatgtgtgttacttggctggaaagttgactttgaaaagattatttcctgatttctaagtgtctgtgatttgataagtccagagttaacagctgacaatgccttcttgcaaaacatgattgtggataaaagaaacttgtatctagttttacgtatttttcatcatagtactccctgctgtctgtgttggtcgatccatgagagatagggtaacagtgatgtttaatgtgaagcagatttaaagacttagtgaaatagttaaaaacttaaacacaagagaagaaaatctgatttgtcaaggattattgacactacttaaataattgaaatacaaattttgtcagagaaaaaaaaacgcttaaagccttcataatcactttagtttctgaactactatgtaaactatcagaactagtatctgtatcaaaactaccatcacataaactttcaaattatatttcacatttaaagcactttggttcatctttcaggtctcatgtcagttgccacttctttctcataaatttcttggtagccaaatttcttccccatttttgagctaagtttccttcttttatatctttattgtccatatgattctcctaatataaaatcgtattgtccatatgttgtaattggctgtttatttgcttataatgccaacttgcctgaaggccaaaagccaagtaggcctcattggtctgtctccaaaacggggcaccttgagtgacacacaaaagacacacagaaagtatttaatgaatggcaatagctaatatggatagaaagcctattaaatgtcagatattattatgagatatttagatatattaaattacttaatacaataagtctttaaaatagctactattattaccgcaattttagagacaaaaaagtggaatttagtgatttttttagaatcttgctgcttgtaagaagcaaggctggccaggtgcggtggctcatgcctgtaatcccagcactttgggaggccgaggcgggcggatcatgaggtcaggagatcgagaccatcctggctaacctggtgaaaccccgtctctactaaaaatacaaaaaattagccgggtgtgatggtgggcgcctatagtcccagctacttggtaggctgaggcaggagaatggcgtgaacccgggaggtggagcttgcagtaagccgagatcctgccactgcactccagtctgggagacagagagagactccctctcaaaaataaaaataaaataaattaaaataaaataaaaagaagaagaagcaaggctaagagtcaaactcaagagttctgtttccagatcagtgttcctaacgattaagttgtaccatctctcaaatgaaaaacacaaacaactgactatctagcagttatcgtattacgttgaccttgtttatttatcatctctagcagtagaaacttttcaagaacaacgtcttgttcatatctcttgttccattggagcacaatgtctagctcatgatttaagctctttatgccaaaggcagagatattcagctctacactttgtccagggaagttttacacagagagatacaggcaattcatgtaatcagtatgtagtcacttctgtaggacttcttcttgaaaacgattagggtcttaagtgacattaacattttggaagcagaagctctctttagaaaaacagaatgagatgcttttaaaggagctttgaaagaaggtacaggcagtatagtacaaataatctttaaaaaagaaagaaaagaaaatgtatgaaatatattatgaatgatcttaactattccagaaacttacaaagttactgtctcttaaaattacatataatgaagagcttaagaataggagtcaaacacaaacttgattgctatgaacgttgtagcatgccatttagtgaatatcagaaagtgtttaatttatgtagacttaaaatattatattttaaacaaagaaagcaaagcacaccagcagtagtgagaagagaaaatctttaaaaactttggaaaggccaaagtaaaagagacagtttctgttttcttttttttcctgtctgctaagggactatttgtaataaataaatctctcatacaaatgtttgtgtattttgtgatgctgatctgtaggattcaaggaagagaccaagagatctccagtggaagatagtctccatgaggaccatgtcaatatacttattgatgtatctctagtacctagaatagtggagatttatattagatacaaaataaatatgtgtggaattaattaataaattcaagagtaaaatatgaaagtacctatcccccaaaacttttacttctataaaattggatataataaagcaggatacttgctataatggaagaaaagagaaatcaaatctatctgtaaaataatgaaatccattactgagaaaatggaccttgaaaaatgaatagaacaaaatatgagaagagatttcatactggaaaatgttgatgttatcacttgacttgttctatatttattaaatgattacattatctcctgtaacagccctgatcatcaagcaagaaaaaaataaaataaaataatagtcttgcacgcttacaggggactgatatggttttaaggtaataaaatagatattattataactataacaggttttatttttccaagtggatgtgttttattttaaaaaaagttgctttataaacataaaatatattattacataccagaatgtagttttctataatatcttgttaatgatccattcttttgtcattctgaaacaatgaaatataacttaaaaatatgcaaaaattacaaatcatgcaaaaatcactagtatccttagtaactaaagtttgagacacactataacaaaattttatatatacatatatataaatgtagttagaaataaaaaaattagaatatctttgtgtctttaaaaatgccttactgtaagttctaaaagagaagttttcaaaatgttcacaataatattaatgtcagagctgaatgaagacaacatttaatgaaatatatcttttatttcatgtttttattctaaataaaaaataaatggacagatagatagataaaatggatacttttttactttagtcccctgtataatgagtatgatttattacataacttagaggccagaggtctggatttcaattccatatttagtctgacaaactttgtgggtacttttggactaatcacctaacctctttgggcttccctgactttaaaatgatgtaaaattaagcagttgatgaaggggtttcctgaatgacattctgtaaaaatctactttgattttgtatttacaaccatagtcagcaagagatgaatgaatgcaatggcatagaatactctgaaacaaattatagttccttaaaatagaaaaacaataaaagacctactgtctagaatggtaataactgaactctgctgtaaactgatttctatctctgtaacaatttttcaaattggagaactgggaaacactcagtaatggtagaactctgaaagataatattcaccaaaacaactgggattgctaaaatcaaaacatcaccactattaattttgctgagaaataaattggtttctcatgagtgttattgtttgttggaaaaatattcgtgcattttctctcttggggctttgcaacattgtaagaattcccctcaggctgagactcacagtcaggtttacaagttggacatacccagggagagatctttagctgtaacccagaggtaggttctcaaccttggctgtcaatcagaattatcaggtcaaattttattaaaaagtgctcatttttgagctccactcagattaatcgaatcagaatttcagtgtagtggagctcagacacccatagttttacacacgtcacgtcccccacgcctgccaccgcgcgcgcgcacacacacacacacacacttgattccattgtgcaaacaaacagaaaaacctgcaagctcattgcctcctcctcatgtaagcatttaatgtattcagaggaaaaggttgaatttagataagtataaattgacccagctcacttccttccccaaacacaggaaggtggagacagctattgtgttctgccttagcattttccttgtggtgagaaacataagaaaatgtctgggttattatcccataaagaaggaaagctcattatttgtattaataatgctcatttatagttcttaaaagtgccacctgttttataattactaaagtgttacattttattgaaagttggatttttttttgtttttccctatatggtatttttttttctttaagttccagtatacatgtgcagaatgtgcaggttttttacataggtatacatgtgctatggtggtttgctgcacctatcaacctgtcatctaggtttgaagcaccacatgcattaggtatttgtcctaatgttctccctccccttgcccctcaccccccaacaggccccagggtgtgttgttgccttccctgtgtccacgtgttctcatttttcaattcccacttgtgagtgagaacatgcaatgcttggttttctgttcctgtattagtctgatgagaatgatggcttccagctccatccatgtccctgcaaaggacatgatctcattctttttatgcctgcatagtattccatggtgtatatgtgccacattttctttatccagtctatcactgatacacatttgggttggtttgaagtctttgctattgtaaatagtggtacaataagcatacatgtgcatgtgtctttatagtagaatgatttataatcctttggctatatacccagcaatggtattgctgggtcaaatggtatttctggttctagatccttgagaaattgccacactgtctcccacaatggttgaactaatttgcactcccaccaacagtgcaaaagcattcctatttctctacagccttgccagcatctattgttttctgactttcataattgccattctgactggtgtgagatggtatctcattgtggttttgatttgcatttctctaatgaccagtgacgatgaactttttgtcatatgtttgttggctgcataaaggtcttcttttgagaagtgtcttttcagtttctttgcccactttttgatagggttgtttgttttttttcttacaaatttgtttaagttccttgtagattctggatattagacccctgtcagatggtcagattgcaaaagttttctcccattctgtaggttgcctgttcactctataccacaaggctacagtaactaaaacagcatgatactggtaccaaaacagatatatagacaaatggaatagaacagagaccttagaaataacaccacacatctataaccatctgatcttccacaaacctgacaaaaacaaggaatggggaaaggattccctatttaataaatggtactgagaaaactagccagccatatgcagaaaacagaaactggaccctttccttacaccttatacaaaaactaactcaagatagattaaagacttaaatgtaaaacccaaaatcataaaaaccctaaaagaaaaccttggcaataccattcaggacataggcatgggcaaagacttcatgactaaaacaccaaaagaaatttcaacagaagccaaaattgacaaattgggtctaattaaattaaagagcttctgcacagcaaaataaactagcatcagaatgaacaggcaacctacagaaaagttggattctttaagctacagtatactttcataatctaattcaaatagttcagattacagataagataattaaggattagagaggaaaaatggcttgtataatgtaagagacaaaaacagacagagctagatgaaatttcatgtttcctgatgcctatttcatttcacattgtattcttggcacaaaaggggctgagaaatgttgtaattattaagaaatttggtattagcaatctcagtctccttaattccttaatatagaacataaattcttataatatttttacatatttactgccaaagtaatgtttgttaatgtttatttcttttaagttatcataaatcttaccattttctgtttgtcaagcagtttcatgagttattaagaaactactcgtaaaaaatttgctgcaaaattctgaaggaagattaaaaaatttaatcaagtcatactgatttcctgatgtaaatgcagatgccatatggtacccagtatttcagtggttaatagcatagactatggagttaaagtgagaagaaattctgactgtttcactttcaaagtttgggctataatgatcatgtataaatctcttgacctgaattttctcattagcacatgtacagtaatgatggtgataacaataacagcaacaatatctgatttgagcaagtgagaaaaattcatacataaaaaattcatagcaagagtctagctctttgtcaagaatagagcaagtactcattaagtcatcactgtttttaatattataaataattatgaagtctttaaaatttttttatcccaaatgggatttaaaggaatattaaatagattgaaaatgtagttattaaaaacaaccctgattttccaactagtgaaattaaaatatatcaaatttggtagaaataaaggaggttgaggctggttatatcaattcagcatatgaatattggaggagacacatttggtttataacaatcaataaggggataaatcaaaatcatgtgccatttgatagcagtgagaaaaccacagaatgatctctctggtatttatctcaaagctgcataacttgaaccttatcaagaagatacatcacaatagccaaagttaagagatactacacaagggaactgatttgtaatcttcaaaaatatcaaggttatgaagccacacacacacaagggcttagaatgattgagggagactaaataatcttgacaaccaaaagcaaaatatagttctagtctggaacatttcacaataataaacattattgagacacatgaaaagttgaataaagtccaagtttagctggtagcactgtatcaatgttgatttcttgattttgatgcttggattaaagttgagatcctcattagcatgttagcaaatctcaagtggctcaagagaaatacatatttcttttaatacttgttactttcctcaccctttaaagtctttcagtaggtaataacaaaaacacaagctattgacaaccttggaactgttcaagaatggttggtagaattatgtccttcaatgttcatccgatgtaatttcctctgtgtcctaccccctttccccagttctctgacatttctgacatatattagaatatatatggtaattatgtgccatattcaatattttttatactttccttttacaggaataaacatataaaattccaattcattgacttgttaaactatgttaaataagagattgatatctaagaacacaaaacagatttcaaggcttatttggacaagaggtagttactcatgatgaataggatgttgtccaaagcctctgaacagatagaacccaatatgaaccttcaattttttttttcactgatcgtctgagccctcaagaagctgcagaatgctgcgatctttaactaaaaagattcagaataaggataacactacaattttatgagacagtgtttatggctatagatgaaatgtatcagaatgacaactgttctgcatttttaaaataacttgtggaagagtaatatctaattcaggaaaaacaatcgacctggaaaacatacagtggtttctttcacattggatagaatcaagctttgaggacagaaagacagaattatgaagcttcaatttgtaaagttgtttcaattgtcatcattacggtgtccttctctgtaaaatggatatatatttggggttgctttaaggctaaaagacttagagtgtggaatcattttggaatttgtagttctacatgctcaatatactataattccctttactgtcccccatcttagtattgtatttgctagttatcactgtgaatgagttggatcttcacaatactcttgtgaatagaaacctgacttctcccagataaacaaactagatttcacaaatggttgcatgattattctctataaggacaatctaataacaggtaatgtgtattaaacatgtatatatcaggcactgttgttagcccttcatattctacaactctatttgttatatgttactattttttctcatttaatatgtggtccaactaaggcttagaagaaagttaaataattttcccaatatcacattgctgatatgtagtacagccaagataaaattacatttatctgatagccacaagtcaaggaaatattacacactactggctttactgtaaataaatgggtatattttgccattaatagtcatagcaataatttatgttttatggcatctagtcttttaataaaatattcatatacattctctttttgtatacttaacaaccttgtgaaggagatgtgtctcagtttatcttaattttgttttctaaagatacatttagactcaaataagtcacttgtccatgattatagattagctggtacatggaaaaggtcttctgattctaaacacagcattgtttacattgcacttttctctctgcatatatcgattattaatgtttttcttgcaaaaacctcatatattgtacgccgtgggagtaataacgtagcatttgactattgcccttagggaacaagctaagagcatttaagttcacttttgtgtctaataattttaagttttatttggccttcagatgtttttgaaaaagattttccccaagttatgaaattaagcagtttaagtatgtatttattttctattttcagttgcattcatatagtatcatgagatagcatataagggaatttttaatattttgggaccactggcactttgagcatgatgaaagatctggactctctccttgaaaaaatatgtatgtaaagaaatgttttttatacatactcaggcattttgaagtcttaattcaggcattttgaattctctatgaagctcacgtttcattcccaagttaagaaccactttcctttcacaaccttatcaccgttgctggcactaactgttagcattcacattctaggcactttatacttggtattttattctaataacagccatatgagatggttataattatcaattcaaatttatgtatgaggaaataaagttgtaggttgtatactcatgagcatttttcccaaaattacaatatctgagttctacctgtaatagtctttcatgttttgtacatattctttcaaataattttttaaaaagttgaccccaattagtctaggaatgattctccaggaaccccatatgtgtatttccctacccatggaaaactctcctttattgcaagcctgattttcaatcattagtctgatttcactgatagtgtactagttttagaaataggtccatgccaatggttaaatcttgttgttctattttttaaatcatttttgttagaaaaccatctattttttatagaggttaaaacttctagattgtagtgactgagatagcataaaaatagtgctaaatataatcaagtcaatttatcacatattaatattcaaaattgcatgtgctactgaatttagtactttagtacaattcaatattgatgaggagaaaaatccctagccttttatctttatggaatcctttgtcactgctaaatgatcattgcaaatgttcctgaagaaagcctgatgacttatctcttcatgggcatcttactgttaaaacacatttcctttcaaagaatatagataaccatgaaaatagcaaaatagttaagatacagaacactctcggggtccatttgtcaaagttaaattatagctgtctcagtttattcttgtctgctctttcataatccagaagaaataatcgaaatgatagtgagttagaatataaatggaaataaagcttaactctcactcttgatattgatatgcagtctggtaatgcaattagaatattcctgcacataagtaataccctaacatttctgtattgattattctctcaaatatcatgccatctagccccagcatattttgccatgaaaaggaaaagtggtttgctgcacccctttaataataccaattaattggtaaataatacaaaattttttaaatttcatttaacagcactttgtgggggacaattctctgtatttaaatggcaatcttatttttaagcatcaaggtctaagagctcaggatctgtagactgtatgcttactgattattttaaactcaattaatacctttcttattctcctcaaccctttcttcttatgtctataccttccacgcttaggcttaaaacatagtaacatttatcccagtctaagacaaatgtcagcaggttctgcaacagaaatacactagaaagaggcatagccttatataggaaacatttgacacgtaccagatggttttttgacatcatataatctcttattttgatctttgttcagattataaaacgtctgcaaggattggaaaaaaaaatcttaatataccatgctgatggtcctcttttgtagatgggaaagcactaaataagtttcttaaatctgtggttttcagtcctgtatgaccaaagaataatctatgaagcttgtaaaatatatgtatactcagccctctgccctagagattctgatccatagctctactgaaaaagtgaattggaatatctggagatgggggcttaggaattattttttaagatccacaagtgattcaaatgggtaaagttaagccgatagggttaggtaattttccaaggttaccaaagtattacataaatggcaatacagaaagcatgtctccatatttagggcactagatatttaggtcaagcctcatttgatgttcttttaatgcattgagttgtcagcatcattctatctaagaagagccacaaatttaccatccaaaatattcaatgctagcaaaaagcctcaacatttctccaactttataagaggtgttatataacctgaatatgattgttgaattaaatagaagtatatggattatttatttaaaattaatcattgaatttaatatgctattgtatgttctcattgttaaccatgtagtatgcagtaatgaaatgactttggagtagtgttatagactatatgtttctgtcccccaaaattcatatgttaaagccctaatgtccaatgggatggtattaggagatgaagcctttgggaggtagttaggtctaggtggagtagtgagggtgaaacttccatggtggaattagtgcccttataagaagaaaaagagacaaaaaactcttttgctttctctgccatgttaggatagagctagaaggtggctgcctacaagcaaaaagattggttctttctagacagtgatctgtgaggactctgatcttggacttttcagtctccagaaaattgagaaataaatgtttgttgcttacgccacctggtctatggtatttttgttacaccagcccaaactaggtcaggtggtaagggtctttgtatggagcagatatggtaggtaagaattcaaaaaaggtaaagtggtagcaggtagaattctacttcctgctgagtgacaaattatatatgcaataaaatttttctgtctcaatacatttaaatttttggaaattatacacatgtaactttaaatgccttccaatttctcaagaaagaaaatcaattccaaagggcaaacaaataattgaaataaaattattaagtaaacaaaaatatcctaggagcaaatgtcacatacaaaattaactggcacatagatattctaggccttgggccctagcaggttagagttgctaaatttaactccctgccaaaagggtctgtactcacggtgcaagtatagacagacaatgagcaaagggacagatgagacattttttctgcctctgcagtgtctctggattacaacaaatgttataatgatgataataaaaatgtctcccctaagattttgtagcatataaatattagcatagtatgaggaaactcacatacctcacaatgagtgtaaatagaccaaaacatccattttaattatctaaggtattgttaagctttaaaatagaaatatataaatatgcaaagatattgaaagtaaaaatataaaaaaatagatatactgacacttatttttaaaagttgtggcaatatattaatattagacaatataatatttaagacaaaaattattaacacagaggggcattatttaatattaaaattttcaattatatttatattattagttcataatttaaatatgttctatattataaggaatatgttatataatacataatatataatttattaaataatttgtatagtaaattaaatatattacctcccaagatgatgtaatagttctacacatatatgaattaataaaatagttttgagatttatgaagcaaaacagctattggagcttgaaaggcattgcatgaatctaggtatttaataggtcagtcagggaaaaaaagtctttagcaatgtacactatattaattgcacaaccaacaaggcgaattcagcaagcaaatgttgacctctgtactcaacaattatacaatacacccttttttaaactacaaaataaaattgatagcctgctgacaatgttctctgacccttaagctagaaatcaataatatttctttttcttttggcttagacgcaaatacttctaaattactctttggtcagggaagaaataataataaaaattttaattacctaaacttaactataatgaaaatactgctttaagattatatgtaatgttattatatataatgtagttataataacaattcagtggaaaagtaaatttacattgttatattaaaaagaatagctaaattattaatgatccaaagatctgaattcaaaagttaaggaagaaaagcaaattaaacctaagcaaagaagtaatagagaaaaaaataaattgttgaaacagaaagcaaggagtataagcatcaataaatttaaaagcctaataaaatatattctgaagctactgaacaaaagaaaaacgactaaaataagtaacattattaatgaaaaagaggatgtaagtgcaaatgccaaaatatatttaaaataaaaaacaagagaatactatgagaaaactgtatgacaatctatcttacaatttatacaaacatatatattcatataattactaaaactgactaaataatatggtgatttaacagagccattaaagaaacagagttattagttagaatgttcccaaagataaaaaaacaaaacaaagtggggccatttgattttagacgtatgttttaccaaaacttattataacaaattttcttaattttatacaattcctcagaaaataaatattgggtgattttttggtgcaacaattttagcctgaagttaatatgaaaaatatgacagtaatagaagtgaaaatgataggccaatctttcccattaatgttgtaaaaattgtaaacaaaataatgtgagcaaaatctagcaacattttaaagttataatggattataaaccacatctatcaagcatgttgaaataaaataatattaaccacagtggcatattaaaaatgtatagacacacaatctcaaaacaagatgaagaataatatttgctagcttatacatctatggacaacaaagaagagtgatatggtttggctgtgtccccacccaaatctcatcttgaattgtaactcacacaattcccacatatcatgggaggtgcctggtgagaggtgattgaattatgggggcgggtgtttcctgtactgttctcatgatagtgaatgagtctcaagagacttgatggttttaaaaaaagagagtttctctgtacaagctgtctctctctttgcctgccaccatccatgtaagatgtgacttgctcctcattatgtcctccacgattgtgaggcctccccagccatgtgaaactgtaagtccctttttcttcccaatctcaggtatgtctttattagcagtgtgaaaacgaactaatacagtagattggtaccagtagagtggggcattgctaaaaagatacccagagatgtggaagtgactttggaactgggtaacaggcaaaggttggaacagtttggagggctcagaagaaggtggaaaaatgtgggaaagtttgaaactccatatagacttgttgaatggttttgcccaataatacagataatgatatggacaatgaaatccaggctgaggtggtctcagatgcagaagaggaacttgttgggaactggagcaaaggtagctcttgttatgttttaacaaagagactggcagcattttgcccctgccctagagatttgtagaacttagaacttgagagagatgatttagggtatctggcagaagaaatttgtaagcagcaaagcattcaagggaagacttggatgctgttaatggcatcagtttcataaagtaagcagagtgtaaaagttcagaatatttgcaccctgacaatacaatagaaaagaaaattccattttctgaggagaaattcaagcttcccacagaaatttgcataagtaacaggcagccaaatgttaatccccaagacaatgagaaaaatgtctccagggcatgtcacaggtcttaacagcagcccatcccatcacaggcctggaggcttaggagataagcatggttttgtgtgccaggcccagggtccctgtgctgtgtgcagccaagggacttagtgtcctgtgtcccagccactccagtcatggctgaaagaggccaacatagaactcgggccatggcttcagagggtacaagccccaagtcttggcagcttccatgtggtgttgaacctgcaagtgcacaaaagttaagaattggggtttgggaacctctgtctacatttcagatgtatggaaatgtctgtatacccaggtggaagtttgctgcagggatggggccctcatggagaacctctgctagggcagtgaggaaggggaatgtggggccacagccccccacacaaagtccctattgcagcaccacctagtggagctgtgagaggagggccaccatcctccagaccttagattggtagatccactgacagcttgcaccatgcatctggaaaagcagcagacactcaatgccagccggtgaaggcagccaggaggaggctgtaccctgtgaagcagaggtgtggagctgcctaagaccatgggaacccatcccttgcatcagcgtgatctggatatgagacatgaagtcaaaggagatcattttggagctttaagatttgactgccctgctggatttcagatttgcatgagacttatatagcctctttgtcttggacaatttatcctattgtatcttggaagtaactaatctgctttcgattttactggcttatgtgtgaaagggaattgctttgtctcagatgagactttggactgtagacttttcagttaatgctgaaatgagctaagactttgggggactgttgggaacacaggattggctttgaaatatgaggacatgaggtttgggaggggccagaggcagaatgatacggtttggctgtgtccccacccaaatttcatattgaattgtaactcccacaattcccatgtgtcaaggaaggaactcagtgggacatgattgaattatgggggtgggtctttcctacactcttcttgtgatggtgaatgagttgcatgaaatctgatggttttaaaaaacaggagttttcctgcacaagctctctctctctttgtctgccgccattcatgtaagacatgacctgctcttccttgcctttcaccatgattgtgagacctccccagccatgtggaaccataagtctacgaagcctctttttcttcccagtctcaggtatgtttttatcagcagtctggaaacggactaataaaaagagggaaaataaagctactaacaaaatagaactagataggaatttacttaacatgctataatatatttattaaaaattttcaatagacattatatttttatggtaagttatcagatgcatccattcaacgcaggcaaggatccctattatatccacttctatttaagagtcaactgaagggcttaaccagaacagagagaaacatgaattcaaggatacaaaagaaaaaaaaaacactataattttgttgatcatatgatgatcataaaaactcagtttacaaaagccaacaagaaaaaaaatcaaatataagattcagctaaaattaagcttagaggaaaatgtatagcccttcatgaatattgataatctgtttccattgtcagaagctaaacatatacagcaagtcaaatccgccaaataaaagaagaaaataagaaacagagaactaaaaaattttgaaaacgagtaatagaaaaattgaagaacttaaattcccaagaacaataatgaaaaagacctcactaaataaaatattttgaaaaaaagtatgccaatacattcaccttttaaaataaaatagaacaatttctcaaaagacagctgaccaaaactgatagaaacaaagaaaaagaaatgaaataaaatattttaaagtctagttgtctattaaagagaatgaatctgtaactgaaaccttacaaggaaaatcccaggctttcatggcttctgggaatacatcacacatatccaaagtctatgagagaacagaaaaacaatgaaacaattactatattatcaagggcagacaaataaccttttatttctattgcagctacaataatccgcagttatttgacagttcatcacatcagtctctctctttttctttctctctgtctccctctatgtgtgtgtgtatacatatatatgtatttaatacactctctccatatatacatatataaacacatatatatgcatatatacatgtatatacacatacatatatgtatacatacatatatacacatatgtacgtatatgtatatatacactcatatatagtacgtgtacaacactctctccatatatatgcatacatacatgtatacacacatatatagatacatttctaattattaatattattacttctttttctcagttacttgaaaacacattacaggtataatatgctattttctaaatattcctgtgaatttctttaaaactgggatacatagctacaataatcatccaaatcatgaaatcagcattgtatatattcatttaattcgtaggtcccatttacagttcactatttattccaataatatatatatatttttttcctttctgcttcaggatccaatctaagatcactcattgcatatagttggcatgtctctttagttttcttcggtactgagtgattcctcagttttttcaatcttttatgatcttcatagatttacagtatacagacatttcgttctagaggtagtcctcttcatctgaatctgtctaatgttttatcatgtccgttctcaggccatgccttctagggcagaaaaacacagaaataatgctgtgctctttactggaggcacattatgtagatttttctcaacactcatggtctttaccattgttgcctgttcatattggtatgtgcctaccttctccattaaaaacttactattcatctttgtaattgagaaatacggggtggaggggggaaacaaatatcccagtccaccaaccttagcattcgttgatgaatattgtctgatcctgctacctccacaatttttgccaaatattgattttctgttttaatcacactttgtctacagattagttggcactattataaaatgggctttaccttcctcatttatttatatgttacctagtggatttatatttaatcaaatatttttatttgttactatcaccattaatttcaaaacttacgctatctcagttatggtaagtgggaactcatttaagctggcttatttgttcttgttgctattgtatttagaatactcccttaatttctggtacatagaatcatttaagatcactttgacttttatctgactcagtctgaagtcggtaattttagtaggagagagtatcttgggtttcagagtgctcattgctactgggtgtcattagctctagaccttctcagcaaacaggactaatatatgattgatatgatatgatatgatatgatagatatgttattactgctacagttatataccatttatttatccatttatctatctatattaaaacataacgctttcacactgaaacctacagatctaatccaactccttagagatatttctagtgatttcacttttcacatttatagatcccatccttaacagtaaaaattttatctccctttatcttcactacatttatttgtttgctcaatttgcttatgtttgaccagttatctgtgcaggatagccacctcattacctctgctcttgtctcattatcttcagctcccacccttccactcctgccttgttgcccctatacattcttagctgccagtttgctacttacccttgagccctactgcctttcttgtctttggccctgctgccttcttagtctagttatgctgtttctcttttgctttgctgcatttttgccccatcacagcctctgcatctttgtcctctgccttcttggtatcaagccttactgctccatctttggcctatagcctacagttgcctgttagagtttgccatcattttagccctgacaatggaaagggaatgaatgaaagcggaaacatttcaattctttttatgagactagcataattgaccacaaaactcgacaaggagaaatcagaaaagtacaattataagaaataaacacaaaaaccataatatcatctcaataagtgcagaaaaagcatttaatataggagcataggagcatacctcaaaaactaggcacagaaagagcatacctcaaaataattaaggccatatatgacaaacccacagcaaaacccacaacctaagtggggaaggtataaagccatctctctacaaacatgaacaagaaaatgatgccaattctcaccacactttttttgctactcagcattttttcatttaaaaatattattaaaaattagtttctgtgacaggatactcatttgatatatcttttttattattatactttaagttctggtatatatgtgcagaacgtacagctttgttacataggtatacacctaccatggtggtttgctgcacccatcaacctgtcaaatacattaggtatttctcctaatgctatccctcccctagccctctacctatcaacaggccccggtgtgtgatgttcccctccctgtgtccacgtatcctcattgttcaactctcatttatgagtgaaaacatgtggtgtttggttttctgttcttgtgttagtttgctgagaatgatggtttccagcttaatccatgtccctgaaaaggacatgaactcattgtttgtatggctgcatagtattccatggtgtatatgtgccacattttcttcatagtctatcattcatgggcatttgggttggttccaagtctgctattgtgagcagtgctgcaataaacatacgtgtgcatgtttctttatagtagaatgatttatcatcctttgggtatgtacctataattgggattgctgggtaaaatggtatttcttgttctagatccttgaggaatcaccatgctgtcttccacaatgtttgaactaatttacactcccaccaacagtataaaagcgatcctatttctccacatcctctccagcatttgttgtttcctgacattttaatgactgccattttaactggcatgagatggtatctcattgtggttttcatttgcatttctctaatgaccagtgatgctgagctttttcttcatacatttgttggctgcataagtgtcttcttttgaaaagtgtctgtttatatccttcacccaatttttgatggggttgtttttttcttgtaaatttgtttaagttctttgtagattctggatattagccctttgttagatggatagattgcaaaattttcctcccattctgtaggttgcctgttcacttcgatgatagtttcttttgctgtgcagaagctctttagtttaattagatcccatttgtcaattttggcttttgctgccattgcttttggtgtttaattcatgaagtcattgcccatgcctatgtcctgaatggtattgcctaggttttctcgtaggagttttatggttttaggtcttatgtttaagtgtttattccattttgagttaatttttgtataaggtgtaaggaaggggcccagtttcagttttctgcatatggctagccagtttttccagcaccattcattaagtagggaatccattccccattgcttgtttttgtcaggtttgtcaaagatcaggcagttgtagatttgtgttatttctgaggcctctgttctgttccattggtctatatacctgttttggtcccagtaacatgctgttttggttactgtaggcttgtagtacacttagaagtcaggtagtgtgatgcctccagctttgttctttttgcttaggattgtcttggtgatatgggctcttttttattccatatgaaatttaaagtagttttttctaattctgtgaagaaagtcaatggtagcttgatggagatagcactgaatctataaattactttgggccatatgtccattttcacgatattgattcttcctatccatgagcatggaatatttttccatttgtttgtgtcctctctgatttccttgagcagtggtttgtagttcttctggaagaggttcttcacatcccttgtaagttgtattcctaggtattttaatctctttgtagtaattgtgaatgggagttcactcatgatttggctctctattattggtgtatagaaacgcttgtggtttttgcacattgactttttatccttagactttgctgaagttgcttatcaacttaaggacattttggactgagataatggggttgtctaaatatacaatcatgtcatctgtaaacagagacaatttgacttcctctcctcctatttgaatatcctttgtttctttctcttgcctaattgccctggccagaacttccaatattctgttgaatagaagtggtgagagagggcatccttgtcttgtgcccattttcaaagggaatgattccagcttttgcccattcattatggtattggctgtgggtttgtgataaacagctcttattattttgagatacattccatcaatacctagtttattgagagtttttagcattgaattttgttgaaggccctttctgcatctattgagataatcatgtggtttctgtcattggttctgtttatgtgatggattacgtttattgatttgtgtatattaaaccagccttgcatcccagggatgaagccgacttgatcgtagtggataagctttttgatgtgctactggattcagtttgccagtattttattgaggattttcacattaatgttcatcaaggatattggcctgaaattttctttgtttttcttttgttgttgttgtaactctgataggttttggtaccaggatgatgctggcctcataaaatgatttagggagtagtccttctttttctattgtgtggaatagtttcagaaaaaaatggtaccagctcctctttgtacctctgatagaatttggctgtgaatccgtctcatcctgggctttttttggttggtaggctattaattacagcctcaatttcagaacttcttattggtctattcagggatttgacttcttcctcatttcgtcttgggagggtgttaagtgtccaggaatttatccatttcttttagattttctagcttatttgcatagcggggtttatagtattctctgatggtagtttatatttctgtgggatcagtggtgatatctcctttatcattttttattgtgtctatttgattcttctcttttcttattagtctggctagcagtatgtctattttgttaatcttttcaaaaccagcttctggattcactgattttttttaagatttttcatgtcactatctccttcagttctgctcttagttatttcttgtcttctgctagcttttgagtttgtttgcccttgcttctctagttcttttcattgtgatgttagggtgtcaattttagccctttctcgctttctcctgtgggcatttagtgatataaatttccctctaaacactgctttagctgtgtcccagagattctggtacattgtgtctttgttctcattggtttcaaataacttatttatttctgccttaatttcattatttacccagtagtcattcaggagcaggttgttcagtttccacgtacttgtgcagttttgagtgagtttcttaatcctgagttctaattttattgcactgtggtctgagagactgtttgttatgatttcccttattttgcatttgctgaggagtgctttacttccaattatgtggtcagttttagaataagtgatgtggtgctgagaagaatgtatattctgttgagttggggtggagaattttgtagattatctattaggtcttcttggtccagagctgcgttcaagtcctgagtatctttgttaattttctgtttcgttgatctgtctgttattgtgtgggagtctaagtctttttgtaggcctctaagaacttgctttatgaatttgggtgctcctgtattgggtgcatatatatttaggatagttatctcctcttgttgcattgatccctttaccattatgtaatgcccttctttgtcttttttggtctttattggtttaaagtctgttttatcagatattagaattgcaaacccctactgttttttctttccatttgcttggtaaatattcctccatccctttattctgaacctatgtgtgtctttgcatgtgagatgggtctcctgaatacagcacaccgattggtcttgactctttatccaatttggcagtctgtgtcttttaattggggcatttatcccatttacatttaaggttgatattgttatgtgtgaattttatcctgtcattatgatgctagctgattattttgcccattagttgatacagtttcttcatagtgttgatgatctttacaatttgatatgtttctgcagtgactggtaccagtttttcctttccatatttagtgcttccttcaggagctcttgtaacatgggcctggtggtgacaaaatctctcagcatttgcttgtctgtaaaggatttagtttcaccttcacttatgaagcttagttttgctggatataaaattcttcattaagttgatcttcaatctctgatatcttttcttctgcttgatcgattcagctattgatacttctgtatgcttcatgaagttcttgtgctgtgtttttcagctccatcaggttatttatgttcttctataaatgggttactctagttagcaattcttctaaactttttttaaggtgcttagcttccttgcattgggttagaacatgctcctttagcttggaggagtttgttattacccaccttctgaagcctacttctttcaatttgtcaaactcattctgcatccagttttgttcccatgctggcaaggagttgtgatcctttggaggagaagaggctttctggcttttggaattttcagatgttttgctctgttttttcctcatcctcatggatatatctacctttggtctttgatgttggtgacctacggatggggttttggtgtggacatcctttttgttgagttgatgctattcctttctgtttgttagttttccttctaacaggcccctcagctacaggtctgttggagtttgctggaggcacgctccagagcctttttgcctggatatcaccagtggaggctgtagaacagcaaagattgccgcctgttcctccctctggaggctttgtctcagaggactacctgccagatgccagccagagctctcctgtatgaggtgtctgttgacccctgctgggagatgtctcccactcaggagtcatgggtgtcagggacccatttgaggaggcagtctgtcccttagcagagctagagcactgtgctgggagatctgctgctctcttcagagccaacaggcaggaatatttaagtctgttgaagctgcgcccacagctgtcccttcacccaggtgctctgtcccagggagatggaagctttatctataagtacctgactgaggctgctgcctttctttcagtgatgccctggcccagagagaaggaatgtagagaggcagtctggctacagcagctttgctgagctatggtgggctccacccagttcaaacttcccagcagctttgtttacactatgagtggaaaaccacctactcaagcttcagtaatggtggatgccccttccatcaagcttgagcataccaggttgtcttcagactgttgtgctggcagtgagaatttcaagccagtggatcttagcttgctgggctccatgggggtgggatccgctgagctaggccacttggctctctggcttcagcaccctttccagggcagtgaacgattctgtctcactggcattccaggcatcactgggatatgaaaaaaaaaaaaaaaaaaactcctgcagctagcttggcatctgcccaaacaactgccccattttgtgcttgaaacccagtgccctggtggtgtaggcacctgagggaatctccgggtctgcaggttgcaaagcccatgggaaaaacataatatctgggctggaatgcactgttcctcatggcacaatccctcacagcttcccttggctaggggtgggaatttctcgacccctttcacttcccaggtgaggtgatgctccaccctgctttggcttgccctccgtgagccacacccactgtctaaccagtcccagtgagatgagctgggtacctcagttggaaatggagaaatcacccacctcctgtgttaatcttgcttggagctatagactggagctgttcctatttggtgatcttccgttctcgccacttttattcaatatactactgaaagtcctagccagagcaatcagacaagagaaagaaatataaaggatctaaattagaaaagaggaagtcaaattatctctgtttgctgtgaaattagacctagaaaactctagagactcttccaaaagactcctagatgtgatcaatgaattcagtaaaatttcaggatacaaaataaacctataaaaatcagtaacatttctatacaccaataacaaacaagctgagaaacaactcaagaaaccaattccatttataatacctacaaaaaatatctaggcatatgtttaacccagagggtgaaatatctccgtaaggaaactactaaaactaatgagagaaattgtagattatgcaaactaatggaaaagtatttcaacctcatggacaggaagaatcaaattgttaaaatggcaatagtgtacaaagcaatttacaaattcaataatatttttatcaaactaccaagatcattcttcacagaattagaaaatactgttttaacatttatatggaaccaaaaagaagagttggaacaaccaaagcaatcctaaacaagaagaacaaagtggaaggcatcgtattacctgatctcaaattataacacaggctatagtaattaaaacagcatggtactggtgtaaaaatagatagaacaatggagaagagaaaactcagaaataaaggtacatatccacagcaaactaatgtttgacaaagtcaattagagcatacacagcagaaaggacaaacttttcaataaatggtgctgggaaaaattggattgtcatatgcagaaaaatgaaactatgtatcttaccatatataaaaattgactcaagatagattaaagacttaaatgtaaaacctgtaactattaaaatcctaggaaagaaatccaggaaaactcctttggacatcagtgtaagcaaataattcatgactaagaccttaaaagcacaagtaagtaaaacaaaaatagacaaatggaagttaattttactaaaagcttctgcacagcaaaagaaaaaataaacagtgacacacacctgcagaatgaaagaaaatatttgcaaactatacatctaacaatgactaatgtctagaatttacaaggaacttaacaacaagaaacaactccatttaaaaggcagcaaatgatatgaacagactttttcaaagaagacatacaaatggacaaaaagcatatgaaaaaatgttcaacatcactaaacatcaagaaatgtgaattaaaaccaaaatgagataccatctcatgccagtcagaatggctattattaaaaagtcaataaaagttattggcagggatgtagagaaaagataatgcttatatgcttttattgagaatgtaaattagtataccctctatagaaaacttaaaatattttgcaaagaactaaaaatagaattatcattcgatccaggtacacaactgttggatatctacccaaagggaataaatcattatatcaaaaagatacttgtacttgtatgtttatcacagtactattcacaatagcaaagatatgggtcaatagaagtgtccatcaatggataattggataaagaaaatgtgttatgtacacacaatggaatacataacttaatgtcttatcttaaaccacaaatataacaaaattatgtcttttgcagcaacattaatggaactagaggccattatcttacctgaaataagtcagaaataaaaagtcaaatactgcatgttctcacttataagtgggagctaaataaagtatatacatggacacagagtatagatcatcagtagagactcagaagggtgggagggtgagaaggggttgagggatgagaaattacttagtggttacaacattcattattcaggtgatggttacacaaaagctagacctcaccactatgcaatatatccacataacaaactgcccttgtacctcttatgtttatacgaataattaaaaggaccatccattctaagcagattcccaatttgaaaccataattagttaccactgtaatttgtttgttttcttcattggaggtaacaagattgtacattatttttcatattccttaattgtttacagtccatgtatccccactcccctacccacaagaatataagattcatggggatatatatatatatatacatatatatatatacatatatatacacacacacacacacacatatatatataatatatatgtttttcacaaaattatgtcaagtactgagtatagtgtatgatacattatagacatttaataaatatttttatataaacaagtaacattaatttgctatttaatttaattctgtataaattcacagtgccacaatattttagtctctttaacccaaattatgttgcttggaatcctagcaaagccctttttcaggtgcatatccaaaataggtcttttttttttttatctttaggattgctgtgaatgttaaatcagtgctaatatatgtaaaacacttagagtagtacctggtacagtgtgaacgcttgaaaaagtgatccatggttatttaccatcttgatctgcagtcagagggtgaactttaattccatttagcaggttttttatcttttaaagccattttagcatgcttccagccacctccacccctgattcctacccctgaactataagtatgacattttttaagctaaggttttcagtatacttaactggtttccatgtaaccttgcttagatgcagtaatattacagttatcttcattggggtgcacccagttcatgtattttgaatccagaattcacacatggaattcaagtgattttttcagcccctataattatatgcacattcttttgtgcagtttctttcttttttttattttttaatctgggatgaggactctcacagctatcatcacacttactagggtgtctttggcatcgaatgactagaattgtccccaggggggaaggaaaaagcacaaactttcacatatgctgtgtctaaagtagtttcagcaaatcctctgaggactcattcttcaggggtaattgttgagcatacttttaacagcttttccttaataaagcatctttttcttgacttcctgaaactgaattttgtgatctaagccttgttctcattacagaatggaaaacataattatttttctgtttttcttcttttttcctgataaactatagccactatattgagagatgctatttatctttaaagataaaactattgtattctgacagcacagtggtttccaaagcaacccaagtaacttacttggacacagttgttcttctttctcactgggggagaaagtttctaagcagctgctaacatcacacctagagaaaatggaatgtaaaataatgttacatttctctgtatttctacgggcattgagtctctcagcaggagcatttgggacaataaaagagctattgccaaatgcaaagaaacttaataatccataaaaagttataaaatataaaatataaaccactgccttctgaatgataagtctgtgaacaatgtagttctttagtaaagaagaacgtttatatgcaaagcaggacaaggtgtagtttcagtggtgctgagctggcactatttgaagaaagggtacaaacaaccaacagcagcaacaacaaatacaagaaataaacaaaatcttgcaatataggctctgccaaaatctgcatatttatatttggggattattctttagtttatcccacctccattttgaaatccagtgttcttcagagatagaacacatttaatcaatcataacagctgaactcaatcacatttctgcagtttgttatcattattgatatattgtatctacctccactccaagcccacaaattagccagtatagggcaggaaagatttgtttactcacccattattaggttcatggctgaggcactcataacaaaagagaaattaatagaagaagatgacttaatataagttatgtgacaatataagaatagtatagtacaacaatagttatattgtcacatatgacttatattaagtcatcttattttattaattcaaattacaatttaaattttaataagttcattaagcataaaataatattgaaagagtaagaaattgagcttttcccgacttattgtagtagctcatcattatttatgaagcccaaatttgtcattcatcctacactgaaaagaaccaccccatttctcccactttaaaccatatacaaatattaagtcaaaatgaatcacagatgtaaatgtaagacctaaaactatacaattttaaaaatggagtaaatatttgtgatttttattgagtcaacggtttcttagttacatcactaaaagcacagttgacaaaagaaaaatagacaaactggaggggtgggaccaaaatggcaactagaagcatggtgctcggaggcttccatcgaaaaaaccataacaagtgtgtgaatccttcaccagcaatcaaggtatccagattctgtcatcaaaatggactagaaggctggcatgacccacggagagaaggaagagcagtgtggtgcggcagcccacctgcgagccacaagggacgggggaacccctttcccccagccaaaggaggcgatgagtgagcccactatccagcaggggaaactgtgctttttccactgaactgtgcaacccatggatcggaagatcccacttgtgaacccaagccactggggcctagtgtcccaaccccagaacacgctgtcttacagcctctcagcaggaaactcaactcccagagggaggggcgacaagaaatagctgcagccacctgctgcctaagtcatttaagctcctgggggaggggtagcaaccggtgctaggactcacaactgcctaactccccgtgcaggggaagggcagcacccatctctatagctccaggctacgcttttcccctgctggagccagggaggcataaaggcctagtcccaagacttctccccacagtccaacacactggctgtcatccgtcatctgtggtcagagtgctcatcaagtcagaccctgtcccatccttcctcactgggtggggcttccctgcaggaactcgagtaaccccaggcagaggctcagcgacagaatctgatctccctgagtctgagcccctagtgggaggggtggctgcagcctctgcaaaccagcagacttagcctattctactggtagttctgaggaatctgggcagcccagatgagtgggttttccccccagtgaagcacagccccaccaccaaaggacaaagtgcttcattaaatgggtcctgttccctgtggcaccaaactatgtgagaccctccaacaggggttgtcaggcaccctatacaggagtgatcctactggcaacaggatggtgcctcaagatcagaggtctcaaaagaaggagcagacacccatctttgctattctccagcctcttttagtgacctctctaggcactggagtgaatcagatgaatagggcccgaagtgaacccccagcaaattgcagcagcctatacaaaagaaggacctgactattgaaagaaagacaaacaggcagaaaacaacaacaactgcatcaacgacaacaaaaggcccccccaaaaaccctccccaagggtcagcagcctcaaagacccaagctggacaaactcacaaagataagacagaatcaatttaaaaaatgctgaaaacccaaaaggccagagtgccttttctcctccaaatgatcgcaacattttgccatcaagggtgcagaactggatggaggatcagatggatgaattaacagaagtaggcttcagaagatggtaacaaagaactatgctgagctgaaggagcatgttctaacccaatgcgaagaagctaagaactttgataaaagatttgaagaactgctaactagaataactagagaggaatgtaaacgacctgatgaatctgaaaaacacagcatgagaacttcgtgaagcatatacaagtatcaacagacaaatcaaccaagtggaagaaaggatatcagagtttgaagaccaccttgctgaaataagacatgcagacaagaatagggaaaaaagaatgaaaaggaatgaacaaagccttcaagaaatatgggacttcataaaaggaccaaacctacaattgatcagagtaccagaaaaatatggggagaatgtaaacaagctaggaaatgtaaggatgtaagaatgtaaggaaatgtaagaatgcaaacaagctaggaaacacacttcaggatattattcaggagaacttccccaacctagcaagacaggtcaacatgccaattcagaaaatacagagaacaccattaagatactccacaaaatgcccaaccccaagacacataattgccgggtccgtcccacacacccgggctgagcaacagatgaaaggagtactcagacacaggtatgcagtgtaagagcagctaggggactgcccgccactagtggccgaagaatgagcagtcccaaacagctggagctgcttgcttttattcagtacagacataatgccacaagcctggagcaaacacagtttgcaggtaattaacattattgtttcccctttcagggagcagtcacagtagaatcgctcctgtataggctgtctgacaacccctgttggagtttctcacatagtttggtgccacagggaacaggacccatgatcaaaggtcagcttctggtcaacataagtaaacaagcctgtttatgataaattcccctacacttccttgtatctactccttgccctctgcctcagggtcagagaacagttgccttcagcttattctcccccaaagctatgcagaggcttctgacctttcagaaggcctgctcttttccctatagtttatcccaccactctgactgatctcctacacataatcatcagattctccaaggtcaaaatgaaggaaaagctgtgaggtcagccagagacaaaggccagatcacctataaagggaagcccatcagactaacagcagacctttcagcagaaactccacaaaccacaagagattggggaccaaaattcagcattcttaaagaaaagaattttcaacccagaattttatatccagccaaaataagcttcataagcaaaggagaaataaaatcctacccagacaagcaagtgctgaggtatttcattaccaccaggcatgccctgcaagagctcctgaaggaagcacttaatatggaaagaaaaaactggtatcagccgctgcaaaaacacaccaaaatacaaagactaatgacactatgaagaaagtgcatcaactagtgtgcagcattatgatgaaaggatcaaattcacacataacaatactagccttaaatataaatgggctaaaagtcccagttaaaagacacagactggcaaactggataaagagtcaagatccatcggtgtgctgtattcaggagacctatctttaatgcaaagacacacataggctcaaaattatgggatggaggacaatttaagaaataaagagaaaaataaactggacttcatcagaattaaatcattttatctttaaaggaaccataaagtaggaagacaacctgccgaatggaataaactatttcaaattgtatctaataaagaacttgaattcagaatatataaagaaatcttccaattcaaaaatacaaataaccaaaatagcaatgggcaataaataaagatttcttcaaataagatttttttaagaaaacaattaataagcacaaggaaaggtgctaatgtaattttcaatagagaaatgcagattgaaaccacattgagaaaccactttacactcacagggagagctgagattagaaagacaaacaacactagctataggtaaggatgtgaggaaataggaatgttcatttattgctgatggaaatttaaactggtgaggctgatttggagaatagttcctctgttcctcaaaatgttaaatatagaatgaccataaggcccaacaactctattcctaaatatgtatgcaaaagaaatcaaaacccattttcataccaaaacatgtacatgaatattcatggtggcatttttcaaaatagcctaaaagtggaagcaaaccaaatgtccatcaactgataaataggcaagcaaaatgttgtttgtccataaaatgaaatactattcaacaattaaaaagaaaaaaagtagacatgctacaatacggatgaaccttgaaaacatgatccaagtgaaagaatccattcatataagaccatatttttcattactccattcatgtgaaatctccagagtaggcaagtgcatacagacaaaaagtatatttgaagtttccaaatactggggggaagggggaataggaaatgactgctaatgaatacagagattttttggggggaagcggtgatagaacaattctaaaagtaaataatgatgaaaattatttaactgaaaatgtactaaaacctgctgaattgtactctttaaatggttaaacttcatattatataaattgcatctaaataaagctgttataaaaacacgtccccagaaaaattggagaaaaacattcatgttcattcttcactcaacctcagcagcctgatattgctagtcctttttgcacataaaagactgagtgcactgaagattatttatctaagatatcataattgagattcataatgatacctcacatctgaattgttaaatattcttttaagacaattgaacaaattgtaattataacaggattattttctgaatttttaaagtatattttagtggaaaaaataataaaaattactgtacaatgggtaacttagagggtgctgaagtaagaaataatggtgtatcagaaaataatgatttcactttaatttctctatactgtaattaagaaaactaatacttttcaaatatttgttccccaataatggtaatagtgctactaataataagtgtaattatagtgtacttatgtgttggttattacactaagcctgatacacacatgtttgaagtttctatgatgtagactctataatgtcttcatcaaggaggattattgacatggaacaatatttaatgaaaagccgaattaataatcaatgacaaaggcattacagaattttgagctcaaagagaaataagggattttttgtgcctttataattatagtatttatagtgtttataattgtggcaaaacattcaaacagactcagaaataaataaataaaggctgtgataatcaacttcaggcaatagatttgtttctaagttaatctaggcatatagctcaatgatcacatatgagcttgtttctctctttccattgctgggcctggctttctgtgtggtgactccattctcagacaggctgtgtccgcatggtggcaagttgtttggtcagatacattaggtgattcttttacattccatgttagtgaaaaagaacaaaggccattatgaataaagtctggagattcacactaatgatgagtttgctcataaatctatgattctatccatggcaatgtgttatgtgaattgatttatgctgcttcataagtcccactcctcaaggtacggagaactaagagtcatgaagaggtgatgccacaatctaaaactggagctgcttccacaagaaagggagttgaatacaggatccataaacaacaaatatttactctcctttatttaaaaagttgatgttctcataattgtaggtttattcagcatctcacaattgcatatcggtagaacaagaacttgaatacagaactttgcacccctgtcttgtctacttcctcttattctacgtttattactgtgaagtattgatgctggcagacatggtcatgatgactgctgaggcaaatgtcacactaaggttagtttatagcatgagaggaaaagtcaattttcagagtcagaacaagttgagtttgaataacagctgtgccatgtactacttttttggcttcaaaaatgtggcttattccctctcaggtaatgtcagctgaaaactgatgtttcatgcttagcataattcgtagcatttggaaagtgcttagtaaatgttaaccactatttttgtttttgttaatactattgcctcagttttcttatgtacaagtaggataatctaaatatttgttgagaagttcaagtagtcttgtacagataaatcattgtcctggttaatttgcctatggcaaagatttagtaaattatttcttaagattgaaatttaaagaggccaagttttttgctgcttcttttcagtccttttaaaaatccctggcttgcctatccagcacaggctataggcaggagtggcatgggttaacattatgggattaccaaagtcagctcctgctgctagtgtctgtctcactccctctctcatttatccctcagatggttatttgacagcattccccttaaatgtcttcaccaaatacatttgtgtgtgtgttgtgtgtatatgttatatgtttgtgtatatatatatatatatgtgtgtgtgtgtgtgtgtatatatatttatatgtgtatatatatgcatgtatatgtgtgtgtgtgtgtgtgtatatataatttatgtatttattttttttgagatggagtctcactctgttgcccaggctggagtgcagtggcatgatcttggctcactgcaacctctccctcccaggttcaagcaattctcctgcctcagcctctggagtagctaggactacagatgtgcaccaccatgcccagctaatttttgtatttttagtagagaggggtttcaccatgtttgccaggttggtctcgaactcttgacctcgagtgatccgttcacctcagcctcccaaagtgctgagattacaggcgtgagtctcccggcctgcatttcatacacacacacacacacacacacacacacacacacacacacgtatatatttaatttctttttaattgtctaatattcttctttacaaatcttcatgaacactccttagtccacttatctccactaatatctttataaaatgataactaaagagttcaacatagtatctatgagtatggctgacagaaaaagactgaataatctcatgggcataattttctgtataactatcccatcagggaggaaaactggacatatttcttgttgaaatccacagtgactatctcaatatgctattggccatgacaaccagcctgcaataagattttctaaggggaaactgctcaagtttctttcagaaacaaaatgacatctgcaaatttactgacacatttagtaacatacataaaacaacactttttttttgtaaaatagcaatcccatttgaaaaaggaaatgtggtagaaaaaggtgatcaaatattgcaatgtgcaaagcactatgctacaggcagagaggaacagaacacaaaaaaaactgctatccctcttcaacatatatagcagatttgtctgccaacatagtaggtaacatgataaacttaagaaagttgtttgggactttgaaaattcagaaagacttcatagaaattgtgacatttgtgctagactttgcaggattttaattagtgcagaagtgtagaatgggaggaagtggaaaaaatgtaatcatcaggcttgggaaatattcagattaatcagaaaatgagagagccaccgtaacaggagttcggtgggagatgagactggagataagactgaggccatgtggaggtaagcagcggctgctaacggcatccattccagtcttaaaagctgtttcccaggaaagcaggacactgataaaagctgagtaattcaacttgacttcaaaaagccttttgaagcattagcaggcaacccaatcaagtgatagagtataaattatggaccagagtctttcttctttttcttcaagagataaattaataaaagggtgcacttccaccagaggaaagaggaaggattccttttatgatcccagagtaactccttgcattctcatcttacggtaagacaagactccagagtaggattttaggtttgtagccccccagggatatacaagacataatttttacctgcatgacggtctgggttaatagttattcttaaattttgctatgttgttcctttcacagcatttcaaaaaggcattgggtttagtgtctattttgcctctgaagttgcttctctggctgtctttctctcccttctctttcttccagtcattttgttattgatcacgctctgcctctggttttcttgttcagaaactgctgcagttgacctacccttgccattgatgtttattttaggtgtggcttcaggctgcaagctccttggagttcctttggctggactgtttaactctcatggagacttacacatgcttttgttattttcagacgtcctatgaaacagggtctcactgtttctaattctccttgtgtttgcttgtcaaggaacttgggacaagttcacagtagaaagttcctggcaatttgatgttttcatactcagaagttgttttcacacttacacttagagggaggaaaggcatcatttgtttctctacttacctatatcagtagttgtcaaactatggtgccaatgaatcaacttaagagttctttttaaaatgtaaatttggtccaatatttcctaatattacaacttatcagtactgatgtaaacatttggttgaatatcagtgttaaaaaccttggatgattttttaaaggtgttgtattttgagaaatacatatatagaatgtaagttttcttgttctgatccatggccagcatcttcacagctctcattagaccttgttcagccatctcttgaacaaagcatttcttattgtacccttcctacacctctcagaccactgaagaaaaccggcatttttcacctcagaatatggcttattgatgtaaatattgctaaggtgaagacaattaagaagcagtagaggaagggctatttctatcctctccttcctttcctgtgtaaagacagagataaattcttccttactggagacaactcttagctctgatatggcacaaaagaaatctacaaacaaacctcacctcattagttcattcctgtgttcttcctacaattttctgactctggaagcataagactgcattccatattcttgtcacctctctaaaataatattgttctttgttaaagatgctatataagcctgagttctaagtcactacttttgagttatccatcattaaattttctcctgtgatgtgcactacatgtgttaataaacttgcttgcttttctcttgttaatctgtcttttgttgcaggagtctgtccaaactacaaacttatgagggctaagaagaaattatattttctccctgacaccatcctcataatttaacaaaacaaaataatctatagtggaatactaaagatgttgtgacatcataagtaccttctttgggccacatgtagcaattttaacataaattaaaaatctcccccaaaaggattttatgctttagtattacttgctacagggagttccaagccacatttatacctctctgcctccaactcttgctatatacggactcatcccaagcacatttacataatccatatcaaagacaatcaggtattaaaaatcaggacttcctgatcaaagcttcttcctatatgtaaccagtaatatggaagagcaacaaaatagaattgtagagagagaacaagtagacttccaagaatattctcattgtaatgaatgtattttcgctatgtatcttttgcatctttgccaggagtttttggaacttaccagcctcaaagaagggagagattttgcactctgtgacaaggtcttccttcaggagttttgagagccagtgggatgacttgagcagatacacaattaaaaacactctgcttgatacataccatcaaagcaagtgagaggacattttagatcacagaaagaaaagtggtattgatgctgaacaggaacaaataaattagacagagtatttgaagcagaagagtacagatacagcctcgttttattgcacttagcttcaatgagcttcacagatactgcatttttaagaaattgaaggtttgtgaaaaccttgtctggtaagtcttttagcaccacttttccaacagcatttgctcactttatatccctgtgtcacattctgggaattctcatattatttcaaacttttccatcattattattattattatcattatttagatggagtctccctctgtcgccgaggctggagtggagtggcatgaattcagctcattgtaacctctgccttcggggttcaagtgattctcctgcctcagcctcccaagtagctgggattacagggtccattattgttatatctgtcatactgatctgtgcttagtgaactttgatgatattattgtaaatgttttggggagccatgaattgtacacagagaagatggcaaacaataaataatgttgtctgtgatggccattgccccatctcgctccctctcatcaggggtccctattaccagagacacaacaatattgaaattaggccaattatagtaataccctacaatgaaagaaagagtcgcaagtctcttactttaaatcaaaagctaggaatgtttacgcttagtgggaaaatgaagacaaaagctgagataggctaagagctagacttcttgcattaaataggtagccaaattgtgaatgtaaaggcaaagctcttctaaaagtgctactacagcatgaatgataagaaagtgaaacagccttattgctgatagggagaaatttttagtggtctgtatagaagatctaacctgccaaaacattcccttaagccaaagcctgctctaaatcaaggccctaactcttcaatgctgtaaaggctgagaaagataatgaaactgtaaaggaaaagtttgagctatcggggtgagttcatgaggttattaaggaaagctgagaaagtcccaatatttctgctctttcacctcttgcacaaccacattgcctaagcctctcaatcatacaatttttgccagaattctgaatgcttatgaaatgttttggagaacccattaatagcagcttcaatgtaatcctaagtattgtttctctgcccagcctcctgagtttccatgagtcctacctgttttccaatcatagttctccagttattctgtatctattgaaatctatgagcacaccagttcctacacacacacacacacacagacacacacacacacacacacacttccttgtgatactgagagcattatttctattacttgtgactaagaaatctgtctcttaaatgtgtaattcccaggttttagagtaaggacttgagtaaagaaacttgcaataaatcctccaaaagtatcctaaagtctctgggcttttgatgctgctagcttgaaaattactgaagaaatttggtctatttttatttctgccacagactattacttatacaaaagccttaagggggtttctctcggctaaaaattttattgaaaacacaagattcattctattataatcttcatcctgatcatttcgttgtaagaagtccagtagctgttgttctctactgatgtccctgatcataggctaaatgtaaggagaaaaatgaggatataaaatgtccattggatgaatttctatatattcagttaaccatttttttggtagaacatttttttgcttacatattttatactagtataaaatatttgaaacttttttcctggaattctcactttctacattatatttaggtccattcttaggaagtggtaactctgaagtatctgaatgcaatttaaaatattcaaatatttcaaatatattgtaaagttattttccaaaatgtttatccagatttacaatttttttagtaatgtttacaaaatttctttcaatattccataacttttcctgtatatttacttaaatttttaaaaatgaatttgatataaatttatatctctttgaatttaaattacttttgtcactaatgaagttgtcaaccatcacaatttcctttatggaaatggttaatgaatgaccttaaaccactaacatagttttctttcatctggttttccaatcctagtttttataattttgtaatctctcctaccaacttgctaccatcagccagttatcatatttacctgattccagaaatcactcttctgtacattttgctgtaaacttgaattcatcccccctggccacttcagtcttgatttaattgtgaaaaaggcttttccagggaccctgagttctagtataagttatgcaacttctggtctacctctgaagactcatcaggccgtctttaagtcagattctgagatatccttcagcaaagagcaaggttccccaaatgtatttaatcacagaattgtttgtgatgttatttctatgaatctttcatagagccagtattccctataaactacagtaaaaaaaaaatgtttactagcatctggagaaaatatttaacaccaaatttgataaaatcaaggtaaaaacatttctctaagaatgactgacccacatttggaatgagctatatgtacaacatgctatgcagttacgttaggaaataatttccccaaactataatagtatacagtgatgtctgcataagattacctttccaattgtaatctaaccttgctaaggaactaatgtaaactattagttccatttgactctggttgtatgtggttatcttcctttacttatctctcattcccctctgttttcatccccacaccacctgttatccccatgctctgacttctccctgcatgttatgtatattgtccgggttctgatttccttgtatgtgtcagacaccatccttctcaatatctctctacattgggctatcaatttcttatattagagtagttattcttatcggtgaatttttctcagtctttacttacaattactgcaaattcaccttatataccagtgctagtctaattcagtattgtgatgaaggaggtttgttcttctaatatgctctgcacaatgtttgctactaattatgggtacttatatccatctggaatgatttcacgctgtatttgcttgctctatttgctgctgtctcagctgtattacctaatctaaaagctttgttccctgccctggctgtagcagctcagtagtgcaactattaaaccattcaaggggattaaaatattttggaaaattaaagagcatatttaaaatgttaattacctatcacttcttcaatagtcctctcttcctgtgtgttttcatccaccattttaaactcaacaaaatggagagcaatttaggcatatggaaggagtagaagcacttatggattttttttaatcaaacagtaaatctaatattttaggaaaatcctacaccctgtgggttttagtttaaattccagtatcagtgacatatgactatatggcatatgcaaaattttgctttttttatttacaaagcatttgcacattctttgtttcctcttattcccacagcaacagagtcaagaagcatacattacagatggagaaaccaaggcttagaaatgtcacagtacagatatgcccatggtgacagcttgtaaatgggagactttagactagaacatacatcttgtgaattctgttttacatttttccctctgtaacactctatcaaataaaaattgaaaatgccttgattttgactgtaaggagaaacactattagaaaaaaattttctcttgttcttgtctaatcagcaatgtacagtgcacaccacaggagcagctggaaatgcaattaagacagatgtgataacaattcattcacagactctaatgctttcaaaccccagtgctagtctaaaagcacagatcacagcaggcaacacaagaagaataaaatgtggtcacaagaattgagcaagttgtaagtcttgcagaattttgaaagtgaaatggtatttagtaatttcaaaatcctacctctatcatgaattccttatgtagtaaatatttttcaaatttttgaaataattagaagaaagtacattcaggatcacagatcatttatatataataagcccagcataagtcagaatggtagggtgacaaaaatgttggcctttggagtttgtgtgaattgttgcattgtcattatatgaaaagccttgctcagtgttcggagcagccattcgctaagtatgactttcctccctttttccttcagataaccctttgacttcagatattatttgattcattaaaaatagcttagtgaaccttctctgataaattgcaggcactgaggagagatgtgtcaaaataaacatcctcatgggtcagaggtggccaagcttaaactgaatacttgaggccatgctctcacactccttattatttgggagacaattacaagaagatgagaaagagcccagggcctgggtttagataatgatctacattttatctctgcctttgaaaagctgtgtgacattgaacaagtcccttgagttctctgagtgtcagtttagttaacttgtttgttaaatagaaaaactacatcttgctagctttcttgcagggctgttaagaaaattgtataaaatagtaactgtgaaacttaactggttttaatgattctgtagatcttcctcttgagctctaacacctgacagggattagcaaccatagaaaaaaaagatcaaccatcctgcagatactgtagaataactattaatgggaagagatacagtaagatagactgtgagataattaatttctctccatttattcttccagctttacagtggttttaaagcttgtgtgtgcgtaagactcacctgggaacaatgctaaaatgaaggtttttgggccacatggctagagattctcatttgcccaatatggcctgggaccaagattctgttttattaacaagtaccctagttgcttcctgggaaggtgattcgagggcccctgtcaggttccaacctgagctggggtccaaggggagttggtagatgggtggcgggcagttgaaagaacactcagggggctgtaggcaggtgaaacatggctttattatatgccacctctcacagtgtcggtgaggcatttatggacctcacaggcaacagtggctcagagtcaggtgatgagcccacccataacatggttacataactgattatataatgcacaggactgtatgcctgcactccaatcccactgtgccatgctgcaccggatgttgacctcggcctgtacttgactgcagcacagccatatccctaatagccccagtgtaagaaatattgactaagtccttcatctgtgatacaagtactttctcatcacatggataagtgccttggaaacaacacaagagttcttaactgattccttgcagactcatggagtgtggggcacttgttgaactaatgttagctgctgaaaaagatgcttctcatgcattctgctaattaacgttattactgaaaatgtgttatttaccccttttcattttctattttaagagttaagatccagttcctcaattgggatgagaaaagagtgatgaactgtggcaaatattgatagttttttcccaaaatagctcttctctctattctaaaaatatattttactttcgtctgagcaaattatcatccatgataaatatttcccagcatcctttgaagcttgctggggccatgttcctaagttctggctactggtatataaacagaggagacgctagcccctttcaatttgtatccattaaggaaaagtatttacactcctctttttttttattttattattattatactttaagttttagggtacatgtgcacaatgtgcaggttagttacatatgtatacatgtgccatgctggtgtgctgcacccattaactcgtcatttagcattaggtatatctcctaaagctatccttcccccctcccctcaccccacaacagtccccagagtgtgatgttccccttcctgtgtccatgtgttctcattgttcaattcccacctatgagtgagaagatgtggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtttttatagcagcatgatttatagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccaaatcctctccagcacctgttgtttcctgactttctcatgattgccattttaactggtgtgaggtggtatctcattgtggttttgatttgcatttctctgatagccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattggccctttgtcagatgagtaggttgcgaaaattttctcccattctgtaggttgtctgttcactctgatggtagtttcttttgctgtgcagaagctcttgagtttaattagatcccatttgtcaattttggcttttgttgcttttggtgttttagacatgaagcccttgcccatgcctatgtcctgaatggtaatgcctaggttttcttctagggtttttatggttttaggtctaacatttaagtctttaatccatcttgaattaatttttgtataagatgtaaggaagggatccagtttcagctttctacatatggctagccagttttcccagcaccatttattaaatagggaatcctttccccattgcttgtttttctcaggtttgtcaaagatgagatagttgtagatatgcggcgttatttctgagggctctgctctgttccattgatctatatctctattttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgagtctataaattaccttgggcagtatggccattttcatgatattgattcttcctacccatgagcctggaatgttcttccatttgtttgtatcctcttttatttcattgagaagtggtttgtagttctccttgaagtacactcctctttttcttttatgcttccctgatggtagaacacagacatagagatgagggtatcatggaccaaacaggaacggacaacattatagaggtagcaacgcatcaaatgagaaggggtctggttcttaacaccttcaagtaacagagtcacaacacctgactttatgtcagaaattcagaaaaagaaagaaattcctttttagtgtaacactctgctatttggggtttctatctcacatagctaaatccaatttattctaactaataaaagcatcaaataaatatccaggattagaaatatgtaatactataatgtgaagtgcagaaccctagctatcatacttgcaaaatgatcattgtgttatctctttcataagattgttaggagaagtacaagtgataaatatgcctgaaaattgtctgataaaaattcctgcaacttttcaagtaaacagtcttgtatttatttgtactactagtgaatattttataaatcattattcgtgagagtaagtcattaactctctgatatagatcttactatatgctaaggtatgtagagaaagttggataagaaaaaaatcaacctccaactctaagctttaagactctcttaaaaatatgtattttttaattttatgttttaaatttttatgggtacatagtaagtatatatatttgtggggtacatgagatgttttaacagaggcatgcaatgtaaagtaatcacatcatggaaaatggggtatccacctcctcaaacatttatcctttgtgttacaaacaaaccaattatactcttagttattttaaaatgtacaattaatttattattgattattgtcaccctgttgtgctatcaaatactaagtcttattcagtttttctaactatatttttgtactcattaaccatccccacctccctctcacatcactcccacaccccaactactcttctcaggctgtggtaagcatccttctactgtcaatctccatgagttcaattgttttaatttttagtcctcacaaatagatgagaacacgtgatatttgtctttcagtgcctggcttattttacttaatatagtgacttccggtaccatccatgttgctgtaaataacaggatctcatattttttacggctaaacagtactccattgtgtatatataccacattttcgttatctcttcatctgttgatggacacttaggttgtaatttatcttttagtcttcctacttggtaagagtaacttacacatgatagttacggtgttgtaatattctgtgtttttttttttttttttggtgaacttacaattaccagtaagttttgtaccttcaggtaattattgtacattaatgcccttttctttcagattgaagaactctctttagcatttcttgtaggacaggtctggtgttgatgaaatccctcagcttttatttgtctgggaaagtctttatttccccttcatatttgaaagatatttttcactgggtatattttctagggtaaaaagttgtgttctctcagctctttaagtatgtcataccactctctcctatcctgtaaggtttaccctgaaaaatctgccaccaggtgtattggagcacctttgtatgttatttgcttcttttctcttgctgcttttaggatccttttgttttcctggacctttgggagtttgactattaaatacattgtgatagtcttcttcgggttaactttacttagtgttctataaccttcttgtacttagctattaatatctttccctaagtttgagaagttttctgttattatcccttttagtttttattttattttatttttaatttttattttagtttcagttccgggacacatgtgcagaaagtacaggttttttacgtaggtatacctgtgccatggcgctttgctgcacttattgacccgtcctctatgttccctccttttgccccccacaccctaacaggccctggtgtatgctgttcccctccatctgtccatgtgttctcattgttcaactcccaattttgaatgagaatgtgtggtgtttggttttctgttcctgtggtagtcgctgaggatgatagcttccagcttcatccatgtccctgcaaaagacatgatctaatttatttatttatatttttatttatttatttatttttgagatagagtctctgtcacccagactggagtacagtggctcaatctcagctcactgcaagctccggctcctgggttcacaccattagctgggactacaggcgcccaccaccatgcccggctaattttttgtatttttagtacagacaggttttcactgtgttagccaggatggtcttgatctcctgacctcgtgatccacccgcctaggcctcccaaagtactgggattacaggcgtgaggcaccctgcccagctgatctcatttatttttattgctgtgtagtattccatggtgtatatgtaccacattttctttatccagtctatcattgattggcattttagttggttccatgactttgctattgtaaacagtgctgcaataaatatgcatgtacgtatgtctttagagtagaatgatttatattcattttgctatatactcaataatgggattgctgtgccaaatggtatttctggttctggatccttgaggaatcgccacattgaattccacaatagttgaactaatttacattcccaccagccatgtaaaagcattcctatttctccacagcctcaccagcatctactgtttcctgactttttaataattgccattctgactggcgtgagatggtatctctttctggttttgattcgcatttctctaatgataagtgatgttgagctttttttccatatgtttgttggccattaatatgttttcttttgagaagtgtctgttcatatcctttgcccactttttgatggggctggaaagggagcctcacaatttttactggtgccctattctgtggctgagcttgtatccaaattgcaagacaaagtcctctttaatctaccctctcctctcctcatacagaaggaagggtctcttttcagctcctgaagtgtgcagtctgtggttgagagaggaatggcacaagcactttcacagctaccccagctggtgtctcagtatgtcacatgctccccatgtccaccgtctctgagcccagctcagcaatagggcttgcctaggagttgtagtccttgtgccctagacttcctttccaatttatttagagccccaaagcactttaggccatggtggtgatgcctgccaaaactcaaggttggattgctggcataggtgattcccctctggctaggactggtttaatactccccccatgggtaaacatctgctgagttcagcccagtgttgctttctgctgtgacactgagtttagtgcattgtctcacaattgctgcgctctccctctcccaaatttagactctctccacgccatgaggctgctgccagggcatgggagaggggtggcattggtaattcaacactgttttcctacttcttcggtgcccctttcagtgatatgaagttaaaactaggtactgtgaatgctcacttgatttttggtaagaaagtgaatttttgtgtagagagttgctaaactggtgtctttgttagggggacggttggtggagcatcctgtttggctatcttgctctgtcccttttctagaacttgcatttctgagtactgaggtgatactcatgctattggcccagagaacacattttgagattcactggcttacaggaagaaagtctctgtagaatttattagattagcaaacttgctgtgggttgagatctcttaaggctgtaggttgtctccaattctctacacgtgttagattataaatttctagatggtgaagaatgtgtgtgtgtgtgtgtatgtgtatgtgtgtgtgtatgtgtgtgtttgtgttttggaactcggatgttttacccaatgctagacacctattagctgcttcaaatttacttatttatttattttgttttctttttcttccctctggcactattgcaggcagtaatatgtcctttcaaatgtatctgtactatggaaagcactttgtagactcatagcatggcaataattgctgcacacatgcaattttgggaagaagacaagaattcaatttgtatgaatctgggctttggagacagaagatctgatgtaggtcaagaacagggtttgaaatttggctttgttttttggttgccaggtaagcttaagagattcacttaatctgtctgtggtatatgaatttaattatttgtagtaatcataacttatgagtttatttcaagttttaacaagccagtacatttaaagtgaaattatgttatttttaactcaactgagatgcctttggtttagctgaaggaaagtaagagtcatgcttgataaagatattttaataaaaaggagagactgagtaattgccaaaaaaaaaaaaagagagagagacagaacattcgtcttagcaagagaagtttgataatgaaatagagataaagttaggtctgagtatttgtctgcatctgcaaggatggatgagtcatgtctaaagagggacaatagaggtacacctttgcatgagatctttatgctcaaagttaaggctcgtgactttgtctacctgagatgtaaatgagccacttgaataatcagaggaagttgaaagtattctgattactcaaatattcagagaaaagtaacatttactcaccacttctggctgggaacacaatgttaggagtagaagtccaaatgttggatcatataatgaaaataaccatcaaaaatttcaacagaaatacaaattcaaatggaataaagtgtttgttaatagtcatgatattttcaataaaatgaaatatttttacaagtgtaatattaaaattgctgtgaatagattttataaaatttttatgaagaccaaaaaagaaaaatacaattgtataaattttactttttaaaaatatgtatacttgtaaaatatgtgcatataaaatcatttctaataacctatttatttaatgtgtttatttgttttattatagcaaacaacaaagtgaatattcatgattttatttgttatctgttactcaattccttatttaattagatcttaaattcttagctatgaatctgctcttttaggagctttcagatagctctcattggtatcaggtcgcttcatgtaattaaaggcagttttattataattttgtaaaaatatttttattaataccacctctgtattcagtcatagtgatatcacttctcaatgaatacatatcttacatgagaggtccaacatactttaaatagttaatatattgtctattgttctgtagattttgagatgagaattttttaaagttcacaaggtttgtatatttatttttagtaatctttttaaaagaattttggagaagttttaggttcacagaaaaatcaagtacggagttctgatatgctcctttctctcacacactcacatcttcttcactcaacatcccacaccaaagaggtacatgtattacaatcaataaaccaacattgaaacgtcgttatcacccccaaaccatagtttacattaggatatgctcttggtgttctacattctgtacatcctgtgtgtttagattaatgtataatgacatgtatccatcattgtagtattatacagagtagtttcactaacataaaattccttgctatgtctattccttcctccctcttaaccttcggtaagtttcgcttttttcaaaatgttgtacagttagattataataagcatgtaccctttcatatgggcttctttcagttagtaatatgcatttataatccatccatgtcttctcatgactaggtaactcattgctttttagtgcaacgggagaaggaagaaaggaagaaaggaaggaagggaagaagggagggagggagggaatgagaagggagagagagaaacaaagataaaaggaagaaagaaaataaagaaaaagaaggaaagaaaaagaaagagaaagaaagaagaaagaaagaacgaaagaaagaaagagaaagaaaggaagaaagaaagagaaagaaagatggaggaaggaaggaaggaaagaaaagaaaagaaaagagaaaaaaagaaaagagaagaaagagaaaatatgtcttctaagaccagtgggaaaatatctcaaggatgatcaactatgtcaaatgctgatgataagacaacaaagacaagaaccaaggatttcccatggatttaacaatgaggtcattattcaaagttagcaaacgtttttttaaagtaaattttttaatggatacatacatgtgcagaatctcatactaaatgtacgttaagagcgtaggaagaaaatttgttctcttttcactatgacaagacatgccccttattagtggagtcagatttatgataacagtaaaacaaaatgtttattctatcaatgccccaatcaactcaaactgactatcagcagggataacttacctgcacttggaacaaaaaagcaaatgatgagcatattcttcttactgccactccatgggaattttctaatgatgctgggataaaaaataacccccaagtattaaataaatcatctttctttgaaatttatagcagctaaactttattgtttggcttgaactgcagtatgaaattttcgttagcaataatttaagaagacatttctcactacagtcaatatttggcaagcttcaattaattcataaacaataagttaggtctaaatttattcttgtaagcaagcatttatgtccttcagtcattaggtatgttttatttactgactagcaaacattgaatgaaacagtttttaaagttaatagcatttgtcttaaacgacagtttgctatgtcttatgtacctgtagaacttatagttgaatttggaaatatgtagaactctttatatcctgtgcctaaagagtgttaacacacatattggtaaaactccataagtagaattcggttctgtcatgaagtggaaaaaagtgggaggtctgctcttaattactctagtccctcaactgtgtttctagaatgaagtggctttattgatgctggaattcccagtagaattgcaaagagagggtggcaggtgttcaagccttaactgggaagattggggtgagaatatctttaggagtaattacaggtgaattaactgatctttcctaatgattttatagcaaatttattctgcacagttggaactctaaggaaaaagctattttataaaccataaattactttctttcctggtgggattggactggctgttgaaagttacatgcatctgggattagacactcaaagccaaattttaagtgtatgtacattttgaccataaacagattaaataaaggaagctacaagtctgtcatttctaaaatggagctgattaagaaatttaccttatggtactgcactgaggatttaatgaattcttatataaagcatactgtagaatacctggcacaaagtaaacactccgtaaatgctagttgaaacacagacatacattcgacacctagtcattttttctccctataaaatacagcctaaaactaaactcacttaccctatattggagtgaacttttcaaaattcatgtgaattacataacacatcttatggtcttatatggctggcctcaatgcaccttttgagtttaatctctcttcgttcgtcagtctcttatgcatgatttcactgaatatcctgtagaactacaagaactagaactactagaactagtacaaacttttccccctcttgccatttcctattatttgcccaactcctttacacatctaaagacagctgagtgtcacttcctaaataggtgcttctccagagacttgtagttttactgtcaggttccttcatagattgtgaactccttgaagaaatgggttgtttttgccccattcccagaacatagaaagtctttataaatgttgacaggaatatgagtatttttctcacaaaattgattttagggtgattgctattctgtatctttagctacatttttaacctatcagaattataactctctgataagggaggggaattattaataacagaagaagcaggttctgtttcgaagagaagtgcctgttttagagaaagagcaaatcagacagagagacatatcatcatgtgaaattacttttatgataaactcttctttatctataagagaaattagaggactcattaactagaaacttgcctgcagtctactaaaataataatgccttataaattgtgatgtcaaagccctcaaccttcttggaaagttgtcctaatcatcaaaaaagatgactcttctttatgtttacaaaatgaagtcaattttattgtaataataagagctaaaatgtatcgagtgcttacattgtgccagcttctgatatacatgctttacttatttaatacaaccacccgttgaagttggtcatgatattttcctcattttatgaaagagaaaacaaggactcaagatgttacaaaatgtgttgaaagtcatagagattataggaaatcatacccaagtctagttgtcctgatccaagaagccagccactgtgctgtattatatgcctactatttggaaagtgatattgtatgggtgagatgaggctaattaacacacagagaatatctaattagtttactcagtgtattgaaatgtgttgcaattttatattacctgacatcaggaaaagtcatcatctcatgtttctcatgcccctaaatggtagtgcaatagtcgtgaagctgcaggtagtataagagattatctaaacgtgttccattttttcacacacgtggatgctgagtgtctatgggagataaggaactaacactagatatttgagctgattcgattctaagtgaagaatagaaacctcataaagcatgcttaaaatttcctatacaagaaaaccaagttcatattctattccctatctgagataacttcaacaaatatttgagcagctgtaaaacttttgttacatctgcaaccactttaaaatttaaattggcaaggtctacactcaactgggacatctgccaccagtaggataatgccatggctggctggtggtggctttagttaatatttatagaattaaattattattcatgtgtgttcaattctatatctttctgtaaaaatatgactattaaagtagaaattaatctgtatgtatattaaaaacataatttatttaaacaaaggaatgatttgaaaaatactttttagtaaaaatatttagtttcaactaattatctttctcatgacttgcatattatgtttttctaattttaaagataatatattttagtctttgaccaaaggtatttcacttgtcaaaagctctgaatgtagcctaggtggctgattcagtttggtctttttctctattattaactcaaaacaattctataaataattgaagctccttccatgttggaagtctactttttatttccatgtagctaagaaaatatactaatgccatatatgtgtttctcatttttcccctagtttctctactgccaatcctttctagctgggagaaaaatttatttccattgctttacctttttgcctttgattttataagaagaacattctttaaattgtaagaagatatcaattttaaaatgcattagtctgatttattaaacttcttaaggggaagaaaccataaatactaaagaaagtatacgtaattctggagaccacatcctgattcctgaaacattaaaaagtgaaaaattgtgcatctaagaattgctgaaataaacacacatggtttagatctagtctagaatgccatccattttcctaagatttctttaataaggcatgctataacctgaaagtttgtgttcatctctcaaagttccctgcctgctaataccatcacactggtgattagttttctaactttgagagatgattaggtcactaatggaaaatgaaggggtgctgaacatgggcatttagtgtctctttaacagaaaacttcttttacctggtgaatgtcctaatgcctatttgcctgatctgtgaccaggggtttcctcccatgggagctggttatactagcaggtgccctgttggctcttgtctgacctgtttatgcctgcctgacctctttcactgtgctgctgggaacgctatggaccttgtgttttcctggcatcctggggaaaacccagcctgcgaagcccctagtttttttgattttgttttgttttgttttgttttgttttcagatggaaggcacaaatataacacaccaccaaagcataaacaattcaaaaggttttctacttacatatccttggcagggatgtgcaatgaatctggaggacaatcttctgtttctaggtcaagacagagatgaaaggtcagacagagagacagcaagcacatggcaactggcactaatatatatacaagcacgtggcaacaggtactaatgtatatgtaagcgaataaggtgtgggttattttaagtttgttggcaatgaatgatttctttaaaggaagtatcagaaaagcaggcaccagtctgctaggcaaaatggtgcctgtaagttattatctctggccactgacttgaaccatttgggtgttgtatacactggaaattgtgccaaaggtaactgagccctagttctgacatgagaaagttaaacttgtattcaaaatggatgcagaggcaacataaaattataagaattcgctaccttctaactcctattgctctctttagtacaggatataagatttcccattgtaaaatgacatatttaaaagggcaaatgtattttctagtcatttgaaaaacacatttaaactgaaatgtggacctcaagcagtcatataaagtggtgcacagtcagttttaggaagttccaaaatagtagatgctttccactgtgagatgcagcgatctctggttttattttgggtactgctgcaggtgattttctcttggtttaaatttaattgcactttggacaaattaatgcatgttttcagctgcctggccacaatggtttattttatttaagtctacaaaatgtagttaaacacatttacataatttattatatttggaaattttaaatggtcccagatcattactttcaccttgaaaattgattgaggccttatcattccactttctaattaagcacagtgatttacagccttcattcagctgtcacaagaactgtattcctgtcttatgactgcagatgcctccccctacttggttcttgcctgttttctgagccttattcataggctttctcttcattctgtacaaagtccttccaataaattcatttatgcatgattttgtcattattgggtatgattatattccaattaatatagagtaagattgtgaaagtatgctgcatttatgatcattttggttttacagccaaaagtttttttttggatttgagctaatgtgtaagccatattgcaaatatgatattttaagtttccagtcaaaaatcaaaatgagattgaggatataattatattaaatattttgtcatcctctgacttaaattcaggttttaccacacaggagtgggaaatattacacgacatttttaggcagatctgacacatacgcatgctgagttcccaaaaagttgtaggaatatttgtttttaagctaaccaacacctgaacaccatttgatattgttaggctttgtgtccccccacaaatctcatcttgaattgtagtccccataatctccatgtgtcaagggagagaccaggtggaggtaactgaatcatgggggatggtttcccccatgttgttctcatgatggtaagttctcaggagatctgatggttttgtaaggggctcttcccacttcactcggcaccgctccttcctgcctccttgtgaagaaggtgccttgcttccccttcatcttcagccatgattgtaagtttcctgaggcctccccagccatgctgaactgtgagtcagttaaaactctttcctttataaattacccagtctcagacagttctttatagcattatgaaaacacactaatacaccatccaattgagaggtattccctaaataggtggtatgcagggtctaccttccacttacagaagccaaaaggggatggatgttttctcactcaccctggtaaaatatggcattagcctaaaatataaatttggttacttgaatgttcttccttgctgttcttaaccgtaagaaagtgacaaaactatgtgattatgtaacatgtgggtggggggcaaaaatatttaagcatgacatcaagcatgtactggaggcgtgtaactaaaaaatctgggatatactagtactaagacaaggctttatcaaggtgaggaggtgatgcaaacgacattaccaggttccaaatttttctctccatattcaggtcttctttttctaagtaaaatctattctcagataaactatgtgatctgtttcaatgcctaagtaatgtcaaatgataattgtttcagaaataaagaagaatgatcattaatcataagtgaaaaggttaaattggtaaattgtctgaggatcagaattcccttttcagtgtcctgtgccaccatgtttttgaagcatataccatctgagaagaatctcagtatggtctttgaggacagtctcccctgtgccccacagttggctcagctgaggctgcttgtaattaattatccccaaattctggatgcatttcaaaatactgaaatgttctgatttttaaactctggcaatgacatttagctttacggaaacatttctttacactgttgcccagaattaccaactgccagaataaattatggacatacattataatcactgtccatttatggatggccacaaagatatctatgttgtggagtgacagtctttcctgtgctcatccaggtgcattgtacaagtatatcataaatgctttaagttaaatgatgttcatttctctgctttaacaccttagaattggacagaataaacaaaagggaattcaagtgaaattttatttgctataatgaagaaatagttgttctcccccacccccatggaaatccgtatattcagatggagattagattacatgatatacgaatttccctctaagaagtgtataatctgtaacatgtaattgtgaattaataaatgagcaaatatattataaaaatgtaaccaagcatatactcagggagaaaagatacagagtctcaaattctgttaatacagaggtgataacaaaccaattatatgtagttatcaaaataattattctactgtttatcaaacttaattacatgacaaacagaagaagtacatgacaataataacatgattaattcaaattctagcagatcctttaaaaaatctagaatatagatgttttcagatattctagcagtattcagctatgcagatgcaatctcttaaacaagtggaatcaccatttaaaactagttatttgcttgggatgactgactagcagtcattgactataatcaatcttgtaggcttgatttatgaataagaattttgcggctgtgaaagctgaagttaaggaggtgggggagcattaaagaggatcatcaaaagttctcatacatgaattcctaatgtgttagtaactctacctactggcatcaaaaaatgaactggttgtttgagatagtcacacaatctggatttattcatctttatcctgagatatattatttcatagataagagtcacatgtttaataatgcacaatgaaaatttgtgcaaataagaaaatacatatgtacatatttatatgaatatgctaacagaaatttctaaaatcacatatagaaaaaatataaagcattttagggccatttacaggaggagtaaaagttcttttttttttttttttttttgcaggtgatacaaatttaattctattgctcttatgatgaaaatacaactgcagtgaaatggcaagcatctcttcagttacactgctttacattatcactctacgtttattcatggaaggaactcaaatgttaaaaagttataaatagctgagaaacgttcaaaaatgaggttggctaatgcagtgagaaaagaaatacaaattagaacaaaagaatactatttcccctaaaattgacaaaagtctacttaaccgacagtatctaatgtgagctagagtgtgatgaagcatacccttgtcaactttggtgataaggcaatttagcatttccacaaaaattttaagtgaaaatatcattagtcatagcaattctacttctctaatacaattataaggaagccatatcacaaacatatggagatatatacatactgacatgtacatatacacatacacatatatacactatgttacatacacccacattcattatatcattatgaaattaaagaacaactggaaaacaccttttggttcctaataagggaagatttaaatactttactataaagctatattattatactttatgcgaaaatcaaaaggaagatatattctatatttctagcaagaaaagaaagttcacatatgttgttgattgaagaaaaagaagttccagactaataaaggtgacgggcttccctctttgataagtcctatgtgtcctatctatctcgacagaattctatcaggaataacactgtacttgttccacagaaattgtttgataagcttgtctggaatagaatctgagttaaatgtgccattgttcttccccagataactttttggagtctccatagatcatacaaagagagaacagagaaacaaggcaacaaattgggatacgctgcaacactctgcactgaacatctgacttcaattagccaaccctcaatttccaatacaaaaatcacaaaaggattactaagggagaatttataatggaaaagaggtgaaaaatggcttatttgctttgattatcagcagggtgtccagtacagtaggtatagctggcatgggactggtagtgcaggctggctcttggaaaggagtatgtattccaggctggttggctgctgttccactgggagctgaagccagggctcatggtcactcgtgacttactagtttgataggctctcactgtggagctagactcgtttgcttgttatttcttaagaatctctgtatctttctccttttttaccttctgtggttgtgatctgtgaggaaaaatgtgtatttctcccagattcagcctatatttatcctgatgtggctgtgaactggaccatctgctataggaaggagcacctgaagacttgttggctgaagttctctgtctggcctcgaaagacattcaaattagccaccactggagtagatgacctaaaagttcttacaactctcaattatacccagtgatgtctcgattagcacttattataaaaattaaaatttataattcaacatttataccatccagaaaaagttaaaatatattaatagcctatttctcttcaataaagcgtatatataactctatttgttaatgtttctattctccataacattctgtttatagataagccctatgctatttctagtcaagtgctaatctcttgaatgaagctgaattaggtagtcaactactagatgtatcctgaaaaacaagtaatgtgtatatttcatttattttatacataagagctacagactgatgtcacaatcttttcaagggctattaaattcattattttaactaacatttttgaacatctatcttatgttgttaattgaggacatttctgaatgtataacaacataagaataatagtttttaaacttcaaagagatgacaggttaatgagtaaaggagaaatatgaaatatcacagaattccttgacactaaatgatgttttgcaaatactgaacagaatgatgtttgtaaactttccactggttttcaagagtcccaaaacattaggaaaatgtacatcacctaactttgtcacatatttataattgtttttcctttttgtttccaagaagcacaatgtagaccaagaggtagaaaaaatatttttaaagatacatgtctaagatgttcagcttttgtcaaatgaagcaatagtcacaataatgtcacagagacaatggattgccagcttaatcctcagcaataacataatactcattatcaggcatttattcatttattcgttcatgaatgctattcattcacattcattaaataataactacaagttgaataatgttttcagcactggacacacagaaaaatcagacagattcgattttttgtttagatgaagaagaaggaacagaatataaacagcaaaaaaaaaatcaaaacacacagaaaaaaacaaaagtagcaaaactcagtgctcagaaattctgtagagtatttctatacacatgcacacatacacacatacattcacaccctataataccacttttattatgctattttgcatagaaaactctttagggatattaaattttattaaaataacaacagagatccttggagaagactacacataatatatcacctaatagcatgaaggtttttatctgcttatcttgtctcctagttttaaatatacacatttaaactttacacatttggactcagaatatggaaagcgttttattttccatattttcagttaatattacaatacttctttaaaggcctggcatatacttttttcatttccatccaatttcatgctgacacacaaacacatgcacaaatacacacgcacacacacacacacacacacacacacgcacatggtttattattttttacaattttgatcatagttttagacatttccctgcaaattgttttcctctaagaacaatttaatatgagcatccatccaggagactaattataaacctgctttacaattagtagagatttttggtagctatataattttgattgtacattctgtgtttcaattgtttattttcatatctgtagcccactctaactcagaaggtgagttctttgaaagcagataactcctgttttatatttgtattctcaagatctaacactgagtctagcacagagaagtcaatgaatatctatgagtgaatagaatatgcatgaataaataaatatttttaacgaatcttttctaaagtaattcattttttttttttttttgtgatggagtttcattcttgttacccaggctggagtgcaatgacatggtcttgactcactacaacctccgcctcccgggttcaagcaattctccttcctcagcctccggagtagctgggcttacaggtgcctgccaccacgcccggctaatttttgtatttttagtagagatgggatttcaccatgttagtcagcctggtatcgaattcctgacctcaagtgattcacccgcctcggcctcccaaagtgttgggattacaggcatgagccaccgtgcccggccagataatttcaacttttattatagattaaagggtacttgtacagatgtgttgtatgggtatattgtgtgatgctgaaggtgagcatagtacccagtagtttttttttttttcagcccatgtctaactcccttcctcccctatctaatagtccctggtatctattatccttatctttatgtctatgagtattcaatgtttaactccctcttatacacgacaacgtgtcatttggtttcctgttccatttagccactgtggaaagcactttggagctttctaaagaatgaatctttccatttaaaacaaattataccctctagactttatgtatgataggttaactgggggcaattgagaacgggatgcctattagaataaatagggagatcacaaaaaactttcagaagcaaacagtcactacaatcaaaatagttattagacacatagaaaatgaggaggagaaaacacaaactaggataatggctagttcaagtcaagttcctgggacttaggaaaaaataaccaatctaacttggttacagcaaattttttatataggcaagacattagactggtgagagattctcaaatttttaatcccttgaaagtcagtctgtttgtaatttataaaactccatgacagattttccgtggggtggcataagattctcaccatattttaggaagtttaggaagtttaccctgaaacaaatgtgctaagtaggttgagttacagtgaaccttagagtaggctagaaaattcgctcttggaagaacccagcaagtgggagccaagctagaggaagaacaagaggataaaaacttaaggaatgagtatatatatataaaaaaactgcaagaaaaacaaacagaactttttttttaatttatcctttttttcatcttttagattcagggggtgcatgtgtaggtgtgtttcctgcatatacctcatgattctgaggtttggagcatgaatgctatcacccaggtactgagtatcgtacctaagagtctttaaacccttgcctgcctccctcactccccactcttgtagtcctcattttccattgttgccatctgtatatccatgagtacacaatatttagctcccatttataagtgagaatatgtggtatttgattttctgttcctgtgtttgtttaggataacaatatccagttgcatctattttgctgcaaaggacaagacttccttctttttagggttgcatagtattccatggtgtatatgtaccacatccaccattgttgggcacctaagatgatgccatgtctttgctaatgtggggcaatgaacatgtgagtgcatgtgtcttttggtagaaatatttgttttctttttttggatctttgggcagtaatgggattgctgagttgaacggtagttcccttttaagttctttgagaaatcttcaaactgctttccatggtggcttcaccaatttacgttcccaccaatactgtataagtgttcccttttctccacacccttatcagcatctgttgttttttgactatttaactacagcaattctgactggtgtgaaatgagatctcattgtgattttgatttgcatttctctgaagattagtgatgttgaacattttctccatattgagagatgacaacgtgctagcagccctggctggccttcggttcctcctcgtcctaggcttcctctctgaccacgctcgaggagcccttcagtccgccactgcactgtgggggcccctctgtgggctggccgaggccggagccagctccctctgcttgcagggaggtgtggagggagaggcgccgccagaaccggggctgtgcagggcaattgcgggccacagtgagttctgggtgggcggggcctcagcggtccccacacttggagcagccagccggccggcgatgccagctccaggcagtgaggggcttagcacctgggccagcagctgcagagggggcgccgggtccccagcaccaccggcccacccatgctgcgctcaaattctcgccaggcctcagccactgccccagggggcagggctcaggacctgcagcctcccatgccccagcctcctcaccccgcctccccccatgggataccgcatggccccagcctccctgacaggcgctgccccctgctccccggtgcctggtcccatggaccgcccaagggttgaggagtgcgggtgcaccctacgggactggtgggcagctccaccggtggccccggcacgggatccactaggggaagccagctgggctcttgagttgggtgggaacttggagaacttttgtggctagctggaggattgtatatgcaccaatcagcactctgtgtctagctgaaggtttgtaaacgcaccaatcagcactctgtatctagctaatctggtggggacttggagaaattttatgtctcgctaaaggattgtaaatacaccaatcagcactctgtgtctagctcaaggtttgtaaatgcaccaatcaatactctgtgtctagctcaaggtgtgtaaacgcaccaatcatcaccctgtgtctagctcaagatttgtaaacacaccaatcagtgctctgtgtctagttaacctagtggggacttggagaacttttacctctggctagaggattgtaaatacaccaatcagcactctgtgtctagctcagggattgtaaacacaccaatcacactctgtcaaaacggaccaatcagcactccgtaaaatgggccaatcagctctctgtaaaatgggccaatcagcaggatgcaggtggggtcagaaaagggaataaaagcaggctgcaggagccagtagtagcaacccgcctctgtggaagctttgttgttttgctctttgcaataaatcttgttctgctctttctttgggtctgcgttgtttttatgagctgtaacactcattgcgaaggtccacagcttaacttctgaggccagcgaaaccatgaacccaccgggaggaatgaacaactctggacgggaggaacaaacaactcccgaggcgctgcattaagagctgtaacactcaccgcgaaggtctgcagtttcactcctgaagccagggagaccaggaacccaccagaaggaagaaactctgaccatgtccgaacatcagaaggaacaaactctggacacacatatttaagaattgtaacactcactgtgagcgactgtggcttccttcttgaagtcagtgagaccaagaacccaccaatttcggacacaatatgattgttggttgcttgtatgacttgttgggaaaatagtttgtttatgtttttgtcctttttttaatggggttatttattttttgcttgctcaattgatttacttatggattctcaaggagattttcatctttgtcctcttccttttgccttgcctttaacatggattcctacgctttctggaagagaataacatagtgaaatttgcaattcagaaaaaaatacattggcagttgaaatttgtatagtacactatgatatgcatttatatataaatatgttcagttttaacagatgcctagtaacatatagttgaatggatctaggagattctgctattgagaagaaaaaaactggaatgtattttcaaaattgtacaactcctattcatacacttttatatttggtatatctgtgagaaaatatccatgaagagaaacgtaagaacttacataaattggaagagtaaagcatatctaagacatccagtttatgagtgacaattataaaaaaaaaaatcaggtaagtatgtcagatccttgtatctgttttcaggtaatctggccaaatagcagtaacatcatctttaaaaaatgagtttaaggccgggcgcggtggctcatgcctataattctagcattttgggaggccgaggtgggcagatcacaaggtcaggagatcaagaccatcctgactaacacggtgaaaccccgtctctactaaaaatacaaaaaattagctgggcgtggtggtgggcgcctgtagtcccgctacgcgggagcctgaggcaggagaatggcatgaacttgggaagcagagcttacagtgagcccagatcgtgccactgtactccagcctgtgcgacagagcaagactctgtgtcaggaagaaaaaaaaaaaaacaagagtttaaaaccagggtgggtcagagtggtgcgcatatacatataaaacgtgacaatttcttgtgtaaaaaataagatttttaaaagacatttctagtctcatatgaatactacaaatttttatttgctagcgtttttggggtgaatgccaaaaacccttgtgaggtacctggaaatggactggaaagagtaggtggcaaatgaaggcagaatagtacagtgttctattagatgggaccaatgttaaaaataaactctgagttaagagacatcacatcatttcctgagacagaatacaaacaaacaaaagattcttttctacctgtttaagagattggtagttttactaacttatttttctctgaaaataacatacgcatattggcaattttctttcactttatctaaactagatacagtgatgtaataaactatcaaattttcatacgttggatgattgaaaaatttagaaatttctaaacttattcacttgcatttatatatcatgtgtaatgacctcatcagggataccttttttgattcatttacaccaaattatgtgtcttttataattttataatggttcgctcatcttcagatttattatatatcttatagcgtgtgatttagtaattatgtatggcagagtgtgatcttttgtttcaaatgtaggatatttgagttgatattgtaccacttcctacatttgaagtggtacaatatcaattctaaatagacttctaaatatactagactctagaaaaacaagaaggtaaaaaaaaaactgtgaggttgtaaacaaaacctgattatatattgattatattaaattacatgtaaatactttaattgagagaaagatatcgccagactatataaaaatatacaatcaaattatacttgacaattatttaaaaatgcactttatatacaaagtctcaagaaagatgaaagtaaaatatgaaaatatatgctatgcaaactgcaagagaaaaggctttagcgtgtctcacatcagataaattagccatgacaaaataaattaccagagagaaagagaggcatattataatgttaaaaggggcaatcctttattctaaaagacataacaattcttaaatttgtaagcacctaaaagagcttcaaatttcatgaagcaataactgacagacttaaaggaatagacaaatccacaatgactttgggatattttaatactcctttcaagctaatagatagaacaaagagaaaactcagagaagatgtagaaattggaattctaatgactttcaagttctttatatgtcaatgctgaaaatgaaagtctcttttgttatatatatttaatgttatttctaaatgaacttcaccatctttgccaatgatagctatgtctattgactgatttcctcctcctttgtcttaaggctctcattttcctgattcttgtgtttaatgatttcgaatgtatactgaattgtagatattacattattgggcaccaggattttgttatcttctaagagtattacattctagtagataataattgtttagcttggttattttgagttttgtttttaagctttataaggttggtctaaatgagactttacaggactgttttggccttgcttgtaagacaggcctttctagggtttttattaaatatcttagtggttaagtctttccattctggcttgttggaaattgaatgtctaggtgagctctagtaatttttcaccttgcagttcttttctggtggttctttagctgaccttgcagcatgtttgtttatgtatatgcagatttccattcatctaaagacataagggaacatccctgaaaatcctgtgtactctttttctgcattgcattcttaaattaagttcagcccaaagttgcctccttacacattttaagtttggcctaaaggtttctctatacatagtgaagtgtaacctagctgatatgttaagcagactgtatcctacacttgtgccagccactgagtttttgccagtgaagagaagtcgactgttaaaaccatgttcaaacacagcaaacaccgagctgtaaccagaggagctgtttttgtacctcactttcattttctgtatgtcattttgctttttctgtccataaatctttgatcgcatagctgcaatggagtgtctctgaacttagtctggttaaggggctgcctgatttgcaaatcattctttgctcaaactgttaaatttaatttgtctaagattttccctttaacagctttgaagcctctgctgttttgtaacataaattatacctgatcacctttctctaatgttaaactctttttttctcaactaatcaaaacttctgtggtctgcttgggtttttcttccatatggtacttcataaattgtctccagataaaaacaaaacagaacaaaaacaaaaaagagcaactgcagggatttcttgcctatttctcctctctttagtacgacagtctggcagtagtggctgtctactgtcttaaacatttgttttattatattctgtctagtcatctagttgtttatggcaagagggcttgtctgaggccagatgcttcatattggccaaaggagttattttctcaattgatttttgacaaaggcacttagatatttcaatgtacaaaggagcatttcttcaacaattggtgcacaagtaactggatgtttgcaatgaaaactaaaagtgaactttgacccttacctcacttcattaaaaaaaaaaaaaggtaacttgaagaggattatagaaaagaatatacaccaaaactataaaactttaagaaaactatttgagaaaaaattcttcatgactttgaagtaggcaaacatttcttagggcacagaaagcattattcccaaaaacttcttgaccaaactttagacagactcctctgagttcgctcttcaaatgggccttttcctcaggtcttgtcttagacttgcctagtccagttgtagctaagtcagtttagggagactccccacccttgatatctaaacctgatcaagtggctttcagaaaggattctattaggcaggtttagcaagaatccctctacccgtgatagctcccattagtagttttctatccattgacctccataattctgctcattggctataaatccccagctgtctttgctatatttttgctatatttagagtcgagtcccatctctctcccttatttcaatagctttgacatttgtttcaaaagtcctgaatcaaatctttcttatcattttacaagtaaacatgataaacagaacttcagtaaaatatagcagtgtaatattttggtctcccttaataaatcaaacataggttaatatttgccgctttatttgtcaaattctagtaatgagaaaagttatttagtccaaagggttttattgtcaatcaaatttaggaaaatcatttacattaaacacaattttattattatcaaaacatctaataatagtaattaggttcacgagtacatgttcaggggtacatgtgcaggttttttataaaaataaactggtaaactcatgtcatagaggtttgttgtacagattattttggcacccaggtactaagccttgtacccaatagttattttttctgatcctctccctcctcccaccctcaacactcaggtaaaacccagtgtctgttgttcccctctttgtgtccatgaagcacaatattctaataaagactctgagaaatccggagaaaataaatctttttcaacattgttccactcatattatcgtagcattaatcttttttgggggagtggagagtaaatattattaaagaaagttaaatggttctatggaacatctttatcaaaactctagcttcactaatggtgtggaatgtttagcactgcttgctactctataaacttgacagacagatcctgatcattgaaaagcctactccaagtaattaaggaatagtctattctgagaaatcagtgtgagaagcagagaaaacaggtcaatgaaataaatagtatgctaaaaattagtcttttgttgtgtatattaattatcatctatgtttcctcagaaaaaatataaaataatatcatttttgaaggataaaagttagtatttgctataatttatatcattcagatcaacattcaaaatttccccttagtgttagcagcattaataagtgaacaaataataataacaaaaataaatgaatacaaacatagatacataaatgaacagaagaaagaaaaaatagctttaagtggagatgcaaattttaaatagtatatactacagacaccaacttttaaatacgctgtttattaattcatagttatttcttaattctaataatgtttcttaggtgtgagtggttttggcaggacataaatactcctatcaaatgtacatcccctattttgtctccattttgaagagttttattttgctacaacctgagcaacattgcagagccagaacatatcagtgtacatccctttattggggatacacatctcttcaaatatggaattaatgtatatcagattctttttaaaaaaagaaccctaatattgtaccttgcatgatcagtgcaaatatttgcaaaaatacattacttgaacaaatcagaataacttcctcccatttgtgtaaaacatttcatggtattgaaattctaactgagctttttagatttccaaattttagctaaagaggaaaaaaacaagtattctttcagactgggacaactgtaccccctcactccatgataggaaaacaaaataaaaaaccctgttcaaaattagcttggaattctaagtggggaactcttaaacttgatgtatctgttcattcactctgcattaaatgttcattttgctcctggtgcttatccaattggccctccttggagttattgcgtataatatgtacttgtaccaggacactgtccactcctctagagtcagtatgatgtctgaatcctgtgtgttttggttatctgctctcctttagcctgcccatctaaagacagtctatgtacttcagctattgcagtaaaagacagaaaagcctgagtgcaataagccagatataattaaatagccacgaggggttggactcagatggttaataagtgtcaaagggacaaacatttgcctttgaactaggtcaattatgagatatttaaagggtaacagatctgtgtatactcattcagaaagagtatacctctcaggcctggaagaagaaatggcttctgagaatcaaggagttcaacatactgatttcatttatttttgatatatatccagtaatggggttgctggattacatagtaatcaatttttaattttttgagacacttccatactgttttccgtaatggctgtactaatttacattcccagcaactgtgcataagagttcccctttctccacatcctcatcagtacttgttattttttgccttttgataataaccatcctaatctgagtgtggtaatatttcattgcattttcctgacgattagtaatgtttaacatttttagtatatctattggcatttgtttgtcttcctgtgagaaatgtttattcagatagtttgccattttttttttcagacagagtcttgctctgccacccaggctggagtgcagtgccgtgatctcggctcactgcaagctctgcctcctgggttcacaccattctcctgcctcagcctcccgagtagctgggactgcaggcacccaccaccacgcccggctaatttttttgtatttttagtagagacggggtttcactgtgttagccaggatggtcttgatctcctgacctcgtgatccacccgcctcagcctcccaaagtgctgggattacaggcatgagccaccacgcccgacctattttgccaatttttgataaatcatattatttgctttttgcttttgatttgtgttcttggtttgttctagatagtaacctttgtcagctgagtagtttgcaaatacgttctcccatccttcagcttgtctcttcactgtattgttttcttctgctgtgcagaagtagtaaatccttacctatcaataataaccttgactataaataaactaaattatctaattaaagtatataaagtggttaaatggactaaaaaaagactcaaatatatgctgcttataagaaacttgtttcacctataaagacatgcatagactgaaagtgaagggatggaaaaagatattccatgcaaatggaaaccaaaacagattagaagtagctatgcttacatcagaaaaattagactttcagtaaaaaatgatttaaaaaatgacaaataagtccattatataatgataacagggtcattacagtaggagaatataacaattgcaattacatatgcatcctacactggagcacctttatatgtatatatataataacagatctaaatggagatatttgttgtgatgtaagaatagtagggtactttaataccccactttcagaactagacatgttatccaaacaaaaaatgaacaaagaaacatcagagtaaggccaggtgcggtggctgatacctgtaatcccagcactttgtgaggccgaggcaggccgatcacctgaggtcagagttcaagaccagcctggccaacatggcgaaacctcatctctacttaaaatacaaaaaaaattagccaggcatggtggtgcacatctgtaatcccagctacctgagaggctgaggcaggagaatagcttcaacctggaaggcagaggttgcagggagctgagatcataccattgcactccagccaggacaacggagtgaaacttcgctcaaaaaaaataaataaaaaaaaagaaatatcagagttaaactgcgctctagaccaaatggacctcatggacattgacagaacattttgcccaacagctatagcatacacatggaaagttctccagtatagactgtattttaggacgcaaacacccacgcacaaaattaaattaactttttttttcaaaaacgaaatcatatcaattatcttttctccccacaatagaataaaactagaaattacctttttaaatgaatgtgttaatgctaatatgccaaattttaattgaataaaaaacaatcttttactttacagatttgattcagttttacaccaatccattacattttacatcatgaaggtctaatttttgaacagaacataaagcaataatgttgacatagttgaaggaattcttaatattttgtctcttctttgcaataaaactatgttttcttcctcagaataaaagcttgaaaaacaaactcttgtcaggaaacaagctctgtggcattcacgcagaagaggtgagtaaatttttgcttcttctagctttaaccagataaaaacagtattattgtcagatttttgttcaactcagacatctggtaactctttttcctcctaatacaaatgccaatttttaaatagaaaaatataatatattttaaaccttttggtatctttgtgttttaacattgcaatagccaaaaggaaaaaaaaaaattaacaaaggcaggtaatgatcacctttgtagatttttttttttctggatttcttccttatctggactatcagaacttccttaatagcaaattactgggagtccataaaatttccttttttttttcccctctcttgtactttctatgtgatgtctacaaagttttgcagtggcaagtgactgtcagagtgaagattccgggcttgtccataaaccatacaaaatcaatacactcattggttctatttgctgtgtagtaaaattgtctcatatatttctcagggggaaatgtcattctgcttaacatagatttaactaaaataatcatttttctatatttctcatctccaagtctattcttatgactctgtaatgtgaaaatgtagctcatagaagccttagtaatatcaatgaaataggaatgatactgtcatgataagtgattgtttatgactcaaggagaggagacaagagtcactgttttagctgcatcctccaagaagcacacactaagatatattaaatgtgcgagaaatatattcaagaaatagcttatgaatgataagggacagtcatgagtggcttcatatcatgatgaatgtcttatacctaagatgtagagggaaggaaggaagtttagctgcaatgagaaaagttgcttacacaagttaaaacaagtttaccctttgtctcagagttgtctagaagtaaggcgaagagtttctaaaacagctctattgtctttaaattatggcatgaccactgattcaaaaatatctttttctgccactatcctcttccagcaggaaggaaagggaagataacctggtgaagcacaagcgttgcttctcaggagtccacccaggaaatagtctcttctatctcattgtaccctatttgctaaaactagctcacatgctgagctaagttgaagcgagtctggaaaatgtcactaggtcagtggtcctgtgtccagcccaaactaagatttgttaaagaaggtgaaaactctccttgaaaaacaagaaaaaatcattaacacaaatacaaaaaaaaaaaaaaaacattaacacaaatacaaaataacatgcaatgtaacaatccattttataatatctttcctataatattatatatggcatgaatagaagtgtttaatacacaaaaactaaaagatgatgttccataggatgaaaaattagcctaaatggtttgtagatctgatctagtgtagcatttcatttctttgtatttttctatttgaatacaaatagacttgtacattgtttatatttcctaggttttggaaatagtataaatgtggtttgtgcaggttgtgagtattacttacaagagggtaacaaggtagaatgatgttttgaataagaaatatctagattgaagttatattctgatatgatttatatgtgttcagggttcacatgacactcatgtatatgaaagagaggaagctcctatgagaaatatctgtggtgcacagaagtaaaaatgggcttacctttattgtttagtctgtcagttcaagaataattcgtattttttcttcatctcaatgcctttgagaatatattatccctgaattgttagatacttcatgtattagtgttgcctaatattgaaatgtattgtcatgcctactattgaaatgtattgtaataggttcattgcaatttatttgctgtatgtcattatgtatttatggaataaatttagagcttaacattctcggtaatggggcaggcatgtgtttttgtctgtcacaatacaatttcaaaacaatatggtggcaaatttaattatttgattcaccatcactaccaaaaacaaaatactaatatattttcttggttaggagctaaaatggagattgcctgttagatcagtgaccctcaactgtcagtattcatagaataaaatatctaaatcccattgacacccagaagattgccattgttttaatttgccagaggataatattcacaagggaagctactataaacaccatctaccaaaatcatcactcctattttatcaaagaaatgctgtttgaacatgaaattataagaagcaaaaatctcagactgaaagataatctcctgaatgggataaaaaagctgagctaaaatatcctatcatggctgcctactttttcatcgtccttgtctttttatatagacaatgttatcattattagcaactttaattttgccgtgaaatcttcttatgaaaactttatgactcacagtcaccaacatctggaactgtatttaaaatcactaattgtttgaaggttatccttttgataattttagcttttcaaaatgttgctaacaagttaaataaaacgatctaagtgttagctgggttttgaattaatatatattataaaaaagagatgtacccactcagaatgcatttattctttgcataatctttcctgaaatcctcagacaggaagttgctttttttgttgtttgttttttttctttttttttttttttgagactgagtctccctctgttgcccaggctggagtgcagtggcacgatctaggctcactgcaagctccacctcccaggttcatgccattcttctgcgtcagcctcctgagtagctgggactatcggactattagcccgccaccacacccagctaattttttgtatttttagtagagacagggtttcactgtgttagccaggatggtcttgatctcctgacctcgtgatccacctgcctcggcctcccaaagtgctgggattacaggcatgagccaccgcacccagccaggattttgcttttaactgaaaattacaagagtgctagaaacaaagagatgagtaactgtgaggaaaacccctaaaacattttttaaaaatatatatatatataattatagcaaagctcaaaaaatctagtcattcaaggccatcaaatgcagaaggttttattgtagttcctgaatgaatcattgaataattgatgttttgataataattccaagttatgtggaaaattttaaatgatattctgtacattcagaatatgcactttaattatgttttaaaaatgaacacctcaaattgttaaaaggcaaccattctgacacttgaaagatagagcatcaattatgtggaagaattgacatgcagtttggcaactcatgtgcaccatatgtggtagtaatctcccactctcccttgatattcatcaacattattttgagggaaaaaaaaaaaacaaaagaagaaagtctgttttcctgagaaacctggttgtaaacgagtcctagacagcagattggaaaagcagggagaaaatgccaatcaactgtgcatttgaaattgtgagagatttaataaattattgttttctaaaatcagcagcacaaaataatgataaccatgtaaagcagaattatcttagagggcctccccagccatgtggaattgtgagtcaattaaactctttcctttgtaaattgcacagtctcaggtatttctttatgagcagtgtgagatcagactaatacagtaaattggcaccacagggaatggggtgctgctgtaatgatacctgaaaatgtggaagcgactttggaactggctaacaggcagaggttggaacactttggagagctcagaaaaaaacaagaagatgtggggtagtttggaacttcctagagacttcacaaatggtttgaccaaaatgctgataatgatatggacaatgaagtccaggctgaggtggtctcagatggagatgaagaacttgttgggaactggaacaaaggtgattcttgctatgctgtagcaaagagactgtcagcattttgcccctgccctagagttctgtggaacttcgaacttgtgagagataatttagggtaactggtggaagaaattcataagcagcaaagtgttcaagaggaagtggagcatgaaagtttggaaaatttgcatactgacaatgcaataaaaaaaaagaaagaaaacattttctggagagcaattcaagccaaaggcagaaatttgcataagtaatgaggagcccaatgttaatcaccaagacaatggggaaaatgtctccaagggacaaggaaaccttcatggcagcccttcccatcatatgcccagaggtctaggagggaaaaatggtgtcatgggctgggtccagggcctccctgctctgtacagcctctggacatgatgccctgcatcccgtctgcttcagctccagctgtggctgaaaggggccacggtacatctcagaccattaattcagagggtgcaagcaccaagccttggtgccttccatgtggtattgagcctgtgggcacacagaagtcaagaattgaggtttgggaacctccacctacatttcagaggaggtatggaaatgcctggatgtccaggcagaaatgtcctgcaggggcggaagccacatggataacctcttctagggaagtgcagaagggaaatgtgggtttggagttctacacagagtcaccaccgcatcactgcctagtggagctgtgagaagagagagccaccgtcctccagactccagaatggtagatccaccgacaacttgcaccgtgcacctggaaaaggcatgggcactcaatgctagcccatgaaagcagccaggaggggggctgtaccttgcaaatccacagggtgcagctgcacaaggctatgcgagtccacctcgtatatcagcataacctggatgtgagacatggagtcaaaggagataattttggaactttaaggtttaatgactgcgctattggctttcagcattgcatggagcctgtggcccctttgttttggccaatttcttcatttggaatgggtatatttacccaatgcctgtacccccattgtatctgggaagtaactaacttgcttctattttacaggctcataggcagaagggaattgtgttctcagatgagatgttggacttggacttttgggttaaagctggaatgagttaagactttgggggactgttggaaggactgttttgaaatgtgaggacatgagatttgggaggggctggaacagaatgatgtggtttggctttttgtttttacccaaatctcaccttgatttgtaatcccataatctccacatttcaaaggagggtcctggtgggaggtaattgaattttggaggcagtttctcccatgctgttcacttgatagtgagtgagttctcaggagatccaatggttttttaagcatctggcatttcccctgctggcactcactctctcttctgccaccctgtgaagaggtgccttccaccatgattataagtgtcctgaggcctccccagccatgcagaactcggagtcaattaagcttctttcctttataaattacacagtctcaggtatttccttatagcagtgtgagaacagactaatacagagagtaaattaacataataagacatagatgctgtacttgaaatattattttgagtcacttgggaagctgtgtgaggacagacagtgatgtaataaatgtgattctgaagtagaagaataaagtcaaggtactgaggggtcaatgtgagttttcattcataaaagccattggcaactaggtagactcaatcatgtctttttgttcttcttatgcatcatgcatttcaccttcagtatccatatcaaaagaaaggtgactttctatggaaatgaaaacaaatcaattaccctgtgagaaaccataaattcttgctgctgctttgtacagagttaagtgatacagaattattaacatatctcactcttaacttacccttcctttcgtttcctttcttttcctttcgtttcctttcctttccttcctttttcctctcttccttcctctctttcctcctctttccttcttttcctctctcccacttcctctttacctccccctttctctctccttctcttcctgtctccttttctttttttttaattttatttcattttgttttctttttgttctttcttgttaacttcctgattcaatggatcatgaaatgcaggtgacttataatagaaatatctgtgaaaaaactgtgtttccaatattagaaccttgtagtggtgcatcattgacaacaaattcaagtttccacttgaatcaatcatacttatagcattgaacaatgattgaaaaattattgtgccattataacacagctccaacttcacaaattgagtacactgcataattagaaatattctggggctgggcatggtggctcacatctgtaatccgagcactttgggatgctgaggtgggcagattgcctgagctcaggagttcgagacaagcctggacaacacagtgaaaccctgtctctactaaaatacaaaaaaattagtctggtatgctggtgtgcgcctgtagtcccagctactcaggaggctgaggcaggagaattgcttgaaccaaggaggcggaggttgcagtgagctgagaatgcgccactgcactccagcctgggcaacagagcaagactccatctcaagaaaaaaaagttctgaatattatagaaaactgaatcacaataaacttgcagttggttcagtggaaaacatatacatgcattgtaagcttggaaaattatatttctaccatataggcagacattctttattaaaaaagggcttgtatatcaacacagtttactagcatgtaatagtgacataaggatcatgggtttattacctactgcagccagctgcttttaaaatttaatttcattgagataaaatttaattttattgagatttatctagtttaagtgtacagtctgatggatttgaccaatggatagattcaaaacatagaattttttcattaccctccaaaatgtcttcttgctatattacactgaatcttcatccccatgtcaactactaaactgatttctgtccctatttgtttgccttttagaatgttttccaaatggaattgtacaaaatatagcttctagttactggattctttcacatggtataatgcttttgaaatttgtccatgttgttctataattcagtacttcattcctttttcattgctcagcagtagtctagtactccatgtcatggatatactacaatttatctcttcatttcttattaaacatatatgctttatctagcttttggctattatgaataaagatgccataagcatttttgtatatgttataattcttcttgggtaattacctaggacatattgcagtgtaatgcaatgtacatatgtttaattttatcagaaactgtcagtttccccaaatgatgatactaatttataattccactcaaatacattttaagtatcaatttttccttcatgtgatcatgctaatctatttatttgtgtgtgtgtgtgtgtgtgtgtgtgttattggttattggtggtagtagttttctttttctgtttgtttgttttttgcctgagtaaagaatcagtacctataattttaggtacagaaatacaataatctgaagtccttatatttaatgttagtaattgggactgtcctgaaaaattcaaaatacatgatcataactctgtgacttaagggaccgtaattaaatgtggtagtcaaagcaaactgctgagaaagattttctttttaagtattttcctattagtgatggccctcttaaaaaatgtattgctctaaaatgcaaacaacattcagctcagcatgttagtattgtagcagcttttcttgcttccgatcacatttgcttttacctggacatatgtcaaattcaaatttattctaatttaatttaaaaaaagtaattgaaaataagtagtaaaaaaaatgaggcatgcatatgtacagatataattagcgtctaaaattagattgttggccatgcctgggtgacagaaattttgtgtgtttagttgtggattggaggaagaacaataatcgactttctttaaataacatgttttaaacaagcttcggtttttctctttctgcctaggttgtccagaggtctgactctcaaagcagagctaagggtttctgctttacttctaaactggttggactgtgctttgcttggctgcaaaatgtattcctgtgaagtctgaaagtattttaatcttcaagtttgaaaatataaatgagttacacaacttatccatgtttttgccttacagtcaaaaaaaatccaagcccagctgaaggagcttcgttatgggaagaaggatttattatttaaggtgagtctcttttctctcttttccctgaaacttgctagctcaatacctaaaatatcaaaaacattatttaggttaaatttattttctggaatttctcatgaattggagttgcatttgactgcattagaaatactttcattttcttgacaacttaattaatggagataagtggaagtattatttcctacattcattcttaatcaaaagcatgcctcattccagcaggttaggagtgtataaaacaaatcctggttccccagagttcatgagctgcagatattaagctgagagacttacgcaaaggtagatcatacaaggacttttgaatcttttaaatttatttttcaaatcagaattttagaaagaaatgttagaagacaatgagacagttcagtaatattcagtgttttacttgtatgtaatatgccagttgaatatagattagtaatgcatcaactttcagatattatcaagatcaggacttgttgaaaatttttatgacttaaaatatgagatatattgtatgtaaaccttgttatttcatgttattttacattttatgaaatcaggagacctgaatacaaagagactatgaagttgcatgaattagaattcctttaatgtatacaatacccacaaaaactgttctactgtaggactttcattaactcaaataacaaaagggccagaagcatgacaatgttatgatttatttcatagctcaacagtgtcaacaaacctcaggtttgtttttcattgtcctctacatcactccatataacaaccctcaacttactgacttattctaaaccttggttcctcatataatcatgatggtcgctaaagatatacatattgtgtcttcatcaaactatgtacacaatcaaagcagaaaaaggaggcatttgtccttcaaggtcattattttttatgaaagaggagagtttttcgagaagattctccaaactaggttatgcatccatgcaaaggtaaaaccttagcatttttagcaattttagattctattgtgaaagactgtttcttttacagataagtaatagaaagggagttgctgtgggtttaagtcttgaataaacatatgttgatgatagacagatagatagatagatgatagatagatagatggatagatagatagatagattagataggtagatagatagatgtgtcaaggaagtagacagtagaaactcaactgttaggttagtgcaagagtaactgaggttcttgccattaaaaaaaaatggtaaaaaccacaattactcttgcaccaacctaatagcacaaaagtatctattaacacagacattcagccatgcacctttgaaaatgagttgacaaactggtgaaccctgagatgagtagtagattctatttcacatactttccccttaggatatgttcaattttgaatagattttattttattttattttttatttatttattttttttagtaaatgtagactttgaagaagtaatgcttgctgtcaaaacatttacatttcatcctaaaaataatgacacatgctggcacttgcaaggcataatgatgaattaagtgcccttattaatgcttgagagctgcctttagcttggaagaggcttttagctgaagtacaaatccttcactaaagatagaggtgaggcctaactgactgttagttgcccagagacttgagttactttatatcctccttgattccatttggagctgatatattctctagaatacctaatctccattttagtgctctttttattttttattttttttattttcttttaaattatactttaagttctagggtacatgttcacaatgtgcaagtttgttactatgtatacatgtgccttgttggtgtgctgcacccattaactcatcatttacattaggtgtatttcctaatgctatccctcccccctcctgccaccccacaacaggctgtggtgtgtgatgttccccttcctgtgtccacatgttctcactgttcagttcccacctatgagtgagaacgtgtggtgtttggttttttgtccttgagatagtttgctgagaatgatagtttccagcttcatccatgtccctacaaaggacatgaactcatctttttatatggctgcatagtattccatggtgtatatgtgccacattttcttaatccagtctatcactgatggacatttgggttgattccaagtctttgctattgtgaatagtgataccataaacatacgtgtgcatgtatctttatagcagcatgatttatgatcctttgggtatatacccagtaatgggatggctgggcaaatggtatttctagttctagatccctgaggaatggccacactgtcttccacagtggttgaactagttgacagtcccatcaacagtgttaaagtgttcctatttctccacatcctctccagcacctgttgtttcctgactttttaatgatcaccattctaactggtgtgagatgctatctcattgtggttttgatttgcatttctctgatggccagtgatgatgagcattttttcatgtgtctgttggctgtgtaagtgacttcttttgagaagtgtctgttcatatcctttgcccaattttgatggggttgtttgtttttttcttgtaaatttgtttgagttctttgtagattctgaatattagccctttgacagatgagtagattgcaaaaattttctcccattctgtaggttgcctgttcactttgatggtagtttatttttgctgtgcagaagctttttagtttgattagatcccatttgtcaattttgacttttgttgccattgcttttggtgttttagacatgaagtccttgcccatgcctatgtcctgaatggtattgcctaggttttcttctaggatttttatggttttaggtctaacatgtaagtctttaatccatcttgaattaatttttgtataaggtgtaaggaagggatccaattttagctttctacatatggctagccagttttcccagcaccatttattaaatagggaatcttttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtataactttaagtcaggtagcatgatgtctccagctttgttcttttggcttaggattgacttggcaatgcgggctcttttttggttccatatgaactttaaagtagttttttccaattctgtgaagaaagtcattggtagcttgctggggatgatattgaatctaaaaattaccttgggcagtatggccattttcatgatattgattcttcctacccatgagcatggaatgttcttccatttgtttgtgtcctcttttatttcgttgagcagtggtttgtagttctccttgaagaggtccttcacatcccttgtaagttggattcctaggtattgtattctctttgaagcaattgtgaatgggagttcactcatgatttggctctctgtttgtctgttattggtgtataagaatgcttgtgatttttggacattgattttgcatcctgagactttgctgaagttgcttatcagcttatggagattttgcgctgagacgatggggttttctagatatacaatcatgtcatctgcaaagagggataatttgacttcttcttttcctaattgaataccctttatttctttctcctgcctgattgccctggccagaacttccaacactatgttgaataggagtggtgagagaggccatccctctcttgtgccggttttcaaagggaatgcttccagtttttgccgattcagtaggtttgcacatgattatctcagtagatgcagaaaaggcctttgacaaaattcaacagtgcttcatgctaaaaactctcaataaattaggtattgatgggacgtatctcaaaataataagagctatttatgacaaacccacagccaaaatcatgctttttttagatttgacaaatgtaattctttaaaaaaaaaatcctaaatattatttatcattgaagaaaaatttcaaaaaagtgtcaaaaaatataaagccaaacttaaaatcccgtcaccagagcaaatgcaaacaatattttaacatattttatatttctgtctatttccctttgtatgaattatatctgcctggtcattgatatatatacacatatatctccattggaatacatctatatatatatgttctttatatatatccataatatatattatatatagttatatataatatatatccataatatgtattatatatagttatatatactatatatccataatatgtattatatatagttatatatactatatatccataatatgtattatatatagttatatatactatatatccataatatgtattatatatagttatatatactatatatccataatatgtattacatatagttatatatactatatatccataatatgtattacatatagttatatatatgttatatatagttatatatgatatatattgataatatatgttatatatagttatatatgacatatattgataatatatgttatatattatatatgacatatattgataatatatgttatatattatatatgacatatattgataatatatgttatatattatatatgacatatattgataatatatgttatatattatatatgacatatattgataatatatgttatatattatatatgacatatattgataatatatgttatatattatatatgacatatattgataatatatgttatatattatatatgacatatattgataatatatgttatatattatatataatatatattctttatatatattcataatctatatattctttatatatatactgtatatgtattctttatatatattcataatttttaatttaaatacacaggatagcttttaattttatgtagatataccaaaggttacttaacctttcacttatgtgtaggtatgtttatacatgcatacatatatatataatgatttaaatttacattatgatgaaaaatcctttcttatttttaacttgagttatagtttttatgaaacatttatctaactatcaagtagttcatgaaaattattttaaaatattaattattgctacctagtacaggtgattttcaaaagaaatacaatagtttactctcccatcagtacaataataacaagagaaatgttgaatttaagaattattttatactggatgttttattaaagaaacaaaaataaataattggttagctaagaaattttatgaatgaataagtcctacacaaccatgacaagttgtgttcctttaagagattataaagtaaaatgattattttgattttaaattttattattggatggtttaaagatttaagtcacttgattttctttgcttacttttttggggaggtaggggtaaattaaaaacaatgtttacaatactcccaagtcacaaaaaattcaatctatcaacttctctgttgagatacataatggcagacattttgatagttttgtgattgtgtttgttgtttattgaataaaaacaattttaaaataccatgtgtcattcagtgtttgaaataaaatagtggcttagttaaattactgcttcagggaattggtagtccagttattaaaaatatactatagtgatacatttttccctgtgtattgttagtttctatatgcatacaactgtgaatcaaaaatatttgaacaaaatttaactcagcaatctcactgttgggtatctactcccccaaaaagaaataattaaatcaaaacttatctgcactcacaggtttatcacagtactattcacagtaggaaatatacagaatcaattgtaatattcatcaacagatgataaagaaatgtggcatatgtacacatatggaatgctattcaactataaaaaataaaatcatgtcttttgcagcaatacaggtgaaactggaggccattatcttaattaagtgaaacaacccagacacagaaataaaaaaaaaaacctgcatgttctcacttaaaaatggaagctaaataatgtgtacacatggacatagagtatggaatgatggataatgagtactcagaagggttgtggggaaggaaggtactggaagatgagaaattatttaatgtgtatcatgtacattatttgagtgatggatacactgaaagcccagacatcaccacaatgcaatatattcatgtaacaaaattgcacttacaccccttaaatgtatacaaataaaaaagaaaatatttttaaaaacacataaaaataatatatccattaaaaataatacagtaaaaatacaatatttacatagcacttacattgtattaggtattaatatggctttgatgactgggggaacaccagggttcttggtctcccactgataggattaacgacagggacacaggtggagtggttttaggaatgaaaagtttaataggcaggaaagaagaaagaaagaagaaaacagctcccccatacagagacagagggaggggggctcggaacaaagaggaaccacatgtgcggcagaaaagtggttgcttatattgggatgctggaggaggcggtgttttgtttgcacagggcccaggggattggtttgaccaggtgtgtcatttatgtagcttccagaaacctggccctcccaccttagtcctttaatatgcaaatgagggtcgccatgatgttctgaacacctggtgttatctggaggtggccattacacttggcacaggtggcgacaaggagaagatggcgggaattgccatgttgtccatgttaggtggacctactttctaatcgccggcatgtgcgtattacagcttgccagcctggcttttaaagccgcatttttgttagaaaagaaatggtttgggggttattttttattacaggaacatttccactgagaacctttacccttactttctccctaaaaattatttcttaataactcctatattagtattatatgcaatctaggcattaaaacatatacaggaagatgtgcatatattaaatgcatataatatgtcattttaaatatgagatttgaatgtctacagattttggtgtccgtggagttcctggaatcaattccctgtgtaatcagaggagtaccgtatatatttagcgtttttactttactcaggtctgtaatgtgtcacttcatttgaccctcaacacaacccctatgagacaggaaaatttatgtgatctctttcacaatgaaagaattgaagtctagaggaatttgacatttgtggccactaacatgttacctgtaaagcatttttactagcagagtgaagctatcgccatggatattaattattttttttttaagtagagctgacctgttggggcatcatgaattaagtacatttgcagggttttatacttagtcctttgataactatccctatagcatatgtttatatcattggattaaaatactgtcttaattgttctggaatgtgtggtgatagactagatgcactcatacctgctgaaattcagacaccacagtggcatgtgtcatcattgttattttctctaaatctagagttatttaatttggtacctctattgtcatctgctcttgaagagagggcattgcaacctgaatttccatgtatgtataacagagtgtcagattatttcctgatgattccagatatctataagggaattttgtaaagtagtttttccttaatttttaaactcttgagtaatttaatttttgtgcatctgtctcattaatttaaacttatgtcatccacatgttaaactaatttttaatgagcaaaatgcttttcagtgccatttacttctaacaagtgtgaatttatttccagttaaatgaggtttggtgccaaaatgtaggcaacttacaaatgaggtgtgaggggttaacaatattattttcttacatgattccagaagctgtaagcttgtcaaatcacattcatttgtgcgtcaaaataattatatgagtcagacagggaagacaatattgttatcttatggattagaaaaccaagacccagagaagttataagagttttctgaaattatgggactaccaagtggcacagttatatctttttttttttcttttttttttttttttttttttttttttttagagggagtctcgctccattgcccaggctggagtgcagtggcacgatctcggcttactgaaagctccgcctcccgggttcatgccattctcctgcctcagcctcctgagtagctgggattacaggcacccgccaccacgcctagctaattttttgtatttttggtagagacagggtttcacggttttagccaggatggtctcgatctcctgacctcgtgatccgcctgcttcggcctcccaaagttctgggatgaccggcgtgagccaccgcgcccggccagcacagttatatcttaatcgaagtattttgattccacgatatcgtatttttcctagcttaatttctactttgtattttaaggtgatttacagattatatcttttagaagttatttcttctaatgtactcaaagatctgtgaaagaaaaatcaaaatcttcggtccccaaactcaatttgccaaaggaaaaagtcaaacttgaaaactgagtctctccaaactgcctcccattttgtcttgaagccatagctacaaagacaggattcggctgggcgcggtgtctcacgcctgtaatcctggcactttgggaggccgaggtgggggtatcacctgaggtcaggagattgagaccatcctggtcaacacggtgaaacatcgtctctattaaaaatacaaaaattagctgggcttggtggcgcatgcctgtagtcccaactacttgggaggctgaggcaggagtatcacttgaatccgggaggcagaggttgcagtgagccaagatcgcgccactgcactccagcctggcacagacgagaaaaaaagacaggctacaaacttccccagggtgctccctctcaatgtgcttacaagataattccttgtgggccccaaggtctttatcctaaaatggttgaaagtcaccctgacaatgtaaatgaatagcttattttcacaggtaagggacaaaaataggactaggagtcatctctcagctcacttgagatgaattcatattttgctgcttcctctactctgtgtttactttatcttaagtaaaaatgcagattcactaagaaggagatgaatacctcgttgactgttattctaccctctctttcttcgtttaaaatatggattcagtgagggctgatcaaagcctcaaaagaatgcaactgcttgcccccccacacccagcccccactccccggcttttttttttctttaattgagacggagtctcattttgtcgccaggctggagtgcagtggcgtgatctcggctcactgcaacctctgcctcccgcgttcaagtgactctcctgcctcagcctcccaagtagctgggactacaggcacgtgccaccacgcccagctaatttttgtatttttagtagagatggggtttcaccatgttggcaaggatggtctcggtctcctgacctcaggtgatctgcccgcctctgcctcccaaattgctgggattacaggcgtgagccaccgcacccagcccgcttgccccttttatttactctcccctttttactttcctctttactgcccgttcctgcccgtagaatgttgaaatctcccaaatgctgtttggaagaagcacagatcacagatgtttctgtgattttatgatcctttttcctggacatttactcaaccttggcaaaatccacctgtaaatcaaaaagtatatgagactggtttcaattaatttagaagtttattttgccaaggttaagggcatacctgtgacacagccttagaaaatcctgagaatgtgtgctcaaggtggttgagctacagcttggttttatacattttagggagatataatacatacatgtaagatgttcattggttcagttcagaaaggtggaacaacttgaagcttaggctagggagatgataggtggatttaaagatttcctgattggcaattggttaaaagagtttatctaaagacctggaatcaacagaagtcagtgtcaatgttaagataagggtttgtggatactaaattttttaatatgcagatgaagcctctatgtagcaggattcagagagaatagattgtaaaagtctatcaaacttatggtgccaaactcttagttaattctctcctggctcagaaaaaaaaatctggaaagggaaaaggattctttacagaatatagattttttcccacaatagacagctttgcatggccatttcaaaatacgtcaaagaaatatattttgtggtaaaatattttaatttatttcagggcctactatttatcatgttggtatctcttattgctacaaagagtctgctttgccagtcttaaggtttctattttagtggtaaatgctggacagctgtgcctggatttcaacaggaagagaggataatgaggcatgtctgacccccatcttctcatcttggcctgaactaatttttcaggttaatttaggaatgcccttggccaaaaggaaagtccattcaattggtcagggggcttagagttttatttttggctcctatactctaccagtttaaaagaaccaacagcttagaagtaaattctgtgcataagaaacaagagaaagtaaattggcttgtcaaaatcaacccaactttgtagccttattccttgcatgcttaaagcacaaaagcctactagcctcacttatttttttcattattcactagctaatggagaggagatgcaggttttaaaagttcacacatttcttatcagaaacaatgacaagtgaaattctaataaacatgaatttttttctccaaaatgtgagaattcttcaaatagaatgactaaaagtatcgaaatttatttttaaaattattttaattatttttttaatttaatttttttatttcaataggattttgaggatcaggtggtgtttgcttacatgaattagtttgttagtggtgatttctgagattttggtgcatccatcacccaagcagagtacactgtacccaatgtgtagtcatttatccctcacctccctcgcactttttcttttgagtccccaaagtccattgtattattcttatgcatttgcatcctcctagcttagctcccacttatgagagaatatacgttgtttggtttccattcctgagttacttcacttagaatgatggtctccaaatccatccaggttgctgcaaatgctattattttgttcctttttatggctgatgagtatcccatggtgtgtgtttgtgtgtgtatacatacctatggaaccagcccaaaggcccataaatcaataagtgcataaaggcaatgttatatatatgtgtatatatatatgtgtgtatatatatatatacgtgtatatatatatgtgtgtgtatatatatacgtgtgtgtatatatatacgtgtatatatatatacgtgtgtatatatatacgtgtgtatatatatacgtgtgtgtatatatatatacgtgtgtatatatatacgtgtgtatatatatatacgtgtgtatatatatacgtgtgtatatatatatacgtgtgtatatatatgtgtgtatatatatacgtgtatatatgtgtgtgtatatatatacgtgtatatatgtgtgtgtatatatatgtgtatatatgtgtgtgtatatacgtgtatatatgtgtgtgtatatatatacgtgtatatatatgtgtgtgtatatatatacgtgtatatatatgtgtgtatatatatgtgtgtatatatgtatatatatatgtgtgtatatatgtatatatatatatgtgtgtgtatatatatatgtgtgtgtgtgtgtgtgttgctgctataaacgtgtgtgcaagtatcttttttgcataatgacttcttttcctgtggttagatgcccaggggtgggattgctggatcaaatggtagatctacatttagttcctttaaggaatccccacactgtttctcatagtggttgtagtagttcaaattcccaccagcagtgtaaaaagtgttcccttttcaccacattcacaccaacaactattttttttttattttttgattatgaccattcttgcaggaataaagtagtatcacagtatcacattatggttttaatttgtatttctctgatttttagaaatgttgagtattttcttatatgtttgttggccatttctgtatctccttttgagaattttctattcatgttcttagccaaattttgatgggatctttttttttttcttttttcttgttgatttgtttgagttcctcatagattctggatattaatcctttgtcaaaaatacaaaaatatagattgtgaagatattttcttactctttgggttatctatttgctgattgtttcttttgctgtgctgaagctttttatttgaattaagttccatctatttatctttgtttttgttgcatttgcttttggtttcttggtcatgaagtctttgcctaagccagtgtctagaagggtttttccaatgttatcctctagaatttttatggcttcaggtcttagatttaactatttgatccatcttgagttgatttttgtatacggtgagaggagtatccagtttcattctcctattatgtggcttatttgtatattagggtgtcctttccccactttatgttttgtttgctttgtcaaagatcagttgactgtaagtatttggctttatttcttagttttatattctgttgcattggtctatataactatttttataccagtaccatgttgttttggtgactatggccttagagtatagtttgaagtcaggtaatgtggtgcctccagatttgttctttttgcttagtctggctttggctatgtgggcttcttttggttccatataaattttagaaatttttttctacttttgtgaagaatgatggtggtattttgatggaaattacactgaatttgtaagtggcttttggtggtatggtcattatcacgatattgattctacccatccatgagcatgggatgtcttttcatttgtttgttttgtctatgatttctttcagcactgctttgtagttttccttgtagagacctttcacctccttggttaggtatattcctatgtattttatttttcttgcagctattgtaaaaaaaaagttgagttcttgatttatttatcagtttgatcactgttgatgtatggcagagctactgatttgtgtacatttattttgtatcctgaaactttgctgaatttaattatcagttctaggagctttttggaggagtccttagggttttttataaaatcataccatcagcaaacagcagcagtttgacttcctctttaccaatttggatgccctttatttctttctcttgtctgattgccctggctagaacttccagtactatgttcagtagaaatggggaaagtagacaccctcgttttgttccagttctcaggaggaatgctttcaacttctccttgtttagtactgtgtttgtcctcatagatggcttttattacattaaggtatgttccttctatgctgattttgcttagggttataatcataaagggatgctggattttgtcaaatgtttttttctgtgtctattaaggtgatcatgtaattttttagaaaaattcttcctgtgtaatgtatcacatttattaatttgtatatgttaaaccatccctgcatccctggtatgaaacccagtttgtcatggtggattatctttttgaaatactgttggattttgttagctagtattttgttaaggatttttgcatctgtgttcatcaaggattttggtgtgtagtttttaaaatgttatgtccttttctggttttggtattactgtgatactggattcatagaatgatttagagtggatttcctctttcttaacattttggaatagtgcaaataagattggtaccaattcttctttgaatgtcttatagaattcagctgtgaatctgtctgatcctggattttgttgtgttgtttgcaatattttattacaatttccgtttcactgcttgttattggtctcttcagagtttctattttttcccagtttaatctcagaaggttgtatatttccaggaatttaaatatttcctctaggttttctagtttatgcatgtaaaggtgttcatagtaggcttgaatgaatgatcttttgtatttctgtggtatcagttataatatatcccctttcatttctgattaagcttatttggattgtctcttcttggttaaccttgctaatggtctatcaattttatttatcttttcaaaaaatcagctttttgcttatcttttgtattgtttgttttaatttcatttaaatctgttttgttctttgttatttcttttcttctgctgggttcaagtttgatttgttcttgtttctctagttccttgaggtgtgaccttagattgtctatttgtgcttttccaaacttttttatgtaggcatttaatgctatgaactttcctcttattactgcctttgctgtatcccagaggtttttgttggttatatcactattatcattcagttcaaagaatttttaaatttccatcttgatatcattgtttacccagtgatcattgaggagtaggttatttaatttccttgcaattgtatggtgttgagggttccttctggagttgaattccaatttcattccactgttttctgagagagtacttgacataattttgattttcttaaattgactgacacttgttttgtggcccgtcatatggtctatcttggagaatgttccatgtgccaatgaatagagtatatattctgcaatggtttggtacaatgttctgtaaatatctgttaagtccatttgttctagggtatagtttaagtccatttgttatttgttgactttctctcctgatgacctgtctagtgctgtcagtggggtactgaagtgttctactattattgtcgtgctgtctatataatttctgaggtatagtacttatcagtagttatcgtcttataaatttgggagctccagtgttaggtgcttatatatttagaattgtgacatttccctgtagggcaagtcctgttatcatgagataatgtctgtcttcgacttttttcactgctgctactttaaagtttgtttgtctgatataagaatagctactgttgttcacttttggtgttcatttgcatgaaatgtcttattccacccccttaccttaagtttatttgagtctttttgtgttgggtgagtctcttgaagatagtagatacttggttggtgaatgtttgtgcattctgccattctatgccttttaagtgaagcatttaggccattcacattcaatgttactattgagatgtgcggtactattctagtcatcatgctatttgttgcctgaatacgttttttttcattgtgttattgttgtatgagtcctgtgaaatttatgctttaaggagattctattttgatgtattttgaatatttgtttcaaggtttggagcttcttttagcaattctcatagcgctggcttagcattggcaaaatcgctcagtattgtttgtctgaaaaagattcatctttatttatgaagcttagtttcactggatacaaaattcttggctggtaattgttttgtttaaggaggctaaagataggaaccccaatccctcctaggttgtagggtttctgctaagaaatctgttgttaatctgataggttttcttttctaggttacctgatgcttttgcctcatagctcctgaaatactttccttcatctcgactttagataacctgatgactatgtgcctaggtgataatctttttgcaatgagtttcccaggtgttctttgaggttcttgtatttggatatctagatctctagtaaggttggggaaattttcctcaattattgccttaaatatgttttctaaacttatagatttcttttcttcctcaggaacactaattattcttaggtttggtcatttaatgtaatcccaaacttcttggaagctttgttcattttttaaaaattcatggctgggcacagtggctcacgcctgtaatcccagcactttgggaagccaaggtgggtggatcacgaggtcagaagatcgagaccatcctggccaacatggtgaaacctgtctctactaaaactacaaaaattggctgggcatggtggcgcgtgcctgtaatcccacctactcgggaggctgaagcatgagaatcacttgaacacaggaggcagaggttgcagtgagccgagatcacgccactgcactccagtctgatgacagagtgagactctgtctcaaaataaaataaaataaaataaaataaaataaaataaaataaaataaaataaaataaaataaaaagttcttttttatttatctttgttggattgggttaattcaaaagcctttactttgagctccgaagttctttcttcttgttgtttgattctattcctgaagggatgggttgcccctccacacctgtgggcgtttctcgttaggtagaatgagagacttggaaaagaaagagacagacaaagtatagagaaagaaaaataggcccaggggactggcattcagcatacagaggacccatgttcctgagactttctagtgtcttttgcatttctctaagtgtgtccttcacttccagaagccatggttgtttatatttgtgctgtctttttctctggagatttctttttccatatccttagacttttgtttgtttgtttgttttaaatttctttaagttggtattcacctctctggtacttccttgagtagcttaacaattgaccttctgaattctttttctggcaattcagagatttttgtcttggttgagatccattgctgctgaactagtgtggtcttttgagggtgttacagaaccttgttttgtcatatcactggaattgttttcctgtttgtttttgtttgtttttgttttttctttcatttggttatactatatcagagggaagatctggggttcaggggttactgttcagatgattttatcccatggggttctccattaatgtggtgttcacctcttcccatagggatgtgacttcctgagagctgaactgcagtgattgttatttctcttctggtctagccacccaccagagctactgggctcctgtctgctgctgggaagtgtctgtaaagagtcctgtgatgtgatccatcttcaggtctctcagccatggatagcagcaccttctccaatggaggtagcagtgaagagaagtggattctgtgagggttcttggttatagttttgtttattacactggttttgtgttggttggcagccagccaggaaatggcacattcaagagatcatcagctgcagtagtacatggaggatacaagcttgctgtagggtctcctggagaatattcgggtgtctcaggcagtgggtggggccatagtgctcccacgagattatgtactttgtctttggctaccacagggggtagagaaagaccttcaggtcgggggcaggtttaggcctgtttgagctgtggctcttcttgggtgattcttgcggcagctgctatgagggataggggtgtggttctcaggccaattgaattatgttcccagaagaattatagctgcctatgctgtcatgcaggctgccagggaagtggggaaaagttggcagtgaaaccagcctcacccagctcgcacacagctcaaaaggctgctctcactctcaccatgccccctcaacatcatcaaatttatatccaggcagcaggtaagcaggactgagaacttgccccaggctactggcctccccactgaaaaggcaattgggttttcaggtttcacgcctccctgcctgccgcagcttctgtgtagtggctgcaccttctgtttgcctctctctcgggttctgtccaggaaactctgcattcagtcagaattgttacaaagtacagctggacgtttccttctccctgtggtcttttcccaattcctctggcagccttccccaaggacccctgtgagaccatgtcagaaatggcttccctggggactgaatgtgcccacagggctcttcctgctgcttcccctacccctatatttcactcagctcactaaatttgtctcagctccagataaggtcaaatcattctcccatgatctggacgttcagcttccccagtgaggatgtgtgttcaggggtgcacaatcctcctttcacactttcacactttcggtgctcagagttttttgactgtctcttggagcctgcaggagtgatctgcttccttcaaagtatctggggattctctttgctttcctgttagttcctgtggtagtttgtggaggaaattttcatgatgtgagtctccatatgtagctctgttcgtctgagtgggagctgcaagttagtcctgcctcctatccaccattttcgctggaatctcaaagtattgaaattttaaagagaatttgggtaaagaaactaagctcagagttttaaagtaacttatttatgactacaaaacttcaatataagtctcctgaccaggtttattcatttgttcaaaagtatttattgtgcatgtattatctatcaggcactgagaaaattgttttttctatttgaccatgatgccttcatgctttagtaagggcttcagagtcaatggatgcatttcaggaagatattaattctgcagaatttgttcataatgattatagatttacataaggcctttttttgagaagagtttgtcaaatgtttcagatactatttaaatggcttgcatactgtcatgcgcatctgtgtgaagggaccaccaaacaggctttgtgtgagcaataaatctttttaattacctgggtgcaggagggttgagtccgaaaagagagtcatcaaagggtggtgggattatcattagttcttataggtttgggatgggcggtggagttaggagcaattttctgtgggcagggggtggatcttacaaaatacattttcaagggtggggagaatattacaaagtaccttcttaagggcaagggttggggggaggatattacaatgtaccttctcaaggatggggagggtgtatcgtacaaagtacattctcaagggtaggggaatatcacaaagtacattatcgcaagggcagggaaggtgtattgtcacaaagtcagctgatcagttagggtggggcaggaacaaatcacaatggtggaatgtcatcagttaaagcaggaactggctattttcacttcttttctggatcttcatttgcttcaggccatctggatatatacacatgcaggtcacaagggatatgatggcttagcttgggctcggaggcctgacacatacatccaaagtttaacaatttagaaaccattgctttacagatttccccttaccttctgtcattctaaacacatttaggtattgataaaaggaggtttctctggctatctttgggcataaaacacacttgttccaagtttctattatttcccgttcttactctgttcatttatttgaaaactgaatgtgttccataactgccaggcttatggtttattactaattttaagaaaatattattataactttaataacatacttaaattttacctttcttattttaaatttttccattctcaccaaattttaccattaaatcaggatttgaaaaaaaaatgttgtgacatattacataagaaaacaaaacatttaaaatgttatatgtcaggacttgtaaatacatttaaaattatgaatatatttgtgtttccccaatctgacacgctgtgcctatttcagaccttgctaataggttatatgatgctcttctccattgtttgtatctagcctcaaactctttctcattctcatatttgaagtagctcctaaaagtctgtcagagttggtactcaagatacaacctatttgccttctgaatgagcttttaaatatttagcctgtggccagtgttcagcctccagagagctactctaccaggatttgtttactattgtcttactatggcagtgaatactatttgttatttttgaaaaaaagctttgtagagcagtatatgtaagctaaataatgtacaagaataaggcacaagtcaggatgcttgtgcagaaaatcaaaacaaagattaattctagaacatgtctccttgcttctgagagggtgtgttgagcaatgaattgctgaccttctttacatattcttttcttgtgcatcacgttgtatatgttgtgtatgtatgtcctggcttagcaagctgccctcacagtgagaggggcccttaactttatgctaagtagagttgatctgcatatttccttgcttaaagtaaatattgaacagtgatgcaatcatgagtcctttggggaaaatcattccctttgtgaagttgcctgggctactggtatttcagtgaactggtttctttaaatactaaatgctttgttattaagtacctgtttaaaaattactttttcagtttgagacatttgtttcttctgagcacaaagaaagtacaacacataattctgatcagatgacattttaggttctaaaattatggattaaaaattatggatttttgtaaaattgcatttgagtgccctggaattacttctcagggatttactgcatcttcaagtagctctcatctctattaaaatataaaacagttatggtagtattgttcttctaaaacaatttcattatgaaagtaaaataaaaaagaaagattagtgaaaaaatagtaattcactaatgtacttacaagtcctgatgtatataatattaaatgttttgttatgtaacatgtcataacatttttttaaatcatgaattaatggtaaaatttggaaagaatggtaaaatggttaccaagttataaaattttataatttttaaaagagcctttttatatcttttatcctaatggtgatgccaatataatttcagaagacaagagcaaattattattctcctttgaatacttcttctttgggcaacatgtttagatgttccctttttgtcgtgaatggagacatttcaaaagcatatttgtgaatttatttgatttatttcactttatttcattactgttagtgagttgctagtgtttttgttaacctaataaaagagaagaagacatttaccttttacgatattgaatagaaagttgctacaatagacacagttcagaacaattttttaaaagttcacaaattttatagtttatgaaaaaaattgtagagctcatggaagcaagggctgaacccctaagtggtataaactgggagtcttttactagtgacaacactaccaattaaatcattatacttgtacatattttttaaagaaaagatttatggtaccttagcccctaccgttgtcatttggacataacaaatcccatttgaggaataagtcagattaatttattatataaagtttcaaggacttagaaccttcacaatggaaggccggcaaatagctgcaatttcagtctcttactcaatagaggcttatctcctcaaaaacattgcctctgattgtaaatatccagtgtttaaggttcacaaaagagtaaggcaatttttttttttccttatacaataatgactgttggagaagcccctctcattcctgatcgtagctgttttatatacctacctgcttgccacagagacgccagccctctctctgtctataaagtaatgtgtgtttttccccatggtcctcttgtattcactttttctatagtctttgtttctatctgtgtggtgcaggatttgagtgggcaatgaaatcatttcagtactctgaactcgtgcagtttagtcagaggccaaaattcacaataaccaacacatatttttaatttttcattccaatttcataatctcaactcttgtcaagctcataactagcgtatcttcccaccctgcttcagtcattgctactactcctccacaaatagatgtgtaaaacttcattaaggttgcaaatacctatatggtatatatattatatcatatgtgaaaactgcttttgtatttttggtaaatccttttgttcaatcagtgcctcctgcaatgagaaacacacacacacacacacacacacatgagtaaaagtaagaagcacttatcttggggtctaggactgcattacatgcttcaagggacaaagaaaagcaattctaagaaaaactaatttacaactttgattaactgacatataaaagttattatttatattaaatagaagcattgtctactgaatattttgttcattccttcttgcttagtagatgtagcttgatgtggtaaaaataaaatatagtcaaaaagaggggatctaatttctttattaagtctttcacttacctggaaactaagcttaagtaaagtcactttacttgttggatatcagctcctgtcagtaaaatatgaatgagatgaaaaaaacacacacttccaagttatgtagcaggatcaaatgagattgtatatgcaaatacattgtacaaaatattttagacatgctgaattatcaatgaattgttttattttttcctcggggaaatttatttcacaagaaattaccagcttacttttttagagtctaaacaattattggtcttagtctcattcaagaaatacgtcatatgtggccgggcgcggtggctcacgcctgtaatcccagcactttgggaggccgaggtgggcggatcatgaggtcaggagatcaagaccatcctggctaacacggcgaaaccccgtctctactaacaatacaaaaaattagccgggcgtggtggcgggcgcccgtagttccagacacatgggaggctgaggcaggaaaatggtgtgaacccgggaggcggagctggcagtgagccgagatcgtgccactgcactccagcctgggcgacagggcaagattccctctcaaaaaaaaaaaaaagaaagaaagaaaaaaaaatacgtcatatgttcttaactcaggacctcatactttccatcgtctggcatatgtaaaactagattgcccaccttttctccttcaagatgtctagccacctttgaagccaggggagaatcagtttatctctttttattttagacaaatgtatttgtttaatttatttattaataagaagaaaaaaacccaaataacattcttgagaaaacacaggttctaagttttagtatttttgtggaaatcaagtactaaaggcatagtattattttcagaaatgaattattgggatacattttttttctaataaagtttttaaatctattttttaattaaagaaaagaaataaatgcaaacaccaacagctaaatatgatttttttagcacaattgcagttgaccatttgtctggaaacagagatctgaaagagtacattgtccttttcaactgcctttaacatatatatcatttgtgggaataatagtcagaaattctttaatcttagatgcatcagactcctttgctataataatttggttttatactttgttctatcttgggcaaatttgatatgctgatatactgaaaatttattcattaaaatatgtaaaatctactaaaataatattgaaaatagctctgtggatttttttttttctaattgagcagaaactatgttaactcaatgttgcaccacttcctccttcttcatgtattaaatttgtttttaatttagatggattgaggaaaatgataccatattaatattttcacttatttgaacccttttatttgcttgtggcttggattttaatggtagtctgcaggagtacggtagcaatcaaacacagtcttaggggttgcccattcaattctggctattttgataacaatacttagctttagctacatggaatgaagatgctttgttggtgtttgacaatttgaacacgtgtaggaaagcacctgtatatcttgttgaaagaaaatgctgatttagtaggtctcggagagggcttgagattctacacttcaaacaagccccagcaaggtgctgagtctaatggtctagccacactttaaattggaaggcctagcaatctgattaatcagatttgaaaggatttttctctctctctctctctttttttttaattttaaaattctgtagacactggtgtggtaggaagaaccagcatttggaaatcaaattatctcggttctcttttagtcatttcactagcttcctagtatttccaatagaaatatagaagtgtacggacttctaaaaaagtgcactcgtacttgtttaactttttttgttcactcaacacagttgacattttctggtaggtgcaggaaaaacaaacttgaatgacaaattttcagatcctcagtctagtaagggagagggtctagtttgcaatcaattttaatacaacatggtaagagttttacaagtatttctaccactctcgggggaagggatcactgaggggacaatcaaagttcagtaaacctattagtaccttcctactagctttatggaagactgacttgtattagaccttgaaggcattgcaccaatgtttggtaggtatttactaaatattcataggaaggaaggaagaaaaaaagggagaaaaaaatccagtgattaagtgaggaatgcagtatttattaagaaaatcgtctaacaaaatggactgccatttggacacgaatcactatttaataaattgtcatagaaacttgctgaaatatgtggtatatatggagacaggcaagataagagattggggagataggctgatgtcaaatcatgagagtcaatgatggtgatattaacaaggtttggaaaaaaatgtctgtaattttatatatatagtgcttctttgtgttggtaggaaaaaatgttcaagctcctgttagcttgtaaatatggacatcacctttcttctcagattttcccttctcttcctgtggttcctgggcatgacttatccttgcagccaatgagggctggccagtgacaacttggcatcatggaggtgcttctgactgatcagcaggtccactggttctggctctatttttttttttcttttactggttaccaccttaagtgtcttttgactgtatggtgaatatagaaaaaaaggagaaaggattggaggataattatatagaaatattttacccagaaaacagagcccccacaaaaaacacacacattgaaatctactactttcatatttctcttaaataagcaatttaatgagaatggaaactatattgctgcttaatggagtgtaaaacttttctaatttaaagttaactacttggctgtgaaaggaaaagtagactcacatattcagggtagtaaggaaaaaaaataggagcactttgatgggtcttcaatattttagacactcattaagcctgtattttatccacaagtgggctcattctctttatcctcaacccatataaaaggcaggaaggtgtagcatttaaaaggagagattctggatccaagcctgctgtgtttaatactttgtcaataacagtattaatttgagcaaggtaagtaaaccttatgtttctctttttttctcatctgtaagatgaaattaatgatagcttctatgttatacagtcattttgcaaattaatgagttaatacaaataaattatcaacttataatagcttctggcacatattaagtgcacaataatattagctattattgttcaaacaaaagagacaattttactttcttttgatcttaatattgctaaccaattcttttgggttctaatagaaccttgaattcaatctaagcttttcctattcttgagtgagttgcataacctctgagctattttcccaactgcaaaatagaaatcatcactactctacagaagtggtatgtgtagagataaggtatgtgaatctacaaactaataggccctcagcaaatgtagttgccttcaacttctctttcacttttgttttgttttgttttgcatgtttagtatatgcagacagaaatagaaaaataaagtatttttccctctttttcattttgctcttaggcaagctggaaataggattgagatttactgttgcgtttagatagaagaggcataaatagaattctcagggtaacccactgggcatagccatcatgagtcccctcattatctggaaagtgtggatgaaggtgctatggcatctaaaggttttggctatcaatgctttatgcttcgtaactgtaacaaactttaactcatatcatagttaggttttacttatttttaatactaagtatgtttttccaaaatattagtagagttttgttgaaagttttataaaatatatcatgtcatcattatttatttatgtttcacctctttaatgtgtccatttagagaaaaatatataaatcacaaactttaaatacgcaaatataaaaaagcaaaattagtctgcaagttagagtttatcagctgtgtcaagcagaaattaattcattcaacagatgaattcaacagatgaagcaacttcagcgtgtccaacactgttggatgcagttcatatgtcaggaaacaattcaaatataacaacactttctgcagggcatttatagtctaatgtagatagttagaaactttgagtagtttgggtggtatcccactctccaaagcaccatcatttgtactcttatgttttcatagtctaacacctcacatgctctgaatccccatcagaaagaaaaaattcaatgtatttaaatttaatgtatttaaaaatttaatgtatttattgtcagctataagtataatttgtgttcaataaaatccatcatttcagttggacaatttattgagttttgattaatatatataaatagtgtgttactgtcaccacaatcaagatatataactgtgccatcatttaaaaaaaaaactgaccatggaacaatttgcagtcaattccctctccatgccctgctttcttttactattgttttgcctcttctagaacatcacgaaataaaaacacttagcataatatgcttgagttcatatatgttgtttgatatgtcagtcatttttccctttttaatgctaatttcatttcataaatagatacagcacagtttgtttccctgttagctaactgattggcattttcttgctttaggtttgggactattataaatactgctgctatgaggtctcacacagagatctttgtataaacacaaaattttattttgttctggggaaaaattaggagtagaatagtcagggcatatgttattttttaaattgtataaaaaattgccaattatcctctaattgaatgtaccattgcatttccaccaccagtgtatgaaaaatccacatgtcctgctttcctggcaatacttggtttggtcagtcctgagtttcagtctttctagtgcatgagtagtgacgagcgtatggttataacctacatttccctgagaatgatgttgttgaatacttttcatgtgcctagttttcatttgtatatcctctttgttgaagtggctgttcacgtgtttttctccttaatgagaaaaagtgttttatttttatattggattttttgttttctaataactaagttataatcatccttcatgtattctaaataatagttctttatcagatatatatttcacaaactttttttgccaatgtgtggcttggcttttcattttcttaaacgtagctttcaaagggaaaaaaaacttttatttttgatgaagtcaaaatgatacctgtttgtttgattttagaactttctgtgtctatttaaaggtcttcttctaacacaaggtcataaagtttgtccttgtgttttcttttggatgtttcatatatgtaggctattgtgtttacatctatgatttacctgaatttacgttttatataaaatgtgagttgatggtttcagatttttcttattatttaatgagatcagttacatcataatttatttttaacatagtaataattgagctgagaagaccaactgatggtatagtaaaataccctgaactgtgtacaacttcttatgccacttatttcatggatttctgcatgagaagtccatataaagctcctttgattggattcgtatggtaattctttgttcttgcagttcaggacattatttaagcactctgaatatgacatgtaaaaaaatcagaaattaattctgggtttgccgctgaatagagtaatttttgagcaaatttttcaacttcagggtttcagcttcttcatctgttagactggggtaattcatagttttgtgcaaacgtagcagagaaacaaatgctttataaatgtacgccctttttactgtctgttttttattttttttccctctctctccctttcattttcttcattagctctttggttcaattaggaaaacattgtatttgtccaattaattctcctctgtactgccatagcactctgagtgaagtgtcccatgctgggatctactgcggttatttgagtgtcagtcaccttttcctgtaggactataagctgctattctggggaaagtccatctaataataatttattctaacttattttgtcaataaaatattcatggctggtcatggtggctcatgcctgtaatcccagcactttgggaggccaaggtggacagatcacttgaggtcaggagttcgagaccagcctggccaacatggtgaaacctcgtctctgctaaaaatataaaaattagttgggtgtcgtggtgcatgcctgtaatcccagctacttgggaggctgaggcatgagaaccacttgaacccaggaggcagaggttgtagtgagccgagattgggccactgcactccagcctgggcgacagagggagactccatctcaaaaaaaaaaaaaaaaaaaatcattaagtgccacagtctattaagtgtctcacttgtgtgctgtggacaaaatataagtaaggtatggtatggtttctgctttcaagaagtccatgtataataatgtcaagtattattttaaatgtacatagccaggcaatgtgcaactaactcacacacacatgatcacctttaatacaataactatttaaggcaatggtatctgtatttgtctgcattttagaatcatctgaagatctttaaaattttttgaagcccaggcaacaccccagaccattagataaaaatgtctgagaaggggtcaaaggcataaatattttttgaagctcctcggttaacttaatatgcaacaattttgggaaccaccactttaaggtcagttgtaatattaccaacctcagtattcagatgaggtaaccatggctctgagaggttaaggcattctgactctaggaccctgtgctcccaaacaatacattataaaactttcaattaaatgaaaattctaaacatatgcatataatttttgtatgcacaaatatatagttggaacacataaaacatacttataaaatatgcagagagaaagagagactggaaatatgtgtgagaattgatatccagtagagagtagaaaaaatggaaaacctaataccacttttagaggtgtttggggacatagtgttattgttgggttacttaagaaatattttgaagagaagttgagatttgaactcaagattggaaggagaagtagcaatgcagttgcaaggattggggaaggttcttcgggagcagatggagtagcatggtcaaacaactcaaggcatgagagagaatagggagtttcagtttgataaatagtgaaaggagctagtggtgacctggcaaaagctgagacctgtagtcagagctgaaagacatgcctaagtcaagtattagaatgccttctgttgcaggataaaggctttaaactgtgctattttttaaaagctgtggtgaatttaattaaagattattatgaatagatttatcttcaatgcacattatatgctcatacgtacatttatgcatagttttgagtttgaagacactgaggtagagtagtgagtgccaattctctttaaatctgtgcagcgaaattgtaagttctttgcaagctggaaaccacatttcatcattacttgccagatgccactggcaagaagcacatttccctgaatagacttctatttgccagttccagagattagcaatataattggatgtcaaaatgcatcctttccgcatctttctctgctcctcctgctgttttcataatggcaaaacctgaaaaaaataaagtaggtgatcttacttattctggaactcagaagcccacaataagatacagagagatgtttccaacaggaatgcccatttatttataaccacacagaaaagtgattgtaacatttttcttctaaatattttctacattcttacattcattgtgttaactcaggctctcttcacctcttctgaattatgacagggctccctgaattcagtcttctcctccaagctgtattccacactatcaaaagaagggttgtctgtttaaatttcaaatttgcctgtttttttttttttttccagtcctacctttatctttctttatcatcttatcatctttccagtgtttatagaaatagtttcaacctccttagtatagcttataaggctctctatgaacaacctctatctatatcttcagtcttatcagcactgaacattggataatagaggtgttacatttctcatggttttccatttcttctatctgttgtttcccaatatttgtgttttttcctcccatgtctttacaagtgctcttcacattgctagttcttacgatttttaaaaaacttttattgagatatacttatataatataaaatcaatccatttaaaatgtacaattctatgttttaattatatgcacaggcttgtgcaaccatcactagaattcaattttagaaaattgtcttcatcacaaaaagatgttcatattcatttgcagtcactgcctgttcccctttttccctagacccagggaaaagatagtctaatttttgtccctgatgattttcatattttggacttttcatatataagtagaaacatacaatattggtattttgtgactagcttctttcacttagggtaatattttcaaagttcattcatgttatatattcatacttcattttgtttaaatgtcatataatattccattgggtggatgtacacatcttgttcatccgtttgttagaatatggacattagcttgcctctactttttagatataaatagtgccaagacaatatatttggtttttgttttattcagtctgataactgctgcttcctgattgtttagcccattcatatttgatgcaattattaatataattagatttgtgtgtcatttttctttttgtttctgatatgtctcatgactattttgttcccctgatgctattttactgtcttttttgtataatgtgatgctttctaatataaaatttttaattccttttaattatatgttttgagctgtgttcttaatgcttcctctaaggcttataatatacttcttaaattattagattctacttcagatttgtactaatttatttctagtgaagaatagaaatcttatacctatatagctcctttgccccaacccttcttttttttctaatattttttacatatcatgaccacgtatgttaccttttgtcttctaatgaagctgagagaatgtagagtaagtgcataattttagaatgtgctgtattgacctcatttacaatttctgcttctccttatttcttcctgtgaattcaaattacaaattattgtcattttgttactccaatttagctatttttcaatgtcttctgtgtgctattattgtcaaatacattagatttctatatattacagttacatatatatctatatattcatatatgcatacatattcatgtataatttgatgcagttatttttaaagcagccagcaggagagatatacaactacagttaacccttgaacaatgtggaagttaggggcaccaaccccatggatggccaaaaatccgcatataacttttgactccccaagtagttactagtaataacctactattgactgaaagccttaccaataacataaacagtcaatttccatatattttgtatattacatgtattaaagactgtatttttctaataaagtaattttgaaaaatgagcatattattaagaaagtcatagggaagagaaaatatatttacccttattcactaagtggaagtggatcatcacaaaggtctttctccttgtcctcttcacactgaatactatgaggaggtggaggatgaggagcagttggtatttctgtctctgagaggcagatatggaagaggaggaagaggtagaaagggaggcagtagaggcagacacactgaatagcttacactagaaaaatatccacatagaagtggacctgtgaagttcaaaccaatgttgttcaagtgttaactatataatcttttatatattacttattttattactttcactggtgctctttttttccccccaagtgtatttgaattattgtctttcatcacttggtttagtctaaataaattattttagtgtttcttgtgaaatactaaaatagagcaggcagacctgctcacaacaaattctcagtgtttgttcatctggtaataccttttctttggccttgatttttgaaaaatttgctggatataaaatcgttgggtgatatctgttttatccttcaatactttgaatattttaacacactacttctgctctccattgtttatcatgagaaagccgctgttgttagtcttggtgtggtctcttgtccatgctaagttgttttcctctcgctgctttctaaatgttcttctaatgattgcctttcaacactttgactgtgatatgtctgagcatcaattctttgcgtttgtcttatgtgaagattgttgatcttgttggatatgtgtgaatttttcaactattatttcttaaaatattttctgttcctttcttttggtattccgtaattcataagttagtgtgcttaatggtgtcccacatttgaggcattgcttatttttcttaattcttttttctctgtttcctcaattgtattatctctattcatctattattaattttccttattattttttcctccaggacaaatatagcgttgagcatcatgagtgattttttttcatttgtttattgtacttttaactccaaaattttcatattgtccttttcagtaatgacaacttctttattgctgttctctatttgctaagacattgtcatcataccttcatttaattacttaaatattattttctttagtattttgaacatatttataataactcttttaaattatttatttgcaatatccaccatggggctttctcaaaggtaatttatatgccctgctacaatgccatctgtttcttaaatatgtatagagtctgaagagcagggcagggttagcaccagaattgtttcttaaaggcaagccctgggccctaaattcactaaagcatgctattcacaggctaaagttatcattgttgttgttttacagtatatgatatgacaacaagaaacacttcttaatcctgctgaatatagacagtataactcatgggtttttagaaccttgtgaacccaccgcttataaaatttcctcttctctgaatgaaaaacagggataagaagatccagaagtatttcttccacattgttgactcttggagaatgaagtagcagcttcctcttgaaactctatctatctatctatctatcatctatctatctatctatctatctatctatctatctatctatctacctatccatctatctagatatacttagatagatagatcagcagaaccatattaacagagccaatagaaaatatatgtttacagaaaagccagtggtgtaattccaccccataaatatatacacctactatgtacccgcaaaaatgaaaataattaaaactaaaagaaaaacaaaacctcaaaactcagtgctgtatttccagggtgaatccaaacatctgaaaactaggagagccagtggtataaatcccagtgaaatggcaggaaaaaacatatgttttagctcagaaggcaggcaggatgcaaaaagggtaaattcctcttttccactctttgttttgtttagggctcaatggattggatgatgtctacctacatcctctatttctttctttcttcctatctatctattatctagattatctatctatctatctatctatctatctatctatctatctatctctctatctatctatgatctaaatgatttagacctaaatgatttctatgacaaacataatttcaaagtatatttttattctcttcactaacaccattggttgtattagtttaatttaagcaagtaatttaagcaagaaaatttataaaacattttgagtacactgatgttgatgtttcttttcttcttagaatatatggactgtgtattctttgctatgcgtaagtgaacatgtgtgtgttctattgagtcatgtcagagtaaacattatcttcaatacaaactgtactgtgtgcttcctcagaggcagcggttcgtaatactggatttgaatgaaattttatacatggatatttcgaaacactgaagccaggctaaatcacttgagattctgcctcagaaggttcgagttggagagtggatattttcatacacaatgacattgatagaaggattaatgatttaaatgtgtagaacacgcaggtgatcagaactctttgaaattagtttgcgaacttttctgaattctctgacaaaggagaaatcagcttttcttctttcttgcctgagataagcttaatgtaactcttctttgtaactcaaatgctccccccgccctttttctttctttcttttcttttttttttttttttgagatggagtctttaagctatttggctaaattactaggaggggcagtaatgggtggatacccatgatggatgggtatatggagggagagatgaatgggtggaaagttagataagtagatagatgtatgagtaagtaagtggaggaatttatggataatagaatatagggtagtgagtagacagatcaatgatgaatggatgggttgactaggagctagattgatgaatggtgagacaaataaatgaatggatggatgaaggaataaaagaaatgcaagaaagaggaaaacgaaatgttaacaccttcttgcaatgtttaatctaccaaattaacccccaaaaatgatttcctatgttcagtaaaaaatgtgtagcttagaagagatttaatttattaattatccagttgtgaatgcttcataattagatcataggaatgtccactaagccctgtgggggctaggtagaaaaatcaaagtgacagctccaagccaggtgaaataaatatttgatctctattttgacagatacaattatgaggcatgcaacctctctaaccgtaaggataagctagtgacatgtgagacagaccaacagaaatttagcagttctttttgtctttagagaagcaatacagctaatgaattgcattataaagaccattttttgctgaaaccaaagttatagctcaaacttcccgataattaccccaaagaaaaaaagcaccagttttttttgcttttgtttttattcttttgcatttattgcctcatttaagcttgagaacaaccctttgacatagtgaaatattttagtacttttttttgagaaggaaatctcagtgaggaattaggttaattatctttctaaggtttctaagatgatgatacatctgtcacatgaaaaatccattaatcaagacattgataagaaagttttttagtttttttttgtgttatagtgatagcttcataaaatatctcagcagaaacccccaatttgtctttcaacattttatgttcatttttgtcttccttcaataagagagagaagatataagtttcatgtctcattttagtttactctcatttgggaggcaatgaagccctgaacaacataataactgggaataaaatgtacattatcttatgtagatttgcgagaatatacttaattactgaatgctgggtatcaggtgtatgggtaccaactgccaaatactattaaagcaacgttgggccacacaggctttttagccttttcaagtttctcttgccctccttgttaaatgattataaaaatattatttattactgcagataatacactcaaatgtcagcacaattcttggcatatgataagtattattcctattttgttgcagttgaaaaactgaagatttgagaaaataagggccttgtccattagcttaaagccaataaatagaaaaagaacaatgcttttaagttatattttacgattatttttctaatacccctaattataagaatttaattaattataagcatttacgattgtgtaaatgaattaacaaagtttatgtgattgttccacgtttgtgcttcggagccaattatattttatcttcactcgtggctttagtcattatcctaattagctcaagtaaaatatatttaaacatatatatataaagatttatgctactagagatcagtaggttttcaattagcctttcctttccagttgtacaatttgggaggtagttttttgttgcagaggaagaaaatctacatccttcttgccattctaaatgtaataaaagtatgtcaaagttgaaaacccttacaaaaactttacaccatccttgatcatagcacatattctatttacaatgggaaataatgattagttcattatattctccaatgcagcatacattcttggaggatgaggtctctattttatgaatcattatcactatcacaatttgcctattgactggcacatggtagataattgatacatatttttggaatcgacctgaattgatttgaatacaagtcattattttgctaacaattcaatagatgtatttactggcaactgaggttgaggagaatcatagatttgataataagatgaacaaatattaaataatgtggaagcagccttattataaaaaaagaacatctttctttaattgtaatataaattattgttgttatcatcgccatcgttatttttccaccatctatgtatcgtgatcacatttaaaagtgtttctaaatcatattataatataaaaatgatgcattcaattaacattttttagagaatataatgttggcacgtgtttttgcaggcacctatataatttattagtaaacaaaagttccctactttggtagaatttatattgaagtgaatgggataagcaatattcaataaatagaataataatatatgtagtatattagaaatttaaatgttataggacaaagaaaaggtagaaaggaatggggaattgagatttccaggtgggaagtgaggcagtttacagtgctaagagtctagagtgaacctctttaaatgagcaacaggagccaataattgacagaggtgaggagtttgagaagtgagagattcgaaaatgtggtcttgaaatcatcagtacctgagttttatttttacttcctttagttacctttatatatgtttctttgacttggcagacttttgtttgcacatctaaaaagtaaggaaaataatactttttgttctactgtttgacttatataaattgatcagaacttgctgtgtaacactaattgttatttaatgcatgttaaaaatagaatgtgctaagaaatgtacctcatgttatgtacaattacatgagaggtgagatattgtcatgggttgaagagctctttggcccatctctgtggcctcacatttctagggtttcaatatttcctagagtttttctttctcctgtaagcaaatttgccaaattctgtgtcattcagctccacttatgaattcaagtgaaaataacaaaaaagtctgtcgagaaatagactacagaaatgcattaaaaatctctactaaaatgcattaaaataaatttaagaaaaaatacacatttagagtagtagggaattaacaagctgatatgtagatgtttcactatctgctgctttcaacaaaattcacttagtagaaaacaatttttgaaatgatttttggaataagcatctagtgcagctgctgtactttggcagtggcaaaactaaacaattggcttaatctagccttcaaatggcagaaagattggcacaaatagccctaggggaccatgatattcaagcagattcacacaggaaaaaaaaatacctgtgggaaatatttccactgacttaatcccgacatctacaaaattttatgctggattgtatccactgtctcctcagcacacttgtcattaaagttaataaaccaccaatttctgtgcctgttggatggaaatgcagccattgtctgccatgtcaattaactgtcagaaaaaggagatttagaggagggactgaaaaagctcctaaaggaacacttcttggacttaaaagagaggacttgaaacctcaaaacatttaagtagatatagagcacttgtaaatacagagacttttcagtaaaaatacagaaacaaaaaaagtgctttggaagaatataagaatcctgttttctttgtacagtatgtggcacctacgtcaaactcattcacttgctaatttgttcatccaatactgatttagaatccactatatacctggcactattctggtaattatttattcaatgattagcaaaacagttgcaaatccctattgtctagtgagagaatgagatattaaacagacaggtaaatggataaatgacaactataacaagtacagatggaagttaaacattatgtattaatataaccatacaaataaatggttcaactattaaagcactactgtaccaactggtaaataatcatctttttttttttcttcctggcccatcttctggaacccttcacttttccctgccactcagtaataaatggcaaacacttgttacagcacaatggctttgccataacactctgataaccttgcaagactccacatagcacaatagcaagggtaacctatagtttaacacaaatctttgtacagtgttctgtgttcctccaaggaaaaaaaaggaggacaggtattttgttatgagatgctacaaaactgtttttcttctacctccctatctcgcaggaggttgccatgaagcaatattttatctgtctcttgtgccagtggagcatgacactttccacagtgcacctcttccccttctttgggtacagctatagacttaaattgtttggctgtaatttagagtttgatccataatggcagagagacctaccacttgtgttgtctgtcatctggcacccctggtctgatgtcatccagagactgggagtgtgggttgccaacaccattctgatgttccttatacaatcattgtgagaaataaactgtccaaatatgtttggactcattgcctcctttctagctgaatctatgagactgtgtcaagtcagcttaggagcctccaccatgctgctgcatggagactgcttaactgcttgaaacctgccaatacaggaaactaacaggaccctgctccagcattcagggaagagtaacattctattggtgtacatccacaccataccaatcattttatattttgaatatcacaatgcgtgaaagtactaggaagaaaaatatgatattctacaagatagtataacatagacgctaaaatgatattcgtagtgcaaaatgaatttctgtgggaattagcatttcaactaggatctgaggaatgagtaggaacggaccagaaagaatagggtaccaaataattttccacaactttaggaagaagggtcaggtacatgtgaagatggtgaggtatgtaagaatatgtctcattcaatgaactataaagaaggccaaagagaaattatactgtacacgtgggtcaaaatatctccctggcagcctagcaaaacactagtacttacacccgtaaagatggagttctgagacttcccaaatggaacgcccgtataattttgttgtctcactatttgaaagacatattgatagttttagtgaggaataaaaaaaaatttgaagacttttttgtctataagtttcataaagatagggatgttgctttatgttgtgttgcatttataactgaccttatactgagtgttaaaaatatctggtaaatgaaggtgtgagagaaggaaagaagtaaacaaggaaccaagagagggaggaaaggaaaaagagagagaaggatgtcttttattttagaggagtataaaatttataaaatggctgggatatattaggcctgcagtaaatgcctttcaaaagattgagagaggagaaagatgtaataaaaattacatggaatgaaaaatataataaagaaataaaaataatttatagtcttaaataattaaccctgataatatataaattccaaagtaccaacacacacttgtgatgtgactttacacaatcttcctggaataattcacctctcgttggcttgttcagggggatttgaacaaaaaacgtgggtgcattctaaactaatttcatgaccagggatataaggcaacattattatcggcgtaccttgggtggtgtgcactgtgtagacaaacaaacttaatgacctctaaagataatattgtgacaaactatttaaaatctcaaactgaagataggggagtttgtgttctattgtaaagacaataagaaatcactgaagttgttttgtcaagaggaaatgggttaaaataaagtttcatgagaaacaaatatgttggatcatgcagaatgactttgtgaaggggaaaggagagacagcgagagagagaaaatgcacaaaactcaatgagatagttgcagcaatctagtcaagggtggaaacaaatacctaactttattagtcttaaaaacagcaaagaagaaacaaatggaatttatgactgaatggacatgagcataaaactacttttgacattagaacagagatcatatgtgtgggacatacaagaatgacccctgagagcagtccacattctaattcctagaacatgtggatatgtgattgggtcagtgcaagcagaggtgggataatatggccacaagcaaggaatgcaggcagccactgtaagctgggaaaggcaaggaactgatttttccctggaacctgcagaaggaaccaggattgctgacaccttgactttggcccagtaagtcatattttggatttcttatttctagaattttaaggcaatacgttttcgatgttttaagccactaagcttgatgatttgttacagcagccataggaaactaatataatctgctattggcagtaatataaagagtgagagaaggtcctgacttcaattttatacatgctgttttggaggaatcagaaacatgtgctgagtgaaaatgtttttcaacaaatgaaacataatggagttctgttcacggaaaacatgcagatagcactcataaatgagtcataggtgtaacaggaaataaagattttggtgatttcttatgtttgggtagaaaacaagaaggaagaacaataagagaaggctgggaagtagtgagaaaaagatgaacaggggtgaaaaatgaaagaaagtgggatttggtagagaaatcttaatgggaaaattaccagaagagttgatgatcagctatttcacatgctacacaaatttccagggcagtgaggactgtggtttttccatatttgaagaatctctagtttaaagtgctttccaattcatggaataaaaaaaaattagaatacaaacaccaacatttttgctaaagtaatattccacagaagtcataaaaataattgttccttggggtagggtagcattacaatgggagacaatgtaaagatgttaaaagtgtgccatggactgaagttgttttatttgtaggtatactaagggcctgtcttgttgtcttgttcaacttggcttttaaactgttggagtgaaagtagccctgtttggagtcagaaaaatgcggtaccaaaacctagctgttatctttcgcttattctctttgatcctaattcttttttaaattgcaaattggcaaattatacttgtatatatgtatgagatacaaagtcatgttagtatttatgaatgcaatgtagaataattgaatcaggttagttgacatgtcaatttctctaaatatttatcattttttatagtgagaacacttgaaattactcttagcaaatttgatatgtatcataatatttactatattcatcatattgtgcaacagacctccaagaaaaaaaatcatattccaattgaggctttgtaccctttgacttcatctttccatcccctcgatgcttcccagcctctatttaccaccgtccaactctctgctttgagtttgtttcagagactacatataagtgagaacgtgtggtatttgactttcttactcagcttatttcacttagcataatgctcttcaattccatccatgttgttacaaatgacaaaatttatttcttttcaaaggctgaataatatttccttgtttatatataacacattttctttgatggtgaacacaggttgatttctttttttttattaatatactttaagttttagggtacatgtgcacaatgtgcaggttagttacatatgtatacatgtgccatgctggtgcactgcacccactaactcgtcatctagcattacgtatatctcccaatgctatccctcccctccccaaccccacaacagtccccagagtgtgatgttccccttcctgtgtccatgtgttctcattgttcagttcccacctatgagtgagaatatgcgatgtttggttttttgttcttgcgatagtttactgagaatgatgatttccagcttcatccatgtccctacaaaggacatgaactcatcatttttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggcatttctagttctagatccctgaggaattgtcacactgacttccacaatggttgaactagttgacagtcccaccaacagtgtaaaagtgttcctatttctccacatcctctccagcacctgttgtttcctgactttttaatgattgccattctaactggtgtgagatgataactcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtgggttgcctgttcactctgatgttagtttcttttgctgtgcagaaactctttagtttaattagatcccatttgtcaattttggcttttgttgccattgcttttggtgttttagacatgaagtccttgcccatgcctatgtcctgaatggtaatgacttggttttcttctagggtttttatggttttaggtctaacatttaagtctttaatccatcttgaattgatttttatataaggtagtaaggaagggatccagtttcagctttctacatatggctagccagttttcccagcaccatttattaaatagggaatcctttccccattgcttgtttttctcaggtttgtcaaagatgagatagttatagatgtgtggcattatttctgagggctctgttctgttccattgatctatatctctgttttggtaccagtatcatgctgttttggttactgtaggcttgtagtatagtttgaagtcaggtagtgtgatgcctccagctttgttcttttggcttaggattgacttggcgatgcgggctcttttttagttccatatgaactttaaagtagttttttccaattctgtgaagaaagtcattggtagcttgatggggatggcattgaatctataaattaccttgggcagtatggccattttcatgatattgatacttcctacccatgagcatggaatgttcttccatttgtttgtatcctcttttatttccttgagcagcggtttgtagttctccttgaagaggtccttcacgtcccttgtaagttggattcctaggtattttattctctttgaagcaattgtgaatgggagttcactcatgatttggctgtttgtctgttattggtgtataagaatgcttgtgatttttgtacattgattttgtatcctgagactttgctgaagttgcttatcaacttaaggagattttgggctgagacagtggggttttctagatatacaatcatgttgactgcaaacagggacaatttgacttcctcttttcctaattgaataccctttatttccttcacctgcctaattgccctggccagaacttccaatactatgttgaataggagtggtgagagagggcatccctgtcttgtgccagttttcaaagggaatgcttccagtttttgcccattcaatatgatattgctgtgggtttgtcatagatagctcttattattttgagatacgtcccatcaatacctaatttattgagagtttttagcatgaaggttgttgaattttgtcaaaagccttttctgcatctattgagataatcatgtggtttttgtctttggttctgttgatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattgttctaaaattctctttttttgttgtgtctttgaccagctttgctatcaggatgatgctggcctcttaaaatgagttagggaggattccctctttttctattgagtggaatagtttcagaaggaatggtaccagttcctccttgtacctctggtagaatttggctgtgaatccatctggtcctggactctttttggttggtaagctattgattattgcctcaatttcagctcctgttattggtctagtcagagattcaacttcttcctggtttagtcttgggagagtgtgttgaggaatttatccatttcttctagattttctagtttatttgcgtagaggtgtttgtagtaatctctgatagtagtttgtatttctgtgggatcggtggtgatatcccctttatcattttttattgtgtctatttgattcttctctctttttttctttattagtcttgctagcggtctatcaattttcttgagcctttcaaaaaaccagctcctggattcattaattttttgaagggtcctttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctaaaaatttccctctacagactgctttgaatgtgtcccagagattgtggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtcagagagatagtttgttataatttctgttcttttacatttgctgaggagagctttacttccaactatgtggttaatgttggaataggtgtggtgtggtgctgaaaaaaatgtatattctgttgatttggggtggagagttctgtagatgtctattaggtccgcttggtgcagagctgagttcaattcctcggtattcttgttaactttttgtcttgttgatctgtctaatgttgacagtggggtgttaaaatctcccattattcatgtgtgggagtctaagtctctttgtaggtcactcaggacttgctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgcctttctttgttttccatttgcttggtagatcttcctccatccttttattttgagcctgtgtgtgtctctgcatgtgagatgggtttcctgattatagctcattgatgggtcttgactctttatccaatttgcctgtctgtgtcttttaattgaagcatttagtccatttacatttaaagttaatattgttatgtgtgaatttgatcctgtcattatgatgttagctggttattttgctcgttagttgatgcagtttcttcctagtcttgatggtctttacattttggcatgattttgcagtggctggtaccggttgttcctttccatgtttagtgcttccttcaggggctgttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatctcctgttagtctgatgggcttccctttgtgggtaacccaacctttctctctggctgcccttaacattttttccttcatttcaacttttgggaatttgacatttatgtgtcttggagttgctcttcgcgaggagtagaagagcaactcctacttctttgtggcattctctgtatttcccgaatctgaatgttggcctgccttgctagattggggaagttctcctggataatatcctgcagagtgttttccaacttggttccattctccccatcactttcaggtacaccaatcagacgtagatttggttttttcacatagtcccatatttcttggaggctttgttcatttctttttattcttttttctctaaacttcccttcttgcttcacttcattcatttcatcttccatcactgataccctttcttccagttgatggcatcggctcctgaggcttctgcattcttcacgtagttcttgagccttagctttcagctccatcagctcctttaggcacttctctgtattgattattctagttatacattcgtgtaaatttttttcaaagtttttaacttctttgcctttggtttgaatttcctcctgtagctcatattttgatcatctgaagccttcttctctcaactcgtcaaagtcattctccgtcccgctttgttccattgctggtgaggaactgcgttcctttggaggaagagaggtgctctgctttttagagtttccagtttttctgctctgttttttccccatctttgtggttttgtctacttttggtctttgatgatggtgatgtacagatgggtttttggtgtggatgtcctttctgtttgttagttttccttctaactgacaggaccgtcagctgcaggtctgttggagtttgctagaggtccactccagaccctgtttgcctgggtatcagcagcggtgtttgcagaacagcggtttttcgtgaaccgcgaatgctgctgtctgatcattcttctggaagttttgtctcagaggagtacccggccgtgtgaagtgtcagtctgcccctactggggggtacctcccagttaggctgctcaggggtcaggggtcacggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcagacaggcctccttgagctgtggtgggctccacccagttcgagcttcccggctgctttgtttacctaagcaagcctgggcaatggcgggtgcccctcccccagccccgctgctgccttgcagtttaatctcagactgctgtgctagcaaccagcgagactccgtgggcataggaccctccgagccatgtgcgggatataatctcctggtgcgccgttttttaagcccgtcagaaaggcgcagtattcgggtgggagtgacccgattttccaggtgctgtctgtcacccctttctttgactaggaaagggaactccttgaccccttgtgcttcccgagtgaggcaatgcctcaccctgcttcggctcgtgcacggtgcgctgcatccactgacctgcgcccactgtctggcactccctagtgagatgaacccggtacctcagatggaaatgcagaaatcacccgtcttctgcgttgctcatgctgggagctgtagaccggagctgttcctatttggccatcttggctcctcccctccaggttgatgtcttaaattgactattgtagatattgctgcaataaacatgggaatgcagatatctgtttgacatactgatttcaaatcttttggataaatgcccagaagcaggattactgggtcacacaggaattctattttcagtgttttgagaaacctccatatggttttcttcaatggctgtactaatttactctaccaccaacagtgtgccaggattcccttttcaccacattcctgccaatgtttgttaactgtcagatgaggataattacttatctcttaggattaatgagaatatttagatgttaattcatggtaactggcacatttacctgctacatgctggtaattacataatggtggtgattgttttatataatctcagaaaaagaggctgagaaaatgagaataaaagtcaagttaaaagcattattagataacaggatgtatgtgggataaccataaatatagtaatatagaaacagcaagttttttcactttatacccagcccaacattagttaaggtagtattaattttcataattgatcagcaaactacctatgtagtttacaggaccacatctcatccaggattttaaaagatgcatatgtatattgagctgataatatctgcctaagtaaggaacaatcagataatcttcacttctttgaaatctctttaaaattaataactacagggtatattatactatgtggctattcctcctagcaattactacctcctagaacacttcaagtagacaaaggcaaaatggattaatagtaacttttgatagaattttgtccttatgaaatcaataaattctatagtaaagaaatattagatgcttctagattatatctcaaagcatttttttttactgtatttatttacctagatagtcaatccaggttcatatatatcactgaaatttcttgttctcaatgcatggtataaaaggaaatgcctgatattcattttcatgaagacaaacatgttttatttttaatgatagagtaagtaaaagtttcagacattttcagaaagtacaatttctagatgtgtagttcagagtctagaacctattaattaagatttaaaagctatgtagagtatcagtaaagtagctgagaagtcccattaagattcccaagattaatataaggaacaacagcctatataggaagacgtctaaaccaaataattttcaaagagcaatcatctaatttctaataataaagagtggacatgtgaaaattgtcattcttcctctctgcataattttcaccatttttctttgttatcaattctagacatgtaattcaagtttatgaattgcatactagatgtttgatgaaattcacctggcctaaaagtaaattttaaagagatagttttctgctgaaatctccatttcttcagttttctccacagaaaactctctctgccaagggccttgattcatattcaaagcttctctggaatatctctgtctaccaagaaagaatatcaacaaaatttgatagccattgaaatcaatgtgtttgtgctttaataactcacaaaaaggctgaataaattatttgtttttgaagcattctctgggtgaaatataaaacatgagattataaactttgaaagcaattttgaggaaaagttataggttaacaaaatttagaaagtgtctgtctagtcattaaaatgattaataaactagtatgataattttacatataaattttttaattaatacctactgttttgaagagaggtttaggaagagagtttaaagaaggaacaatatgaaatgtatgtagaatattaaatggctcatttaaaaaataaatattaggaaataaaatcacatgttgttttgtctactctggtacattgactagatgtgtctattactatagatagcacccaaggaatcataaattcctttagatagagggaacatttaaaaatcatctactcaaaaattcttactttgcacacagggaatctgagatcaaacagtaagtggcaaagataatgcaataactgtgactcatggatcattaatctctcctggagtaatttttagatattcttaagataagatagtacacttaagttttctaggggaagtggtttttcattgtagttttacttgctttatctgataaataattaggttgaacatattctcatgagcatttttgtattttgaatataaccattttacatataaataaaccacttttcatttattcaattatttgaccaatttttaaaaaatgtggttgtttgtatttttaatttatttactacctaagtctatttaacttttcttaatggttgtcttcttattgttgagctgtaagtttcatttgtatgttttggattcgagtcctttcactgatgtacattttctcttgtttatgacttggcttttcattctctctgtagtgtctattgaagaacaacattttatatataataaaattatatttacatttttctaatgtttggggtttttgtctatttaagaaatatttgtctatctcaaagtcacagtaattttattctagaagatttatgtttgagcttttacatttaggtcaataattcatttctaatttttgtttgtgaatagtgtgaggaaaagatcaaggttgattttatacatgcacacatgcattacgtttatatatataatggctgatatattatatataagatatataacatattttatacattgtgaaatatatattttatatgcatattatattatatacacatataatgtgtgtgcatgtgcaaaatatatattttacattatatattttatatatatagtggatataatatattcattatatcagttgatatatccattatataatgtaaaaatatatatgtatacattatataatggatatatacatatataatgtgtgtgcatgtgtaaagtatgtctaatatatatattatatatatataatatatgataaaatctccaattgctttctcactatttattaaacttagtatttttaatgcattgaattacagtttgtctttctcaacaatcaaataactatgtatgttttcaactgactatatatttgggtcaatttccagattctgtcctgatccattgtcatatatgtctatgcttatgccaacaacacactgctattaatatagctttagagttagtcttaaaatcagatggcattagtcctacagctagtgcttttctaaagatgttggagacacattttaaaaatagcttgtcaaatttaccaaagtaatcctgtgggaattacagtctgtttgtattttatctgtacattcattaatttagggagaccagacattataagaatattaaatctcgtgttcaacagcaaaaatattttaattcatagacattgtatatctttctgtttatttaaaatttttattagtcttagtaatgttttgtaattttcaacacaaatgtttttaacattcttcattaaattttttcctaacaattctgaatgcattttttctctttttttcatactcttttctttctagtattccagtgtacatatgttgaagtggttaatattattgtaagcatttttgaggccctgttcatgtttcttcaaactttttttctcttcactgttcttcagaatgaatcatttctattagtatcacgtcatatctactggccctttttctgccatcttcatttttttaatgtgcatccaatttcatttttctttttagaattttcatttgcttttaaaaataacattgtgcaacttttatgttaagatttcctcttttgtcaagaacacattacctataagttcctaatcctatttttaatagctgccttaaagtgtttttctgctatattcaacatatagactatctagatattggttatcatcatctagtcttgtgtgtgactttgaatcatatatacatatattaataactggtgagattttatgttgcgatggagattgtggttgatatattacagagactctgtattttatctcttgaatatttttaattgttgttctagaatgctgttaaaatactggtaatcaacttgatttgtgtacggtttgttttattctttgcctattgccagtacttaaaaagttcaaggtagtacccaagctcctcttatttaattgagctaaacctccaaagatgtgtccccacccctcccaagttctgtctaggtttgatttagatttttttaaggtaggtttgaaataggccttattctagggcagggatcaaaaaacatttgctgtaagtgaacacacagtaaatattttagtctgagcagaccatatggttaactactgaattccaccattgtatcacaaaagcaagtagactatacttaaacaaataaaggtggttgtgttttaataaaatttgcatacaaaatcagtcagtaagcaagattttgactgtgggctgtagtttgccaacaactctttagtgcttagctattaatctaaagactgctgttttgattgcctgtggtattaagagtttatgggtgtctctggagctctactatccttctacggtgcttaaccttgagtttttctcttctcctctcagccatgtagaatttgttctattattgcccttgtataatttattaccctggtatgtgtagaccaactctcagccaaggatgtacaggaacactcctgttacccaagctgatttttgggagccccacccctgctcacttcatatttctctgatgccctgtcccgcatattgtagccatttaatctgttctaaactctgctttccgcttcaattgctcagtgcaactacagtgatcatcttgggccattgctcttcgcaccttggttaagaaattgccatcaggcagaaagctggtgcagtcatggggcttacctagtcagtttcctatatttcaaggttcgtagcctggcacaattggttcacagttgtttataggaggagggctagtccaatattgattaccctgtcatctctgacatgtctagaagcagataatttgaatcctttttttaagttatattttaggtttgagagtacatgtgaaggtatgttgcataggtaaacccttgtcctggtggtttgttgtacatattattttctcacccaggttttaatcccagtacccaatagttatcttttctgcttctctccctcctttctactcctcctgcccactcaagtagactctagtgtctgttgtttccttctttgtgttcctatgttcttatcatttagctcccacttataagtgagaacatggagtatttggttttctgttcctgtgttagtttgctaaggataatagcctaatccttctttaaatatcaagaaatataaatatctaactagaatttaagaaaaaatatttcttcacattaactgaaaatgcagggttcattgatttcaggcatggtttgaatgagtttttcatgtcaccaaagcctgctgtatatttatttcttattttttatgttttattttattctataggacagtatagctgttctcttttatcccagcaacaatgtatatttgagtttaggcctaaacatcttcatattactctgcaaagagaaataatatactgtatcttcccttagatgaagaagagacagcttttattccagaaaacatcagtaaatatcttctagtttctgcataaagtcatttaagtgcctaaatcaattttcaattatttaactagagagttaagagatagagtgattgctttaagaaattacgtctccatctttgcaactgagcattgagatctcacctagcatgtatggctacaaaagaatgtgaggcagaatggatgagaaagagtggagttattactcacattttaggaggccagtccatctcatgacttgttcatctggttttctgagttttggtgggaacacacacatgcgcgcgcacacacacacgcatacactttctctttcttgaggaattctaggaattatcttaggaattaagatgaaccatgcatttgtactttatgttcttagagccttaaaaatggtttaccgagctgaattataaaatctgttagaattttattttagaaactactacttggaaaactcctgcatcttctgtgtctctggtaggtttactatctttgataatgagaattttggagccaacagcattactttttacaagcagctactagaggtcttggaacaaaattttcagctcagccaagacaaataagttttaaggctccactatcagtgctttttttctgctgttgcatcccctaccctacctttatatcacattcatgcagcatattatcatatattttttccataaacctgatatgtctttaagattttattacttttaatgtgaaattgtctcacatccttttcagaggaaagtaaggtatagttttatattctataaacctcagtgaaatttatcagagaaattaaaataaagacaactggatagttttacctagagggaaaggggtgaagggagaatttttaaaaattgtatcaaagagttatttcagaatcattgaattacaaatctaacgtatgactgatgagtcagaacttcgcaaatttagctagttgccaaaattttataaaattattcactgaaatttcaataaaatgtaataatctagcctcacatcctttttcttttctgcttcatccaacacagttataccttcatgtttcccagaagaaaacagagtttgtgcacagaacacgctactggtgctatcctttagaatctagctctacttaaggtccattctgagaaaaaataacaagtaacacctccttggagcactacacttagagtgagccagaaacaaaaccaagctccagctttttatggtctgtaaaaatttgaagttctacatttttgtaattgttaataaagtgtattaagaatttacattaagaatgtggtacatatacaccacggaatagtaggcagccatataaagaatgaaattatgtcctttgcagcaacatggatgaagatggaggccataatcctaagcacattaatacaggaacagaaaactaaatgctacatattctcacttataagtaggagataagcatggagtgcacatagacataaatatgggaacaatggacactgttgtctactagagcaattatcctcaacctttgtggcaccagtgaccagtttcatggaagaccatttttccacgtacctgagatggggtcggggaggggtttcatgattattcaagtgcattatatttgtcactagattctcataaagagcatgcagcccagatcccttacatgcgtagttcacaatagggttcatgcccctatgaaaatctaatgctgctgctgacctggcaggaggtgaagttcagctttgctcacttgccagctgtttacctcctgctgtgctgcccagttcctaacaaaccacagagcagtaccagtctgtggcataggggctggggaccactgtactagagggtggagggaggaggttaggttgaaaaactacctactgggtaggatagtcactattagcatgatgggatctatattgcaaacctcagcatcatgcaatatccgcatgtaacaaatctgcacacgtacgccctgtatctaaaatagaagttttaaaaaaaaattataaaaaataattatggctactctgtatgatttaatccagtacctaatcctttccaaactggaatcaaagtattacaacatgggatggtatctgcaagtccttttattactttttcttattctttttgtcaactctggtttcccaagatctcttggctggatttttaccaggtaaaaaaaggtaaatcattaaaaccctgggcatggccaggtgcagtggctcatgcttgtaatcccagctctttgggaggctgaggcaggcagatcatctgaggtcagaagatcgagaccagcatggccaccatggcaagatcctgtttttactaaaacagaacaaaaattagctgggtgtggtggcatgcacctacaatgccaactacttaagaggctgaggcacaagaataacttgaacccaggaggtggagttgcagtgagccgggatcatgctactgcactccagcctgggtgacagcggagtgagactccgaaaaaaaaaaaaaaaaaaaaaaacacttgggcatgaatgacaataaaattttcaaaggcaaatttgctatttttgttagaatttattcttcctgccctgatacaagcttcctgaattgttattgattgcctttatgatgaatttatgacaagtaatataaactgtattacttatcatatagtcatatattactattgaactggtactactctaagtattttacagatattgactaatttaattctcccaacaagcctataagttaagtactattattcatctttaaagaagaggaaactgaagcatggggagattaaatatttaagtagtaaaaattaataaggggtaaaaactagtactccaatttcaatgtgaactccagtgttcatctcctaccatatttgttttgctgtctctctatagtgaaagacaacaatgttgtccttctatttttgagtatgttccttcaatacctaatttattgaacatgaagggatgctgagttatatcaaaggcctttttctgtgtctattgagataatcatgtgggttttttttctttagttctgtttatgtgatgaatttacatttactgatttgtgtatgttgaaccagccttggatcctggatgtaaagccaacttgattgtggtggataacctttttgatgtgctgctggattcggtttgccagtattttattgaggttttttcattaatgttcatcagggatatttgtctgaagttttctttttttgttgtatgtctgccacgttttggtgtcagaatgatgctgacctcataaaatgcattggggaggagtccttccttttcaactgtttgtgatagttttagtagaaatagtaccagctcttctttgtacctctggtagaattcacctgtaaatccgtctggtcctgggttttttttttttttttaaatttttggttggtaggctatttcttactgcctcaattttagaactcattattggactatttatggattcagtttcttcctggttcagtcttgggagggtgtttgtttctaggaacttattcatttcttctgaattttctagtttatgtgcatagaggtgtttatagtattctctgatttttttgtattcctgtggaagtcagtgatggtatctccatgatcccatttctattgtgtcttctctcttttcttctttattagtctagctagtattctatatatttattagttttttttttttttttcaaaaaaacagctcctgggttcattgattttttgaaggttattttgtgtctctagctccttcagttcagctttgatcttgttatttcttgtcttttgctagctttggggtttgtttgctcttggtcctctagttctttaagttgtgttgtcacgttgttaatctgagattcttctactttttttgacgtgggcttttggtgctataaatttccttcttaactttgctatagctgcatcccagagattttggtacattgtctcattagttttaaataacttcttcatttttgtcttaatttcattatttagccagaagtcattcagcagcaggttgtacaatttctatgtagttttgtggttttgagtgaatttcttagtcttgagttctgatttgattgtgctgtggtctgggagattgtttgttatgatttttagttattttgcatttaccgaggagtgttttacttcctcttatgtgatcaattttagagtaagtgccatacagcaatgagaacaatgtatattctgttgttttttaatggagagttctgtagatatctatcagctctgcttgatccagagctgagttcagttcctaattatctttgttaattttctgtcttggtgatgtgtctaatattgtcagtggggtgttaatgtctcccactattattgtgtgggagtataagtctctttgtaggtctctaagaacttactttaataatctgggtgctcctgtattgggtgcatatatatttagaatagttagctcttcttgtggaattgaaacttttaccattatgtaatgcccttctttatcttttttggtctttgttggtttaatgtctgttttgtcagaaattaggattgcaacctctgcttttttgtgtttttcatttgcttggtaaattttcctccatccatttattttgaacctatgtgtgtctttgcacatgagatgggtctcttgaagacagcatatggatgggtcttgactctttatcaacgttgccattgtgtttcttttaattggggcatttagcccatttacatttaagattaatattattatatgtgaatttgattctgtcatgatgctgaaactagcattttcttacacattaaaaagggaatttttgcataaatagttctatgtatttatgacagataatctttctaccaataaaatgaaatacatgtgatttaaatataatttataaattcttgtttctttcagcctctgaatttgggtttctgtttcacaagagaagcaaattaacccatatagatatggcttatcaggaatactgttgtgattaaataaattttaccagatatctaaacgataagaagaaaattatgcttggaattttaaagaccttacaatatagataaacttagcactttcgaggtaaaaataaggccagtatatccaaagcatattgagcaaggggcaagtggtaggaaagaaagattgagaaggagaaaataatgttgtgcattatttattatggtaaaacatatgatttttaaatcaatgaataaatagggaaaatgtgcatatgtgagttgcctgggggtcagtgatcttggctgggctgaagtatgactctagagatccaccagcttgcttatccaccagcagtttgactgtaagctgggtttattgtaaatatttaaaatattaatatgttgattaatataacctctcacatgctctattctgttttctagcttcactttcttgatagcaactgtcactatctgattttatatatgtatattctgtctctttttaaagagaaggatttctttttcttcattattctacaattagttcagagaatggtttttgatttatattaaaagatgagtaatatttgctgaattataaaattattgaatgaatgttgacacctaataaaatggcagctttcctatagaaaattaaatgcattttattattcttgctctcagcagataccacaatcaactggaagatgtaaacaatttaagaatataagtttgtagattatttagagaaagtatttgttgttgctgttgttgttgtggttgttgttttaagtcatcttggcaattctcatggcccagcacagtgcctggcatagtgaagaacacagagattaatcaaaggatgaatggataaatggaacaataatggaataaagcaaagtggtgcaaatgctatatgtatacagataatggaacttccaactcttcacattcctaatttgaacctggctattatggtgtagaataagtattgccatctctagtttagaaaagtcaagggctttgcccaatatcacatagctgggaaggggtggaggcaggatttgaatatatgaattccaaatctgaaggtactgcttttttattctaatagcacaataatgatacttgtaatggtatagaggtatggtaggatagagaagtgtatgggattaaaacacaacaacaaaaatagagtacatattagtacatttgtctgcttgggctgtcataacaaaataccatcgactagtgtaaaaataaaaatctattatctctcagttctggatgctagaagtcccagagtaaggtgtccatatatttagtttctggcgaaggctcttcctggcttgtagtcagtgccttctctgtctgccctcacttggcctatccacctgtgaacacaaataaatatctctgttgtttttttcctctccttatgtgaacatgtgtcctatggaattagggcctcactcttgtgacttcatttaattttaattacccccaaagtgctctgtctccaaatacagtgacaataatgagttaggccttcaacgtataaattttgggggcataaaattcagtctatatcaactagaaatataagtgatggatctaaatcacaggtattcctagggacttgagttgggtccttgaaattagatgttttggtctagtgaagcatttagtgcatattcatccagaactaccattttctgcatattaaatattctgcacatcaaattatcatgatatatagtatttttaaactgaattctaaatgaatcttacaggacactgttttttttttttttcttttctctctttttacaattctttggcaatatatgacagatgcttaaagtacagagggaaattgcagaatttatctagaagatttatctcttattttacaggcgcagcagcttactgatctggaacaaaaattagctgtagccaaaaatgaactggagaaagcagctcttgacagggtaagtctacattcatgaaccattacaactgtagttttagcaaaaaaaaaaaaaaaaaaaaaaaagttaaagtatgctcattgcttttcttgatttattaatgtgtttctagatgctgtgtatataagatagttacagaattcaggaaggtttgatatcttctttggaatccaactatttctttgtttttgctgctacagtaaactgactgaaggttcagtctttgtgagttcatggctccatttttcacctcactggtatatttattccataataccatgaataaacatgctttaaagcatcaactaaggcactatatattaactctaggtgaatgagttatgaagcaaaaggaagtaattattggcatcaaattgttataaccagtttttgaatgcatgtatcttataatttatacttatctatatttacttagaaacatgcacaagaacactgaatatagcaatgtttatattaataataaatggaagtaatttaactgtttactgtaagataattaatgcacctatttttaaatattttctatactcaaatttggaaatagtaattaaaatataatattaacaaatatacataaatgtgttttatcaatattgatatacctacaacatataatgttcaatgagaaaagcagaattatatgtataatatttaacagttgtttaaatacacaaaacacatttttaaaaattacatacaatgtaaaaagataatgtgtatgtagaaatttgacatgtatatagaaagatacagtcacataaaattcatggatacaattgcgtttggggaaaaacagtaaaataacaccagggatgtttacaaagagcacttctgctgtaccataaatattttatcctccaataattgtacatatacaagcaatctttaattcatacaccacatatatgtacattttatccattacatacatgcattatatatgtatacatgtaaacttccattacatatatgctttacatatgtatgtatacatacattagatataggtaataaatatatgtatgttgcacatatgcccataatatgtatgtatatatacactatgtttaacattatagaaaatgatatatgtaacaagtatatatgtattttattatcaaaattttgcttttaacacttaattcagatagatatttacttgatatttattatgtttctctctatctgcttctattgtttttaattttttttttaattaaaggaaatactctgatgtcaagggctttctatttttgtggtcacagcttagtaaccatttatttgcgaaaattaagcaagtaagatgattgcaattataaacttattttgcaataattcatttattttgcaatagtacactgtatacatttagcaattttgtaaggaaaggagcttaccttctaaccatcagtttgtaccatagttattttagtataaaatagaggggagcttgccccctattttgtgaattagatcaagtataatttgtcttattaagatcccagcattataagattttaaaaaaatttatataaaacaaatttataccaatttaagctaatctctgaccatatccaacttatgccaattattacttttaaaaaatgtatataactcattataacattggtggaatcagagaatcagaggcatatataattctaaagctcaagtaggccacctttgttttagtcctttctctgacattcctgtacagtcgctgcaatattgtttaaatcctagaaaatcattagattcccatgattctgaagcagtctggtcttctctgagttgttaccctctctggttcttggaatattcttcgttatattaaatgttctcccgatttgacttcacataatccttttagtcagtcaatgactaaatagctttgaaatgccttttttgtggccatcctatgctaggtacaagggaaaatagaaaatatatgacacaaggtcttgggtcccatatctctcacaattttgtttagcactaacaattagggaataattgtatactgagacatgaggcaacagaagcacagagaatggatatgtattttctaagtacctgtgggtcatagggcacggtatagtcacaaaacactttattttgcaactggaatttggcctgagtcacagagctcagggttagtgtagagttgttcctccatctttagttgtacatattcttacccattcaatgctcttctcctcccaattccacctcccaacccctgtcattatgtccctaaatttcaggatgagaggctgatgttgtagtggttaaataatggtctccagagatagtctacttatgttcaaatcatgactctttgactgaatgaccatgttcaaattcctcaaaatctttatgtctcactggaaataacaataaactttatttataatggtgatgagaaaattacacgtagccaaaaattacagtactaggtacaatgcctggaaaacattcattaaataagcttagaagttattattgttactgaatgagatcacagactgcttctctgtgataacaattccctctttaaccttcagatcttgtcacgccttttagtaactataaatgcctttcatattactggaggctgattttaacaaatctcatgtaagatacatatgaggttcataaactatagccataaagttagatagaaatgctagttgacttcaaaatggataaaaactacagtttaatgaaatagattttcccctctctccatcatctttatatgaggcttttaaaatactatttgagtatttagttcccaagaatataatatctggaatttaaataaccttaagtacttcatacgtattatgaaaaactcttaacacttcaacttgattcttatgacatatttaatgaaagaagtctcagtttagtatctcagtataaacaataataatatcaagagctaagaatcagccttgagtttcccatcagttatttatttggcagtatcttatgaattatatatagttggcctcagctactggaatataaaagaagctttatgctaagaaaaatctctcaaacttttacactaaaaatgtttatatagtatctgtccctcacacccgggaaagcatacattattacatccatattacagatgacataggtagggtaagtgacctacacagactccaatgactgagtaatacagaatgagaaatctttttgcaaccacacagtgtctggcacatagcaggaatataataaatacttcttaattaaaaataaagacctgacctaaatgaataaacattctagtcatcccacatacatgggacctgaatatcactggagcagaggtctcaaaatattgaatgactttcccgggctctctgagctgatttcatggcagaaataaagttagggagaaagtgtttggcctcacagtctctcatggtctttccaaagctggcagttcaggacttggtgtcttcatttaaaagagttaaggtaacatgaaaaacatcttgtaaagtttcatttatgtagagtttagatattaggggcacagttgtctttgcaaggtatatcttgttgtccccagacaaaatgcattttttctgagaaaagtactaacacacaccaaaaaaatctacctcctaaattttccaccatcttaagatcacatatgagaaatactttcttataaaattttcatattatacagtgtaaatggtagtattttttaatatatgaaataatttcttatctaatatataagataaaatgataaatatttcatcattttctcttgtaacaaaacactaacctatattctctggagggtttgcttaattttttatataacaagcgtgtgttgtgttagaaactgatgatgccacagataggataccagccttcaaaaaagtttgttaaaagtgaacattaaacataaaaacaacaagatgatttgaaatgatggtaaggactaaataagatataaaggtagaaaatataataacaactttaggaaagaaccattcctggaaagggtgataggggctgtttgcatgaaaatagtttgtgagctgagacatacattttaagtggcagtttctatatgggtatttggaagaagggttctgcaagcagaggaagcagcatttgtaaaggctctaatatggaaatgagtttgggatgcttgagggtctatacacaaaggatattgtgataaacagggcattttcattaaggaacttgcattttactatcacattttaaaacaagtaggaaaagtggtgtgctgcagggagcggaaagacagagcaaaaacaagactggctgtacatggtttacatcatatttcattaggtgacagcttgttttagcaaacttcaaagtaaacagtagcctgcagttgaaaacaaatgacacctaacagtataaataaaaatgtaatgccatcgtggtgtaaaatcatcctctgggttttgctcatggaactgagtcaagccaaacctgagtagtatgagtaataggctctgttaagttagaggaacttaatgggcagtaggtaaggggtgggcaattcggacctgagggtttcccccatttttagaccatatagggtaactttgtgaccttgtcatagcatttgtaaaatgtcatggtactggtgggggtgtcttttagcatgctaatgcattgtaattagtatataatgagcagtgaggatgaccagtggtcaccctcattgccatctaggttttgggggttttggctggtttcttgactgtaatctgttttatcagaaaggtctttatgacctatatctcgtgttgacctcttatctcaccctgtgactttgaatgcctaacctgggaatgcagcccagtaggtctaagcccagcctctattcaagatggagttgctctggttcaaacgcccctgacgctgttacctaacaaggcccagaggaaatgagagttttatcagagacaaatttgtttttaccattatgtggggaaatcgagtagagatataggctaatctgagaaacacaagaatctacattgctatggcaacgattctaaatacagaaagttgatgcagaaagaaagatggcaagtttcatcaacagagtaaacagacaacctatagaataggtggaaatatttgcaaagtatgcatctgacaaaggtctaatatccagcatatacaaggaatttaaatttttaagagaaaaacaaacaacctcattaaaaaataggcaaaggacatgcatgaacagacacttttcaaaagaagacacacatgtggccaacaagcatatgaaaaaagctcaatatcactaattattagagaaacgcgaatcaaaatcacaatgagatactatctcacaccagtcagaatggctgttattaaaaagttaaaaaataacagatggttgtgaggttgcagagaaaagggaagacttatgtagttagtgggagtgtaaattagttcagccattgtggaaagcagtatggcgattcctcaaagaggtaaaagcagaactatcatttgacccagccatcccgttactgggtatacaccaagaggaatatacatttttcttccataaagacacatgcatgtgagtgatcattgcagcactattcacaataacaaagacatagaatcaacctaaatgcccttcaatgacagattggataaataatatgtgacacatatacaccatggaatagtatccagccataaaaaagaatgagatcatgtcttttgcaggaacttggatggagctggagtctattatccttagaaaactaatgcaggtacagaaaactaaatacccaccactcccacaagggagctaaatgatgagaacttaggaagacaaagaaggaaacaacggatgctggggtctacttgagggtggaggatgagagaagggagaagagtagagtggagtagaaaggacaactgctgggtactgggctgaggacctgggagatgaaataatctgtacaacaaaccctcatgacacaaatttacctatttaacaaaccttcatacatgtccccaaacctaaaataaaagttaaataaagatggtaactttcaaaaaaggatattttctacatcagagtaacctagagtatatttcctttcctgcaaactatcatggtggaaatcatgtcagttcaagagaaagtaataagacatatctttgtatttcagtgttcaaaatatatcatgaaatgcattagctcctagaaacagactgagtgtggatataaaagtatgtcataatgaaatttataaattaggcaattacatttgaaaagtgatatgtatttttgtggggagtataggctaagaggaaagggagaatgcaagcagataattgatgagcatagctaaatgtaaatatgttaatgcctctttttttgtaggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaaggtacctaccttttatttgcgctttgtaaagtaacagcaagtaatgtgttgtctttaaagcccagtatatataatcaccagagtggattcaagtatgataacaaatccattgaaagattaggaggaaaatggaaggtagtaacccagcttgtaaaatctccatagtcactagaagaatgttggaagggagcttttctttcatagagagcctagctgattcttaggcagaatcatctaattgtttaacacaaaacaaaaactaataatgttggaataagttaaaagagaatatcttgtattacattgaaataaacatcacaggtttgatatggggaatattttcttctggggcacaagtatcttcagaaaggtaaatcattttttttttcttaagtccacaactctcaacactggctgcacattagaatcttagtgtaaatatttttaaaagtgtgtttaggtgtatttacattaaaaaaaagccttactcctggggttttttttcccagacctattaaattagattttttttttttgagttagactccagttatcagtaatttttcaaagtcccaggggattttaaggtgcgttcaagtttaaggacaactcatttgagcaaatcttcctccaaattccctccaccaacctactttagacaaaacaaagaacatttaatggtgcttttgtttcaatcttcaaaaacttcaatttgtaggccctacatacattgaaataaatcctgagagccagaaataatctttgggggagggagttttgttttgggcagtatgttggaaagatctagttctctgatcacttgtctgagcatcacttgttattaaaatgagtgctatggataccagcctgacttctaaatgcaaatctcaagggttgagtgcagaaaaacttaagaaccactaatgcaaatacctaatgatgtgttacatctggctttcttactgcttacttctgagatttcctatttttgaattaaagtgggtagattagggaaatgctattttcaggatggagagtcataaataatagaatgaagtaaatcttctgatatactgtttttatgtgtaactagtcaacttatgaactacaaagatttagtctgtatgagatccttatgtaatattaatgtttctcttttaaaaattattcaaaacaatgtattcaactatattatattattgtctgtgtttttatatgtaaattacatattttatatatatatatatatatatatataattgtgaattttaaaagccacaagttcacgaagggaggagtacaaaattgcaagggtttactagaaaaaggttaaaaataattaatatatcagtacccccaccatttaaatttattgtttttattatggtgcatacctgttacattcactgttagaactatagcttaagtttctgctgagagtcttcaacgaagtccctcagataccctttcatcattaccctttataaaatcgagatgcaggtttctctctgagtgaattatttcttaccctcccagttagaattattttttctttcctcagtgcttgctttgacagctgagtgtttactactcttggcccttggtcatcccttgaatgttacctctgcctatgtcttccttcttcagagagatgtctgtgcttagctcattgatctgtttaatgttatttagtgtccagaatgatgtttctagaaaattcatttgaaatacttgtggtatacccttcttcttcttataaattttcgtataaattcttataaattttacttatttggaatttagaaaattatacattattgtttgtttagtgttttgtattcaactacattgtttttcttctatgtaccagtactctgctagtaactaagacagcaaatttcaagtgacacagccctcaacttttggagattgcagcctaattttctgcaagagacaacaagaaaactgccggatttgttcttagtagtagatcaggtcatcttctgtttgtttccttgtttgttttctagatacctggatacaaacacacaggagatgacgtatcttttatgtctttgttatgatattatatatttgttatgtagaaaataatattctttcgaatatataaaaagtcaaggtagaaaccaggggatctgatctgcattttgcgtaaaacgaccccaactcccaaactaaagtagaaacaaataaaccatgtgacaatcttctgacctatgtaggagaggatggtgacctactttatgtcaccaacactgaaaatagtattcgaaatgttattgagtcataataattgtcatgacctagtgactaaatgggaagcatgaaggcaggaaatcaagaataaaagtccttgcattcattcactatgatgtaaagggcaagaggaggttttaaaagggaagccaaactggtttgtttctaacctgctatgttttgggtttctgtcataaaaccaagtgcccgtatccagtagatgattatgtatttaaatctggaactgagggaagacatctgaataaggatattagattagatatcatcacaatgaatagggttaaatattggaaataaataaaattacctgaagagacagtatggagtgaaaagagatgaggtctgcaaagtcactagacatgagaagtaacatgagtatggttttgtgtgtaagctaacagagggaatgtttatgacaaaagtgcatttattcccattattttgctgagatactctctaatgtatatttaagctgagagccatgacttttctatgtctattttgctattgcaaaaaatagagcatgcatgtcactgtgtttattcagaatgataaatactccagtggtctgttggagctggcttatacatgcttgcaaaagttgactgttaaatttacagaatttgtactattcaactgttaaatacaggcattattaaatattatattatatatacttacaattaaataaattctaccaatggcaatgtggtaaataccaaagctactatatagtgccataatctgtgctgttcaggatattgtatattttgaatctgtatagtggaaatactatataatagtatactactgtatatctctttgcaatttgtgttcaatgacatcatgttatcagattgaaattggtaacatttatactgtagaaattgactaacactataaatcagggtcctcctaacccacagagctagtgaatagcatgcctctgtgtgtgtgtgtgtgtgtgtgtgtgtgtgtaacatttaagataggattacttggcattatagataatatacaaaaaaagtgactaacattttttctactgctatgtggtagagctagatgcacagtagtgctcagaaaaggcaaattaataaacaaaaaggcttgtgtaattaatagcattctgaaaaaactcactttgtatatctattgcaatatttaattatattcattttttataaaatatatgctttatagaatttggaaaaaataaatataaaaggaagaacagaaaacatatcaccaagaatcctaccacttttagtttaaaagatatgaattaatacacagtaatatgtttggtgtttatatttgcataatagaacgtttaagaggtaggattcattagtcagactaagtaaaaatctcttttctgctattttttaattttaataccttgatcaaattacttaacttttctaagactcatctttcgtgtctattaaacggagataattacagcaccaaccttagaaagttgttgaggagatcaaatacaaaaattcacataaaacattagcatatgttgtggtgcctgacacacataaagcagtcaataaatacgtgaaacaagtattaggatctcttaaagccaggataacatgaaaacacctgaagaaaatttttagtgggatgttactttaactttgaataaagctacactatttacattgtattatttttcaagtgttagaatacattaattcaaataagtgtaacttcagttttttatcataaaagtatagcagaatccttacaatccatttagtgtcagggatcataatagtacatgtcataaagaaaggagaatgtttaaagacaccagaaatgaaaagcaattcagataagcaatgcagataaacagcaatgaaactgtgctatgaaaacccatatgtcacgccatcccaggctattactgtttcttttctttttcttttcaactcactgccttagttgcagtttatattgttgaaggtcacaactgtggtatctacttaattggaaaaggatgatttgttaatttttgtttaaatgtgttgtaaatgccaaagtctttccagggcaggaggccctggaacgaatggggctctctttaggagcttaaagacatgcaagtgaaaactgcatttttcttggtgcctggaagtttagatagatcaaggtacatttttcttttcctcttttctgccaaaaatctgttacaaagtagttttttaagaaacctcaaaacagtgcacctggaatcatcataagccaaggttctgagcctaggcggcatcttcaaattattatgggcttcaaaaatgctcacacctgggtgtcaatactcctgattctgatacaatttagcaggagtttaggctagttttggaggttattcaaaaatcacagatgattctaatttagagccaaggttgaacatgagtaagatccttattttagaaatgagaaaggactctaagaagtaagcttgccctatctctctacttctctgcttctagaagagatttctcaaataatacagaggtgatcaattttaaacagttctgtttttccacctgctgtccatcaatcactaaccatttagttatctccaacatcccatgaactatcctccatgtgaaaggatgcatgagggaggtgagatctcacagtatgtgttaaagccaatatttccttttcaacctccttttaatattcaaagcttataataccattctggaagaaagaacatgaatagcattagaaggtaaaattttttttcagtgggaaacaagagagtctatgtctagatatccctaatcaaactctattccctaggtttctgcaaaggaagttgtagttcagagataaaataatgtttcctcacaactttctaaaggcatcacagccaatgttcttgttactttattatgagacatgttactgaatgttagaagaatctatggatgtaaaataccgtgactatatgcaaagagtaatttaattaactatataaaatatgactatgtaatgtggtcctttatgaaatagtgttaaagaagacatgattatgcattttattataagattcttttaacagccctgataagcatcagtatgaccttaaacttgaatatgtttttcctgaatcatacatttaataactatgtattaagtaatttgagtatacaaagcaatgcttagggatatacgtgctatatttcttttagttactgtgactatccataaggacaatatcttttttacattcaagaagctggatatcggagttttagaaggttatcttctaggatttttgtattgtgttgtgtcctccaagaagacacaacacagaattatatttgcaagaggtttatttggaaaaatgcctgtgagagaaaatagggaggcagccataggaggccggaagagccatcaggccccagtgcagatctgatcattctggagcagtgagggaagaaagaggatctagatataaaaaggcttagattcctgtgcagttaaaaaaaaaaaaaaagaaaagaaaaacaactttggcaaatgtcaatgggaagccatcgtataaaagtcatccatcagatgagtccccatattttatgggaatgggctaccttactagccctgttgcatcacatgcgggggaagtcacagtttagcaaatggggctttcagtcaattatgctccccgcagtgggaaatctgagaggttccatgttggtggactgtattttgctcattatggtggaacaaatctcacattcctaaagactgtcagtttcttgctaaactatggcttctacatctcagggaaatataatgtctttaaaatttaggatatcttcattatttattttgtttaatagctaaagaagctaatgttatgggagactcacagaatagcaaaactctgacactcatgatatcaattcaaaggtgtagcattaactgcagacagtatagcttgcttcctatgtggagatagaacagacaaatatggactctgtgaaagccatcctgatgctgacatttctttcctatatctttcagtcaggaacaaagcaaaatgaattatatgaacaactgggatacggtgaaactgagcttgccaaatttctagatgtccagcatttgggttatattcaaagagaatatgctggcccatttgttcaagtcactaagctaaacaatgtaaggttaagatatttgacctacgtcatccaactaatagaaaacaagatttaaactaaggtctggtagttctaaaatcaggttgttttttttctatactagtattgctaattattataaatatacaaactaaattgattcattatttttccatcagttcctaatcactgggcacctaaattgcaattgtcatctgtctccatttaatcctacttttaggtgggatcatttaaaatattgccacatattctctgatattcgtccatcaatatatggggtctatgccccctttcttacaatctgggcaagtttgtaattatctgacaatgctagcaaaattacagattgttcatctcccctaaacctaaatgaatgcactcaaattttactacctttttcgaggtagttcaggttgcttatatctagcatgactcaaaagactattgaatgggttatcctgaagttttccaactgtttaaacatgcacacacacatacaaacatgtattttacaatttatatatacatatacctttataatttttgtatatgttttatgaattttatatgtaaaatttaaatttaactgctccattttgtttttcagcaaaggttaatttgagtcaaggacaaatctttagattttgaacataatcttgtctcactgatggggaaaatatatgactaaccattggtaatatatggttcaaatatttactatttgtatatactgcaaaatgatgaattgaaaggtaaatgcagagatgaagactggaaaaccatttatatgggattccttggttaatcctaaggaaaaattacaaaacttccattaaaacagcaactggtgagaacatagaagctgaaagacagtaaatagagttggcacatatttggtgatcttattagacaacctgagagttcaagattttaaaagactcattcgagttagaaatataaagaatctaaataaaagtcaagaatatatatttttcaaatccttacataattctagcctttttattctatatatatttttaacccccacccaacaaccatcactcataatgctggtgaacttctacccccctttcatgggttcatctcaaatgtcaactctttttgactacttccttgagtttctattgtgtttaagcatttatttttatttatttttcctttttaaattttttatttccataggttattggagaacaggtggtgtttggttacatgagtaagttctttagcagtgatttgtgagattttggtgcacccatcaacagagcagtatacactgcaccctatttgtagtcttttatcctttacctgcttcctacctttccacctgagtccccaaagtcctttgtatcattcatatgcctttgcatcctcataatttaactcccacttatgagtgagaacgtacgatgtttggttttccattcctgagttacttcacttagaataatagtctcagttctcatccaggttgctgcgaatgccattaatttattccttgttatggctgagtagtattccatcatatatatgtgtgtgtgtgtatatatatatgtgtgtgtatatatatgtgtgtgtgtgtgtgtgtgtatatatatatatatatatatattccatcatatatatacatatatctctcacagtttctttatccacttgttgattgatgagaatttgggttagttccacagtttgcaattgcaaattgttcttctataaatatgcgtgtgtaactatctttttcatttaatgacttttttcctctgtataggtagccagtaatggaattgctggatcaagtgatagttatacttttagttgtttaaggaatttccacactgttttccatagtggttgtactagtttacattcccgccagcagtgtagtagtgttccctgttcactgcaaccacacaaacatctattattttttgattttatgattatggccattcttgcagaagtaaggaggtattgcattgtggttttgaatcgcatttccctgatcattagtgatgttgagcattttttcatatttgttggccatttgtatgttttcttttgggaattgcctatttatgttcttagcccactttttgatgggattctttgttttttccttcctaatttgtttgagttcattgtagattctggatattagtcctttgtcagatttatagattgtgaagattatctcccactttgtgagttgtctgtatactctgctgactgttccttttgtggtgcaaaagctcttatctattgtggttcagcatttttattgtatttatatggcatttgtgaaaaatttaaccttgagactctgccctaaattccctggctagcctgtgagctcctcataaatacatacattggcaagtttccattgcatcaccaatactccaaaaacaggctgtaagaaaatcacacttagtgggattgaatacttaaattgaactactagaattggtgaactagtccagtaaacagtaggcaaacatttattgtactctattttggaaaagataattgtgtgtgtatgtgtctgtgtctatgtgtgatgggggatgggtgaaccattttaccatgattttcttaggactataaatatgataaaatacaataaggtggtattggctgctggctgttttaatggaattagattaattgaattacctgaagcataagctccatgaaaataggcaactaagtttcttttgctcactaacatataccaaactttcaaaacaatgtgatatacagaaactattcaattaatatttgttgaatgaataaatgaattatttaaaaggacatgtcagagttacttccaggaagcattgctcccaatacctaaaaattttctgactgaaatacaaatatttatttattttccctgacatctgcatttataattcattttgatgtataatactgcttccaagacattgtgacatacaagttgtactatctatttgatgacttccctattgaatttattgtatatctgtgttattacattttatgtgaagtaaagcacaaatttaagcatatttaatttaagtatacataatgccagttcacaattctggagcttcttgttcctttatccagaaatcttttcattatttgaatttgaaaattacctgaagtgaaaagattcaaaatatacaattactttttaagtttcaaagaaaattctctgcttcacaacaatattttatttatgtttacaacaaattgaattcaatattctattgatatataaattatctgaattttcagggaaattagactcttgctaaaaattagaaacatggtaaattgtaaagttagaatttggtattaccattatctgtctggaaaactacagttcttgtctctatgccccactacattgactgatctggcctgaaaacttaggtgatatataatgggagaaaatcaatcccagtaaatctgttttactttgttttcaattataaggaaattaacaactattacattaaaaaagagaaggttaaaatgtcataatgtaaaagcagtcaataccaaaactctatcaatgtcattatttgggttatttacatctttcctctaggtattctgcctcttgggaaatatattaaggaaatcatagttattgccagtcttgttttatcttttagtaaaacatgctctcatttgcttctgtatctcccagttattactgggtagataaaactgtatgattaatcatatacacagttagaaatattatatattcttaatgaattcaccctttaccattatgcgatgccttttttgtgccttttaatgtttattgtcctgatatctattttgcctaattttatgatagccacaccagtttttacatcaataatactacatccttttcaaattattatattttatttttaagctgtgtctttgtgcaaatattttcttccattctgggggttgtattttcactttattgaagatttcatttgcagcacagaagacacaagtttttaaatttgatgaagtccaatatatttttccatttcttttttttggggggggtgtgggggaatagagtctcgctctgttgcccaggctggagtgcagtggtgcaaacttggctcactgcagcctccgcctccggggttcaagtgattctcctgcctcagcctcctgagtagctgggattacaggcacgtgccaacacgcccgactaatttttgtatttttagtaaagatggggtttcaccatgttaatcagtctggtctcgaactgctgacgtcataatctgcctgcctcagcctcccaaagtgctgggattacaggcttgagccactgcacctggcccttttttttttttttttttggcacttgtgatattgctatgtttaataagactttgcctagtgtgaggtcatagattatctcctatttttctattcagagacttaattttaactcttacatctaggcatatgatttaatttgagtttacttctatatgttgtatttggtagtgatcaaacttcatttgtctgcatgtggcatcttgttgtttaaacaccatttgttgaaaagacttgttttatttcactgaattggcataatggcctgtctaaatacagttgatcatgatgcaagggactggactctcaattcagttccattaatctatatgcctatctatctgacagtgtttgcagtgactatggtagatttgtagtgtattttaaaatgaggaagtggattcctccagcttagttctttgtatttaaagtttgctttggctattcttggtcattgcatttttcaaataagtttgagaattacctgctcaatttctagaaaaacaaataaagctcagattttaaagggatgacattgagtctttagataacttagggactattatcgtcttaacaatattaaatcttcgaatattctattttttcagggtggtaatttaatctttaaaatgtccttgctagtgtataaaatacaattcttaccacatttttaataaattgaatatattgcttttcatttcatctacactgccattgtcagtcctgtatgtaatattctatattctaggtgtcattctaggatttcccaataagcacctttgacttagcacaatctactttgaaattatattatactgttatacattacacaaataagaataccataaaacgttttattttcatttttcattgtcatacatttcaattgtataactgttataaccacaaaataaattgatataggttttgcttttaaaaatgaattacaggctggatgtgatggctcacacctgtaatcccaacacttttggaggccgaggcaggtgagccttgtccttgagctcaagagtatgagaccagcctgggcaacacggctcaatcccatctctacagaaaatacagaaattagctgggcgtggtggtacacgcctgtagtcccagctacttgggaggctgagggagaaggatggcttcagcaaggggggcagagattgcagtgagcacagattgcaccactacactccagactgggtgacagagcaaggccttgtcctcagaaaataaaaataaaaagctaataacatatatttatgcatatgaaattgagaaaaaatgctcttttaaggggactcatatttatcatttctggactcatctttcatcagtataaatttaacttttcatgttacctcatttttttctacttgaaattatttcattttgctttttaaagttttttttttctgaatttagtaagctaggttgacagatttttaaatttagtagattaaaaatgtcaccccattgccttctagctggcatagctcagataataaattatgtgattatcttttcctttttgccttgtatttaatatgtattttatctctgaatgctttaaattttgttttcttttttcaatggttatcagcatgctctaaattcaattcacaattgaaaggtcaatggtttggttttcacttgctgtttacttgtttccagaattttctagaaagtcaattccaactctgataagggagaaaaaagtcattctaaattcagtgttagtgctacatgacccaatcttttttttctacattacttattatttaaaaatccagtaaaattttttgtataattcatttttattgttaatgttatattcttctatctataggttctaattatttttatatattttattttctctttgttattggtttcctctgcatattgattataaaaatattatctattataatatatttaacaacaaattgtgtatctgagtttttttcggtcattttttattgagtgaattttctcctgattatcaatcatatttttcttcttcttgacatgtttcatgttttttgactggtcattattttatttaaacttggatttcattgttttctattaaataaataatacgtttctctctctctccctgttcatatttcctctatctttctctctctctctctccaattaactacttgtaaaacagattcaactctcaaggcatgtttttaaattttctagaatggatctaatgtagccttcacttcatgaataattcttacattctattaaattatgaaacttctggggtttccacaaaatgccacagattagaactaggattttccattgtaattgtcttcccaccctgtgcaacttctaagaattctcacgttacaattattcagatattatttttcttttttctttttttattttattttattttattttattttattttattttattttattttattttattttattatactttaagttttagggtgcatgtgcacaatgtgaaggttagttacatatgtatacatgtgccatgctggtgtgctgcacccattaactcgtcatttagcattaggtatatctcctaaagctatccctccccctctccccaccccacaacagtctccagagtgtgatgttccccttcctgtgtccatgtgttctcattgtttaattcccatctatcagtaagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagttccaccaacagtgtaaaagtgttcctatttctccacatcctctccagcacttgttgtttcctgactttttaatgatcgccattctaactggtgtgagatggtatcccattgcggttttgatttgcatttctctgatggccagtgatggtgagcattttttcctgtgttttttggctgcataaatgtcttcttttgagaagtgtctgttcatgtccttcgcccactttttgatggggttgtttgtctttttcttgtaaatttgtttgagttcattgtaggttctagatattagccctttgtcagatgagtaggttgcgaaaatgttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctgacatttaagtctttaatccatcttgaattaatttttgtataaggtgtaaggaagggatccagttttagctttctacatatggctagccagttttcccagcaccacttattaaatagggaatcctttccccattgcttgtttttctcagatttgtcaaagatcggacagttgtagatatgcagcgttatttctgagggctctgttctgttccattgatctgtatctctgttttggtaccagtaccatcctgtttgggttactgtagccttgtaatatagtttgaagtcaggtagcgtgatgcctccagctttgttctttttgcttaggattgacttggcgatgcgggctctgtttcggttccatatgaactttaaggtagttttttccaattctgtgaagaaagtcattggtaacttgatggggatggcattgaatctgtaaattaccttgggcagtatggccattttcacgatatcgattcttcctacccatgagcatggaatgttcttccatttgtttgtatcctcttttatttcattgagcagtggtttgtagttctccttgaagaggtccttcacgtcccttgtaagttggattcttaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggtgagacaatggggtttttctcgtcttgtggagttccacgtatttctacagaacatgatattcaggaaaaacttaatgaaataaaaatcagatttttagaaatctttctgcttaatcctctactttccagaaatatttcacaagagttagtagttcagcttttttgaaatcctgtctacctatacccaacttaataggatttctgggctctctttcaggtattcaaacctggactttcagccaaagaattgcttccaggcataaaatcttgatgataaaagactcacctttcatttttttttgtttttggtttctttctctcagggatcacaatactgtcatgcatgcagtcgataactaaaaacagttacttcataaattttaaaactattttaaaatagtttaaaattttaaaactgtttttgtgtgaaatttgctgtctgttagaagtcatcaccaccattttccttcaggttattcctagttcaacaaatgtctttaatctcttaactgcctcatcatatataatgatctaatgcaacacatggtcattgagcccttatcacatttcatttaatgatgttcaaaatttcaatgttacatttcatttaatgatgttcaaaatttgaatgtctcatgcctaagaattttcactttctatagcctccaactctaattatgactaattacatttagttctttattgaccttcaattatacttctaaaaaccagcagaaatgataatttccagaggtatagtaaaccatggggagatacagatattgcaatgagagaagggaagaagaaggggaagaagaagaggaaaaagaagaaggaggaggaagaggaggaaggaggaggagcaggaagatggggaggaggaggaaggagaagaagaaggaggaggaggaggaagaaggaggagaaggagaaagaagagaaggaaaaggagaaaaagaagaagaagagagaaagagaaggagaagaagaggaggaggaagagaagatgagaaggagtggtaacactccttttagtagagttttaccatgttgaccaggatggtcttaatcccttgacctcgtgatctgcccacctcggcctccaaagtgctgagattacaggtgtgagcctctctgcccaaaatagtggctacattttaagtgacacatgcaatgttatatatatttctaagcacttctcacaaataaattgttttaaactcacaaccttgttaattaagtcttattgtgtccggaattggttccttctggtgggttgttggtctcactgacttcaagaatgaagctgcagaccctcgtgttgagtattacagctcataaatttagtgtggacccaaagagtgagcagcagcaagatttattgtgaagagtgaaaaaacaaagcttccacagtgtggaaggggaccagagtgggttgttgctgctggctctagtggccagcttttattcccttatttggccccgcccatatcctgctgattggtccattttacagagcactgattgatccattttacagagtgctgattggtccgtttgtactgagtgctgattggtgcggttacaaacctttagctagacacaaagtgctgattggtgcatttttacagagtgctgatcggtgtgtttacaaacctttagctagacacagagtgctgattggtgcatttacaatactttagctagacagaaaagttctccaagtccccacctgacccagaagcccaagccggcttcacctctcaatcctccctctaaacaggacaccccaactgctgttgggaatttggctgatgactgctctagctacttcctgctggataggggcaaagaagggtccctgcagttgtagtgtcctccagaggggaactcttcaggccagggaaagggccagaggattggtccagggttccttggtagtagttgttagttgagctcatttggggttccatttataagaccacctgtagcttgatgccctcaattctggaggaaacaaatttgacaagcagtttaaaaatacagggcccaaaggtgagtaacagcaaaatagctgccacggtacttagaaaggggagaagccatgttgcccaactccagaggttggtataagagtttgaaaggtgttgcctgatttcagaagccttttcctgtaaacaccgggtggcatctcttagtatccctgactggttagtgtaaaagcagcagtcttcccctaagaaggtgcaaagtcctcctttctcagcagtgaggaggtctaggcctctgtggttttggagagtcactgctgctaaagagtctatttgggattgtagttactatccttactgaatagattttgttatttcttgcaaacagtctgagaaatcttttgagagtgtgtggtagtaggataatgaagtagataaactggctattctggttcctgtagcagtggccatttctaaccctataagtagaggtattagttgtatggccctgcgctgatggacttgagctttgaggggcactggtaggttctgatttccataagattagaagttaggataatatatgtttacactgttaacttttagcaaactctacttttgttgaaaaccttgtaagtttgggatttcaattattctttgctattaataagacctcattcagtccatattaactgagaattggtatagatggctccttcctgattctgtaagtactttaaggtttggctgagtgcaaacagctcacacatttgagcagaccaattattaggcaattttcctaactctgctttaggagagtttccttatcatttactgaatacctattacgtcttttttccttaatcgcctcagaggaaccatctagtcctgtcctgaagggagttcctcctagatttgtcagacctttgtatggtaattaattaagatttagatcccctgttaggaaacctgctgggttaaggattatttataggaaagctatgggttgtcagtgacctcagtgttttcaggctatggccttgtttacactgacaacaaggtggtattggagtgttatagggttacagagaagaccttcaattatcaattataggttttaaatttatcctggcttttaaaggaatagggtacactgttttttctttactgcttatatctctctttctctttgacttcatctttgtctatctctttctctctttccttctttgactttctgtcagtctcttcctctgtctctctttgactttgtctctctatctcttcctctctgtctccttctctttgacttcctatctttctctgtttcttcctctctctctctgacttcctgtctctttctctctttcctttctgctgcctctgccagctgcttgtactgctgttctcccttctcctttccctttttgatggctttggcagtgtaagactgccacctccttgggtttttgcactgagtgcaataactccatgatttccctgtggtatttaatgggggttcccccagaggttaggaactccctttctttccatattgcagcatgggcatgaaggattagataagcatactttctatctgtatacacatttattcttttcccctttcccaattctaagtcttgggtaaatgccactagttctgctaactgggtgctggtcccttggggaagaggcttactttcaagtatggttacatcactaactatggcataacctgctcttcatatcccattctccacaaatgaacttccatcgttatataggttaaggtcaggattagctaaggggacttccaagagatcatctcgggcagcataagtctggactataatttgttggcagtcatgctcaattggttccccatcctctgggagaaaagtggcagggttgagggccattgacatatgtatttgaagcaccggtccctcaaggaatagcacctggtatctaagtaggcagttgtctgatatccataaacttcctttggcacctagtatgccatttacatcacgagtagtccagacagtgagatcctttccttgtattattttggtagcctctgacactaagatggccaccaccgcaactacctgcaaacagtgaggccagccttttgctactacatcaatttccttacttaggtatgtcactggttgtggggttgtcccacgagtatgagtaaggactccaagagctatccctgctctctctctgatgtataaaaagaagttttgtcctgtgggaaggcttaaacctggagcttatagtagggccttctttaagattttgaaggctatttctgaccctggttcccattctactagataagtatttgccctctgggtctccttgattagagtatacaggagcctggctaccttgctgtatacagggatccatagtcagcaaaagccagtgattccaagaaacccctgcaaatgttttaatgtcttagggtgagaataagccagtataggctgtattcattccttacggagggccctggttcctctggctaaaattaggcctagatatttgacctgctgtaggcaaagctgggccttcaacctagacaccttgtacacttgattagctagaaagttcaagagatctagagtagcctgctggcatgaggcttccaaactggtagccaaaagtaaatcatccacatactgaaggaccagagtgcctggacttgagaagagacctagatcttgggccagtgcctgaccaaacatgagggctatccctaaacccttggggcaagatggtccacgtaagttgggatgtgtggtctgtgggatcctcaaaggcaaagagaaactggggagtcagagtgcaggcgaatacagaagaaggcatccttgaggtccagaactgtgaaccattctgcttcctctggtatttgagagagcagggtataggggtgggtataactggatatagaggaattactgcctcactgatgagtctaacatcttgcactagtctccactgaccattcagtttttgtactcctagaattggggtgttgcagggactgttgcatttccttactaaaccttgagcttttaaacgtttaacaatatcctgtaatcctttataagcttcaggccttaagggatattgcctatgataaggaaaagtggtgggatcttttagcctgattttgactgggcaggcattttttgcccttccaaattgtctttccaacgcccagacttcagggttgactccttcctcaagtaggggacaacaaatgggtaacttgttccccatattcatgtagataataactccagctttggctaatatatctgtccctaataaaggtgtgggactttcaggcataacaagaaaggcatgtgaaaagagcaaagtctcccaattaaaactgaggaggtgggagaaatacctgtttacaggctgtcccaggattcctcggatggtaacggaccttgaagacagttgtccaggacaggagattagtactgagaaggccataccagtgtccaggaggaagtgaatttcctggccctcaatggttaaacatacccggggctcagtgagggtgatgacatgagctggcgcttgacctgggcaccctgagtccagttgttggatcatctggttgggggctgctgacccagagaaactttgtcttctggggcagtgcaccttccagtgattgcctcagcatagcggacatggacgagggggtggcttgtttctcactggacaatcttttttaaagtgtccttgtaaacaatactgctaacaagccctaccagatgattggcctgctccattttctgtcctctgaaccaccaaggtttgtttgcctgaaggctatgacaaaggctgcagcctttctctgatctcgcttttccttttgggtgtgttcctcttggtccatattatagaacactgtggttgccaggtttaataatgcctccagattttgttcagggcccagggcttgcttttggagctttctgctgatatccgcagctgattgagtaataaacttatcttttagaatcaattgaccctcgagtgattagggtgataggggagtatattgtcttaggcctcccatagccagtcgaggaaagtggaaggattttcttcctttccctgaattatggtggacatcattgaataactcatgggctttttcctaattctccttagtccttctagaacacaggtcaacagaagtttacaactccagtccccaagatctgagttgaggtcccagtggggatccatactggggatggtatgctaaccagtagggactttgtccctttcttcagctgtcattctgtcatttacttgactaagataccaggtatctccaaactctcaggctgcagccaaagcctcattcttttcattaaaagccggggtttgatctcacaagagcatgacatctctccaagtgagatcgaaggtttgctctagactctgtaggacatctatgtacctatcaggatcatctgaaaacttcccccaggtctgccttgatctgctttaagtcagagagggagaagggacatgtacccaggttggaccaaattccccaccccctacagcttgaagggggaactgatagccgggtggattttgtggtcctttggagatttctctccttgttcccttctgggctggggagattagaggaggcttatcattaataggagggggagctatagggaggctaggatatgggggtgagctgaaaggtcctcctgtgagatgtaaattgcaagctttgcatagttgtggattcaccttcaattaaaagaaagcttggacataaggtatctcactccatttgccttccctcttacagaaaaggtcaagctgcaggatagttttgtaatttatatttccctcaggtcaccttttttccccatcagagagagaatattggggccaggccatggtgcagaaaaaaatgagccatctctttttcagggtttgcaggtcaaattggtcccaatgacttaggatgcatttccagggtgaacctgttgatgcctgtttcccatctgaaagacaaaaccacccatggttttggtttgtttgtttcccgctgcccaagaacccgcaatggtccctggaccctgctgattggaatagttgtgctcaccgacgcagcagcagaaacactagttttcctcctagaacacaaagaggactgaggaaggtcggatttagtggcccttaccaacgcattctcgaaaacctgtaccctgtcctcttagaccacaaagaagaccaggaaaaatcggatttagtggcccttaccgacacattctcgagaacttgttagagtcctaagcattctcctgttagtatcgggatcttacccctgtcctataaagatgttatgccccaaaaatgaagtggagggccaaaccctgagtgaggggagggatctccagagttggaagattgatgccttatgtccttacttatatgaataggaaggatacaatttctgaggctccccatatcccctgcttgtctgagaagggatcctaaaattccagatagtcccccctatgattgtgctttgggcaaaaattatgtctttctgattggtgagcccgggtgcctaaagaaggtaacagagtcctgaagtttatactagaaatcattcttacaggagaaaagccccagagagtggtttttagaagcaggactagtcttggagaagagaggtgagaggaagtttgtctgacaggcattaggacccaggagccaagggtcaggatagataggatagatgggcaagtctcgcttgggcgacatgactttgatagttctgctcatggccacaggatcaaccaactttctgtcaggaccctggagctgaatggctttcctctctgtcagcccttggctcagcctagaagtacagaaaaagtggaagctggttccaggcaaaccaatgctcacaactccaaagatttgggggttgttagccctttcccagaaagcctgacacccgtgtctttagtccagcggccacactagtcgcttttaactggccaacatgtgcccggtatttagcccccaaattctaaggaaacataggacagaatagcaagcgaaaggagtccaatggcactcaccacttggcgatagtcgatagtcccatctgggtcaccaaaatatgtctgggattggttccttctggtggattcttggtctcgctaacttcaagaatgaagccatagacccatgtggtgacggttacagctcataaaggtagtgcagacccaaagagtgagcagcagcaagatttactgtgaagagtgaaagaacaaagcttccacagcgtggaaagggacccaagcgggttgctgctgctggcttgcttggccagcttttattcccttatttggcccagccacatcctgctgattggtccattttacagagtgctgattggtctattttacagagtgctgattggtctgtttttacagagtgcttatttttgcatttacaaacctttagctagacatagagcaatgattggtgcatttttacagagtgctgattggtgcatttacaaacctttagctagacacagagcactgattggtgcatttacaatcccttagctagacagaaaagttctccaagtccccacccgacccagaagcccagccgggttcacctctcactattattgttattgtacaaattatagaaacaactcaaacaacaaagaacctgaaatcctataaaagttgtaaaactattaaatttgccagatttggtggctcacacctgtaatcctagcactttggtaggctgaggtgggcaaatcacttgaggtcaggagttcaagaccagcctggctaacatggtgaaaccccatctctactaaaaatacaaaaataagctgggcatggtggcatgtgcctgtaatcccagctactcaggaggctgaggtaggagaatcacttgaacctgggaggtaaaggttgcagtgggccgagctcacaccactgtactccagcctgggtaacaaagcaagactccatctcaagaaaacaaaacaaaacaaaacaaaacaaaacaacactattaaatggtgaatccagggtgtgaatctgtaatctggtttcagagttggtgtttactgttatcataaactaatcctcaaatatacccagattgtttaattaggaggaagggcaatgtttactattatatacatatgtatctactgcaaggtgtggacttaatcatgaatatataaaatattatggttattaaaattttgctgtgaaatatttaaaaagtactgtaagttagtactaacattggtcagaaattactataatttatgttgtaactaatatgccctaataattgcttgtgaacagaaacagttccttttgaatatccattgatgctgtataattaacaaaggtcttcaaatctataataatttaataaacgttcatttaaatagaaatgacacaggatcctttcggtgccactttgcaagatggaaatctgtgtgaccagtcgtgtccttacctgggcttggctcagttctgggttgactactgggcttgctctgcccactcggcctattgggctgcactcagctcatgctactggcctggattctgcatgtccacagggactctgtgttcagcccgtggctgagccagatgtgctggaggaggttttcatgttggtcaatggtgggtagatgagggaaaagtggtggaaccccaaatctgagagatggcagcaaccatggaggccaaaggtgtgttactgcttttgcttgggcagtcccaaggcctgagcccaacacccacagtgcagcgaatgggatggcagggggaattgagggggcgtgttccagcttgtttgtgttacagcttgtttgttcccatcacctgcagtgcagcgaataagggcctatcacggctcatttggttcctccatttgcagcttggtgaactggggcatgtgacaccccagcagctttttattccctgttgctcagcaagtgggagggagggttacaatgttacaggtcttttcccagctgcttttcctcaggctccaggttcctgtcctgggacaaagaagaatgaggttatgtggacacgagagtaagtaaggcagtgtagaagaagtttattgagtgagagaaaagctcgccaccatgagaggggaagccctcttatgagaggggtcccagaagcaggaggcccaatgtgtgactgagtccagggtatatatggattcagaaaggggaagtgtgtgctgattggcccatgggcgggcctgggaaaaataccattcaattggctaaaaggcatcaaggaagttctcactctggtagtaggctcttcctggaactggctgctcaacttttcaggctttaaattgtctttggcttgaaggtgggatttcacaggggaccactcctttgtcttcttaggaatttatctgcctcttagcactgtcataaacactaatatacaaaaaggtaaaaacttttcagtctttgccttaatgtgaaagtccagaataatttgtccaaataccattttaggactgtgtacattccaacaattttgaggagggaggaacagaggacattgctatgttaaagtatccatatagctcatcataattcatttgtttatgattacatataaaccagaaagaaagtgagatacgtactttaaatgatcttttacttaaacttcagcaaaaatgttgtcatttttgaaattctctaaaattaaattatagtttgtatgactttggctatgagttatgtccataaataattatttgcattgcatatatatattgtggtaatatgctctgaaatatctaatcaatgtgtaataaattaaaatatgtatttattggaatattagtgttagtacttcataatttcatagtaacttttatctagtaactaaagaaaacatacaagtatcaactaatctttatagcgtttcattttcttttaaatatgtataagaagggatcaccatgtcattataactcactagagatttgagacgaatattattttttaaaaactttctatttttcgttttacctcattttgagattatctgaaatgtctatgactaaccaaaggcattgtgattttaacacattctttacatttaagagtcaagtatttaagaattcatgaaaagaaaatgaatgttttatcttcatgcaataaaaataacatgatcttagtgtctcagtctctgataaattggcctattaactcagcagttagtactactccttgtttcttcatcctcacccatgacctttcctttccccttcatctttactttcactttgagccaattaaggatattttagtctaccttggcttaaaaatattttttaaatttcttcctcaaatattattggaacaatattaaaaatacagtaaattatgatttttaaagtacattagtttgttaacatttctctttgtcaatccccatgtggtaccattccagaatttcctagcttacactgttttttaaaactatcaggcagtctagcatagttaagaccaataatttctattcaagtaaccttaaattcaagcatatgctgctatttcctagttataaaatcattggcaattattttaacatatttaagaatctatgctctctaaaataagtgtattaataacattgctgccctggcactgtggctcatgactgtaatcccagcactttgggaggctgaggcaggcggatcacttgaggtcaggagtttgagaccagcctggccaatatggtgaaaccctgtctctactaaaaactacgaaattggccaaggggattcacctgtcatcctagctactcaggatgctgaagcaagagagtcacttgaaccagggaggcagaggttacagtgagccaagatcacaccaatgcactccaacctggatgacagagcaagagtccatctcagtaataataacaataaggccgggagtggtggctcacacgtgtaatcacagcactttgggaggctgagggaggcttgaactacttgagatcagtagttcaagacctgctttgccaacatggtgaaaccccatctctacaaaatacaaaaattagccaggcatggtggggcacacatgtagtcccagctactccagtggctgaggtgggagaatcacttgaactcgggaaggggaggttgcagtgagccaagatcgcaccattgcactccagcctgggtgacagagtgagataccatccaaataataataataataacataataataacaacactgcgaagtggtaggaaggattgaatgaaataatacatatccagcaaagtcacaagtactcccaattaataggagcttcttataagtagatagataagtgaatatcaattgagcgtatctttccattagaggctaaaattagagtcactgatgtttctgggaatccaatattgatgtcatcaaatgggcacatcatagttaatgggttaattctgaacagcaaccctcgagggcatggggcatatatattttattttagtttccttaatttttagcacaatatattgtgactatcagtgaatgctcaatgaacaaaccaattactaagttaatgaatgaatgatctgagaaaaggaatggcttcacagtagacaaattataatatgtacatgagcatctgtatctctccttatatccataaacttattctatcatgttgagtaaacatattcattatagtgacagcatggctttgaacttttgcattagacacaagaacatttttatgctcttctcatatttcatcactagtcatgtatatgctgtgaatttcagtgcccataatagggacaactttgctttaatccatcctcctactcttgttagttatctgctctaagactagactacagtgaatagaaaagcgaacataaggttcaggccatttagttttctatagggtatgtaaaatattctaatttttatattaaaacaagacataaaattcatgaaattctgagtgcctttttatggatggtggtacaatgactatatttaagtaattgaagacacactaaacagttttcaattttgtttaaatttttttattgatgcataatattttacatatttatgaggcacatgtgatattttgttgcaaacatagattgtgtaatgatcaagtcagggtattcggggcatctatcaccttgtagatttattatttatatctgttgggaatatttcaagttctcttttctagagagagaatatatatgtttttattttaaaatttaatatatatattttaataaccttaccaaaattatctagaccttgattaaaatacaaaatggagatggttaataacaggaaagttttctgaaggcttgtgtatagacacaaaaggcagcattccctacccttttctaacaaaatggttcatttttaggaaaacacatacacttatttttgttggttagcaatgtgtttcctattattattagaattaagtcattctaattagctgccttgaagggtaatctgctttgctgagcatttaataaacactgagtgacactttcccaggtctctcacttacgcaaaatataataacctcttagtctctacatctttatgagtctctgacgtgaataaccaggtagtataaataatcaagatgcttttattattaactgctgcctgtaaaactaactttcatctccctgacttaaatctttttctcccaaactccccacactgtttcccaagcatggctaaacttgccaaacccattagacattgtaaatattggacttccgtctacatctattctttagaactagaaaggtgttcctatctccctgatgcatttttacttccttctttgcccttctgctggtgctgctgaagttctcaaaacccattaaagtcctaaatgtgatgacaccactactgaggcagtcagaagcatgcccttagtcttattaagcttttatttccactgcattatgaaaaaaatgctcaacattattaatgatcagagaactgcaaatatgaacttcagggagatatcatcttatcccagtcagaatgactagtatgaaaaagacaaaaaataactaatagatgctggtgaggatgcagagaaaaggtaattcatatattgttggtgggaatgtgaactcgtacatccactatgaagacactaaggagatttctcaaaaaactaaaactagaactacccttcaatataggcatcgcactactgggtatcaacccaaaggaaaagaaagagatatatcaaatggatacctgtactcagatatttatgcagcactcttcacaatagcaaatatatggaatcaacctaagtgtccatcaatggatgagtggatcaagaaaatgtactaggtatacccaaatggaatactccacaggtataaacaaaaatgaaataacgtcattttcagcaacatggatgaaaccggttgtcattatcttaagtgaaataagccggggaccaaaagtcaaatattgcatgttctcccttatatgtgggagctaaaactttgatgacagggaagtagagcgtggacagataaacagaatgtgaagggtgagttgggggaggggaggaggatgaagaggagtgggttaatgggtacaaacatacacttaacgtagaaaaaatgaatgtttaacagcagagtagagtgactgtagttatacaaaaatgtagtgtacttgggtgagggacaacctagataccctgaccaaatcactatatattatttaaatttcacatgtacctttataaatttttacatatgaaaattaattaattagtttaaaaagcaggcctacactagcttacccatatgcttactagtttattggtacaaaatagataaaatgtttgatctcttgaaatgcgtgaagatatatttaatataactatggcttatttccttgtttcttttttcacttttagctatttgttaatgtctctgagataaactattattttaatatggatacagtattaatcctttgtcatattttcatgcttatagacataaggtcacccaatgatataatttttaatttcaacatttaaaaaattacattaactgtatttatttatttattattctttttttattatactttaagttttagggtacatgtgcacatggtgcaggtttgttacatatgtatacatgtgacatgttggtgtgctgcacccattagctcatcatttaacattaggtatatctcctaatgctatccctcccctgtccccccaccccatgacaggccccagtgtgtgatgttccccttcctgtgtccatgtgttctcattgttcaattcccacctatgagtgagaacatgtggtgtttggttttttgtccctgcgatagtttgctgagaatgatgatttccagcttcatccatgtccctacaaaggacatgaactcatccttttttatggctgcatagaattccatggtgtatatgtgccacattttcttaatccagtctatcattgttggacatttgggttggttccaagtctttgctattgtgaatagtgccacaataaacatacgtgtgcgtgtgtctttatagcagcatgttttataatcctttgggtatatacccagtaatgggatggctgagtcaaatgctatttctagttctagatccctgaggaatcaccacactgtcttccacaatggctgaactagttcacagtcccaccaacagtgtaaaagtcttcctatttctccacatcctctccagcacctgttgtttcctgactttttaatgatcacccttctaaatggtgtgagatggtatctcattgtggttttgatttgcatttctctgatggccagtgatgatgagcattttttcatgtgtctgttggctgcataaatgacttcttttgagtagtgtctgttcatatccttcgcccacttgttgatggggttgtttgtctttttcttgtaaatttgttagagttcattgtagattctggatattagccttttgtcagatgagtaggttgcaaaaattttctcccattctgtaggttacctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctagattttcttctagggtttttatggttttaagtctaacatttaagtctttactccatcttgaattaatttttgtataaggtgtaaggaagggatccagtttcagctttctacatatggctagccagtttccccagcaccctttattaaatagggaatcctttccccatttcttgtttttgtcaggtttgtcaaagatcagatagttgtagatatgcattgtatttattataaaatatttttgtcatgtataattttagaaaatgttattaatattatattgagtagttgcgatttatttagtcatgctatatccgtataaattctcacaaaacactaaaagaaagaaacattattatcctgttttaaaaataaacttttagtttggaatacctctacacttacaaaatgttacgatagtacagagaattcctgtgtaacattcactcagcttcccctaatgttaacatcttatataatcatgctacatatatcaaaacaaagaagttagcatttgtacaatactattaccaaactacagaccctatttgggtttcatcagtttttcttactaatatccttttcctattttaggatctaacccaggattccacattgtgttaagtcatcctgtgtccttagtctcctcaggtctttgacagtttttcagtttttccttgtttttcatggcctgatacatttgaggggtagtagtgagatattttatagagcattcccaatacagatctgtcaaatgggttttcatgcttggactggagttacagatttttgtaaataacacgacagaggtgtggtacatttgccaacatcccaccaggaatacatggtatctacatgtattcctaaatggagctgttaaaccttatctcttggttaaaatagtgtctactgaaaatttattcacaaagttactatgattcttgtccaattgtttttcatttactatgtatttacttcaatagctttaggggtatcagtgggttttggttacatgaacgaattgtatagtagtgaagtgtgaatttctttttttttttttgtattttttacttatttattttttttttgagatggagtctctctctgtcacccaggctggagtgcagtggtgcaatctcggctcactgcaagctccacctcccgggttcacgccattctcctgcctcagcctcctgagtagctgggactacaggcgctcgccaccacgcctagctaattttttgcatttttagtagagacggggtttcatggtgttagccaggatggtctcgatctcctgacctcatgatccgcccacttcggcctccaaaagtgctgggattacaagcgtgagccaccatgcctggccatcaagtgtgaaattttaatgcacctgccatccaagtagtatatattttacccaacatataattatttatccctcacccttcttccaaccttcccccttctgagtctgtaatgcccattgtaccactctctatgcctttgtgtactcatagattaactctcagctacaattgagaacctaagttattttattttccattcctgggttacttcacttagagtaatgacctccagtttcacccaagttgctgcaaaatatattattccattctttttaaggctgcatagtattccatggtatatatacatatatatgtatatatatacacacatacatatcatggtgtgggtgtacctatatatggtgcagtatgtgtatatatatacaaacacacgtgttacatatgtgtgtgtttgtgtctgtgtgtaccacattttctttatccacttatcagttgatgttcacttagtttggtttcatagctttggaattgtaaattgtgctgctataaacgtacatatgcatgtgtctttttcatatgatgacttttttttcctgtgggtagatacacggtagtgagattactggatcgaatggtagatctacttttagttttttgagaaatcgtcacacgtttttcatagaggttatattaattttcattctcaccagcaatgtataagcatccccttttcatcacttccttgccgacatcattttttttttactttttagtaatgggcattatggctgtggtaaggtggtatctcattgtggttttaatttgcatttccctaatgattagtgatgctgaggatttttgcatatgtttgttggccatttgtatatcttattttgtgaagtatctattcatgccacttgcccacttttcaatgggattatttgttttttcttgctgatttgtttaagttccttgtagattctggatattagtcctatgacagaggcatagtttgcaaatatttctcccactctgagttttatgtttactctgatgatgatttatttttctatgaacaagcttttttagtttacctatatcccacttatttatttttgtttttgttgctttccctttggggacttagtcataaattctttactacaatgtccagaagagtttttcctagattttcttttagtgtttttatggttttaagtttaagtctttaatttatcttgagttgaactttgtatttggtgagagatagggagccagtttcattcttctacatgtggctatccagttttctttgcaccatttattgaatggggtgttgtttccccagtttgttttcatatgctttgtcgaagattagtttgttttacatatttgtctctatttctgggttttctattctgtttctttcgtttatgtatcttttataccagcaccaggctgttctggtgactatagccttattgcataatttcaagtcaggtaacacaatacctccaagtttgcttattgttgttgttgttgttgttatgtgttttgcttagtattgctttggctattctggctctatttttgttccatgtgaattttaggattgtttttcctaatcgtgtgaaaaatgatgtggtagattgataggaattgcactgcatctgtaaattgttttgtaaagcatggttatcttcatgataatgattcttcaaatccatgaggattgaatgtgtttccatttgcttgtgtcatctataatttctttcagagttgttttgtagttctccttgtagagattttgtaccttcttgattaagtatatccctaggtaggattttttgtttctgttttttttttgtttttttttttgcagctgttttaaaaaggattgagttcttgacttcttgatttgatattcagcttggtggttgttggtatatggcattgctactgatttgtgtacattgatacttgagacttctctgaattcattgatcaaatctaggagtcttttggaggcatctttaggatattctaggtatgcaaccatggcattgacaaacagagagtttgacttcctcttttccaatttggatgccctctatttctttctcttggctgattgttctggctgggacttcctcctttccaaactttattctttggaacagaatcactaagttcagcctacactcaagggaaaggaatttaaactccactttctgaaagatggagtgtcagcatgcattatttagaattctctcataaggaatatttatctcttctcctccatttatttattcaatcatttattctcctccattcatttattcaatgcatattagcatggacttatagttacttttagtctttgagctataatataatactatcattattaattcctttttcctttttttttttttttttttttttaaagacactctcactctgttgcccaggctggagtgcaggaccatgatctcagctcactgtaatctctagctcctgggttcaagtgattctcatgcctcagcctctcaagtagctggaattacaggtgcatgccaccatgcctggctaagttttgtatttttagtagaggtggggttttgccatgttggccaggcttgccttgaactcctggcctcaagtgatccacctgcctcagtcgcccatagtgctgggattacagaagtaagccaataagtccagccttatcttccctttaaatgactttattttttagaacagttttagactcacagcaaaattgagcagaaagtaaagagagttcccaaaattttgctaccctcctctcaacatgcagcctcccacattatcaacattttacgccagagtggcacatttgttgcactcaatgaactaccttgacacatcactatggtcattgaagtctatattttacattagcgtttgctcttggtgttgtatattccatgacttttgacaattttgacatgtgtcccaccttatagtatcatatagaatttatcttcgttatacatgacagtaaacagaatctatcatatagaattctatcacatgaatctatcatatagaatgtcatacatcatctaacatagatttatcttcattttacatgagagtaaacagaatcatagaaataataagttgctcacaaaaggtgacacagtttaactttttgtgaatgatataatgcatttcattaaaattaattgtaaatttgatttgaactatatcatataccattgtcttatagatacataccataaacaatttatctccttatttatgaatttttaattattattatttttatttaaatgagcatggtttggttgatttaaacatctgccttatactccaccaaaacaataaagtctgcaaagaaaatatgtttcttcatttttatgtcctcctttcttcctcattgatccgttcaactcaatagcatttaatatagaacttttactagcagaatagatgatggattattgtttgctgaatgaatgattatctaatatgttattgagcttaagattttatcatgcacactatttaaactgccgttatgggagcctgacttctgaggtttcttgaggctactgtcagaggcaggaatgtgagtaggatcgcatattgtttggatctagtgtcacatactttatcttcttaaaaatgactctagattttcacatattggcatattgttttgatgtagtgtcatatactttatcttcttaaaaatgactccagattttcacatcctggattgtgttttggtataatatttaaagcctcataataatttgagagaatttataggttccactttaacaaccatctgtgtactgcagcaaacacatgatcaaggttctagaatcttgaaaatttaacatattttctaaagtttatcattttaacatataaaaatgagaataacttcacagtaacctccactgtaaccttctgatggtcacagaaaggagcaatagcaaaaaaaggatgattttactttggggaaaattatggtctagtaccacatatactattttgtctagtgctactaatatcatttgctagacctctttttttaataagaaatgtctaagaaagaccatcttccatttgtgatttactaataaattgtgataattaatctccccatttaccctattgtcttccagaaaagccagctacaacctagcctattttgtgaagctgcacttgtagcttatttcagcatggactgcatctgaatgaagattttagggcaaagctccattctttttaatttgaggaatcactcattcttgcagcactatgcatcctcttatgtttcactagtcacatctttctgttgtcatttttgcagagttatattcttggtggtgttgtatatagcaataaattgattctgttcagttttgattctacatttaatcacctgaaaacactattttctttcctgctactctagcacaaaattatctcttaagagtaatttgaattctcagatttttttgatgccttttacatttctttaacaaattaggaccctctaataaataattttacttggggtctaatttaataacttaaaattattcaattgattgtattctgctatgatagataaacgttgtaataggcacatgataatgtatatccaagagaataatttggaatgttattaaattagaaatgctacaaacattttataattatgaaggggcattctgagtacagcagaacagaaagatgaaaagttcctggattctggtgacattactgaattgcaaaattaaacaactctagaactcttctacattaagattttatatgtaagatgataaaccccttctgttcaagctcttcttagttggggcttatataacttgcagctaaatagtttctaactgttaaagaggttttattatagtagggaaaatataactaaaccaataaaaataaatgataaccatgacaaaatctatgaaagcacaaaaggtgaagaaaatcttgatgggcaagcattctctcagagacttattaatccaggttatattcaaatggtgttttcaaggataattgggaatttgtcagaaaaaaaaaaaggatgttttgggaagtagaagaaatagccatgcacaaaaaaacaagatcaggaagaaactgttaaaagtagtgcaggacacaaaattattgtccatgcatgtgcacacaggttgtgtgtgtgtgtgtgtgtgtgtacacatgcaggtgagaaagaatgagagggaggagaagagatagaaaaatgcacacagggaaacatagacaaagacatagggacagtaggtgcttgagatcatgattagtgtgtgtttgaggtattaatggtgagaagaatagttgagctactgggcagggatagaaagagagattaaagagaaagtttgaaagagcttctgttccaagacccaggaattttcatgttaactgaatgtggaagggagccaggataggaagagtatcatgatcagctttagttgtttcttttattatgttgttctcagcatttgaagaatgcaatataggggaatatagagagtctgtgaagggcagtgacaaagaagaatggtggaattggagcccatggagatcagatatgaagctactaccctctaatgtgaatgactctggggtaggactaaaattcaaagtgaggagagatgattaagcaggcattaatgagacactcatgtcttccactccaactgtatttttcaccactcttcatccttctccaggcatatcaccttcttttggttcattaaggttagaaatgtttttccctcctcagtccagtacttgttgcactctttcatcctggaacactctccctggactctttatctggagaaccaatgctcatctattaggtctcatttttaatgcctttgcttgggggaaacttgaccccagaagggtcagctaactgtattaatatgctgtgtcctcaaagtattgtaaaattttctttcattataattattcaaattgtatctaaataaagctttatgaaagtacctcttttacatgtagttcatccaccagactgggtattccatgaacacatggaccatgtctgttttgtcacatgccacgttctggccatatcatgcttacccaataagtagtttgtgaaaaaataaacaagtaaatgaaacatttattactagcctgaaatggaagggtatgtataaggcattagggttgtggaaatacttaaatagggaatgcaatttatatcaattgtccttcatcatttgggattttgcagactaataattttataaaagccatgggctctcttcaccaaaaaaatctgtaatttagtatcagtaaacatcagtttaagaaatctcattttaaaaactattattattagaaaattatacaatcaagtttagattgtgggaagataaaagttatctaggaaatctgtgttcctaaatcaatagtactggacagaggcttacagattctctatatttctattaaaataagatgagaggcccattcaatatgataatggctatgggtttgtcataaatagctctcattattttgagatacgtcccatcaatacctagtttattgagagtttctggcatgaaaggctgttgaattttgttgaaggccttttctgtgtctattgagataatcatgtgatttttgtctttggttctgtttatatgatggattatgtttattgatttgcatatgttgaaccagccttgcatcccagggatgaagcccacttgattatggtggataaactttttgatatgctgctggattcggtttgccagcattttattgagggtttttgcttgatgttcatcagggaaattggtctgaaattctcttttttttgttgtgtctctgccaggctttggtgtcagaatgatgctggcctcataaaatgagttaagaggattccctctttttctattgattggaatagtttcagaaggaatggtaccagctcctctttgtacctctggtagaattcggctgtgaatccatctaatcccggactttttttttggcaataattaatagcctcaatttcacagtctgttattggtctattcggggattcaacttcttcctggtttagtcttgggagggtgtatgtgtccaggaatttaaccatttcttctagattttctagtttatttgcatagagatatttatagtatactctgatggtagtttgtatttctgtgggatcagtgttgatatcccctttatcattttttattgcatctatttggttcctctctcttttcttctttattaatcttgctagcggtatatcaattttcaaaaaaaccagctcctggattcattgatttttttgaagggttttttatgtctctatctccttgagttctgctctgatcttagttatttcttgccttctgctagcttttgaatgtgtttgctcttgcttctctagttattttaattgtgatgttagggtgtcaattttagatctttcctgctttctcttgtgggcatttagtgctatacattgccctctacacactgctttaaatgtgtcccagagattctgctatgttgtgtctttgttctcattggttacaaagaatatctttatttctgtcttcatttcgttatgtacccattagtcattcaggagcaggttgttcagtttccatgtagttgagtggttttgagtgagtttcttaatcctgagttctagtttgattgcactgtggtctgagagacagtttgttataatttctgttcttttacatctgctgaagggtgctttacttccaactatgtggtcagttttggagtaagtgcgatgtggtgctgagaagaatgtatattctgttgatttggggtggagagttctgtagatgtctattaggtctgcttggtgcagagctgagttcaattcctggatatccttgttaactttctgtctcgttgatctgcattccctttgaaaactggcacaagacagggatgccctctctcaccactcctattcaacgtagtgttggaagttctggccagggcaatcaggcaagagaaagcaataaagtgtattcaattaggaaatgaggaagtcaaattgtccctgtttgcagatgacatgattgtatatttagaaaaccccatcgtctcagcccaaaatcccctgaagctgataagcaacttcagcaaagtctcaggatacaaaatcaatgtgcaaaaatcacaagcattcctatacaccaataacagacaaacagagagccaaatcatgagtgaattcccatttacaattgcttcaaagaggataaaatacctaggaatccaacttacaaaggatgtgaaggacctcttcaaggagaactacaaaccactgctcaacgaaataagaggacacaaacaaatggaagaacattccatgctcatggataggaagaatcaatattgcgaaaatggccaaactgcccaaggtaatttatagattcaatgccatccccgtcaagctaccaatgactttcttcacagaattggaaaaaactactttaaagttcatatggaaccaaaaaagagcccgcatcaccaagtcaatcctaagccataagaacaaagctggaggcatcacgctacctgatttcaaactatactacaaggctacaataaccaaaacagcatggtactggtaccaaaacagagatatagaccaatggaacagaacagagccctcagaaataataccacacatctacaaccatctgatctttgacaaacctgagaaaaacaagcaatggggaaaggattccctatttaataaatgatgctgggtaaattgcctagccatatgtagaaaggtgaaattggatcccttccttataccttatacaaaaattaattcgagatggattaaagacttcaatgttagacctaaaaccataaaaaccctagaagaaaacctaggcaataccattcaggtcataggcataggcaaggacttcatgtctaaaacaccaaaagctatggcaacaaaagccaaaattgacaaatgggatctaattaaactaaagagcttctgcacagcaaaagaaactaccatcagagtgacaagcaacctacagaatgggagaaaattcttacaatctacccatctgacaaagggctaatatccagaatctacaaataatttaaacaaatttacaagaaaaaatcaaacaaccccatcaacaattgggcaaaggatatgaacagacacttctcaaaagaagacatttattcacccaacagacacatgaaaaaatgctcatcactggtcatcagagaaatgcaaatcaaaaccacaatgagataccatctcacaccagttagaatggcgatcattaaaaagtcaggaaataacaggtgctggggaggatgtggagaactaggaacacttttacactgttgatgggactgtaaactagttcaacccttgtggaagacagtgtggcaattcctcagggatctagaactagaagtagcatttgacccagccatcccattactgggcatatacccaaaggattataaatcatgctgctataaagacacatgcacacgtatgtttattgtggcactattcacaatagcaaagacttcgaaccaacccaaatgtccatcagtgatagactggattaagaaaatgtggcacatatacaccatggaattctatgcagccatagaaagaatgagttcatgtcctttgtagggacatggatgaagctggaagccgtcattctgaccaaactattgcaaggacaaaaaaccaaacactgcatgttctcactcataggtgggaattgaagaatgagaacacttggacacagggtggggaacatgacacactggagcctgtcatggggtagggggaggggggagggatagcattaggagatatacctaatgtacataatgagttaatgggtgcagcacaccaacatggcacatgtatacatatgtaacaaacctgcatgttgtgcacatgtaccctagaccttaaagtataataaaaacatgtaaaaataaaataaaataagatgaaaagcaatcatttgaagttataacagaaaattttggaatgtatatgaaaattgaatgcttaacatttggtatttacaaactatcctctagagataaattattagattgtgaatactattccttctaatatgcttcagagatgctgtgtttggaaagtagagtgtaagaaatgtaggttaaaagaacttaagcttattgccttaaaatgtgattatttttttctaattaatttttacaaatgtccagtattagcattgactaattaaggggtgattatttgtgtggcctctattatttacttgctttgttaaatttggacaaatttcttaaactctgggttgtagttccctcatttttaaaaggtagcatgattggttgctatgatacagtgtacacagtgaacttatatttttctgacacatgacaagagttctgtatataacaactgtcattgctatccaccctatctccgagaaaagaagaaaaagtaattcagaggatttgttgtactatttcacctttttattttttttatttttttaattattattttttttctttctttatttatttttttattattatactttaagttttaaaccagtaaaatcttgaccctctcctaaattagattcactgtcccagattttaattaaacatttgcctgtgttcttccatttgcaaataatcacctatgcatacagatcacaaccatccacaaacataatatcaaatgggttcctgaattattacaggatcttaaattttttaacaataccattgtatacaagcaatatatttactgatcatttctcagaaattattagcaaaagaaaataaatcattgctaaattagctcctctaatgtaacaaggatttatgttattttgaaatattattatacacatttattaataatgggataattcataatacagcttagtacagtgatatttatcttcaaatcactttgggagtgctaatattctatttctcatgattaatttagaataattctcctcttgattaataatatgtgtcatcatttacattatttatactttattatcaactttatgttagttaaaaattaagtttagaagcacccataaacttcttcattgttcttttctctgccttcatagtttttatttttagtctatataaaattttaactgaatcatctggccattgctgaagttaccagtacgaactctatcagttattatttctacagctgttgcaatgttaaaaattagcatttaggtcgggcacagtggctcatgcctgtaatcccagcactttgggaggccaaagcaggtggatcacgaagtcaggaggtcaagatcagcctggccaagatggtgaaaccccatctctactaaaaataaaaaaattagccgggcgtggtggtgggtgcctgttaatcccagcaactcgggaggctgaggcagagaattgcttgaacccgggaggcagaggttgcagtgagctgagatcacgccactgcactccagcctgggcgaaagaacgaaattccgtctcaaaaaaaaaaaaaaaggtgtttagatttagataccatcaatgttttccattggctagtggataaaatctaagttccccagttcggagttcaaatctatcaactagtatttgatataatatactttccgtctattggaacttgctacgtggagaatattcatatcccagttttaacttttgatttatttttaattaatttttaatttgggggtactagtaggtgtgtatacttataggttatacgagacattttgatacaagcatacaatgcgtaatagtcacatcagggtaaatggagtattcatcatttcaagcatttatcctttctttgtgttaataaacattccagttatagtctttcatttatttttaaatgtgcaataaattattgtcgactgtaatcaccctgttgtgctatcaaatactagctcttattcgttatatttaactatatttttatacccatttctcatccccactccccatgtccattacccttcccagcttatgggaaccatcattctgagtgtccatcaacagacaaatggatgaagaaaatgtggtgtatataataatgaaggatcattcagccataaaaaagaatgagattttttcatctgtaacagcatagaactgaagaacattatgttaagtgaaataaactgagcacagaaagaccatctttgcacgttctcatttatttctgggagctaaaaattaaaacaattgaactctatgtactatttttaattagaaagtagaatcgtgtaccattttttatttcagtagagtagaattatgtaccatttttaatttgcatgttttttttttttactttctttccattttatattgtttgatctgtctcatttgaaaatccagttcatccataagatagtcctagggtctagtttctagcctcaattcctctgtcatattcctaaaatttttcttgactataattaatcttgttcttacacacagtattttatattctttaaatcattttgcttatttggaaacaaactatactatattaggcaaaaggcaaaagctaaacaaaaggcaacaaagaacttaaaagatcattaagtgaaataagccaggcacggaaagacaagcatcacatgttctcacatatttgtgggatctaaaaatcaaacaattgaactcatggacatagagagtagaaaaatggctaccagaggctgggaagggtagtggggacctggtgggtaggaggagatggttaatggctacaaaaagaaaatagaaagaataaataagacctactatttgatagcacaagagggtgactatactcaataataacttaacatatttaaataaagggtgtaagaggattgtttgttactcgaaggataaatgcttgaggagatgggaaccttattctccatgatgtgcttagttcacattgcatgcctgaatcaaaacatctcatgtactccataaatatgtacatctactaggtacccacacaatttttaaaaataaatttagaagaaataaaaaacaatacttcaaatatgaacactctttaaaaaagaaataaagaatgtgtaatcggctgggtgcagtggctcacacctgtaatcccagtactttgggaggcaaggcaggcagattacttgagatcagtagctcaagcccagcctggccaacatggtgaaaccccatctctgctaaaattacaaaaattagccttgcatggtggtgggcacctgtaatcccagctacttgggaggctgaggcaggagaatcatttgaacccgggaggcggaggttgcaatgagccaagatttagccactgccctccagcctggattacagagagagactctgtctcaaaaaaaaaaaaaaaagtataattatttcaagaaggaaaaaagtaccttacattttattttttctctcataaaatttgctttacatatacacatttttacaggatactattgtatatgttgttttgtgatacattttattttatagaagtataaacaattgccatgtcaatagatatattttgtaactaccaagtaattattttttatttttatgtaaggtgtgtacataacataataaaacaagcacacatagatttaccaaccaacataaccacatgatttggggcattattaagattactgacattagatgggtattcatgcaaaatgcttgtcctaaattttgtgtttatcgttcccaacctttgtgtgtttgcatatttgtgtgcattttctcccatatacatttgtctttaagaaatatggctagtattgattattctgaattttatagaatcagtaatattctctaatttttggaactcacatttttcactgaatatttatttcaaggatatctttgttactggtagttgtagttcaattaattctcattaacaaattaaagtatgagataatactgtaatttatttctctattctcctattgatagaaaggataattcagcttttgctcttattagcaatgcagctaaaaccattctgtttcatatctctacaaacatagcctagaatatagaactagaagtgagttgtaagatcaaaggccaagtgtctatcaacattaaagaatattgacaattctttttccaaaaatagttatttaaaatttatttatataaatattgtggatgaccactcttattccattccatgtactcaccaatacttgttactttaagccttaaattttgctgatctgctatagcattgtagctcactgggtcttaagttgcattttcttaattacataagagataaaaccatcatttcctaatttaatacataatttgttttcctcattttgagatatgactatgtatttaccattttcttatttaaattttttcatttacctattgctttataagtattatttacaaattctaaatactaatcttttgatttgcaaaaagctactcacaatttgtatgtgtagcgtgtgtttgtgtatatgtgtgttactatatatattatatatatatataatatatattgtattatatatatataatatatattatatatattatatatataatacaatatatattatatatatataatacaatatatattatatatatatatatatatatttttttttttttttgagacagagtctcactctgttacccaggctggagtgcagtggtgtgatctcatctcatgcaacctccacctcccgaattcaagcgattctttggcctcagcctcctgagtagctgggactacaggcacgtgccaccacacctggctaatttttgtgtttttagtagaaatggggtgtcaccatattggccaggctgctctcgaactcctgaccttgtgatccacctgcctcggcatcccaaagtgctggtattacaggcgtgagccaccatgcccagactactgtatttttgataccgtttgataaataggtttccactatttcttcagtaaatattgcaaaattatatttttcttgaaatttctcaattgcttatgtgttttccaatggatttaaagtttatgtggtgttgcctttatgtcttttaaacttcagctgcaaacattttatgccaaatttctcattccaaatagcttatttgtgcctatcaatattgcttgaaagatgtgtattatattgttttcaaattgttaatttttctgtttatacttttcattctaattttgttttctattcccacaatttgtgtccctctctttactatcagcattttctaatttatttgagttgttttcccagcttttaaatttttttttgccttttgtttttctttgatatgggcatttagaaattatacatcttcctacaaagggttaccttagctacattcctaacatttaacatataccattgttattagaaataaagtttacaaattttttaaatcccttattatttcttcttggatgtataagttatttataagtacattttaaaatttacaaatatatggtggattttgttagattacgtgacaaagaacaactaaaattaccaatcagctgattttaaagtagaaataataccctagattttctgaatggaccctaagtaatgacaagggacctaaaaattggacagggagggcaaaaggagggcatcgtgactatggacagcatagagggttacaatgatgctgggtctgcaaatagaggaaagaagccataagccaaaggatgtgactaggctctaacagctggaagggccagggagtgtattcctccctagcgcctccagaaacacacatagtttctgggccaccttgattttagcccattgagattcatgtaagatgtccaaccaacagaactttaggataatgaatttgtgttgttttaaaccacttgtgtgttttcacagttgtgttataagttgttgcagcagcagtaggaaactaataacgctggtatgacaacaaatttagcaacaccatgattttggacaagtgacttaatcactatgagtttcaattttttttcctgcaaaaatggggattctaatacacccttatttcttcatattttagtattattgacatgaagatataattttgctctaatattctgatactccttttactctgatactccctcacccagaaatgtcagtagatgttgttgagtcttttattttattttattttcatgcccttagaatcatggagaagctctcatacctgccttaactttcaggaagtgcttgtgaagggaaaggtgattgctctgggcaaatagcattgataaaattcatgattatagtcaggaaagaaagcagattggtagagaaatatcaaattgaataaaagcacagaaaggatgctgtagggtttattcaagagatatgaattcccatagtttgttgcaagggggccttatacaatacattcattgttgataattgtgatggtgcttatcttactatataccactatttattctgaagttagatcaaagaaaaatttgagaaaaatccaagattttgttaagaatcaagacagctattcaacttttagggaattatttgttggctctaatttagaaataactctattatacagaatcccataagaaggtttgcttttccctcttaacaatcatctaactttggcaaacattctgaagatggagagttggaaagaaacaaaacgccgggaacatttgagctacttcaggttacagccattagtcctgaaataccataagggtggggaatagagcagtaactaaggacaaatggtgcatgtgttttctccagaaacatataagaagaactttagcagaataaggaacacagaaataggaagatattaattcagctttgaaaactgtatattaaccagattttcttttttagaagtatttattcgcagtccagctaggtgcccggtatgctaaggaaagcatggattttcttgtacagttagtgaccatttaggttttttaaatatttgtattgaatgcataaaaataaacatgttagaatcaaaggattaaaaaagtcaacttttattttagatacatgatgtacatgtgtacgtttgttacatgggaatattgtgtgatgtcgaggcttggggtagtgatcctgtcacctgggtagtgagcacagtacctaataggtagtttttgaacacaaccttctcacattccttccaacttccagtatccacagtgtctataacttccgtatgtatgtccatgtgtgctcagtggttagctcctacttataagtgaaaacaagcagtatttggttttctgttcccatgttaattcacttagaattatggcctccaactccacctatgttgctacaaaagacataactttatttctttttttatggcagtgtggtgtacatggttttcatgtacacattttcttgatccaatccaccattgaaaaacaggcacctgggtcgattccaatctttgctactatgaatggtgccgcaatgaacataggagtacctgtgtctttttggtagaatgatttatcttcctttaggatctatccccagtaatgggattgctgggtcaaatggtggctatattgtaagttatttgagaaacctccagactcctttccacagcaactggtctaatttacattcccaccaacagtgtataaacattcccttttcttcacagcctcaccaccatcccttgttttttgactttttaataatagccatcctaattggtgtgtgaaataattttgtagttttgatttgcatttctcttatgattaatgatgctgagcatttttttcatatgtttgttggctacttgcatatcttcttttgaaaagtgtatgttcatgtccttttcccatttttaacagggttatttgttttttgcctgttgatttaatttccatatagattctggatattaggcctttgttagatgcctagtttacaaatatcttcttccattctgtaggttgtctgttttgttgatagtttctttttctatgcagaagttctttagttaaattatatctcacttgtcttttttgttgttgttgcaattgcttttggggacttagccaaaatttgttttccaaggccaatgtcagaagagtattttccaagttgtcttcctggatttttagtttgagttcttacatttaaatatttgatccattttgtatattgtgaatttttgtatattgtgaaaggtaggggtccagcttcaatcttctacgtgtggttagccagttatcccagttccatttattgaattgggagtccttcccccattgaaagtttgtgttggccttgtcgaagatgaaatggttataggtgtccgactttatttctgagccttctattccatttaattggtctacatgtctgtttttgtgctagtactaagctgtttgactactgtgcctccatagtatagtttcaggtcaggtagtgtgctacctccagtcttgttctttttggttaggattgctttggctgtgtgggctcactacataaacagaattaaaagcagaaaccatatgatcatctcaatagatacagaaaaagcttctgataaaatccaacattcttttgtcataaaaacccttgacaatttagacaccaaaggaagataccttaaaataataagagccatccttgacaaatccaaaacaacatcatactgaaaatcaaaaagcttgaaccattgcccctgaaaactggaacaacgcaaggatgctcattctcaccactgatatgcaacatagtactggaagccccagtcagagcaatcgggcaagaggaagaaatgaaagatatccaaatagaaagagaagatgtcaaactatttttctttgctgataatatgattctttacttagaaaatcataaaaaaaacttccaaaaggcttttataactgataaacaacttcagcagtttcaggatacaaaatcaatgtacgaaaatcagtagcatttctacacatcaacaatgtccaggctgagagtaaaatcaagaatacaatcctacttacaaaagccagaaagaaaaatgaaataccaaggaatacagctaaccaaggaggtgaagtatctctacaagaagaactacaaaacactgatgaaaaaaaaccaggtatgacacaaataaattgaaaaaccttccatgctcattgtttagaagaatcaatatcaaaaattgaccattatgcccaaaacaatgtacagattaaacactattcttatcaaactatcaacatctaaggacatttctgggagaatgggtattacagtaaaatatacatcaattttatatcttcatgtcaagaatactaaaatatgaaggaaaaaatgtactggtgagtcacatttattgatttacttatgttgaactagccttgcatcctaggagtaaagcctacttgatgatggtatatttacttttttatctgctgctgcactcagtttgctaatattttgttgagtctttttacatctatgttcatgagggatattggcctacattttttgttgtcattgtgtctttgccagattttgatatcagatggatgttggcttcataggatgaattaggatggaggccctcctccccagctttttggaatagtttcagtaagattggtatccattcttctttgtatgtctgctaaaattcagctgtgaatacctctgatctgggacttttttgcctgatagattctttattgctgattcaattttataagttgatattggctattcatttatttagagtttcaatatctttctgattaaattattgggaaatttcatgcttctagaaatatatcagtttcttctatattttctaatttgtgtgtatagagcttttcatagtctttgaggatgttttatatttctgtgggatgagttgtaatatctcctttgacatttctgattgtgcttattgcaatcttctctttctttttctttgttagtctagctagtggtctaccaatcatattcatttttttgaagaaccaactcggtttcattgatctcttatatggattgttgcatttgaatttcattcagttcttctctagttttagttatttcttttattctgctagctttggggttagtttgttctttttttttgtaattcctttaggtgcaaagttagattgctaatttgagattcttctaacatcttgatggaggcacttaagattaaactttcctcaacactactttgtctgcatcccagagatctgagcaagttgtatcccaattttcattaatttcaaatatgttttttttcctgacctaatgtcagtattcactcaggtgttaatcaggagtacattgtttaattttcatgcgttgagagagatattctttgtattgatttctattttattgcactggggtccaggagtgtgcttggtataatttcatttttaaaaaaaaatttcgaggcttgctttattattgaacatgttgtctctcttagaatatgttctgtattcacatgaggatgtatatcctatggttgttgagtggagtattgtgtagatgtctattaggtctaattagacaagcgtcaagttttagactagaatctcttttttagctttctgcctcgatgatctgtctaattctgttaatggagtgttgaagtctctcatgattgttgtgttttgtctacatctttttttaggccaagaagtatttcttttctaaatctgggtgcttcagtgttgggtgtgcatatatttaggatagttaaggcttcttgttggattgtatcctttagcattatgtaatgcacttaattgtccttgttaattattaattggtttaaagtctgttttatgtgatataagaatagctatttctgctcttttttgtttcccattcgcttggtagctcttattctaccctttgattttgagcttgtgagtgttgttacacgtgaaatgggtctcctgaagacaacaaatgattgggtcttgtctttttatctaacctgacactctgtatcttttaaatcaaatgtttagcccatttacattcaaggttaatactgatatgtgtgatttttgattctgtcattgtgttgttagctggttgtcatgtagatttgattgtgtagttagttgctttgtagtgccagggggccgtgagcttaagtgtgtttttgtggtggcaggtgcagtttttttaaatctatgtttagcactcccttaaagacctctgataaggccagtctggttaaaacatatttcctgtcacatgcttctctgagaaagattttatttctcctttacctattaagcttattttggtaggatatgaaattcttgttggattttttttttcttcatgaatgctgagtataggccaccagtctcttctggcttgtgaagtttctgctgagaggtctgctgctagcctaatggagtttcctctgtaggttccctgccccttctctctagctgcctttaagattttttcttttgcctccatcttggtgaaatctgataactacatgccttggggatagtccacttgtatggtctctggctgaggttctctatattacttggatatgtatgtcaacctccctagcaaaattagtgaaattttcacgtattgagagagatattcttggtattgatttctattttattatttttatattaatattattaaacatattgtccaagtggctttttatctctcctctcccaggaatgccaatgagtcatagattttgtccctttacataatctcatatttctcagaggtattatccattttttaaattctttaaaaaatttttctgtctgacataatttatttgaagaaccattagtagagctttgagattctttcctcagcttggtctattctactgttaatacttacagttgtattatgaaattcctgtaccaggcatacctgctaccacaaaaatatccttaagctcatggcccataggcactgtaaaacaactatgaaatcaagtctacataacaaccagcaacaacaggatgaaagagtcaaaatcacacatatcacaaaattgcacaattttctttcagctcaagaagctcagtttgggtctttctaaaaatggcagttacatctttctattcttaaatctttgtactgaattggttggctttcttgaactgagtttcgactttctcctggatctcattgaacttccttgccatccagattctgaattccagtctatcatttcagacaattcagactgattaagaaccattgctgtggagctagtgagctcatttgtaggtaaggggacactggctttttgaatttccagagttcttgcactgactatttctcatctggaagggctagcatttctttaactgtggtgtaaatcgaatatagtcagttggctttatttctggaagctttcatagagctaaggctctgtacaaagtcttcgttgctgaattcttgctcttggttttgcagggggtagaattagtaaagtgatttttggtgctatatttggactgtaatccaatagaggatacttgagagcaatgggtggttgataagctcttagccgcacagcatctttgcatatcctcacattcacagctgttttctgtggtgtaaataggagagaggtaacccccctcaccaggtccgctccttggtcttggggtttgagaaagatacctctggtcactggaaatgtacttgcaatttttgttattgttgttgttagatctttcaggtgttggggctcccttggggattggacctgaactagtggccacagccctgggattctaggacctgtttgcagctcccttctgtggatccttggggttgggttttgggtacactgggggatgcaaaaggctttcaggctgccaaaatgcactcaggtggagcaaaggacccaggctgtgcacttgaggctacactgtgtacatgcacctgtggggtagccaggcataggccctaggtggtactggtaggcaggtaggcctgtaggactgatgggccccagtcctgcagggaatcaggcagtgttttatccatggcagttagctggggctaaagcctcttagagggagataggagctctggtgggagggcgcttatggcccaactctgccggagctgacccatactcaaaggtacccaaatccatgtgtgctgcagctccatctctgtctaatacctggggagatccccctgccagctcacatgtccatgggggtatggagactcctgcaactaagatcctagaggtccaaagtgagatgagtagtcccccagtcccttcactcgtatcttcctcaagcaccattcagagttggaacagattatttttttattttgtaatttttaaaattttttattgcagcaaatctctattccctgagaagagagaggcaggtagagcaaggacaagtattgtcctttaaaattttttttcaaactctgtaggtcatcttttttgaaaaattgtttttagatatcactacagacactttctctgatcacactttttctcgttttatatgcatgaattaaagtcaaagaaggcatgattttgggaggatcatgggtggaccaccctcacaccccctctatatgactttattttatctattaacaacctataaatatataaaaccaacagaaatttctagaagaccaaaattagtaaatcatagaagaataaaataatatatttggcaaacttaattcaataaatgcatatgagcatttgcatgctccaaacagaacttgattttcatgcccattaaatgtgtgttttattttctcaaagcaatgacttgcttggccataaagcaagctttaataaaattaaagtatatgttagcaaactatactgtatatgcatagttctctgtagagagccacttttctttctttccgattttttttttttttttttttgccaatagcacagaatacccctggggaaatcattacataaatctgatttcaagagggaactcaaggtgaacagtaacaaattctgtcaaccactttcacacaagtagaaaatcacaatacctattaaggtggaagtcaaagaacaaatagattggaatctgacagcatgggttaaataattagctgtataatccaaacgctatttgattctcctaactcagtggacctctcagtctgttttttcacccagaatatggagctaataatatctgtctcatagatttcagttgcaatatcccaagagttctgtgatgttttaagcatcttctttttgtcagccttaatgctcaatgtgatgagttgtagagatgaaaggggcattgtctttgcctttaaagaagttgatgatctcatttttgtcaggactctaggaaattaaatgaagtcagttaaacaaaatgactattccaatcatttcattcatctgcatgatccttactatagcccctggtttgattcctggagagtccactgcatgtgtggactttggaagaattgtatcgctaccaaaattgatctttggtacccatcatttctcactgttttagctcttgactgccctcattctggcatctagtggctacaggctatgtgcccttcatttgtgtcctttctctctggaaccactgtccctcattacctgttgtcagttttcttaataccattgtttatattttgttcatttttttcatggtttcaagtggcacagaacagtagctttccttatctgcaggggatattttccaagaccttgactggatgcctgaaactggatagtattgaatcctctatacgctgtattttttctatacatacttatgataaagtttaacttataaattaggcacagtaagatattaacaacaataattaataataaaatagaacaattaaaacaatatactataataaaagctaagtgaatgtggtctttctctttcttactctctctctctcaaaatatcttaatattttcaaaccttggttgacctcaggtaaatgaaatcatagaaagtgaaaccatatataaggggtattactgtaaatgtgattattgttacttcatcttggtcagaaataaaatccatctcattctgttttaagacaattaaataaaatgttgcatttaaagtgcttaccaatcagctgaaatatatgaattgattatatacgtatataaagtgatatgtatcttatatatgtaatatgtattattttatacacacacacacacaatttattatcactttgaagacccttgtgggtcgaggatcaaagggatttttctatgtcagccacttttactctccttgagtattcttcagcgcaggggtccccagccatggaccagtactcttccgtggcctgttaggaagccggccacacagcaagaggtgagaagcaggtgagcaagcattaccacctgagctctgcctcctgtcagatcagtggcagcattagattctcataggaggggaacccctattgtgaactgcgtgtgcgagggatctgggttatgtgctctttatgaaaatctaatgtctgatgatatgaggtggaacagtttcatcctgaaatcatcgtctccccattcatggaaaaattgtcttccacaaaaccagtccctggtgccaagtggttggggaccaccacttcagtatatttgcactgcaaggaaaaaacttcatatatcaatttgttaaaatttcctcatgttatatattaaaaatatgcacagactatggaaaaaatcaagttaaattagaaaaaagaccacttatgtaatatgcatgctattttttttaatggcacaagaaaaagactaatatatttcatttattctggaattcttgattttataattatcctcttgggaatttttattccatccatttacaaaacagttaatttaattgaagttttcataacgtttaacatgaattttgagtaccatttaaaagatgtaggcttcaaactttttatcagaaaagctaagagaaactttggatactttgatgagggaatattaaattattttgccttgcataggaatatgaaatataatcaagagctaggaaaatgagtctctagtacattataaattactggaagaagtggttgtttttgtttcctattgctgttgtaacaaataccacaaacttgctgacttaaaacaacataaatattttctctcacaaatctaaaggctagaaatctgaaatctgccaggactatacttcctctagggtttctaggggagaatccattctatgcctctcacagcttctggtagttgtctggggatacctgggcttgtggctgtctatatctgcccccattaccaccttgccttctattccatgtttctgtgtgaaatctccctcttcttctatcttataaagacacttgtgatagcatttagggctaacataataatccaggatcctatggagtgaaatctgttctcccaaaagtaatatgttgaagctataaccaccacggtatagggcctttgtgaaagtaattaatgttaaatgaagtcataatggtgggagcatgatctggtagaattagtgttattgtaagaaagtaaaccagagaacttgtttcctttgtgctgtgggaatagttctaagatggccatctgcaagctcggaggagagtcttcataagaaactgatcctgctggacctcgatttgcgatttctagctttcagaactgggagaaaatagatttctgttgttttaagccactcactctgatttttctgttgtagaccaagctgactaatacacagggtaatctactcatctgaatagccttaatatcatcaaatcctttgtcatataaagtagaacattgacatatcttttggggacctccacattctaccatttagcccagtacagtggtcaatctttttttaatccacacctccctagagtaagaatcaagtaaatcatacatcttcaagcgatagctgtgtaacagatgccagacgctacttcatattcaatttctcccttcctaaaaacaaacaaacaaatgacaacaacaacgaaagcaaaaagcacactgcgatttaggtactttttacatcatgtgacagagctgcaaaaaaaagaagctctgcaaggatatatgtatccaggatatatgatatatatatatccttgattaaattactccatcttctagtaatttataatgtactagagactcattttcctagctcttgattatatttcataatccttgatgtatatatatcatatatatcagacaatatatacatatataatatttatcagactatatataatatacatagtgtggtatatatataatatatatagtgtgtgtatatatatatctgtcacattatgtaaaaagtacataaattgcagtgtgctttttgcttttgttgttgtcatttcattgttcatttttataaaatgggtctcagactatatatatatgtactctacatatatctgatatatatatagtcctctacatatatctgatatatatatagtccatatatatctgatatatatagtctacatatatctgatatatagtctatatatatctgatatatatagagtctatatatatatctgatatatatagagtctatatatatctgataagactatatatatatctgatatatatagactatatatatcagatacatatgtagtctgaggctgtatatatactatagatatagtgtctctatatatacacacacacatatatatgcatatatgtatgtgtatatatatatgtgtgtgtatgtgtatgtgtgtgtgtgtgtgtgtgtgtatatatatatatatatatatatatatatatatagtctgatgcccattttatttaaatactgatccagaattgaaatccatattcctttcactccaatatacatcatctttccctaaattcagttatcattctggtgttaattaatcagtttcaataaggcttctttccacaaggagccatctcactgatggcaaaggcatgtatgaaggatgacatttattgtttttgaaagcaagcagttcattaattaaatattatgtgtttgtatttaaaaaattaacttttatacttttgtgctcacactcatgaagaaatgcatattttcttcctattgttaaaagtaattaatggtgggactgtaaactagttcaaccattgtggaagtcagtgtggcgattcctcagggatctagaactagaaatagcatttgacccagccatcccattactgggtatataccaaaggattataaaacatgctgctgtaaagacacatgcgcacgtatgtttattgcggcactattcacaatagcaaagacttggaaccaacctaaatgtccaacaaggatagactggattaagaaaatgtggcacatatacaccacggaatactatgcagccatgaaaaatgataagatcatgtcctttgtagggaaatggatgaaactggaaaccatcattctcagcaaagtatcgcaaggacaaaaaaccaaacaccacatgttctcactcataggtgggaattgaacaatgagaacacatggacacaggaaggggaacatcacactctggggactgttgtgcggtggggggaggggaggggtagcattaggagatatacctaatgctaaatgacgagttaatgggtgcagcacaccaacatggcacatgtatacatatgtaacaaacctgcacgttgtgcacatgtgccctaaaacttaaagtagaataataataaaagaaaaaaaatgaaagtaattaatgtatatacatgatttaaagcaaaattaagtggaatagcatcagtattggtacaaaaacagtagtaaaccagacaacccagttttctgatagatgagcacaaggacagcctttcattaattcacagaataggacgtaaagaataactgaaaaaaaaaaaaaagaaagttacaccgtcattcttttctccttgctctgtgtgaacttaatagtgaatgaagccccttttatcttccatctaaaatgtcaaagtcccataagaataaattatggatagatgataattaatttattttcagtatattctttgcctcagccttactttcaaaatctgggcacattttaataaatgcacaatatttgcatgagaaaacataattaagtgagcatgaaaaggatccatctgctacatagttttatttttaggaatttactgaatatctatgctaaaatcaaatttccatcattgctgagcctgttattactcttttgagctttcataactggttgatgttttccttctggtaatttttatggtaaaacactatctcagaacttgtttgtcagtttcactttattgacttgattccctgtatcatccaggcctctgtggttacatgcaaaaaatactgatctttaccaattttagtaaaggagatttcttggttgaccattataactcatagtattagcaagaagatgggagaaacaagcctgggcacaggcagaaataaactttgcttcattagattgggacacatgaatcacaaaaatggttttattgtagaaacaactcgtacaagacacactgctgaaattaacatatctaaccattggtagcctgtcttgaatctggtcagctaagttccaaggcttctaatgacctaacttggattatgtatgtgcccatatcttgaattggtcaggaaattaaatgcacaaaacaatgcttgggatataccataccatgagagaaaagtaatcctccaaaaaaaaaaatgagtcaatgattattaggaaggtagaaggaaagatgagcagctactgaggagcaaatgggagctctttgagatacagatctgtttcaaatatttgattcagttctaaacataatactgttgtagagcggatgcataataaatatttgtttattcatattgggaaatacaatttaaattgctacattttagaaagatttctccagcaataaacatgtccactacccttgcttcagtactgaccctaattttaccttctcttaatcctaaaaaaatcataaataaatgatgaaaaggaaagagaaggaaacaaaaaattgtgaatgaaaaatatgtactagcttccaagatgaaacaatgaataacacacactatcttcctttaaggagccccaagcctataatagcctgatgtttggatcggtgattagaatgatatgagttatgcagactggtaccaagaaggttaatgttcaccaaaatattatctataaaactcaaaattgaaaatttaaaaaatcatcaactataatatacattttttaaaatcttataattttttagacctgtaaagtatagatacaaaccatatatagcatcatttcatgttatatgtaaaagcagaataaaaatggcatggagacaataattgtgactgtgtaagatattaatttatgtggatattaacaaagactgggagggtaacagaaataaaagtagattttctagaataatggatgtgttttattttttaatttcctttaatgccactatatgtgaaaagaaatttgcaaggaaattttgggactatttattctgtcatctgattgtttagaaacaaaatacattgaaattgtcccttgcctgttagtgtgattcaatccattcttcatgattttgcagctgtggttctggctgtgactgccaggggagacttccagtattactatttatttattactcttgttctttttaacctgtttcctcaaagcatctgcaagtttgtggttatgggaagacaggtggtggatgttcagtagatcttaggtagaataaatagctgttttgactcttgttaagaatagtattgtttttattttttttattttttttttttttactttttaattttcttttttttattttttttaattttttttaattttttttttattatactctaagaatggtattgtttttaacactggtatccaataatacttacctattaggagttgcgagtgctttaaactctcgattaggaatataaaattgcccttcttgctaaaaacataccttttcttcagtttctatatttcagaattctatattacatagaattcttcaaatggcatagattctaacccttgttcagaacatacaattactattcaatctcttccatcaccaggatttgacatctcagttcagctgttgttgccatatacctggtcattttaattgcttctgtattagtttcccactctcattttcttctgtttcatttttgcctatgtactgttgccatatcatgctgacaggggctctagccatatcatacctctgatttgaaatatccaagggacccctgctttgggtatttttgtttaagttagaccctatgccgggtaagagtgcagtgatacaatcacagctcactgcagcctagaatttctggactcaagccatcttccagcctcagcctcctcattagctaggattataggtgtaaactaccacattaaaaaaaaaattgtagcgacaggagacacatgatgttatccaggctggtcttgcactcctgacctcaagagatcctccagcctctgtctcccaatgtgctggaaatacaggcctgaggcactgcacccagcccccctttggctgctgaattaagtataaaatttgtagctcaattttgggatctcctctctactttttagtattttaaatcatgcttattgctccttctaccctatagaccaacaagccaacaactaagtctcattcttccgtttctttgcttaaatgttttccttcacctggatggcctccctcattcttgccatagttattcagcaacccacttcaaaaataaccctcttcactagaacttttcttattaccccaaatggaattgaccatgattcttttaaaatatacacaagtctgttctgcctccctgcacttaataagctttatattagagttacttatgtgaataacaatcagattaggtgaactctatgaagacccaaatgctacctttgtcatctttgtatttaccaaaggcatctaaaacagaacactggcttgttcattggcttgatttaaagggcaactgcaaatttattgaataaatttaataggattagaaagaataacttttgttttcctgtttaattattttttaatcctagagaaattagaggggaggtcagacgtaggattcctaaacaaaagaaagacaggaaagaaaaagagagtatgggaggtggaaaacaataaatgccttctggatttcacccagtgaagttaaatttctttaggtataaattaagaagaatgtatttactttttatttatttatttaattaattaatttatttatttattattatacccagagcccagcatttgggtgactttatataggatcagttttagtgaactcagttactttattttctattgtttttctaatattctagttgctttattcatgttcttttttacatttaatattctatcagctttattaactattcttggagtttagttttataaagatattgtttttgtaaaaatgttctcctgctaaagaacgtacttgcctgtgaaaaaccaggagaatgctgtgtagaaagtagcgcaggtaaaaatacctgggtgagatttgactactctctccagaccctgtcttagttttcctcgacccctaatggatagaaacctaatttcttcctctcctgtgaagcagtgtgatcaaagtctcagactcaggcaaattagcatttactagtttattttgtgtgccctaaaacagtaccctcagggattgaggagctgagtgaaacaccaatattcaaattagctcttcccaagaaacacatacacatttgaatggataatcttaaacctacctatagcggtatttctatacaacaattagggcatacccttctctgaccagaactaggaaacagctttttcttttcttttcttttctttattctcttcttttattttcaattgtgtttctagagagatgaattctagaataatatttagggtttctggaaatataaagcagagtttgattagttagtatacatattggagttaatataatccactatgtatattatgaagtgttacgaatcattttctttctatcgagaaaatcagttattttcttattcacatattatttctctatatactgggggttaaaataaaaagaaaggacaggatatatactttgtgggggactagaatccttaaaataaaatcttaccatggaagaaataaatattttcagtaagaaaataatcccaatggacatcactaatgcaaaattaaatataatttatttatttaatttcaaagttaagaatttttcaaggtatattttatggtctctgatatatacaaatttccattttcttgttttattttgattgtaatgttgctataatattatatcatgtgttacaataaaacgatttggatctatttgttcaaactatttctcttgtatttagtgatttctttctttctatctctcttcgtctcttttaagcctcaacaaagtgcttctggaaacaatgagagctctcaagttgagtcaacaaaggaaggaaatccaagtaccactgcctgtgactctcaagatgtaagaaaaacttaagatgctttttacagtattagacaggagaaaaaagcacaagcattttagcaattctaattcatgccaccatgaaactatttatatgtaatatctactatctaaggattgtacttttaaatataagaaagtaaatgttctttatgttcttttttttttttttttttttttttttttgagacggagtcttggtctgtcgcccaggctggagtgcagtggcacaatctcggctcactgcaagctccgccgcctcccgggttcacgccattctcctgcctcagcctcccgagtagctgggactacaggcgcccgccaccgcgctcggctaattttttgtatttttggtagagacggggtttcaccgtgttaaccaggctggtcttgatcgcctgacctcgtgatccgcccacctcggcctcccaaagggctgggattacaggcatgagccactgagcctggccgtaaatgttcttttgttatgaatcaggtaagtgttccattaagcattgcaactagattcttaggacaactgtgaatatgagtttttagagaggtaagtggaggaccacaggctaagcaaggtgctcattcccacagctacatgaaagaaagctgttaaaatgtaaaaaacaaaagccaacaaaaaaccttataggatgtacttctccatgtaaagcaaatacactcagcatacagagacatcattgtagaggaagggagattcatttccttcaaatgataggaaatatggaatttgttcaatgagtcttttcactctttaaaagtgcaatggaattttatttttttgaactttggcaaaattgagctaatggatctattacatttagatttgagaacagcaaatgacaacaattgtgttcaaaattaggctttaatccaacttgaaaagtgtctgatgaaactatgcttgaaagaaatcaggctgcagctaaaaatatataatgatgataaggaggaatagaaaagtaagttaaacaagtgttctcttttttctcttctggctgccaaagtggatttagaaaaatgaattactctcccaactactcgggaggctgaggcaggagaatggcgtgaacccgggagatggagcttgcagtgagccgagatggcgccgctgcactcctgcctgggcgacagagcgagactccgtctcaaaaaaaataaaaaagaaaaatgaattactcaacagttttgccttcaactctttgtttatttaaacatgtatccaaactatacaatttaaagcataatgttaataagaagtataaataaaatgcttgaaatttacttccaaaggaggagagagtcaaaaagactttgggcaggaaggaagatttttactatagtttgaagcacgggtaggtctttgacagtgagcaaatttgcagaggcaggaaaatatcacagcagtatggctaaaaaacagtacacaaaatggcgggatatgtgcttacagcaatcattgaagactagagaatgaggggccctggattcccaagctaagaaatttaatttgaacaagggagctagttcaggttttcaaatgtttgtattcaatcgagtgataaggccatggtgttaattctaaggatggtgtttttatttcttgatatatatttttgaaactacataaaaacatgttctcattggaggcaaaatagaaaatttatgtgtggtttgctaggattcctcaaagcaacattctggtctacttttcttattgaagcctccttcaaatcataaattgatttgttcatatgttatttgtttctctcttctacttgtgttgttctcctttgtcagggataactcttctgtcctcagtgagttccagaagcagatactatctgtttctggtctcagtctggacctggggctcttcaaaaagctgcctccaccagaacaaatataaatgttatttcactaacctgacttctgtcctctagacttttgtattggagtctctactcctaagaagctacaccttttagtacatagagtgctcagtattcagagcctgcagattcaattatagataataatgaagaaagtaatacaatgagtgacataaaccaggtgtgagtaatcggaattagtgggacatgcatgaacatcagttttcaagttctagaccagtacttcttagctctgtctccagaatagtgtcaaccgaagagtacttacaaaatactgatgcccacaacccattgcagaaaaattacctcagcacctcagtaggtaaggtctagacattagttgtgttaattttttgattcatccagatgattcaaatatgtaggtcatttttcactaataatagatttcccattcataagaaccctctggggagcttttagaaagtcagattctgagcaattcatctggaaatttttaataaataaaactagagagactgttttttgccttgtataaatttagccataatattctgatttgcattaaatattgtgaaatgtattgcttccattttaatgtagcagtatcaaaatactgactaccagtctagagacttaagctgcaatttgggttgctttattgagtgtccaaactgaataagaaggcagaacttaatttcatttttttaaatcacaaaataaaattctttatcacatttctacctttatattttgtctattttggggtgtgttttaggatcttaacctatgcctttatatgactttcctttaatcagatattgaatgaatgctatttagtttttaacaaggacaaaaagtaggatataatgtagttttactttgtttttaatgtccttaataaaattgatagtaactttattcctatttcttgttttaacttgattttcagttgtaatgaattcagaaatccaaaaaccactgaatcagcaaattttaaaaataattaaagagagagtaaataggaacctgaatctaggcaatcacagaaacaattgggaacaaacaatgaaaagtctgtttcaaagagagagccccaggattctgtgatcaaatgaagatgtaggtataaagatgaagtgtaacatgagccccaaatgtatgttttattggcttaaataattacatcatcattatcaagaaagaaaactagagtaggagatatttttggttaacttttttctatttacttctgaacagaagagattggtactctgttaataattagaatgggtgaaaggcacaatgaagctaattatttttgaaatatataattttaaaaaagctttattgagatataacttacataccataaaaattcacccatataagtgtatgtttcaatcattcatcccatttgctgagtccaggactgtaatccagtttcagaacattttcatctccctaatatgatcccacatgcctttttttttttttttttaatacaatgagtcctcatccccacactaagcctcaggcaaccaaaaacatggtttctttttgtatttgtttgtacctttttattgctgaaaaccattttattgtgtggtgtaccacatttctttatccattcaccaattgctgtcttttggattatttttaatttgtagctattatgaaaaaatgatgctatgaacgtttgcataaaccactttgtatggcaatgttttaatctctgttgagtaggcaccaagatgtagaattgctgggtttgatgataagtttatgcttatattgaaaaattggtacattctttccccctttgaacaaacatgagtggtgcttctctattctcccatcttcaccattaaaacctcatggttctcagaaaggtaaaattctcagtaatgagggctcaccttaccttaaactaagcctcttggagtttttgtatttcatgctagtccatattcggcctccagaaatttattaaagatattacataaatattcccatcaactactggctccagcagctttcacttaggtagcttgtctgtgttctctgtattcacggtctcaccagtttttggggtggtagtttttctgtaacattaattctttgatacatctaagaaaaattattgattatcagtctgttcagctttttgcttgttgtgaaggtggaagtggagacttccaagacctttatgtgtcagagcagaacctgaagtcctaatttgtgtcttctgaaacacacaagcttttattttcaataaagttcaactcatcattttattcttcatgcttttgatatatctaaagaattattcacctgtttaagcacactgattttttttcttatggtttctcatataacgtgtgtgcttttatttcttacatttagatcaatattcttcaattttttgtgtgtgtctgtggatggtgttaggtaaggttttgcatttattatttgcatgttgttattcagttgtcctagtctttataacacatttttaaagaatatctttttttaattgaacttctttagtatctttgtcaaaaaataactgacacaaacatgagttcatttctcatctttcaattttttaattgatttatccttatgctaataccgtattttcttgttttgatttttatttttaattttagtggttaccatagtaggtgtatatatttatgggatgagataaaaacatgagatgtttttatacaggtatccttggttactgtagctttacaatcagttttgaagtctacaatttaaagtactgtgactttgttgttccttttcaagattgtattggctattctgagtcccttacatttctttgcaaataataagaccaaaacattgtcttaataatactgtttttttttcaatccataaacatggaatgtctctccattttcttaaatctttttttcttttctttttttttttttttttcgaggcggagtctcgctgtgtcaccaggctggagtgccctggcgcgatctcggctcactgcaacctctgcctcctgggttcaagcgattctcctgcctcagcctcctgagtagctgggactacaggtgcctgccaccatgaccagctaatttttgtatttttagtagagacgggctttcaccatgctggccaggatggtctcgatctcttgaccttgtgatccacccgccttagcctcccaaagtgctgggattacaggcgtaagccactgtgcctggcctactttaatcttttaaaatttctttcagcaatgtttgatagtttttcagggtacaagtcttgcatttcttttgtctttatttttcttaagtacttttctctttttcatagtattgcaaatgtagtattttaattgcatttccagattgttaattgctatatatataaatgcaagtaatttttgtatattgatctatcagattgaggagttttaactgactgtgagctctgagttaaaactgtgatgagatttgcacaccacctataggtagttgcagtgttgattttaagcagttacgatgctacatccagaataaaggagacacatctcttatctaatttcgcttatcagtctagaccgataaattctgcctcattttagaaataacactctgaggttcaacaatgacgaatggaaagtgttttctaatgcttgagatagaaggctgaagaaaaaagttagaattgaaggtttgtgttaatttatgtttcaaccagtttccagctgtgtaatcatgaatatttaacccttttaagactgttttttctcctctgaaaaagagagataaatatctgttgcttaatataactcatccaaaggatccagtgagatagcccagcttaacagttagcatatgactagcacagcaagctctcaataattactactttccattcccttatgaaagctatgcctctcacaaaaaacctcaataagtattttgaattatatactttaattaatttatcaaatgaaaaaacttaaaatatgagcaaagcaaccttaaatactgtaattgtatttgtaatgtatttatagtgagtagccttattcagtgctactttacacagcagaaccagatgcagctagtagaaacagctataggaagaataatattttagtcaaatataaaaatgaactcttaatgaaaagtatctgaaactagaattagcagttggcggaagtactataatatataatagaataatgaaaaacagccattctggaatatagtcaggaattgaggcatttgtgtggaggacagactgatcatgttagcatctctttcaatttcaggattctataattatcagcaacctcaccaccctgacagctgataggaccccatgcagtctctcagtaaatagataagaaagattatgcattttgattcctgttggtcatacctgagactgagtaacagaagagaaagcatgggaattacataaaacctagatgtgtatattgactttgctgtttcctaacattgtcgctctgggaagggactttgtattcagatccctttatcaatataaggtagatgaagatttttcaaattttagcatactaagaatcaccaagtcaactggtaaaactgcttatgctcaagatccattcccatgtattattaatccgttggtcaggtaaagagcccaggaatgtgtattattgtaataatcccacgtagattttcttctgtcaatatttcatgttaaacactttgagaaattgccgggcgccgtggctcatgcctgtaatcccggcgctttgggagcccaaggtgggcagatcacgaggtcaggagatcgagaccatcctggctaacatggtgaaaccccatctctactaaaaatacaaaaaattagctgggcgtggtggcaggcgcctgtaatcccagctactggagaggctgaggcaggacaatcacttgaacctgggaggcagaggttgcagtcagctgagatcgtgccactgcactttgagaaattttgttgttcatttattgcaggtttattatgattattatataaatatatagatattaaatatgtcacattcaaccatatcatagatatccttattagctccttttaagaagcagctctgaagttttaatactcaaagtctcaaaatattctgtggcctaagaatcaaacttggaattataaaacatgcttatttttagatatctttgttgctttgttccacttcctgcctatggtatgccctatgtaaaccaggcagggtcacttagaaaatggccctcagattccttgttcctttttaaagaagacttaagaaacttgaaatggatcactaaattcttagcagcatattcgactatcagtttggggtatgtacaagttactctaaaagctgcgttgtttaaatgataatattggagtcacattgagaaagcaaaggatgtgtctactccatcccattttcctgcagcttgcaaatgtgcctcatattgtttaatagcatatcaagaattaaagacattgaacattgtattttaattttcatttaggaattaagagttaatattcaatgtaaacgtgttttgcaatgtttctgactcctataagtagcaaacatttaatttttcttactgtgctgaggaaatgaaaaacaaggatggcttatgtttagcaccgggagcactagctcaatttcctgccattacatctgcttgcaagtcccttaccaaagggagtctattcaacataaaaatattgcctagggaaatgagaagagaaaatgtgcagaaaataaattctagagctgcaagtagaaaattatgccagctttttcatgttaagacaattttggctgagatataagaaatctagtttgctattatatccaacatgcattttgtggcatttgatggtttggatgagttgttggtagatccaatgcttggttaacataattttctaggcaagtcataccctgctgtaattggactgagagaccacacagcactgtcattctgggctacattccatcagaacatctgaagaggttggcttcattagaagcattttttattgtcctactgtggtatttttttcaagaagaagcaggaatccctccaaatagtgtaggaatgataggtagattccaatggtctttggaaaaatgttatattttattcatataaatctccatgtttacttttctatgacaacttaaccatccaaacatgttaacctaatttgatttatttccataaatagtatggaaagcttaagaaaaatggttaatctattaatatggtaaatgaaaataacccagtaaccgtgttaatatatattataaaaatcattggccaaacaataacgtgcaaacacaaagcataatctgataaataattattttactcctcccatttacctatgagacacataaggacttccttctctgggtttccattgtccttgctggatgaatgtattttgtctttcatcacagtacaccttgtattttgattatttgtataaggttctcattttgaattagataataagtaatttgagggcaaaggctataaaaatatttgtattgtaaattaaggttcagagagggaaggtgacttgcccagaggcacctgcttgggggacattgatgtcagaactttcctcccttcccctcgaccactcctgccgttggctccatcaactgaatttggagtcattgtcttgatttaatgttacattctcaatcttttgacttcttgcttttcagtttcttaacttataaatattaaaccagcactaaaacattgttctgtaataaatgtgaaaaatcaatttcctgcataaattggcatcatagaaaaattcagtcaaaaactattggtgtttctaagtagcatggtactcgatttactttgtttctcttttgtaatattataaaaattttgcttgtttttagcctatagcttgtcccatctcttatttaaatatgcagaatgaactggatttttgtatttgtcataaatagtttttgttggtagaatttcagatttaccagttgtgtatttgcattaattattctgagttattttaatcttttagagtaagatcataagagacatgactaatctctttagtgaagtataaagaagcgtttaataacaataacaaagtcatagcaattggcaagatcagcgatacaaagtaaatgaaaatttgacaatgaatttctgaaaagttattccatctgctttaattcttgaagttttattctctatttctgagagcaggaatagagtataattaaaaataaacaaaaagcaaaagaggacattatctttttgtaatcatttcagtgattataaattcagtcatcatgcccttttgaaaaaatcattctaaatatactactttatttccataaataatttccaaatgggatatctgcactgaagtcaaacacatgcatgtatcataatgaaaaccttctgaagcatttgaatgccttagttagattagatgggctgattgatctgatgtttctgccttgagggggaaaaaagaataaaaggcatccttcaaggtaaaagttactcaaggcaggatgaatgcttgattactgagactattttctttccctgttaaatcataaacacaaaaggaggagaggaaaagaaacaaagaactgaggggaaaaactccagcaataaattctttggcaatgtctagattttgtaatgatcagaattaatatgttgaccacagaagtgtaaacttaaagtgagtatcagtgcttctattatgataggaatcaaacttattggcaatatagagaaattttgactgaaggaagggaaaaatgaaaaagggagatgaaagatagaaccaaattgagcacctaatatgtgcaagatattccattaggaacctttatatgttttttaaaaatgtaatcaactcttccagcatctgattgatgtgggtattattttgtctagcttacagataaagaatcagagcctcagtaagttgaggtaaccttccaagttcatacaatgaatgaaggtaaaaagaatttgtcttcattcattagagttgctataacaaaacaccatagactgggtggtttataaataatagaaaatttatttttcacagttctagaggctagggaatcctcattcaaggcactgacagatttggtgttcagtgaggcccacttgcttagtgaaagccatcttctcactgtaatttcacatggcagaagaggtaagatgatgtctctgaagcctcttttataagggcactagtaccattcatgaggctctaccctcatgacataatcacctcccaagggctccaacgccttatcccattaccttgtgagttaggatttcaacatataaattttgcggggacataaatattcagatagcagcaaaattctaacctaagatggactatctctttattcacattgctgtgattacctttattatctcatttcactgtgatataaacattttgaaggtaaatatcattatcatcatttaacaaatgagataaaatgaggttaaattggtatttcccactttgccataggcaaatactgttctgtgattaagttttcaacagtataaataaaaagaaaagtgatatagaataaaaagccatataacaacatattagtggattttccattaatcttttatcttctgtcttatcctcatcctcctctttttcccattcctcttcttgtttcttcctcttcttttttctatttctccctccgtctcaggataatttatgttgtcattgaatcctttgtctatttttcaaattaaaatttttatctgaaatattgctgaaatatagtaatctattttttgttgatttatattctccaatgtcaaaatttaacattggcaatttcattgttagtggtgtctaattttattttccaataagatatcaaagtccaggagcttcaatgttcatgaacttacccacattatcacaaatagtaggaaatagagttgggactcaaattcatttgtacatgactccaaagcttattcttcctgccttactgtgggactcccagtaatgactagagacatcacaggattagagtcttctgcactacgctgtgattgtgtgttcttttgcacacacagagattatgtaattaccaaggtttgtcttagctacatacttttgttgttaccgtgattgcttttgtgatcatataataatattgtgtcagttggcagtttattgccagaaatcacagaaacaaacaggttattctagaggtgttggtgaatatgtgtatctgagaggcagtgtttaatcattttaatagatgtatttgtggcttatcccactttataatttacagacccagctgtgtttctccttagatctcctgtataattgaatgggtgaaccgcatagtgaagcagttgaatttgtgcatgctttcctgattaatttgcatattttattacttgaatttgcagatcttgggtactttactaattaggttgagttttacttaattgagatgatgaaggtatttggaagacttgtactactctttgtattgttttaaataattctccagactaatatttgatattttttctttttttagacataaaatgattcttttgaataattaatccatcattcactacaatttattacatctctatccattctttcccaagtaaaattatattctttaattatacatgcataaagagaaatgatatctgaacttttgctttagttcaagaaaaagaatttgagtttgaaattgatatggaatgaagaccttaagtttttaggcacttttcaaatttaaatgttatatttttatgaacctgtgtattgcccgacatgccagctatacacagataagcagttattatacagatggaaatatatcattggaaagtgacatatcagtcatacccctcaagaaaagggaaaaagaagaaaggaaaaacaaaaaacgaaaaacagagggaagggagaagaagaaaaaggagggagacaggagaaaggaagggaaaaagggaagggaaagaaggagaggaggaggaagggagagagagagaggtagaaataatggatatagaaatgataaagacagaaatagatagttacaacaatggccaaacagataggtaggctttatttgttattttgaaactaacctccagggccaagcatggtggcttgtaactgtaatcccagcactctgggaggccgaggtaggcagatcacttgagttcaggagtttgagaccagcctgggaaacatgttgaaactctgcctctataaagaataaaaaaatatatatatctgcatgtggtggcatttgcctgtactcccaaatacttgaagggctgaggtgggaggatcactggagccagggtggttgaggctacagtgagctatcatcacgccagtgcactccagcctatgtgacagagcaagaccctgtcaaaaaaaaaaaaaaaaaaaaaaaaaagaaaggaaaggaaaccagcaaaatgtcaaagcacaccaataaagttgtgtgtctttccgtctccaactttatcattgtgctatgacatttgacaataccgagtttaatatattttatttttgtcagttttatatacatttcttgctttgtattagtgcaatattatctatataatttcatattatatgctaccagattaagcatttttatataaataaacattgtaaaaacgttgtcttaatgaccacaaaatattttatcattatttagttaatccgcatatttttgtttgaccaatatcttgttttatttctgttatacaaatcaccataatgaatacttcttagtgcccagtttcttttctttttttgtttgttcatttagttttgttttaaattttgtattttttttcagagaaaaaaataccccaaattaaaataaaattggccttctctatccctgggttttacatctgtggatttaaccaaccacggatcaaaaatatttgggaaaacatacaacagaaaataaaacaaataaaatatagtgtaacaactatttacatcacattcctattatattaggtgccataattaatctagagatgatttaaagtatatgggagagcatgtgtagattatatataaatataacatcattttatttaagggacttgagcatccatggattttggtatctgtgtgggatgatggaagaaatctccagctgatattgagggatgtctgtacactgaattgtgaaaatatttaaagccatttatccatcttaatacaatattttccaaaatatctgtgtgaatatatcttcacaccagcattgtaaaagacagaaagggaaagagaagagagaggagtctgcttcagcatgttatagccaacagtaaatgtatagtttttgtttattgatatgttttataagaaaaatagtttatcattttaattcttatttatattttgtgtaatttgatcataccattttattcagtgtcatgtggatggcattgcattaatgcaaatgcatctgagtaagttaatgtagaaccacatttcttccaaaactgaatggaccacattaatcattaaccaccatttgttaaatacataatttcagagagtggtccacaatgataaaaatacatatgatttattgaacatgtaatgtgtatcaggagctttattccaggttctttgtctttatttaaccccacaaaaattccatgaatacaattccatttccctattaaataaatggtaaacatgaagaataggacagtcagacaaagaacaggtgaaaaaaccagactcaatattaaactttctgaatgcagatcctgcacttctcactgcctagggactcaatttatcttcagatatcttgtaagataaacattattacttcaactttatacattttgaacatgaaggaaatgtagcctgaatatattcccatgtctgcttgtttacaaagcacatattctttccactaggttgtacattttcaattcacataccatatagtttattttattgtttcttatcattccacctgtactgatttccttggtgaaaaagaaacatattatacaattattattttctgataatatctatattggcattcatatttaaaacaccattaatattatgcagtctacagaattatgttgacatttaaatagatggtgtatattaaattatgtatctactgctttataattgcttgttaaatataaatttcctgtgtgattaatttcattatctctttctttatgtgttaatgatgactcttaaaaaacatgagcagcatgtaaacttctttttttaactattcaaattttcagcaacttctcatgtagacttaaaaaaataaagcattattgtcaagcattagaagatatacttaacttgtgaaacttgaaaactaaattagcatacctactctatttcataaaatctcatggaatttcaaatttggtgtaggtctcagaggtgaccgaacccatccatttcatgaaaatagcctaagattgtggctgttttggcttaatatcaacatttccagttcatttgattttggactgtctctcaatttaagacatgttctttccattttcccaatctgctctctctcttatcctaggcacgtcactcaaggaacagaatatgcctagcccttctcccagcatgatggcccttgaaacatttgatagtatgtcttaattctccatttgttgacatttgtgacttcgcgaatttctaatgttcatctgaaagataaaaatctcaaaatctctagatattgaggtttaatatgttagcatttaaaaccataatcataaccaactactcagaccaatctctaaatcagtgctttgtttggagataacattgacaggcatagtaaaaaagagaaacatgttctgacttcctacaaaacacaattcacttagtgaattctttcttaaatatttgataccaaaatatgcatcttaaactatgggaaagctgcttgaaagagccaaatgttcttgtagtcaatgatgattttggtcatgcattgtctctgggttgttctctaccatgtacctaggtcccacaaagcacctggcacacagtcatcacctggtacatctttattaagggccaagtgaatgaaccttattaacattgcctgctgctgtcataattgcctataacattaatccttatgttcatcattatcattgctgctacaatatataatacagaacacagtgggatgagtgtcactcagataagtgcattaaatatatgtccttatttattccttacaaatattgatgaaaaaacttgttcctcattttaaaaatacgaaaattgagattgaggaaaattgagtaatccaaggccacaaagctagtagatttaagaatttaaacattgactaaacatagattccgtcacccacggggtttaaccttattcttctttgtcatgaaatctcttatgtgaacagcactttttatctgtttccaagagtcacagttccatttcaggttttgccaggaagaattaaaagaatgaaatttcaataattactccaggtagaggaatgaggcaaagaatatatcagtgtgacaaaactttttgtgtttgtgtatgtatttaacagtcatagtcaaaagataatctatgagtcagagaaggtgacagcaaagattcattattttcatgctcactcatacaccttcactatgattcatcaaagttaatctgatgactacgttctatgacacatcttatttgtttaacaaaacagtctccaaccttctaatttcatccatcttctctgtctgcctctgcacttatcatgcttagcacacaaatagtaagaggaacaacaatgaaaatttggcagaatctgcttttttatactaaccataaaaaccttccagatttccaaatgagcatttgttggaaggaggatttctagggaagctagttcagagtgttatacaacattttgtcttctcgggggattttatttcttctattttgtgactgaaaaaatctcccaactcttcctattagttatgcattaccaaaaggctatttgaagatgaggcaaattttcattcactgtggcattgtccagtgatggtctcagtggaaaggggaggcatgagagttggtagtataaaatgattgcatagagcttttcaacacaagatttatgatctttggagatttataacttgaactgcttattaaatgatacgtgggagtttacaaaataatgttttgtgatcatttgggggataaacaagcctgagcaaagatttaaatttgtccatttgcttatcaagtttgaagaataagtaaaaacctgtggcaatgacattcgctaaggggctctaagtgtagccatataatgaatgatcttaagtgttatttagctaaattcatgctttattctataggcaatgggaaatcacatatttgtgtgggggagatattttttcttgttttgtttagattgatttttatgcagtgagttagcatgataaaatccattttaggaagacatttctggaggctgatctgtttgggttggagaaaggtgacgttagagagagttaaaagtttaattcaacaatccagagatgaaataaaggggtaaatgccattatctctgaaagagaaaggaagactataacgtgctgaattgttttcatgaaaaattgtttacagcttacccacaaaaggttgtctgtttctatcatctgcaagtttcattttcaaagctgacatagcataatcctcaaaatcctctgagttgagacattgaacctacatatggcaattaaaactacaaaaggtattgtccttgttgttgtctgtggtgagtacatgtaaagggaaaactctgaaggtttattatcccttgggttgagattcattatcattaaagtaataaaattatatttttgggatgggaagttaattatactctgattacatgtagtgtaggttttaggcacagagagactgagtcattttaaaaaggaactttagagaagtgtttgttcatatcctttggccactttttgatgaagttgtttttttctgtaactttgtttaagttctttttagattctggatattagccctttgtcagatgaatagattgcaaaaattttctcccattctataggttgcctgctcactctaataatagtttattttgctgtgcagaagctctttattttaattaggtcccatttgtcaattttggcttttgttgtcattgtttttggtgttttagtcatgaagtctttggccatgcctaagtcctgaatggtatggccttggttttcttctagggtttttatggttttaggtattacatttaagtttttcatccaagaagacatttatgtggccaagaaacatgtgaaaaatgctcatcatcattggtcattagagaaatgcaaatcaaagccacagtgagataccacctcatgccagttagaatggcaatcattaaaaagtcaggaaacaacagaggctggagacgatatggagaaataggaaaagttttacactgttggtgggagtgtaaattcaatcattgtgaaagacagtgtggagattcctcaaggatttgaactagaaatatcatttgacccagcagtcccattactatgtacccgaaggattataaatcattctactataaagacacatgcacacatatgtttattgcagcactgttcacaagagcaaagtcttggaaccaatccaaatgcccatcaatgatagactggataaagaaaatgtggcacatatgcaccatggaatactatgcagccataaaaaaggatgagttcatgtcctttgcaggaacatagatgaagctggaaaccatcattctcagcaaactatcacaaggacagaaagtcaaacaccacatgttctcactcataagtggaagttgaacaatgagaacacatggatacagggaggggaacatcacacactgggggcctgttgggggctggggtctagggaagggatagcattaggagaaatacttaatgtagatgacgactttatgggtgcagcaaaccacaatggcacgtgtatacctatgtaacaaacctggacattctgtacatgtatcccagaagttaaagtatggttaaaaaataaaataaaaaggtacttttatgtatttttctttcagttttataatttaatttagtaatagagtcatgaaataatatttggaactctaactccaaatatttgagtattaaaacctaacttctaacaaatgttgccaagtttcaacttcttgtcagccatatgagagaagaaaaatggtgctgccttgacaagctctggaagtgagagagggatgcttataaaaatcatatagattacaattctttcgctggaggaagagtcatactgatgacatgtttgaacaagtattgtatgtaatgatcgctgtagagtgctgttcataaatctctttagattccaacacagagaacgcattgacttcttagaaacatagacatgttactgcaggatatttacaatgtaattgttgcttaataactgccagattcagtataaacatcactgcttgagctacctcagagttcttgaaccgtacctactctaatcatctcagtatttcccatctcagcttacctcacaactgctacctttgatgcatccccctcacttacagaatgtttacttctgcttttttgtcctcatgactctatctcaaaaaactttattcatcgctcaagcctcagttcatccttcatgaagaaatcgatagccctaattagccatgagtgatatttttcttcttttctggataatacagctcactgattcatcaggcccaaatgtgtaccaaccatttacttagggatcttggtagaatattgcaaaagcattgatattatgagaaacgttttttggttttgtcacaaactgtgttgttacctgagactgcaacatgtgaggtgctatcaaaatctaaaatattatatagttaaataataaaatggaagaaagaaaatataaatctttgaacgatcccaaatttgcagcaagagactttgcctcagttgcaacagcaataactttatgaccttgaggatgttatgcagatctgttgatcttgttgtcctcatttataaaaaagataaaaatatcttgagtattgatatgagaattaaatcacatgaaatatacatcaaatcaatttcagcatctggtacataacagatacctggtaagttatggtgtactaattcataaattaacatttctttattttcaattttcaaaccccagctacacgtacaacatctggaaataataacagttttgatcacttgagcatgttttcccagtgagtaatacactgtatgtgtgtgggtgtataaactaatatatacataaaatagcagaaaatatatattctgaaaaaagttaacaaaaggaaaataaaaagtgacagggtatacatgtctatatttcaatattcagtagtttcaattcattttatcaacttattcacttatatcatatagctggcaaacaattatacttggaatgaaataaaacgttagttctttatttgattatactataaattttttcttcaatttataattttttgcaggaatttcttatttttttttaatttgttgttaggaactcttatgtgaaacatcaaggatgtttcttgacatgtggccatctgagtgagtttagtggtgtcaaatcttgtgttaattgcttacttcttatttatttaaataaatacatgagcattaacagttctattgttttctttctgtcatccccgtaatatgtgtttgcatacctatgcaaacatccaaatgggagtctactcatttagggattgagctgagtgaggactaaagagattagaaaataaaaccttaaggtaagagcactaagaaacacagaattttaagaaatgaaagagccagcagtatacatagcaaaaagaagttaagcagaaagacaaatggagaaaagattcacttatcctttcacctaaatttatctatatattatgttcacaaaattatttaaatattaaccatcccccagaagtgtatttatttacaaattttctagggtccaccttcaaaaaatgtggagccagtaaatagactacattttaataatcaaagcaaaggcaaagcaaagataagatatttattatcttgtcaggttcaactgacaaaccaggcccatctagataatctccatttctattaactcaaagccaaccaactacctgatcataggagttatatttcatcacattcatagggtctgcctgtgagaacctatcaagaggaggttgttatataaggtttgcacaccagtgggtgagaaacatggggagcatcttagaatcctgcctgttaaaatatcccagttaagtccctaactagcatttgaaatttttagaatatgtgttgtaaaataattgtttttccatagattaaaacatttaaagatcatatgtttcagatacatgataagttcatatataagtttcataaaatggcattgtgaatgactgtgtatggtgtgtgtgtgtgtgtgtgtgtgtgtgtgtgtgtgtgtgtgtgtgttactgaaggctaaaattataaactgcctgacaaaataagaaaaaactttcctattgcccttcaaactttcctattgcccttcagttcacatcttgaaaaggttcccttctttgaatcacctttagccgtgaccttgaagttttttcttgtggcagggtccaaaaattccacagatgaaaaacagagccctattcatgtaaactgacacgaaaccattcgtgtaaagcatatgtgtatgtcttacactttcagcacaattaacaatgaccatgtcatgcaattttgtaaatcataaatctactgaggtatgataatgtgttttatgaaacatacctatttgtatcttgatatcacttaacacagttctaatctatagtaaatatataaacagcaattaagttgaaacagaattaccatctgtaatttatttcacatatatttatatgtctattttacatgttaaatcacacatgatgctaaatgacgagttaacgggtgcagcacaccaacatggcacatgtatacatatgtaacaaacctgtacattgtgcacatgtaccctaaaacttaaagtataataataataaaattaaaaaataaaaataaatgtaggtgctttgttgatcgagtttaaatataaagtttatatttaaatgtagtttacatttaaatgtaagtgcttcattgatcataaacttatcaatgaagcacctacatttgaaaagtctttctacaaattgctttctatttgaagtaatctagtttttctctttggggtggaaatctgcttttcaggaaggcaaattattaaacttacacagggtggggaacatcacacaccggggcctgtcatggggttgggggagaggggagagatagtattaggagatatacctaatgtaaatgacgagttaacgggtgcagcacaccaacatggcacatgtatacatatgtaacaaacctgcatgttgtgcacatgtgccctaaaacttaaagtatagtaaaaaagaaataaaaaatttaaaaaaagataaaaaaaaataaataaatcacacatgatgaaaaagcatataaagttaaagcaatggaaagaaaaaaatgtaactggttttaggcacctgaaataattaaacaaatgattcttgtgcatctaaactatgtcacgcacatacactaagcatattgattttatgttttaaaatgtatagaaattgtctgtgatggatattaatatccttattttcagttgattaaattaaagcccaaggatattgcagaacttcccctgatagataattagtaggtgaaagaactgggacttgaacatagatatgcctgatctcaaagcctgtgctatcatcttacagaggttgccactggatgtgacctgcaggcactttccatcattacacttaaatctctctgatactctttttaatatgttcttgtttatgtatgtatttatgctttctccactagagtataacctccactgacatcaaagtccttgactttttttattgttctattttcagtcagtgcctggctcataatagaaattcagtaaatgtttgtggaatgaatgattaaagtatagaactatttttgaagctcaatttggctcttagtgttgaggcaatttaaggataacaaaggtaatttattagattgtctatatttcatttgtgtggccaaaaagggaaaaataaaaatacatttgtggaagcaaaagttactgcaatagttttcgataaaattatatttactctttagataacattggttactctccttagatcttagctatagttgcagttttctctcagtgaccccacctcttaccctgtaatgtagtgtagcttttttaaattaagaggttttatttaagaattaaattatgttgtttccaagggagcttccctagaagtaagcccattggtttaattctatattcagtgattaccattataaccccaaacccaagttttattggataaatctttaaatatataaacacaatttggtgtcatcttgaagcctatattttctcaagtatcttttctttccaaagcaaaacatgaatatagacaatttgttgcagaatcaggaggaccagagagaccttggggtatggcaggatctttattgagtgcactcacacccagcagacttaacatacaaacactgggctcagaacaaagacagcacttgacttttatacacactttaaaaagggggtgggctagcttgaagcaagcttacagttacagtggctcaaaagcaaggatacagaggcagaacaattaattaaattgtgacaggttcataactaaggattacacatgaccattgccaagcaatccagatgtctgttatctagattttgctttaaagagccttgcactggtttatcttctaaccttcactatggtgcctagacagctgtagttcaggcccactcaggcttcttatgaccttcattgtactttttagataaaacagaatacttgaagttactagttacagagaacaagaatctataaactcatattataaaacaaaggaaactttggttttcttctccctgtgtggaggaagtgctgggagaatctccggaacacattcctttgtgtcctggcttcttagatagtattatcaagacattccctgggtctgggctgtgcccattgctgcctctgggacaagttagcctaatacaggaaagcttatttctctttttaattttatttttttctttctttaatttcccacctaaaatttttgttatattttagctttattgttaaaaaaggagcattcgtaagaaacgtttttgcagcccctctactcagcaccttcttcatttcctttccttctcttctctctacctttcctcttatttttctatgtttggtaattgcatcactgttgattctgtgacataaaataatgtcagtgtcaactgatcataaatattgttttgtaaccattaatgttagtaatgacaataatcaaaggaggagaaagaaaaaaaggaacgatcactatttgttaatccatgctgaatacctgtttatgttttctaattttacccttaaattaattccataaagaagcagacccattttacagccaaagaacccgaagcccagcgaaaaataacttgatcaaggtcatcaatggataagtatcagagctaaaacataaagcaaagtctatttcactccaaagcacttttaaccaatagtcaaaactacttttatactacaacattggaaatgggtcaaatttgtcttgccttccttcacaacagttctctggaatttttgatagtctgtgtcctgtttgcaacagagtgagggaactctattagaaacccaccctttgtgcctcatcatattgagctctatttcagcaaaggctataagtttagtaaaaggctttattaaagcagaaaacctattcagtatagtaatgtggccttatctctggtgcctctctgagactcactaacaattttatgaaccatcttacaaaatttccacaatgcctgtgacgcacagaaagagtaaatttaaagttgctattcattgtaagataaaagtatcagaaaaagctacagctgccttctagacataaaacattttctttaatgttgaaatgtagtaagttttcattattcagatgatcaaaggcttatctcgaatagttggttgtgctagcattaatgaaatatattgcatagcagatctcgtagtgttttcctcatgacaatgacctcaagtgaagctttacacataaagaattttaggtcaaagatattcaagaaatacgtacattatatctccttcttagagatttataacatattgtgcattatgaagtgaatatcaaatttcataggtacatttgaattgctagcatgccgattaaaaatgcaaaccccatatttataggacagaattatcaccctggtgtgtttttttagcagtcacctcctgtgattatgtgatcagatcattcaagatcaaaactttaagatattgtataagatttctgagaagaactacaataaatacaactgtttaatgttgaaatcaatttttccctaaacttaaatgacaggaactccactcttaccaagtgcattttgggaaatcctacactatgcaaattactttctgtatgaacaacattttttgagcttgatttcttacaattagttaatttttcgaagggtaaatgcaagaataataaaaacagcagccaattggtttattagagcaaaacagagtgattataatatttccagagaaatgtgaggtttgaattataaatcatacaacaagaaatttttccttaggcggtgtagaagattcctctatgtatataaaggaatacatagtattaatattcagaatacttaaaaagtatttagaattaggtggttaagaattcagctattgatttttagtcttatagtgacaatctctctttttctgtatactgtaggcttatttagaagaaccaattgtgtataaaatgtgcctaaatgtggccatacaaagaaagcaggcatttatgaaaattctaaagtattgaactatttcatggccaatattttaaaattatttattacttatttagagattatatatcgaccactttttggtaggcatctagctgcgatctagtggagataaatgttgcccctgtcttaaagttattcacaatatattggggaggcaggcatgattacacatataaaaacaatggtaagtgttacagttgttataagcattacctttagagcatggaaggatgactgagtctgtctagtagtagaaaagataaattatggcagaaatgagtagctggttttcaggggcctgcagtgaaagaagtggggtagcacacacatgggcagagaaacgtacagatacatggtttgtgttcatttaagagcaatatagtgtgagaatagagggagcataaaaaataacctttaaaatctgaattagagtagatttaatctactataaacctttttatttatcttccactcagaatttttagagtttaaagtcaacttagctctctatcccctgattcatcgcttggaaataaacttatttttttgatgtcagtgggtcagtggtcatgaattttatatataattatatacaaatataataattatatatattcttttttgagacaggatctcactctgtagcctaggttggagtgcagtggcatgatcacagctcattgcagcctcaacctcccgggcacttcagaaggtgatcttcccacttcagcctcccaggtagctgggaccacaggcatgtgccaccacacccagctgcttttgtttttgttcttgttttcgtttttgtttttgtttttgtaaagagaatgtttcaccatgttgcccaggctggtctcaaactcctgggcttaagcaatccacccacctcagccttgcaaagtgctgcaattacaagtgtgagccatttcacctggcctaatgttcacaaatgattaaactcttaggctctgccttgcacgtggaaaagattatgagaaatataacaaacgcacacacaaatgcagattcttacactacatatgttgctgttaatttaaaactatgtatatgataaagaagaaaggaagagaggaaggaggaaaagtatcagtaagtaaaaaaagaaagggaggaaggaagagaggagggaaggagggaaggaggaagggagggaggaagggaaagaagagggaactaaggaaggaatgaaggaaggaagggaggaagggaaaaagagggaaggaagggagggagggaaggagggagggagggaggattgaatattttaaccctggttaaaatagaagtgaagcccaagtggaatcctttttttttttttttaatttatttttttttttccattgctaacacttcatcttcctttaaactggtgaagctaataagtaagatcagatattctggccagtaaaatgactgggatcttagttccagaaatattatcttttaaaaaagatactgaggattttatgcaagacagattggtggtcacattacttacattgcttcctagcttgcaatattgatgttcctgcaggcactctgataattgacatatataaatcacagagtctggatgcattgtagacatagtagttttataatcttttacttctttttaaatgttttacaggaaaataattttccattggaattgtacttctttgtagtagctgactgccataagcaccactgtgatccccaaaccagtcaggaatgcttgctctctccttgaaatcccactgctgtggtgattatttttgtccctagcttttgccctttcagtatggatcaaagtgatagaatcttctcaacaggaagaattcaagagagtgtttttgactcccccctccactttctttctttaacttcattgatgtatttttaattgctacttttgtaggagggcagaccgtgttccatgaagcacaaagaaagtcccccaagtaatgccactgcagaaaccgagcctatcccacaggtatgtgtttgttttatttcgtttgtgtcaaaaagcatttattggatccattgtatttatttatttatttttatttatattattttttattttttatttatttatttttttgagacagagtcttgctctatctcccaggctggagtgcagtggcgcaatctcggctcactgcaaactccacctccagggctcacaccattctcctgcctcagcctcccgagtagctgggactacaggcgcccaccaccacgcccaaattttttgtatttttagtagagacggggtttcactgtgttagccaggatggtctcgatttcctgaccctgtgatcctcctgcctcagcctcccaaagtgctgggattacaggcgtgagccaccgcgcccgaccagatccatggtatttaacactcttctctcttgctcttgctggggcaggatattgtacttgctagtactatatgtaaagccatggtgcccctgggcttttccaaggctgctctgctttctactaagcttttggcttgactatatgaggctctcagaaggtcaagggtgaggggagttcttcctcacttccaccctccctctcacagaccaggaaacaaaacaaaaataaacagggatgatcacacaggcatatatttctttttgtacaaaggagactaaagaggatttgaggaagcagaggaggtgaaaagaagtacatattacttacaagaacaaacaaaataaacacaagtcaagagcttaattctgaatttttatttgtactgtattatacttgaccaaaaatattgtatcattgacattcttaatatttatttcacttaatactaaaacgtggagttagatttaacttattttcaaactttgaattagattaaacagaattgaatggcttgggcaaagttttttcaaaatagtttttgaaatgttttgctgtttttaggcaaaatattgttatgtacttttatgaaatataattaacatcttcacatttgtttcatttctgtcctgtgttcattttctctaagatatttgttgagatctttgaatttccattcttattcttttagacttttcaatttttaccttaaaatgtgttattttgattcttcgaattgtcttttctgtattgtttaacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgacttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttggctcactgcaactctgcttcccaggttcaagtgattctccctgcctccgcctcccaagtagctgggattacaggtacctgccaccatgcccggctaatttttatatttttaatagagacggggtttcaccatgttggccaggctggtctcgaactcctgacctcaggcgatccacctgcctcagtctcctcccaaaatgctgggattacaggtgtgagccaccgtgcctggccagtgtgtttttttcctttaaatatatatggcattatacatccagcaaagtttactgtgttatactcattgcatcatttgtttaaaaaaaaaaaagaaacttgtagcaggagacatttaaaaatatatttaggagttccttttaataactaagttagagactctctttcagtaagttctatgactgtaccttaatgaatgcattttatttatctcaatttttatttgcttcaaaatagaatcggataagtttaaaatgttcctcttacatttgtgaatgtgtctatgagagaggggccatttctcacatattttaattaacaactaaataaacagacgttgttttaaaggaattaacacttaaatcccaaccatcctcatatagaataaaatatcaacctaaatctttactatagatagtataattctattatgtacctgtaatgataagcattgaaagattatttacattttgaaaaacatggaattgattcttattaagaaaaaagatattttccaatggagtaacttgttttaatagaggtacaaccagaaccaacaattgtatttctctatagttattttaaaatagtaatcaatgctatgtatttgatgtatatgtttctaaattagaaatttcttttggctttgtgtttttttaatgtgcgttaaatatgtaaactgaacctgttcctaaaatgcattaaacttgaatgctgtgtctatccaatgccaaaatgctcagaagaaaagtgaataattcagtcattcatctggatgtagttttctgtgtaatctcaaatatctgaatattgaaaaaactaggttgctaacttttttcattccttatgcaaatgtttagcatcatagtgctgtttcagatacagatctgtttcatcaaatatcctcaattacaagtctaagacagttatatgtaaagaaaatgtattattttagatgaacaatgtggataactgaactaaaacgatatttgtgaactttgctataatgaaatcttttatttttatagctcaggtattgtaattagcactaattgcagcagagactgaaataattattgacaccgtagagtaccatagagtaggttgaactggccagacctagacaatgaagaaaacacatactgtttacttaggagacattttcttagtcgtgtgtatagtcctaaatttccccaaactatgtgttcatttggattgtgttatataataacagtcgaatgatgaagaataaaagatgctgaaagatggcctatttttgttcaataaagattgttacaagaatacaatgtatattatcttacataaactaattgaaaaagcagatatgaacattaaaaatggtacttgcttctgtgtatcaggatgtaagaacttttcttaaatagcatcttgaaattttttttaatctttctttgccaatgaccccaaaatcttttattttgcaggtgctttctttaaaaaaaaaaatagagttccatggtcacagggattttgtcttttttttaatttgaatttttatttttaatttatgaattattgtgatgtgtaataggtacaatgtgatgtatctctatatatgaacacacatgtagcggaatgattatatcaagctaattaacatatccatcacctcacaaattaatctcaagtgcttggagctagctgcctcatacaagatgctcaaacatttgttgaataaattaatttagaggctgaagcagcaagggaacaagcaggggagcagcaagggagcatgtattggcatgagaacagagaaccataagaaccaaaaataagcattttgtttcgtttgttgctttgttcttagactatcttttttttttttactttttctttttctttttctaaaagctttaataataggcctgtggctgggattttctaagcagagtagataaggcactcctgggtaaattttgaaatgtaggtcaatgcaatagaaatatttcacgtggactttatgagtctttaattgacacccacttctgacacatacttggacatgcacaggtcacttcttttagcattcgtttcctaatctattgggtcttaagcagttggcttaaaacagagattttcttctacattctgaagagacctagccctttagtaaaaataactctagggctaccgagaggtaaatgaatatcaagaggataggctctagattctgtttgtttgtttgtttgtttgtttgttttttgagacggagtctcgctctgtcgcccaggctggagtgcagtggcgcgatctgcgttcactgcaagctccgcctcccgggttcacgccattctcctgcctcagccaaccgagtagctgggactacagggcccaccaccaagcccggctaatttttttgtatttttaatagagacggggtttcattgtgttaaccaggatggtctcgatctcctgaactcatgatccgcccgtctcggcctcccaaaatgctgggattacaggcgtgagccaacacgcccggcccaggactctggattctgtaatcccttcaactaagatatttattattttacataatttatttgttgggcttatataatctgcatatacttttattggagaaagggagtccaagtctaaagtgatttgaaagtcacagatcaagaggatctctatgatccctccttcccatttgttcattcagtcagccattcaatcactcactaaatattctttgagattctgatatgtgcctggcattctacttgttagaggatccaaatgtaagcaaaagtaatagttatgaataccaatatgtttcagttacactattcattcttttaggtgatttttaaaaaattattaaatattctcaggattcgttgaaatagatattacagttatcattatttcacggtttaggaaattgacatagagaagtagtaattacccccaaatcatacagctagtaagaggaagaggtgagatatggatctggaaatgagttactggaatccatgcacttaccaacttcaacatgcagcctctcctgcaaagcccggggccctgccctgatggaacttaaagtttaaaaaaaaaatggtttcaaaatatacatatatatgtataaaataaaaaataaaaaaaataggactcagaaaaacactgaaaaaaaagagagaagatgattaatgaaggaagcatacagataaatgcattactgcgacaaatacaaatgtgggttctctttatagcataccatagggtaaaggcaggagtatctgaatgtcttagctgtgcaaaggcttgatggagaaaatgatattaagctaagattaataaaaatatgatatttgtatggatgttcaaaccttcaaaaaggaaattttctggtattagatactagctaacaatatttgaaagtgcaaacttgaattcgcacaattagatatttgttaactgctgaatgagcatgctttcctgggccacatctctatcaaggatgagaacaagagaaggcacgctgtggtgggtcatgagtaaaatgtgatgctgacactctgcacataaaagccactaagaatgacaagtctgggtgattctgagaaagtgtaggataagtagtaacagtatgggtaaggggttgcggagaggaataaataatgaagaggaaattttaaattcctcgttttaatccctgaaacagatcttgctgaagtagacgggtcataaataaaaatgaattatttactagatgtgtttccagtcattactcattgaccatggaggtactttaatgaatattagcccaattaataactacaagtttgaaaagtgtgagatagatgataaatgttcttcagatcatcagaacttgagatcagctaggtgtgtccaaaaagtaaattagattatcaagttgacataattaactctagtacccttgaaagagaatatgccttctcacgttttattctccttggaggaaaagcaggctgtttgtaagtattcaacttaataagagtaagggaataagagggtggttgaggtttggggcagtataaaacctgagataccctcattttttctacgatgaatacatagactggtttttgaatgaggaattaggagagatctttctctataaacgttaaaaaacagtctgtcatttcctcttttattatgacttcatttggggagtttgcccctaaaggctttttggtttttgagtctccaaataagttttagatactcctatgatgcatttgttttacccattgacatggcatctgttaactgaaacctaataatttttcatgtatgttcctatggacacatatgtgcattgtatgtgcttgtgcatattcttgtttgcatatgcctattgtaggcattattatagggattccatacacatttgtgctctctggcatctgtgcacattctaatttgtggatgggtaaatttagcatatgaataacttcatatgttcacatctctccacatggatgtacatgccttcatgatgttcatcaatattaattcatcaaaacatacttacgttatacatacatgacacatatatcagttgaatacctttttataccctgattccatttacatgtttcatagtattttaacataggaattctaagagcatagtagataactgcgtatttatagttaagtgagagtccaataccgttgcagtgaacacactgctaattcatgctgtgcaatgaacacaccaaattagcataccacttcagttatttgatagggtagccatcctcagttgtcaagtacgcaggcttggctcatgtacctctttatgttttctcatccatttacacttagacctagaccagacagtgatatttggaactacttgctggatgcactaaggcaggggattcctgttggcatggttctgcatgaatggaacctcaaatggattttgtagattatcctcattgttaccaaaacattttttatttgaggaaaatgttgcaagtatttatactagataatatccactgtgactgtactggaacaaaggtattctgatagagaaaaaagaatgtaatcataaggtccaggaaagagaggtatttcatttatcttaactgatgagaatgttctaatgacaggtatttgctgtagaagtttctaggcctagcttaccctgaaatcaatacacttttgaaagtcagtgtctgtttgtgaggaaatacattgctaaggttttctcttattttctttataaaaaataaaattatgttactttgttctctgtgttttatttgaaatttgggttaattacttaatacaatccatgtttatagtgtacggaataaaatactaattaatccatggtagaattactaaggttaatgggcttttaattaagatatgatgtgatttttgtaattttattttccagataaactgaagttagatatgtctgtttgattcaaattatccagtttctatcaactccaactttaccaggtgacctggtacctaattattgttttccaacacatcataggatttaatatctcctactattccatgaaatatgagtaaacaatgcaaactcacaagtcattttttctaaaggttgatgcatgtactttacttgggccaaaggctagagtgggcattgtcatggtagacttttaaatgaaacactcagaagacttcctgacttggctcccagttttgggtcttgaaatacactattttaggccagattttctaaaggttacttcacttcatacatatgtctgaaccttgaggagtgtacacataactgcccatagaagtggtaaaatatgtttataagcagatgctttggaggtagactgttagcattacattttttaatcagttttttatgtttgtgtcctcaattagctaatctctgtgtgtttcagtgcttccatcagtagattgggaataataagatagcacacgtcaagataataataaccatttcatttaaatattaaatgagattatatgaataagacacacagtaaacatttaataaatgatagttatttctgttttaagggtatttacacatatagaaatgcatttgcaaatgcctaataagaaaattatcatgcatttgggattggatatgtgttcaatctgtgtgtgtgtgtgtgtgtgtgtgtgtgtgggtggggaggtgtgtgttccagggtgtctatatgtagtgagcaggagatatgatgtgtcttatttctaaataaactatattgtttattatctaaagaaaaagactggagttatctagttacccttatgttgaactcatatttcttaagattaatgagctaagatatgatgatcatccttgtaaaagccctgagtagtagcatgaagtgactctccatttatgtgctcaatattgtcgcactttttcttctaaaaacatctaatttttgtctcctgttgtgagtcacaaataataactaggagagcagaattctgttcatttctttcccaagattttataagaatgctttcatttcctttaccttctggcataaattattttctagattttgttttcttatctaatcttaagtgataataaataacatctgcggaaaaatgacaaattgattcattcttatttgcaacgatataattttagtaagatgtggtataggctataatctaaagtgatttgcaacagttcattctagaaattgagtagatatagaaataaaaagttacaagattcaatgatatttttattgaatagaaaaaaatttattctagtttttttttttttgctttccaagttttaagcatgtattggtctagtactagttttacagggacctttaaaacaccaataaaacgttaatgaaaaccaagcctcatttcagattttatggtggaaataattttacacacattcattactttttgaaattagattttgattctcaatagggaaatagaagcatcaatttcccctttcaatcttacttcatccttacttcaaagcttcgtggacctctttatgcctttcctctttcccattttttcttttattaaagacaagtgtgtgaaaaaagactccttcctgatacgccctgaaattcttttttgagagtgtaaatgagataaagtctttgtggaactgaaagctcctagaaagtttgagatttatatagccaatatacttttttaaatacaaggtttttacacttttgaactaccctaatagtctgctcaattgtcattctgtgacacctttgcccccgcagtctattcaccacataatgtccatactgattcttaaaaaaaaacaaaaaaagttacatcatgacaatccactgtttaaaattatcaaattgtttctaatctcactgagaactgtacttaaaagaatgaaatcctcatcatggcctaccaggccctactgtgcttggcctccctctcttggcctcatttcccgccactctcccaatggtttattttcctctaattacactggcctccttgctgtaccttatatttgctgaaaagctcttatatcagggtcttagtacttgatctctgactgggatgctgtttctttaactatttatgcagcttacccttctctgttctctactgaaatgtcactgcataagaaggattattcttgattactctacttaaaatggtaccatatccccaccactctcccgttactttgtttaaaattacttcgtggcattatatcatatataatgatatggcaacttttagcaaaataaatttgtttttacagtagattggtttaccagattaagaatgcaatcaccccaatactttaggtgacttatccaaggtacatgataccagaactgagatacaaatttggaagacagtgtagccttactcatctagtttttaatgtataccctgaaccttatcttagcagggttaggataaccaaaagagagttcctgggccatgccctagaatcactaaaacagtttttctcatattgtatcgaaggagtctactttttgtaagaattaagatgaacctacacaaactaggtttaaaagcactgaagtatgcctgacttactgcttatataactactattaacatctatagctgtccaatttttctcttatataaaatctaccttgtgaggcaaatttttcctgttccaatgtttttcattatagtacacataagatattatgacagatttttctaccatctcccaaatactgaagcttttcagcctgttgtgaagcaaagttgcttttttccccatttctggctacttcttatacagcaatcagcatgccagaccagaatttctcaccaaattggcaaggtaatggttttgttttccctctccactggatgtattaatataatgagcatggtaattgatggctgatagtactaataattattctaacaagaattatgtaattgactgtcatgcagactgatggtaataggatctccataattttaatttccattaaaagtagtggcaaaaaacacaattacttttgtaccaaacctaatagcctcttttggaagctattggtttcattatttttatgacattgttccatttcttttgaactgtaatcttatctccctgcctatcaggataagaggctttcgagtttggtgatagattttcgatgtgactggaaccttcatacatcttttagtagagaaacaaatctatggctataatcaggaaaagagggataaaggagctagaaactattggagctagaactttgcctccaccatcgtccaataaatgatgtgaagtaacaaatttgttattatcaatgattttaaaagaggttataaagtaacaattttcaatgagtttgctcctgagtaggtcattaaggaacctgaacttacccatgtctcgattatattatagtgttagcctcaggcctttacatgctttcaaagatcaaagagtaaagttggcctgattcagtgaagctgctattttgcatccctcaacaagcagcaagaattcaagcatttacttttatttattttttctgagtagtctctaagtcaggctaatagcttaaatttgtaataaggagataggaactaagggaatgaaatgcaaatcagaatatttcactctttattctccacttttccatcacttagtctccaaacttctcaccaaggttcacaatgccatacccgatctggcttctggctcaatagctgcatatcaggtacaaatatttaaaagtaaataacatcagttctgcacaatttcagaaaaggagcagaaccattttccatgtcattttatgaggctattacaacactaattcaaaaacaagatgaaaacaatacaaaaaagacaactacaaacaaatgtcccaaattattataaccaaaaccccctaaaatatgtaaacgaataaaatgtaacaatatatacagacaagaatataccatgttcaaatggagtttaccgcagatatacagtgatgattgactataagaaaagcagccaatttaaccttgtatactaaagtcaaaaagaaaaaaaaaaggccaggcacggtggctcacgcctgtaatcccagcactttgggaggccgaggcaggtggatcacgaggtcaggagatcgagaccatctggctaacacggtgaaaccccgtctctactaaaaatacaaaaaaaattagccgggcatggtagagggggcctgtagtcccagctactcgggaggctgaggcaggagaatggcatgaacctgggaggcggagcttgcagtgagccgagatcgcgccactgcactccagcctgggcgacagagcgagactctgtctcaaaaaaaaaaaaaaaaaaaaaaaaagtatatcaattgatacataagactatttcacaaaatacaatatctctttatgataaaactctcagcaactaggaatacaaggaaattattattttatagataaatgtcatctacaaaatgctacaacgaacatcacacttaatcattaggaaatgaattgtttattctaaatttggtagcaagagaagaatgtccacattttccactctcatttaacattatactggaaatcttcaccagtcaaataaaacaaaacaaacaccacaacaacaaagttaagcagattagaaagaaaaaaataatagtgtctctatttacagatattatgagtgtctatgtaggcaattccaagcaaatgaaacaacgacaaaaaaatctcctaataataagtgaaaattatagaatacaatgtaaacacagaaaagttaattttatttttgtatatgtaaatggaaatagaatgtttaaaaaaaatttccaatgaaaccaaaataaattgggcaaaaatctaagaaagtttgtataggatttctatgctgaaatatgtaatgtcagtgaaagaaagtaaacagcactgaagtacacagagaaacatactctgttcaatggtaaatctcaatataataaaaatatcaattttctccagattcatttataaatccatagttgtggctaccacagtatccatgagcaaataaattagcttctctccctgttcaaaagcagcagctagatatcctatttccttccaaaacacagagggatacaaacctaacctgactgcatggcaatgtcatgccagaactcactagtacttacagaaatgctataacctggtaaaattagccttctcttagacaaatgtagatttattacaccctctaacattctgatagtcaactcaaacttcctttgaattccaaagtgtttttgtttcaacttcctttcagctctctacatatccaatatatctgtcctatcttctatattgtctttataacacacaattccctttcttatatttattcccaagagtagcttaagaattttaagaatatgtaagaatatgtgacattttattagctgcttatagaaataattcatttttaagcatatttttataaattcacccagtgaaggcaagggaactgtttggcatgtaatagtcattcattaattatatgttggatgaaagagtgaatgaatatatattatatgactactgacaccatggaaaggaaatttattatgcagcaactcttatgggtcaagcatcattgatactattcacattatcattatgttttattatttatattatttgtacatattatattctaacatgaatatccttaaaaatatttgaaatgcatagagagtaactaacttgtccaatgtcacaatacct

SEQ ID NO: 319 - DNA, 704604 bp, Homo sapiens
agatattgctaactgtaccctggaggcaaaattgcccctgagaactactaccttagacaagaggtcagagtatttctctccagtattgcacatatccagagagcccctgtagatttaaaaaaaaaatgtttttgtcttccctgagccattactctgatccaaatgaacaaagaatttcagattttcccatgacatgaggggacgtgggtgagccagcacagagggtccttaaagatgcacaaaatggtaaatgctgaattttggtaactgggtgctactcacccagacaactcagtctgcatagcgactggaaagagagctggaggtgtctgcctggggcccagaactttttaaatcctcccaggcttcccactggcaatgctaattttcaaggaaggcttgcatcccacacaggacatttctggccttgcctgcctcctccaactttgcatcctcaaatgccaaattctcccactttgtagcttagcaggcagagaagcagctgaaaaccctgcgggctattgagaatgagtaattggatatcagccttaaaaataatcaatcccttccccccgcatcccttcccatctccatttcctctcttgcctccccctaccctcagaggtaaaggaaatcttaatcacttttagaccaaggaggcaaaatcatactatattaagctttttaagaaaaaatgtaaaggaatttatcccatggcagacaaagtacaaagtattaaagtataggagatacatacatctgctatgtactaaattacccccaaaattcatatgttgcaactctaatccccaatgtgactgtatttggagatagggcctttaaaggaggcagttaaggttaagtgaggtcatacgggtggggccacaatgtgataagactggtgtctttataagaagaggaagagaccccaggggtacgcacaaagggaaaaggccacctaaggacatagtgagaaggtgcccacctgcaattcagcaagtgggccctcaccagaaaccaaccctgccaacaccttgatcttggacctgcagcctccagaactctgagaaaatccatttctgttgttgaagccacacagtttgtggtattctggtatggaagccctagctgactaatatgctatagaacacaggtgaccctccatatctgcagattcgaccaatcgtggatcaaaaatatttgagaaaaaaaattgtctactgaacatgtgcagacctttttcttgccattattccctaaataatacagtataactatttacatagcacttatattgtattaggtattataagtaatttagagatgatttaaggtatatgggaggatgtaggttatatgcaaatactacaccattttgtatcagggacttgagcatctttagattttagtatctgcagagggtcctggaaccagtcccccatggagaccaagggatgactgtacaatttagcagttaaaaaaaaaaggcatagattcaaaagatgaattaagtgggagaaaataacaccactgaacaataggtacattattatgcacttgtaattttagaaccccacagacaaaaaacatacacacacacacacacacacatatgcttttgtgcattagcagatatcctgacatgtctggaaggagcgttccaatatggcaacagtggttagctctgggaagagactggaattgaggaagggagtggttaagagtttttatcttacactatttggacttttttaaaaaaccaaactaacgtagtatgcattacttgcatcgtaaaacaaaatattaagggtttttctgttttgggtttttttgtttttttggtctcaactgctcttcttagtcttctcaaagcctgaatcatgttcttggtgacacccacatcaggcccctcctgaaagtagcataaaatcatagagaatatggcattctttctggtttaaattctataaatggaccagaccatttcccactgtttcagtgtaaccatcaatgacatagtgggggaggggcacgaagaaagaacagtttcctcaaaatccaaaataaagctcattaataggaacaaggattgagacattttaattatccaggcatgcgcctgtggaatttctcatccattttaatggaatccaggaagggagagggaatacatttttaataaaaataaagagtgaaacaaaaaccaatccagacaaaatacaccaaagtaacaaaaataacccccatgaaatagatttcaaaaataaaactgaaataagttgaggggagaaaacatcatcagccagactcctggggtgatttcacagggcccgtgacagtgcacaacaattttgcacatctagctacaggaaatggttcccgtgttacaagtttccaataagaccagttaaaagaaagcaactggaaacaaaggtactcccagcccaaatgtgttctctggaacccaattgttggccctggtaggaagaataaataaaatctttgcttctttctaaaaaggagaggagcacatcattttcctttcacatagtttgtggtaattctaagaggttttaggatgatccacatgttgaatgtgggttgttctcactgctttttattttagcaatggggagggtcatttggtcccctctaaatagctttttttttgtctctcctttcttcctctatgggaataggcagtgagtttttctccctaaggctcacagacatatttcacttcttgcttctatttctccccatggctatggtagatctttagtctcatgggccttccctccatgcctggaataaaacacacacccttggccatgaggcctttgctcaggtcttgcttcctccttggaaagagctcttccttcttgcctcccttttttcttctatcaagattaagtcctccaattacagacactcaagggcaccacatacactccatagctgttaccacaatttaactcaattatccaatgtctgtctttcctggcagattctgaacttcaggaaggctgaagttttattgcttttgtttgacgctgagtgcccagcatcaagcctggaaaataatactcagtacatatttgttaacaaactgctttggcctgatttatatttttagaagacaatggagtgagttaaggtcagctaaggtataatttcccagggataagtggaaaatctaaatcataaaattcctcctagagggggtggctatagggaggactgtcaaatagatgggttggagagatagatgacattttcactagtcttgacacattctgcagccaataaaagagatactgtctagttctagatttcgtgactatctcaaatgtactcttgatttctcctttggtcccaaattagggctggtcatatcaatggtaccttctgggtcactggactggaccagtgttagagttgcttacataaatactagagcttctacgtaaatgacactttttgtcagtagcattttcccaagagtatttttcccctaaattttaaggcttgtatgttattttggtcataggaatgtcacactccactcattcactcataacacaattatttttcagccccaaagttgcctgctaaaattatttgtgggtagagatggggacagagacatcataaatactttggaaaccaagaacttgctagaaataattttccctcttcatgactgctgattgtcaactattcaatattctcttgttaacataccacatgttctatttaaataagaacataaaatatttctcaaaagaatttaagtgaaaaaatactatagcttaatcttgattaaatgatggtgtttctgacctgttcttgagaacaactgtccttattagtgaataaattcagtggtgacaggaatgtaaaacagaattcacaattgatatatacatgtccattatgtttatatttggctaataattttgtgcaagtaggaaggttgtttagtttactttcggaaaataatctcacaccatcttttctttgagctgctgcatcatcgcaaccttaaaaaggcaagcatagacaccttatgaagaaaagagaaagcaaagcagacacattcaatccccatcaggctatggggttaaagctgatggacaagggcatggctctctattaaaatcacctggggccttttataaaccccggctacacccagagcaaccacatcagaatctctggaagtgggcccaggcatcagcgcttttcaagctccccaggtgattccaatgtgcacccaaggtacgaaccattggttcagcggctccgctgagcctggtaactctcatctgatgggaaaaggtcccacagactgcaagcactttgctaaaaacagctgctcccaataaaagaatgcaaattctcagtaacatcggtgtcaccagaaaaaaggaggattaggagtcacaatttatctcttcaaaactatttaaacaaaccacttaatggtaccaggttttaaagtataaagttcttcactgcagcatgtttttgtaataacaattgcgtgtccatagaggattggttaagtaaattgtggtcaactttagaatatgcagctatgaagagacagcacaatacttttgtttactgagtatacaaactatgtcctgggcactactccaggaccttggaattcatcagattcaggacaaagattcttgccctcatgaaacttaatgaagaaacttattctagaagaggccagctacgtaactggcaagacttggtgcaaattgaaaatgtgggggtccttattcaaaaattactgaaaattcaagaccatgagagcagagcattaaatcaagcaaagggcccttctaagtgcaaggccctgtgtgagtgcacagtttgcatctccacaaagctggccctgattataaaggagacaggtgataaacaatagacaccttgggaggctgaggccggcggatcacctaaggttgggagtttgagaccagcctgaccaacatggagaaaccccgactctactaaaaatacaaaattagcctggcatggtggcgcatgcctgtaatcccagctactcgggaggctgaggcagaagaatcccttgaacctgggaggcggaggttgcggtgagctgagatcgtgccattgcactccagcctgggcaacaagagtgaaactccatctcaaaaaaaaaaaaaaaatagaccatgagtaagcacatagattacacaccacgttagaaggtgttgagtgccgcagtggggaaaagagtagaacacgggacacaacttgcaattttaaatagggtgatcagggtaggatgcattggaagaatgacaattgagcgaggatttgaataaagggagggagtcagccgtggatatctgaggaaagaccagtcccaggcaggggaccagctagagcaaagcccctaaggctgagtgtgccagagtggaaaagaggggccaaccccatcccggaggacctcagagcctactctaaggactttgacctttcacttgacattttaaaagagtagctctgcctgctacagggagaggaatctgtaggtggcacagggaaaaggcagagagaaccgtaaggaagctaatccaagagtgggggagagagaaggacaaagaatgggaatgagtgacgtataaaaggctttatttttatgtgtgtgtgtatatctatatatacatacatactcctaacttgaagaaatacccacaatatgtaaggtaaaggaacagttcataacatagtaagggctaatggcccattttttcataaaaactatatatacgtacacatatacccatacagttatacacacacacacacacacacacacacacacagaaagactagaaatgtcacgaatcaagctgctaataacagttatttctgtggattgggattgacaggtgtaaggaagaatgtcactttttatactttcctgaaatgcttgaatcttttattgtaaatatgcatttgtaaatatgcattcgtattgtaaatatgaattcgttttgtaaataaaaactgcttttaaaaatggggtatcataggattgagtggtttctttcttcacactcaaacatggggaatggctagcaaagactggataatacatagacaggcttctgtaacttgagaaagatgtggtcaacttaaaaaaaatgaaaataagattaggtttgaaacaaggatctggaaaaaaaaaaaaggctagtaaggtgggaatttgtaaacctgtagaaaacccagtagaatagtaaatgatggaccttacctaacagaagaaattgggtacaaagtgttctgcacgtattaattaaggtatagggaagagaagctgaaggatttaggttggaaataaaatgaactcttttagtaagaggaaggtaaacatgggcttggggacttctgaactttgagaactgcatggtacaggaggggttttcgtggtaacaattgctgccctggacagccccggtggctaactggattctttccacctctctccaagtccgctctcccatggtgctgtgaggccatctttctcaaacttaaacctgagctggtcacctctccctccccgaacacacacacagctcgccggaggccctgttaaaactcttcagtggtcttctgttattctgaagtctacaatctggaacaagtccagcctggcacaacccttattcccttcacaatgcaacccttcccttctagaccacactcccttgcacttgggcctttgctcagcctgcactttgttccttctttcactgattagcttcctcttccttctggcctcacttgaattataaccttcttcaatctggctaaatttcctattagttgctatcagaggaccccgtgcttctgcttggtatgcagtttgcaagcatttgtcttctccccaccaactacgagcacttgagaccaggaaccaggcatttctagcccccaccatgtacctggcacagagctgatcttcaataaatgtgttgaggaaatgagaaatagagtagcaagccttgcctattacacatgcaggaatgaacagcctttctgagatattttcccttcaattccacaatcttatgagaccaaagagaatttattctctgagggataaatataaagtacagcacttaatggagtggtgtttagagctctcagctgtgaagaccatgcctttattccctccagagacatgacaataaagacttttcagttaggtggaaaggtgatgcagtcaagggtagcagtcgcatgcaatacttgagtatttactgtataattcaacagttatcactactttgcttaaatccatgtacttgcaaagagatcttgtgctttggatccattggacacctaataactacactaatgaagtaaagccacactcctcttgcctctgacaatgaccacaatgcataaagacatcacttaggggtgggagggagtagtcaaacaattttcacagaagatccactcctgcaaaaaataccctaaatcattgtgttggagagggcatttcccttcacataagcttctaatgatttgtattgccaaagcacttggatctcactgtgctaaacatccacgatgctgatggtgttgcctcaaaggagaaatcgcttggaggaacttgaaagggcttttccttttatgattaatgcaggccaccaaaggtggtctcggattgcccccagctggaaaaatcctgacggcataattgagtctctgcacatttggtgtggctgtttatggcaggcaaagaacttgcatgacataagggctttacaaacagcttcaactgttggttaagccagggaccactttgagatgccatcttttataaaggagatactagggaagtgagcagagttcataattaccatcctggtgacaaagcaaaatacagcaaaggagatgggttggaggaaggcctactattcaacaaaatgccttttgaacgcccaggagattaggttctggaggaaaaccccaaacactaagtcataaaaaggaacaaccaaaaactgtgtgaaggaaactggaaagttattcaacactacctgatccacccccacgaacgttaggtcacttgagaatggttaactttcgtatctagtgtgacttgggagtatatctaattccacacacatctacctcctgaagttagacttagagatgactttgtctcagttttcacagcacagcattttggtttcatattcctcagcaatggttaagtgtagtattttgttgaatagtatgtactatactattcataattaaaaggccttcttccccattttaatagagtgagaaaataattttttcttacaggcacggtggctcatgcctgtaatcccagcactttgggaggctgagttgggcagattgcttgagcccaggcatttgtgaccggcctgggcaaaagggcaaaaccccatttctataaaaataccaaaaattatttgggcatggtggcatgcccctccagtcccagttactcgggaggttgagcagggaggatcacttgaacctgggaggttgaggctgcagtgagctgcgatcatgccactgcactccagcctgggcgtcagagtgagaccctgtctcaaaaaaaaaaaaaaaaaaaaaaaaagtttttttcatttattttgattggaaaataaaccaggacaacaaaaagagtagagtactcattgccacgcagaaatcttcctcaattaaaaaaaaaaaaaaagttcgtgtcatttactgaggactcttctgattgccaaagatgtgtatctattcttagctctgtgaagtatgtccttttacagatgaggaaatggaggcttcagaggaggttaaggaatgtgcccaagaatcacaccagaagtgatgaagctcttagcttggcaggatttgttttattatcagggttctgtgctatactgtgctgtgctgtttaaactttcatgtgcataaggcatagctgaggatcttattaactgtacattctgactcagtaggtctggagtagggctgagaatctgcatttctaacaagctcctcagtgatgatgaggcagctggtccacagaccacactttgagtagcaaggcactatgctattgcaatggcatagatcctgctctttcaacacaacggcatttcatcaagttggagtcaggggccctcaattgattacttgaccctgatacatttgagacaacatagagacaaggaagatatcaatccagaagcaatagtggttgtggaatgcatacatttccatgtatttttacagtaaaaatgcattaaaaaatctttcacaaaagaaacttaaaaaatacaattagggtgttgagtcctcccccccaacattctttcaggcatcaactgtgtaacggagggagacaaattcctaaatcgtttgatttcatcatacaaaatactcatccattatctctcatcaagacatttacattaagtgggggaggggggcggcgggattaaggaaagtaggctcacaagaatcagtttccaatttaaggttacagcagttcaaagaaaactatatctttctgcataatgcatagtccctgtacagtacaatatttccaaacaaatctgatgtgtggaattcaggtgaaactgccacaccaaaaagtccacggattgagacaagcccaggtgggtagcacatagattttaaattgccaaatatcatcttacaacaagaaggacatcaagatgttaacttcaggatatattcccaaaatccaccttgatttcatttatttaaaactctggatcacaattgagagcatcagtcatttaacatcacagattttgttagaactagtgagaagaatcctagcagtggagccctgggaataaaatctccaagtcagctcttaggaacttgatgaaaaagaacatcattattcagttgtactcttcctcagccttactacagctcaatgtatgctttgtatggaaaactttaataataaaaatagcattcacagacttttccctcctttttagctacagaatgtatattgtgtctgttccaggaaaggaacttgttttataaatgtccacacaactacagctactcattctaatgttatgtataaacccataagtcaaataaagctatgaacaatgtaatatttatatatgcatagtgttttataaaaagattggcccacatactgcttttcatcaatacagaaagagcattaagtccatagcacactgcaagaaataaatgagtgaagaacagagaatgcaaacaagtgcttaataattcacaagcaggctcaccatggaggaaatgatgatattcaaaccaactaaagctttagagaattacttatatagtctcccattttaaaacaactttacatacctgatttagtttacattaaaatatatccccatgaatcaatttgttccatattcagaaatataaacacgtatcacattcctcacagctaaattttgtcataaattctcttttatacaagaaaaaaaggcaacagttgttttcttttttttcccaacaggctctattaattacaatttttagctctgtacacgcaatgattggctggttttctttttttttttctttttcctttttttttttcttacagtaccatgggaacaacagtgattgacttgcaaagttttctgtctctatggaaaatgcaaaacagtactacagaaatacacaatgcactgtaagcagcggtttgctgtagtggtccaacaggtacaagcaaacattttggctcagctaggcagtaatccacttaaaccacatcccggggctacggccgacccaaccacagctcctgtgggatcaaaaagaatgggtctgtttaaaaataaaaattgttatgttttgtgctgctgtccaaaggactcaaaggacagagtcatgaggcagaagtttcccaaccagacctagaatcactgggaccacttccttcctttcccttctaccaacctagagacttggactatggtttcaaagtgaaattggcatttctaacaatgaatacccacagccctcacttctttaaatatcaacagagaggttccttccaccaaggctcattgcctcctccccagtttggcaaagggcaaccatgggcttctactaaaagggaggggggcatgctttccaaattggggatcttacgtcttcctcacaccaggcacactgtccccccattccatctactattcagcctccaatcagacgagacaacacgaaagatgcttgttgtctcttcctcgtagtaattgagcaaagctgtgatggcattgccttcaatgagattttatcagatgttggtgatgatcacgaacctgactgtctgtgcttgggctgtatttgagtaaaagtggccgacatttttgtctgtgtgccttcctgggccagggagagtacaaactgttttctgaaccaactataactcacaatataaaacttctttgtgctgcgcagtttagctataaatatccttcatttgcaatagtagtcttgtcatacagtttgcttacttttaggatcatcggcaaacctaatccatccccaagggtcctcagcttttacaaataaaactttgcatttttgctctttgcttttaagaaaaacttccgactacagtatagcactacatcactacatgacagtctatatcaaattaattaaacttaatcaataaattcccttacgtagagaaaatgatcaacagccccatttaaccaggagagaaaaagattgccccaaaacgggaacaattcttgacgattctacaggttacgtagaaacaaaatttatatccctttgggccagcatttggcaaataatttccaaaaaagtatgcatttaaaaatactttctttaatatgatacatcaggcacaatacttttcatatatattttttcttataagatttcaaatgcataaaatgtttgttgttattcataggatcatcaggtgtcagatgcttcattaggtaagaaactaaataatttcaggtttgtgactttcctcttagaacctttgacacggtaaaggttggaatgtgactcagcgtctcagatactgaggtcggtgctacattctttgtaaggtcgccttctctgctccgggggatgtctggaacttctgccggcatcctgtttcagattcgcctcttccctttctcggtggctggctctgtcctctctgttccttttgtccagggaccgctctctcctgcgctcgggggagcgtgcgcgcctccggtcggtggacttggccctgcgctcgggcgagccccctctcctgcgctcgggggacctcctctgctccaggagtctctccagagaccgtctccgccggctgggggagccgtctctcctgcgggtgggtgaccgctctcgcctccgctccggagagacgtctcgtctcttctcgtgcttctccctcctctccaaagtgttgtcggcgctgcgggtgccctccctccgcttctctggggaccgcctcttggggccgttggcggctgccgcgcgctcggcctgcgcgtccctccgtccctccggcgcccggtccttgggtcggcatgccccgctgtcgggtttcctcgaagtcccattccaggtgtggtgttcattgggttgtctgctatactctctgctgcctttcggatcccttgcgtgtgcccgcttttccccatgtggtgatgatttgtgaagatcgggtgggtaactggactccaatgacggatgctgccggcggtcgggcccggccctcacttccggaacaccttgtggaccggtggcggggccgtggcggtcgctgctggggtctgccaggaaaataaacgagagcaacagttgggtacgaaggtccctcggctcctgtccccgttcccacccacactcgagacctcattagtcacaacaagcaaacaactgttaaagcagtcagactcaaagccaactgaatctgttaacttaaggataactgcacgtagttagggttaaaaactagtacttgtggctttcagcgtctggctgactgaatgttctccatacccgagacatagatcattaaagaactgacaaaaatcagtcatgatttgagtctttaaaggcacaatccaaatagtctgtctagaggcatcaaaatttcctctctgtagctatcccttgttcttcctttcccacccccccaacccttttcccctgtgcccacccgtctcccacacccaagaaaatattctttgctttaaagaatacttgttttgatttacttaaaaataatttagggtattgatgtgaagaaggggcacctgggaagctttctggagcagggcaggaatcatctacatcttatctgggtggtgattaaatgggcgcatacagaagtgaaaaatctactgcactgtatattcaggatttatgcattttaccatatgcagaagtatacttctatttaaaaaaaatccagggtagcaggcaaaggggattacagaggcaacatgctggccagatgttgacgactggcaaatgggatatgtacgcaagggcccattaaactgtcctatctgtattattcaactacgttctctacttttgcacacattaaaaaataaggaactgtttttaaaaggtgttttctgatagataaaaggtaggggaagagaagctgctaagtacacatttgagattggatgggggtcaaataaaatttttggtttagaggcattttttctttatgacatgggaggcagtcataatgacatctaagagcttggagtcactgggctgcttcctataacatcaaggtttctacaggtttaaaagcagggcagcccataatggcccctatttatcattattcaatatttgaaatgacagtgcaaatgttttaggcagtgtcctgaattgaggagagctcttttcaaagctaggatgctttgttgcaactaaacccaacaagtcatccacatgacaccattccaagcaaagcacctgaaacaaggcactgcagtctggagggcagacttgtatgacagtcagagactaaggggtcactggggctctttaaggatctttcatgagccaacaaggtcaatatttagcaattaacctgtttcatgacaacttcccaaaacctagagtgggtttttaacaaaaagcaagtgaaaagccaaaagcaggggtcagccaactttctctaaagggcaatagtaaataatctgggtgttttgggccacaccatctctgttacagctattcagctctgccactgtggtataaaaacacaggcaacacaaaagtaatgggcgtgcctatgtgtcaataaaactttacttacaaaaacaggctatggacaggattgggcccatggactgcagtttgcaaagagatacctgaccaagcaggaaatctcgtcttcccatctagcaaagccctacgatacagggctccatgaaacaaggttcattctttctaaatactgggttggctacgagaatgaacaaaaaacaggttcttaacaaaggtcatgtgaagatgtggatacaggaaggcacttggatcaccagtggcttcttatgcctacttttaagacaagggaaggcaacacttcaacagggtcagcgttgtacttacaattcaaagaacgcagggtgctcagaatgaattgccaaacatatcaaaacagagctaagcagaagcaatgaggaaattaggccacagcacagaaacacctagtattgattgagctacaaaccgtagtttgattatggcccataaggtagaagcaagcctccccgagcttttcatttctcatacatgcagcgatattaggaggtatcatcgctgtggaagggagggcccagcaccaagaacagtcagagagaaggagaaagagagaaagagaaaaagttgaacatttagattccctataacacagaggaaagaaaaaaaatctacatttgttaacatagggcaaagagagtttatttgtccagtcagacagtctaaggcaacactcaaataaggctgcagagaccgcaatcggaacagtgacatttttagacagccataaggtgactcgagaacccagacaacgaatgcatccttttttgttttgttttgttttgttttttcaaacaactggaacaatgacaggctggcataggagagcattaacaataaacaacaaaagaacaaaatcccttcccacccccaccaaagaccgcggcagttaaattaagtacaaaaaactcattacaaaaatagcctcacagagaagcaggttccaatcaagtcagaaaaatattggaacttaacatattataacccatttgtgactctaatcaatggaattagagagatttagtccaagtgacgcatggagacattacagtagcacaaccctgtggcaggttcaacccttcttggaaaaccatgtatttaaatgatctttatttttagcccaaagaacatttgttagtgttggattttcatcctcagtgcaacagacataggttttgagaaggtacacaggttactgacgatgactctcaaatgaaatatcacatccaacagaagcatagggaagacagaaaagggagacaatgttacacagtttcagtggtatcaatacacctaatggtcagaagttcagtacagtgcacagccacggcatcttaatgttgtcaaaatacttcccctgtggttggccatgtctataggggccttgtctaatacccaccctccccctgtacctcggacccctcgtattttgcacctgtacaaatgtcgaacacctgggaaggctggccctccaaggagctatccttctccttgagctgcatctgaattaaacatctcatcaagtccaaaatgcaactgagaattgtgcagaatgactttcagaaaagagggtgataatagataaatccctaataaaggggaccaacgtatctggggaccattcaatcacagtttctatagaaactttggtagacctttggttgggaaaaaaagccctacatctagggcatagcttcttctttttttttttttttttaattttaaacacaaatctcaaataaataggacataattattatcatatacaatattttgccatcagaacactaagctatgtaaagatcattgctgtctactcaaatcaagtctaaagatatgacaaaggaactctatgtataacctggctttcctcataggaaaggtatagtcacatgtttccctcatgatgagcactgggaatttatttcatcctttatcatttaaaaacattatggctaatatattaacagtttttgtttgtttgtttgatagtagtgggctcagatggtctgatttggggtaagacaccagttgggggatggagaagtgttgtatacagagcataagggaggttagcaaagcccccaaatctctcaaaatttcatgcctcttaaataaagacaccaagtaaccaaaaaggaaaaaataattgtgcctcaacatatcactcaggaaacctgctttcctgcttcttaaaaggagtatatagtcattttgtgctaacaattggatctgaggaacagtttggcacagtacaaacaaacattccttcgctcttggtcggactagacaaaacgttctctctgattatcagaaagggggctataaagatcttgtcttaggccatgccccagtccacgtaagcaagcaaaaggatgaaatgtgtagagatttcagaacaagcgaggcaaataatcacatggtgcgagaggctggtaagacactggtgaataggggaaacaaaaaagactttcctgctgccgttctggagacaaattcatggagtcatgccagggaaggaaggaatgttttcatagtttgacccaccatattctggtactgagccgtctccccgcttcagaaacagacgaactctgcggccaccattcttaatcagttctatagctcgagaatgcttcatgtttttggtggtctcaccattgatctctaaaatttcatcaccaatctgccaaagcaaaagaaaactaagtgagatttgaaattcatgtacggattcaccaaatgtttattaagcacgtggcagaacatctattgctttggaggtggcagtgacaaaaacaaacagaaatccctgccctcatggagattatattctaaagagggaaagacaattaagaaaattagaaaactacatatatgccaaatcacatgagaaaggggggaaaaaaagcagtaagggcatgttaatggttggggtaggcagcttttaagaaggctcccatgatttctgcctccttgcattcacaacctgtgtaatctccccctgcctttgaatgtgagctacgtcaagtgacttgcttctaataaacagaatatggcaaacatgatatcagttcaaagatcaggtcataaaacgattttgtcatctgtcttacttgccctcttttcttctctcacttgtttgccctgatgcatgttatgagctatcctctggagtcccatgataatgaaatgagggactgccctataaggcactgaatcctggtaacaaccacgtgagtgagcttaaaaagcaaacccttccccaggtgagacttcagatgagaccataatcctgactgatgtattgaatgcagcattcactttgtgtcagccactattttagacactggaaataaaagaataaataagacgaggcagatccccactcaaatagagcttatattctaaaaagaggaggaatggcactggctttcaagtctacagtctttaatttgaatcctatcatttggtaactgatttgctcccagtactttaacttcctggagtctactttcttacttatagaagaggctgataataccactcacacctaccaagctgctggcatcaaatcaggtaatacatgtaaacctgtcatgtaaactatacaccattatacaaagtagcataataatatttcatttgattaactttttaaagagattaaatttttaaagtaatttaaagtaaagtaatttaaagtaattaactttttaaagtgattaaaaggcaagggaaaataaattccttatatctgaaatttcaaacaaaaaaaatatgtaccaccatgtatctccccttgaatatatacatgcaaaagaaaagaatatgagagaaactggtatactgtttggccctggacactgtatttttactacatttttcactgtttaattttcttaaaacacattcaatgctctaccttctcaattttaaatgttaaaaaattcatgctgaacaaacttaaacatcaagattgtggcttaagtgcaagtgttacgatcctcacccttaatcagtttttccctttttctgctcaggcccaactgcattcacttttttcctttcctggcctgactgtcttgatttcttttaatttgttgtaaatggctctccatgggcaattcccaatctatgtgacctatctatgggtagatgatttatgttttcttaatcatctaatctgcccaggagaacagcacattcatctacagtaacagatattagcgaaacagagcagagtggacttttggcatttatgtattaaaaatctgtagctcttactacagagcaactctgaatattcatgccacagagccctggctctttgctaaggcagagagtagacttgctgtctctgagcctaaggtaagaccactggtaaccagctagaggataagtagacctcactgcccagaatctacagggccatatggctttcctgctttctaagcatcccagggtaccccagaattcctgtcaagtgatgtgcctgccccatgacattaagcacaaaaactatagaaatgggctctgaaaaatatctactttaatatatttgaaagtaatttaaatcctttattccctatatcaaccccaaagagttggaagtgttcacctaactttagcagctataattaattgtgctttaggcagaaatatttggtagggtaggagtcatgcacttaagagaatcatgaaagctatagaaaatgtagttcttatgaacatgaacattctaaccatatatgacaagaattcactgcagatggtttctttgcacctaccccagactcctctctccacttaccctcatctttccacacctctccgcaggaccgtcctctgctaagcgcagaacatagaggtccatgttatactctcggcctcctcgaaggctaaagccaaatcccttggctcctctttccagttccacagtgtaaaaatcttgctcctatttaaagaaattaaatgcaatcattctaggagaactaatatccataggactcttcctaaacattcttggcaaaaaggcacaatctctatccccctcttggtgactcttgtttattaataatcttgattcatcctcattaatctcagaagtcacagatccagaatttgaaaacagttatgagcatgtctatatgcatctgtgtatttattataacatgtggattaaaatttaatcagtgaggctgtgatttgcatttggggaaggacaattcctcattacatgataccagccacctggctgctggatgcccagcctccctgacctgtgtccaataaatgctggctgtgcccatcatgaggataccaacaaaacctctccaaatcctgatcaaggaaaattatgaagggataactgaaagcccccaggcaaccagtaaagaaagaacccagctggggacttgtaataccagctactcaggaggctgagacaggatgattgcttgagcccaggagtttcagtccagtctgggcagcacagtgagacccctgtctcttaaaaaaaaaaaaaaaaaaaaaaaaaaaggaatctgtttaattttgcatcacccaaagttcctcaaatttgtttcacctgctagtattttcacactctccctcgccatcctgaggacaggcattttgctctatggatctcaccttaaattctcaagcctgaaaaacaccttatcacaaagacattttcttggcagaagcatgtttatgaatactatgagtagatattggttgctttgctttctctaactgccgatccttgtgacaattactgcttttcattttttttcccctagaaaaggctatctaggaatattttaaggtagtaaaataacatgttatttcctagacaatcaaatgtaagtatacgtttggtaaatcacctcacaaaaggttatttcttttaaattaaaggtgcttcaaaaaatatcccataaaagtagcttgagaaagttggaaggaaacgtgcaaagtatagagaaaaaagagacatggtgctcacctgtgttgcttggggtgctttgaactcaaattgagattcctgctttggtttggtggtattcctgccaaagtgaaagaaataaatataagagcaacccattagcaaactgagaaagaatcaaggacatatattgtcatgctgggagttacttttttcccctttaacaaaggaaaccagtcatgtctgaccttgtctcctgggtcccttgctgagaaggggtgtgtgtggtggtgatggtggcaatcttctctgcattggtcagcaaggtggcattcgaggactctgcaaagagggacagagcataaagaaatgaagaccccagagaagacatcctccagccaggaggtgtgcagaagccctgtatctgaataacaagtgtgacttctctgtccccatttcaagcagtctgacttgaatttctagacaattaggagtttaataaaccattttaagatcttctctgatgtgggtcatgtatgtccccatgaccctcctcccaaacagacatctccacaaataaaacagagtttgccaaagaaaacactgctctaaaattctagccaaggtatatgtttctcactcctcccctgccactgaaaaaaggcagtcccatcaaagtgctgcaccacagcagaattctcttccagaactttaaagtctgataattaatgtctctaccaatgtttcctgcaatttatcagcaatatttagtgagtcggcttaatttcctcaactgaatattaatatcagaagtgtactaacaacttgttaaacacacatataatatccactttctttcccactgcttttaataaagcacaactgaaaatatggaactcctgacagatcttgtttggtatcactcatgaaaagtcctatagtaatagctatatgttctttactaataatttcttcattaagaccaaggcaagtagcaaccaactatgagcaagttgtatttttaatatttaattgtaggttgactgaaactcgtcatacattttctaacaaagaaaatgctaaatgtggtgttaggttccattataagattcacctgtgcatgcccatttaattcagtgcaccatcaaatctagaagttaccaggagacctatggcttatagtaggcactttcgtgtttactgaatacatgtatcttcccatcacatttaactattatatgggaaaatatgttaactattccaaactgagatacctataatatatatctttccactggagtcctggaacaaaagacatcccacaaatcccaactacctgtggtctatcttccatttacatttcccaaggatcttactcagctttggtccggcttcctgttattttattttcatgacacatagtggttaaaagcatgggcttgagattcagacctgggatcaaatcacctttttttcctactcattagctgtgtgccttatttttctcatctgttaaaatggggtgatgacaataattcccctctcatggataaaagtatatgcaatgtttaagctctgtgcctgacatacaataagcactcaatacacatttattacagctactactttttattactatgagaccttgtataagttatttaagctctctgcaaaatgagaaagtcgaaatatgatttcaacagttaatttactgcagccataaaagcccattattcttctagctaaggcacaagagtaagaagaaaataactaaatcaagtgaattgttaggtgaatcccattcatgttttgggacaatgtttcccaaaatctgttttaccaatcatttcctatgcactcctctgagtctttactacaccaatatgcctgtgaccgtccaagctggggaggtggtgtttctcaggcttactgggagacagtttagcacaatggtgactaggtcagattctggagtcagactgtcttatctgactttgcattctatgctcttcaatttcctggatgggacttaagcaaagttacttaaattctcagtgcctcagttttctcgtgtgcacattgggaataagagaattatctaaggaaattggggcaaagatgatccaagaagattgtttggaatactgcctggcacacaaaaactgctcagaagtgattagcatatttttggtaccatgtgtttattattgtcatcataatgttaaaagcatattgttcgtatattttaatgacgctattttaacagcaaattattttcagagcttttggaggaaaactagctccttcatatgactcccatttgagggcagttaaccagcagaaccaaggtgatgaatcagtgatattttataaagtacgctcactgtgtcactaaataggacaaacaagctgtatagcccatcgctgtgactctccagaactttcataaacacgtgtattggtcctttagcaaacttcatattgctcattgcaattaattttatggagactctcagaaatcaccaggttgttcaggccatggggaaatcacaatcaggatactaaaaagaatgtctccttgtaatcaaagtgattataatgattgaattgtacagaggttcctctttacagttcttgtgtgttgttggtagccagagttttctgagcagatcagattccattctcaaattatttttatttttctgctgctttcataatttgatgagataatcacccaatacacagaattcctttattatttttattcccatcctttatttgctattttttttcctcatctgtatgtctgtgaaactcttttttgggttgaagcttaattttaagcatagtaaaattaacatttagcatggaaatgtcgatttgaccttgctgaattttcctcatttgttgtttatcttaatctatgaagcaccaccatttaaggatggtttaaacgtgccaagcactgtgctaagtccattaccacatacttcatttgactctcaccactcaataaaataggtgcaattatggccccagtttacaaatgaagacactggggtgtagaaaatgtaggtaatatgtctaaggtcactcaggcagcaggtggagatactgggaattaaacccaggacctgcctgacagtgaacttttagtttttggtttacgtaggaatcatgtgttggtattgaggaaatcatatctaattggaacattcctttcaaaaaagaaataattttattttactgtataaatactaccaacctcaccaagcagtatcagagatgaattaaaatatgaaacaccctgctttgatggctagattttataagccatcctcagagcagcaccaaaataattttaggtataccctagatttccaggatgtttttatactatcaataaagttatgcttgttttaatgaacttttacttcttcatttggaattaaaccaggattgtatttgctgaaatgctctctagcgctttaaaatataaagatgagcccattataaaaaagagctttatcccaaagcaaaattgactacttacggtggaaaaaatataaaagaagggcctgaaacaagagtatgagtctccctgccctccagaaacagtattagaaagaggtgtcaatgtatttgacttttaaaactgcaaggcacatggacagattaggtactttatgacaaattccagaaagtacccaacatcctttattaaacagtgtttatacctactttagctctcccagaggagtgaaaatggagattactacactttcaatagcagtcatgtatcaagagaagcaaatcccagctctcacagccctgtccagggactattccaaatctcggcacttactcttccaacagcagcttccatcttgggtttcaacctatctatctgtgacaagcaattacaattctaaccttgttcccatattaatatcctcagcctccccttacggaatccacattgaaagccaagcaaatcaacaaaggatacaattattcctgttgtaaatattttactggataaacacgtatgtaataaatatctaagggcggcatggggaaatttgaatcccataaatatttgaaaagttttgggggactttttactattctaatgcctttgccaaggaaacagcaatatctatatgttgccaagctctacctcctacataagcaaatactttgaatcagagtgatctgaagtgcaaatttaggaccattattcaaataaagcatttttaagcttctaaagattttcattatattgaacttgattcaatctgatggttccatgttacctggctcagggagcttctgtccttgtctgattaaagtctctctcccactccatggggcatctccatacaatgcaaatgttgtttgacttcttagatttcaagttcagattcagtaagttcagctattctctgggcccttctgtgctgccattgtgtatttattcattcatcccttgcccatatctcacaggagagaaggttctgccctcccccattgtccaccctggtcccaaagagaatcaaagcaatgaaggtaaggactcccccaaccttggcctgaccaaggctgtgaaaacactcctgccagaccttctaacatacaataatgccaaggaaagaggaatcacgttttggaggttttgttggaaaagtcagagaaaaatgtgggaagcagagtgagggaaactaaagactgagatgagtgaaactgcagaaagaataaggctaccgatgacaagagcaaagaattagatagcatgaactagacatggaaatggactcagagtagactcacgcactgcacaaagggcagagcatcttttcaaagggcctgctggggtttcgagaacagtgtcccagacgtgatggattctttttttttttttctggagacacagtctcactgtctcccagcctggagtgcagtggtatgatcttgactcatagcaacctccgcctcctggtttcaagcaattcttgtgcctcagcctcccaagtagctgggactacaggcacgcgccaccatgcctggctaattttttgtattttagtagagacagcgtttcgccatgttgcctgggctggtcttgaactcctgagctcaggcattctgcccaccttggccacccaacgtgctgggattacaggcatgagctaccatgcccggccccagacgtgatggatttctaagagcttagaaaccactctgagttaagaccttcagtctccttgtagatatcatgaaacaaatggtttttgggccacttgatgaagtaaatattcgagtaaaaaatctgaaagagacctgaggcataggcacctccattttaccttggaatcaactatgtccaacacgctttcacagaaaggaagtggatccagtgtgattatctcttcactgaactgtaatgctcactctttgtcttctgggggtttgcaaaatcctcctggatctcccacatcttttgagaaatctaactcccctgcttcaactctaatttccaaaatgctgtttctcagacccacttaaaataggagcatcaccatgaacccgggaggcagagcttgcagtgagccgagatcatgccactgcactctagcctgggtgacacagcgagactccgtctcaaaaaaaaaaaattgagcatcacatattcaccctctgccagacttgattccctttaccgggcttctggcacttacaaagtaactagagaagaggcttattatcatatcaaccaaattcctgaaacatcttggatgaaatcacatgctcagcagaacatgtattgccttaaaaaatatcaatcctcaactatgttgtaccagttttatgtttacttgtttctaaccaaggtagcacaaggtgtctatgtgaattttatatttcctacatatttaaattttaaaattgcctttataatgccaactgttattggataatccaccttgcatgataatttttggtgttcaggcttaaaagttttttttccagggtattttattttgtttgttctgagacatggtctcagtctgtcatccaggctggagtgcagtggcatgatcagggctcactgaagctcgacctcaacctcctgggctccagccatcctcccgccagcgtatcctgcccgttgccccaaatagttggactacgggtgcaagccacctctcctagctaattgttttgaatttttagcagagacgacgtctcgctatgttgcccaggctggcctggaactcctgagctcaagtgatcctcctgcctcagtctccacaagtgctgggattacaggcgtgtgccactgcacccagctgtgtattttattaaattaagtcaacatctactatctacactgcagaataagtcgcttctgagtatttatgtctttactgacttcaaactctttttctaagctcttcactcagggagtactttctttccttcttttggatgttctcattcccacaataagattgaccaattataaacccagcaagtcaatccctgcgtcctgttcttttgggttagtctgtttgatatctttccatgacatgttgataaacgtgtctaaatccatacacaaagcatacctcggagatatcacgggttcagttccagatcatggcaataaaaaagcaggtattccagtaaagtgagtcatgcaaattctttggcttcccagtgcatataaaattcatgttcacactatactatagtctattaagtgtgcaatggcattatgtttaaaaacactacataccttaattttaaaatactttattgctaaataatgatcacctgagccttcagtgagttgtaatctttttttgctgatggagggtcttgccttgatgttgatgcctgctgactgatcagggtggtggttgctgaaggttgggtggctgtggcaacctcttaaaataagacaacaatgaagtttgctcttccttcaatgaaagatttctctgcagcatgttgctgtttgatagcattttaccctaagtagaactttttttgaaattggagtcaatcctctcagactctgccactgctttattaacttaagttgatttaataatcaaaaccctttgttgtcatttcaacaaagtttgcaacatctttaccagtagattccatctcaagaaaccattttctttgttcatccataagaagcaactcctcatctgttcaagttttatcatgagattacggcaattaagtcacatcttccggctccacttccaattctacttctcttgctatttccaccacaaaggaacttctgcagcttcttcctccactgaagtctcgaaacccctcaaagtcatccatgaaggttggaatcaacctcttctaaaatcttgttaaggtcaacatgtctcccatgaatcataaatgttcttaatggcatctagaagggtgaatttttttccagaagattttccaaatctttccaaatggattttccaaatccattagagccatcactatctatggcaggtatagccttacaaaatacatttcttaaatagtaagacttaaaagtcaaaatgacttcttgatccacgagttgcagaatggatgctgtgttagcaggcatgagaacaacattcatttccttgtacatttccattagaactcttgggtgaccaggtgtattgtccatgagcagtaatatttgaaagaaatttttttcccctaagcagtaggtctcaacagtgggcttaaaatactcaataaaccacagcacaacatatgtgctgtcatccaggctttgttgttccatttctagagcacaggcagagtacatttagcatcattctgaaaggttctaggattttcagaatagccagatgagcactggcttcagcttaaggtcatcagctgcattagcccctaacaagagagtcagccagtcctttgaagctttgaaactaggcattgatgtctcctctctagctaggaaagtcttaaatgaccatcttctttcaatagaagactgttttgtctacactgaaaatctgtcattttgtgtagccaccttcatccatgatcttaataattaaatccgctggaaaactagctgcagttttatatttgcacttgctgcttccccttatacttttatgttacggagatggtttatttctttaaatctcatgcaccaacctctgctagcttcaaagtatcttctctagctttctcccctctctcagcctttactgaattgaggagttaggaacttgctctggattggactctggcataagggaatgttgtggctggtttgattttctatccagaccactcacactttctccatatcagcaataaggctgtttcgctttcttaaaatccatgtgttctctggagtggcacttttaatttcctttaagaaattttcctctgcattcacaacttggataaatgtttagcatgagggatctagcttttggcctatctcagcttttgacatgccttccctcactatgcttaatcatttctagcttttgatttaaagtgagagatgtgtgactcttcctttcatatgaagagttagaggccattgtaaggttatttattgtcctaatttcaatactgctttatcttggaaaagggaggcccgaggaaaggaacagagatggggaatggccagtcagtggagcagtcagaacacatatgacatttattgtttgtcatcttatgtgggtatggtttgtggcacccccaaacaattacaacagtaacatcagagatcacaggtcatcacagcagatataataataattaatactaataaaacttgaaatattgtgagaattaccaaaatgtgacacaaaggcacaaagtgagcacccgctgttggaaaaatgacactgacagacttgctcgaagcagggtggccacaaaccttcaatttgtacaaaatgaagtacctgcaaagcgcaataaaatgaagtgcaatgaaaggggggatgtctggaccgcatttggctctctcaatcacttctcactatattttctggcttccttcatccttcctattaggaacctatgttctatcatcttgtgaccactttcctaaattgtaacagctttccagagtggtgaattggtggaatgaactccagaccagttggtaagtgactaaccatgcatttgaaggagggtcaagtagatcatcattcaagaggccagtgttttcctccacatttagtgtgggatatttttggtgcagagaaagttctctgttcttggaatcaacaattttaaatttttactgtttggttttgcatttaccttttccgtaaggcaccggctatacctttcaaatcttgaactataaagttcactttctagcagttagtatataaaaatactcatttggtaaataactttcagatgaaaccctaattttcttattttatagatacatggcatagagtttttatcacactatcttcataaactagattttttcttgagaaatactcacttttagaatatatattttataacatgtatagcaagactgaaaaaagacatttaaacattttgggacaagtgtcaccttcctcccaagagcaaagtcagcttagaataaagtgaatattcaggaactaattctctaaaggatctatacttcctggccttagtgtatcaacttaactttttttttttttttttttttttgagatgagtctcgccctgttgcccaggctggagtgcagtggcgcaatctcggctcactgcaacctccgcctcccaggctcaagcgattcttctgcctcagcctcccaagtagctgggactacaggcatgtgccaccacgctaagctaatttttatatttttagtagagatggggtttcaccatgttggccaggctggtctcaaactcctgacctcaggtgatccacccgctttggcctgccaaagtgctgggattacaggcgtgagacaccgcattcagcctcaacttaatttttattaaacatgaataatacaatgagtattggtattttgtgctgggtaactttttattgtgagggctgttctgtgttctgtaggatgttttgaagcatgtctgacctaactagatgctactcacacccactgcagacaatgccaatgttccctggggggcagaatcaccacttacataaaagaaccaaagatttgaatttaactaatcacaaaaacaaataaggacaggcctagtttaatgcagatacaatttatcaaaaatatagagatttcattctttcttcattcacatccaaaaattagggaaaatccagtagacacaaactcttagattctcccattaaatgaaaaactttgatatattcacttattctaaaaaaccatagtactggctctgaattgccaccatgcaggttttctcatgtcaccatataatacagctcatattatacatatcagaggatctgtaccacctgtattaaaactattttatagtgttgaagacaaggacacaaaaagctaaataagttgaggaaagggtgaagatttttctgaaactttttttttttttttttttgagatggagtctcactctgtcgcccaggctggagtgcagtggtgcgatctcagctcactgcaagctccgcctcccgggttcacaccatcctcctgcctcagcctcccgagcagctgggactacaggcgcccgccaccgcgcccggctaatttttgtatttttagtacagacggggttccaccgtgttagccaggatggtctcgatctcctgacctcatgatccacccgcctcggcctcccaaagtgctgggattacaggcgtgagccaccgcacccggcctgaaacttttatatttgcagcaacacagggtcacagggctacaggattaattacacaagagggtgaggtatgggttagtaacaatggctcacgtttacctgatgggtatatttagttagggatgaataaagctgccactaaattaatactattcagttacacgaacactaatcaaagagagagaaagagaaaaggaaaagacagagacagagagagagaaaaagagagagagagagagagataataggtatactttaccatccccaggaatgatgcggagggtaactgtgtttcccgcttccttgattaggttcacaatgtctgaatgggatttgttggtgatggaacatccatttactgccaagatccggtctcctactttcagcttgccacagcggtcagcagggctcccctcaataatccgacctattttgtgaggcatagccacacatgcattgcctgctttgatattgagttttaatttttttaaagttacgtgggaatatagcaaagggaagagaaaaagggttgaaaagggaaagagaaggttaagtgttaataaattaaagcattaagcaaatgttattaaaggagagctctgcaccgatggtcaaaacattggcaatactcagggtgtctgtataaggagctactgccctgaaactagaattcattgctgccatcctttccagattcaaaattaggggaatccccagctttcctccttaaaccaattacaaaatttgggatagttggcaacttcaaagatttttaagagccccaaaataactggctgttcgcttattttgggactgcaaatgtgaaacccaaggctgggatggatgcttttactcattctgtgttcatgtcacttcatttttgccagctgttgtttaagcttctgccaatgttttgttctttctctgtttagaaaaataatcactgggcatctggtgaggcataagagtctgctagcaccaaaaattcaatctgaaaacacctgatgaacaaacactcagactttctgccttctccccagaatgatgaaagctttagaaaaagggtgtaattataagagatgagccaagaaagcacccaaccttgaagcttatttttccttttaggacctttgctcaagcagctagtcttatgtgctttcagagcgtggcctgactggttcattagctctgaaatcattctgctgcctcacaaaaatcccctcaaaggactacgaaaatctagtacctattcaggctgaggacattgatccaaagctaggttcaaatcattcctcaccctttttcctttaatcatctcctttctcatcatcagttacccatatcaaagaccgagaaaagtgcatttggagagaaaggtttattcgtgcactttgaggcactgcatgtcattgctaacttctagagagaggtggctggctttgaggcctgacataggatttctggttaatctagttaatcatgtattgagtttcaaagttcttatgcatattcacctactttgagaatttgtctttctggggactatgaaggtagttatgcagttgagttaccttttggaaagggtgacaaataacatgagggacattacaactaactgagtaggctcttctgtcatgatttggaccttaagggtaaagtgtgtgggaaaatgcactttaattcctttgaatttcagcagatttgcctgagcttgtatcacagaatggaacaccaaggtaagataatttttaaaagttaacagtctattagaatacaataggtaggtgtgctggaatgctcccatactcaaattcaaggtcttgactaagtttagttgatctccaaggacaattggtataacaaaggtatcgaacagcaggtctgaggaaagctcagcaaagctcagaagcctcatgcaaggtattagggaaagtttaatttgttcgttgtaagagccaaaggaaaacaatcaaagaccaaattgtgagtgtgaatacaatattcattatataacacataacctgccacttgacatatttgctatttctttctagaaggtgaaactgacaattctgaaatagttaggaacgtcacaggatgcatggagacagtcaaactgtagatctgaagaaaataatttgggatttctttctcccctcttccttctctttatttttatattaagcaagaaagtctctgaaattaattttaaaacaaaaccaaaaaaccttgctttgatgtcaggtcatccatccatgacatgctatgatgactttattaatgtagctcaaaaagcactgttagtaataggcgtttgttactgcagccacacatgcatagacctggctgagtcactgtcccctgttaaacataaaacttacggggagacagctccagcaggaagcaacacaccaggattaaatggaggccaagtgagctctactggatgagaatgctaaagggttgtagcaccttgctgattctagccagtttccatgtggataagtcattcagggatagagctgaggtacatgaaaagcccacacagcctgcacagcccttccccttctcccattgtattccatagtaagtaacaaatgtgcttgggagataacaaatgactttttacccaatcaggaaggtggatcatttttggagtgtacatctataatcaatccattgcaatgggaagcagattcatatatcactagtttctgcaatcatctgggtttctattggtctttgctagtgtacccagaagagagtgaatccttctgagaaagtgacaactgtgtttctccatactttgctgaaaccctcaatgtctggacgagacaggaaaatcgaatgactcttaactcagattttaaccagactttaaatcaagcaacagtaaaaatattatttaaaattaaaaaaaattcctatggggatagagtagagaaagaacacagatgaggcagactagcatctcatgtagtatttttactccttacacctctgtttttcctagagcatttttacagccgtatgctccttgtaaaaactcttaagacattcttaagaccattctgaggcccttgcaattagtgctatcctattcaagacctttcgaaagccttgctttggcaaaaactgtagactctgtatgctgtccaggggttcctattcaaatttcttttctttcctttccttttcttttttttttttttttaagacagagtctcgctgtgtcacccaggctggaatgcagtggcacaatctcggctcactgcaacctccacctcccaggttcaagcgattctcttgcctcagcttcccaggtagctgggattacaggcatgcactaccacgcccagctactttttgtacttttagtagagacagggtttcaccacgttggccaggttggtctcaaactcctgacctcaagtgattcaccctcctcggcctcccaaagtgctgggattacaggcgtgagcaacagcgcccggctgctattcaaatttcacgcaaatctgatgtatgctttaagttgtgtatgcgtgatcacattctcagtgtggaagttgaaagggttgaacaaatattcccaaccttcaaaagggaaaaagctaccaaatcaactccatctccaattaagtctttaattacccagagcaagaagctataaagcatttctgcacgtgaggtctgagtcagctttcactcgcaagagaacaaaaactcccaggcatggtgggaaaccctgggtaatttcacgttcagcactcaccaaaggtcgtgcctgcttcgggcctgctcaccgaggacacgatgacgaagccgaagccctcgttctccccgcgccggatctccacgtcgtagggctgcaccacggtgctgaccacgccgctgcccccgccgccgccactgccgatgccgctggtgctgccgctgcccgagctcaccgtgttcagcgagttctggctgccctgcggagtgcgcttctcttctgtcagcgaggccggctggttgctactgtgatgagaggaggctggcgagggcacctcgttctcggttttgggcactgtagcagagagatgcacgcgtacatcaccgtgtcctgcagcccctccatcctgctgcccctccctccttccagcaactcctgctagaaatcaaaacgtgaaccgaggggaggagacagcacctggtttcacaatacctggatatacggattgaaagcagcttctcttgacaaatattaaccattcagtatctacgaacattgatcccacctaacaccaaatgggactcccaaatagcgtttgttgtttatagcatgctatatgtcgacatccacactcagaatcaagtctgcagcaagatcggcctgctgtgaaatatttccccattgcacaaagggaagggcctaagcgtaggtgagggctacacccgtgaagaccgccatcttggcttcatagatacaaccttggatgcacgttcacattgtcattactttccagtcacatttccacccagctttttccatcaggcgacaaacagtaaggtgatggtaacgttgaggctacccgccctatgtggggttcatgacaacacctgtgagacatacacatgcttctcttcttagcttccaggtgtcaacatcgactctgatcacagaactggatacactggcctccttctgaatttagtcaccgttctagtgttaccatcagactgcaaggtaaagcactcctaaatagccaacaccgtaggtggaaccaactatgccaaaaaacaaaatgtgtgttgtgtccaagttttggatcagactgtatttatttccaaaagcttctcttttcatagattgttttaattttggaaaaataagcataacaaatttttaaaccatttttaagcatacagttgagtggtattaagtgcattcacatttttgtgcaaccatcatcatcatccatctccagaattttgtcattttcccaaattgaaactctgtactcattaaaaactaattccccttcctatttcctccaccccccaccaaccatcattctgctttctatctctataaatttgactaccctaggtatctcatataaagggaatcaatatttctccttttgtgactagttcacttgcataatgtctcttcatagatttgacacgccttttacacagagctaaaaatccaaaatatttaagatttaaaaaaataaacctgaaacaacaaaaaaaatcacattgccttactatttctatttgggccagggaagcgagatagttagttttcatctcatctcaaaaactcgttccagctgactgcttttagctacatggaatagtatgttaagaaggattgtgaggtcacaaacacactggaatttaacatcttaattctataattaatcatataccatttaaaatgggttatactctttttttttaaaagaagttaccaattaattttatctgacaggtatctgtttcactaatatgaatgccaagagaattcataatatttcaggtcatatttctccagtaattccactgatagaagacaatcacctctgctgcactctgggttctgccttaaaggtttcaaggtgggagctgcatccaaaggtgaacaaccaaggtgtgttcaacgtgagctttcaagggaaaggacaaacactcacacaattcactgtctcaaaatggcagattctgatacagcagtaaaccatgagtcactagaatggcaaggagggaatgctaaaatctgaaggcagttggaggaaggaggaatttccaagggaagaaagttatatttgagctgagcctgaaaggatatgtagtattttgagaattaaagttcaaagcttatgggcaggaagaaggaatcaaagctgacctagaactggccagctctacaactttcttgtagaaagaaaaaaaaaaaatcttggtttaatacataggacagtaagaaatcagtaacttttttatgagcttattttgtagcacaaacccgatttttgttcccttgatatgaagctacaactcttctgactttcataatgacctcatttgctgaggattagcatcaaatgaagaggatggctaagttctgatttgcaaggagatagaagggaagtaatatatattcaactagccttcctctggaagcctttgttgaacacatgcaaacggcacattaaagtactttagaatgacagtaatttttgcagggtttgagagaagcaagccatctggaaattctgagcttgatcacatttgcaaacatttgctaaaatagacgctcaaggaggcagacacaggaaggaggccttttctgtgaataaagtgacaacgcactgtctgaaggaatgaatgaaatacatacccgcaaaaaccactttacgccgcaccgtgagattgacgtggccttgcttggcagcttgttgcataagctggaccacaagctggtgtgattttccaattactggcgtcccatccacacagattaattcatctccagacctcaggcggccgtcagtatcagcagcacccagtggtacgatgtgaccaatataaatctgttgagtaattgaacgatggatgaaacattgctctcctatgtttactgttacatcaatagccttcacatctctgggaacaattcattcattcatgtctgcaggcatgccgcaaacatttattgagcacccactgtgtacaagacattgtgctaagcactgcaacaattcttaaatggtggaaagagtatttcttgcttagtttccagatgtttatctgtggcctattgatgactcactctctttttcccctttgcagatataaattacttttctcccttcattatataccctattcttctttggtagctacctaaaaactctctttccataaaactctgctaattaaaatattaatattacttttatttaagggtctagcatcatgcctaggaatagggaatctgtaataaatactcttaaatgaatgaatgaagcaaaagttggttggacatctccatttttgaagtcttttagcacccgaaagcagagcactctttatagttagtgtcttgctgttatatttgccattcactaaaccttagctaaaatatttgtgcctgccttgcctttccagcagacaataatgctatagctacctttacgtggcatttatagtttacaaagaactttgacaaaatagttgctaagaacatgaactcgagtcagaccttatttgtcagtccctccatttggtagctctgcgatcttgggcaagttagttagcctttcttttccttgatgtgaaaacgggataaactggtgggtttgacggataaatgagagaatgtatgttaagagcctttagcacagaacctggcacatagtaagcgctcgatgaataatggctgttattaccacaaggaaattaacgatacctatttcagttttcttttcttccttcaaaggaaccctgttatgttattctaaatttattccaaaatggaggacactgaggcccagggaagttcaatgtttcttgacccttactcagggttctttctcaagttttgtaaaggcaggggtctgacattctccaatcactgtctcataaggctttgcgaagtactctctgcacaccagcaactcaacatacaaagcctactacctgctggcagagtgaagggacctggccagaaggaccaggccactgtgatattaggtgatgcctattcctgttttgctttctgttttcatctcccttgggggaaaaggggtggtctacagaggcagctcccacctttcacaaacactcatacaaactttttagaaagaatctagtctcttcttcctcaagacaaagagagctccacaaaacccaatgagaaacccacactactcaagattaaagagtcagtgttgcatctagctggacttaaatcttggtgatttgtcactgtcgccaatttgctttgaagccttagaaaaatatgctgggaagagagacaagcaaaagactcacaggttcccctggttcatttccacccagaatcctaaatccaaatccagtctcttttctccagaggaagatgtcctgttcctggtaatctggaactgcagagaggggagaaaaaagagaaggattattttactgataaaagcaatgatacccccaagatgaacacagttgcaggacaagaatggtggtgcttgatcagatggaagattttcaatataggcaaagaaacaaaatactctgaacaggtgaaataatggaagacacggggataaacagtgggaatagtcactgagccctaaagttcttcacaggacccatcactgtttgataattccgaatcaagcccaagccatgatccttaactacaaatagtcagcattaactgctttcctcagtattcttgcaaggagaattaagtaaattaaaattattatgtgccacaccacaaagcaggtgtccatgtccaagaacactcaggctaagtcagagtcacctctgaagccagatctaaggattcggaagtcatgttaagtcaccagatgtttcctctactagaggatgaaagagaacagcttggtttaaacagactttctgatttatctttaagtcactttcttcttccttaaaataattaaggctagcaatgctaataggctttgttagatcatttttgccaaaaattactctaaaacatcctagtatttctgcatacagtcagtcctccatatctgtgggttctgcatccttagattcaaccaatcacagatagaaaatttgttagacctacaatggttttagctgtgatgaatacgtacagatttttttcttctcgttattccctaagtaatacagtatcacaactatttacatggcatttgcattgtattagatgtcataagtaatgtagagatgatttaaagtatataggaggtggggtgcagtggctcacagtggcactcccagcactttgggaggccaaggcaggcgaatcgcttgagcccaggcattcaagtctgggcaacatagtgagaccttgtctctacaaaaaataaaaaatgagccaggtatggtggtgtgtgcctgtactcctagctattcgggagctgaggtgggagaatcacttgagccagggaggttgagactgcagtgagccatgattgccccagtgcactccagcctgggtgacagagtaagaccctgtctcaaataaataaacaaacaacaaacaaacaaataaataatataggaaggggtgtgtgtgtgtgtgtgtgtgtgtgtgttacacacaaatattaggctattttctagggatttaagcatccatggatttttatatccttggtgggggatgcgggtgtcctgaaaccaatccccagcagacactgaggggtgactgtacaaattttattaggatttcaatactattaccaaaatcagccaggcctccaaatccttaagatcaatggtgatgacaaaaagtctatgttaatgaatcatatatctcattgccaaaatgactgctttactctagaatttgcctatgatatttcagcattaaaagtattaattcattttccagtaacctgatattttactttcaatactcagcaatggtccagggctttaaaatgaatatcttgttttttaaaacaaatgcaatttccataagaaaatacttactatacatgaaattgttctatacaccactctgttacttcactaaagtaaaagagttatttctatttaattcttacgtaatattttaatgtatacatagggtgttttatgacctataaaatgatatatcatttttttaaagagaaaaaatatatatttcagttgcagtgaatcctaaaggagattttcaaatgctatagtgcataccttcttatttaattaactggatttggggctgaaggaaagcgcaggcctgagaatttaattcttttcttctccagttttgtacaatggaatagggaagaagaaggtggatgtttagattttaggttggcgaagagatgtccctttttagtgattcacccacaaacttaaaatgtatagtgaatgaatacaccaacagagaagaaaccaagtgaccagtaagtacaagtcagaggagtttgaatctgatctttttacttgagctatctcagtgccagggctgtaaatgggtgctttctatccactgcttttattataattgctgaggctaagctgcaaaacacccagaacatggagctaagctactgcacaggactcccataaacacaatttgagagtaatattttcttgagcacgctaaggtaacaatattttctttctgttcgagtagctggctacaggatatttgctgtaatagcctcaatgaaacaacaaattaaatcaagttgtgtctccgtctttgagtcactcaagcaagaggattattactgaaatagaccactggtgctttccagccagcactgggctcctggcagagtctgttttaggtctgctgagtgtgtggcttttctgggaacaacgaaagggcctctgcagagacttccagcccagacccatttttctcagcatcatttaacaccagaacatttgcccatcctacagtgacaccaaatgtaacaagtttctgcctactgttgctcatttaggtgtgagctagcatggtatgggaggttgtggccaacagatttaggcttatcacaccgtttaggccacatggaaaaaaaaaaaaaaaagcttcgtttccttctgagaatcagtggtaaatggcaaatttatttaaaggttttctgttgaaaaggaagatgcccactgacactagggatgttaaagacacaagagtgagccagaaaacacagacataaacgtcgacacacagacacgttacaaagaaagtcttgctactttaattttggtattttaagaattctactcttctaccaactaaatgccatttaccccaatttataactttggcaataaatcagtactgaaacacattatgggattataaaatttctctcttctgtgtcctctgaggccacctcttcttagaggcattgaagtttctaaactacttcccccaaaatggttttcttccttacttcaggcagattttattagaattaagtttttaggcggcagtaaggtagaaccattttcccaatattaatatcactttttttgagtgaggctaaatcaaatagagctaagaaaaccttgtccaattttcatttgtaagcccctgcatatgaacagtttctgcagttagtctcctttgggtaatgccagtgacaattcaataaagcagtcaaaagacttcctttgataattagaaagaatggacccaccagatttgcaaagaaactgcctggtgtctccattactacagacaaactaacacatttccagacttgacaagggcatgcaaaaccctttttattccatcttgtctttggtttgcgtttggtcaacaagagctccaaagcacttcccttcatgccccttttttcttccctctcttttctgaacttctccccaggcccccagaccaatgagaacatcaaacaagatgaatgaaaacggagagacaaaagttttcagcggatccttactcggacattctccaaaattcgtggaattgatttctctctctctctcacccttgctcaatcccgacgcaggtgaaggtgacatagctggaatattaatttcacaattttgcaaagcttaatgtacattctttctcttagttcactttaatttagttttgattgataaggaacagtcagttcagctttcacaataaaggtcatggctgttatgttaaaagactatagtttgattccattttttctttctttttttttttacagtgctttacttgtaaaaaaggtagaatttacaattgcaccactgagagtttcctataactcctattactatcttaaactctccttatttaatgacattctaaagtacacattcttgaatggccttacttcaatcatggtttgtctaaaaccttattgctttttgaaaaatttaagtatatttgtgctaccactatactacagcatttattcaaaagtgtatcaagtccaggatgaaattcattcttgtactaatatctgttcaggtgaattctaagcatttcaagccagaatagtcttatatttagagatgcagatcaatggatctatccgagaactgaacaaacacacaaatacaaactcataattgctcttaaaatctggaggtatatccaagcttcttaagctcactatgataaagaagctcaatcgccacttccaaacttgtaagcatgtctctccaaggcaggacagatttacaatgttggttaataggacagttttcagttttttctttccaaactatatagtgaacaggcaaagtttcaactataagccttataatttcttttgtagtaaatgctactggataggatctgattttcctaaacatttactaataacactgcatcgctgtcgtttttaagatgtgcacaattctagagaaaccataaaacaggcaacatggcttttaaaggacttcagtgctcgtctttgtttttaattaaacattgaaacccttcaaaaggattcatgaacacatttgtaattcagactgattcattctaatactgctgccttgagagatggccatatcaaaaatatggtacattgcaacacatttagaccatgtgaaggaatgcgttcacagattgtgttaatctccacattgcccctaataaaagaaaagaaaaagaaaaatgtatttccaacaaaaagagggtaatatggcacagttaagctgctgttgctgacttcaattttcctgtttttcctggattactctgctcattttactgtcttggggggagggggcagggaatcacatctaacaaggctatacacttttttctctttgaaagacaagatacaaaacaacctaagagaatggcagaaactgatctcagataaagaaaaatactgattcaaagacgagattgatgcacgatcattcctaggtgctgtgaaaataagaaaatctgtgacagatactgaataattaccatgggggccagggggaggtctcatcattatcctcatttagtagtgaggaagaaatccatgtgaatgttaacatcaattaggttgctactatctatccgtcaactacagagactccaattaccaaaaaggaacaggttctcatttgtgctgctctatccgattccttagatgttaaagaaagtgaaggaacaaaactggcaccattccgaatttttttttttttttttttttttttttgagacagtctcgctctgtcgcccaggctggagtgcaagtggcatgatctcggctcactgcaagctccgcctcccaggttccagtgatgcctcctgcctcagcctcccgagtagctgggactacaggcgcacgccaccacacccggctaatttttgtattttttagcagagacggggtttcaccatattggccaggctggtctccaactcctgacttcgtgatccgcccgcctcagcctcccaaagtgctgggattatatgactgagccgtggcgcctggccccgaatatttcagtccggctgccacctgagcaacttcagtacttacagtagctggctatggccacattacatattttcctaatttttttttcctagtgaaaactttttagacacatttgattaagtcaaattcttaagaaaatttgccgccaccagggtaaaaatggcatttgagcaagagccttctattaaacggatgttttacaattgtcctgtcaacccaggacgcccccgccagcccttcagaatgcaattcattttatcacaaaaagattcatacaggaaaactcaatcataaatgtgtactgtattgaggagagcaggagttcggtcaataaagcaatatctcaacattaactgaagttgggccattgactggacgagccacaagctcagagagaaatgcgcggggaatgtgaaaacgctcctctttggaaatatctcttaaatggttttcttcagtgaaatcactacagtgagcgaggagacacaatgaggacagaacctggttcctggttagcatccactgcatatgaggtcattccaaatggaacttcatttcctttagtcaggcctcaggggtactttaggggtgtctttctagtccagcgactaaataagtccctgctcaaattagtgggctttttgtcagcagagtgaacttgtagccaaaacagcctatttaattccatgcattgtggtaccaagaaggcagtaatatttctcccttgaggaggaaaaggatgaagccctgagtgactcctaacatttgataaccagcaagactccaggctcacctctgccccccaactgctgagcatcattcagtggactgaccaactttcctcctcagacaaggatgctggcctcactgccccattttgcttgggtcacagaggagtcgactttcagcatgcacctcggccggcaaaggaagcacagcatggccaagtctgtgtagtggacgggaggccagggacccacacctcacacaacctctctgccacgactctcgatggggaccctgctgagcagtgaccacatttgcagctaggaatgaaacctgtgctgaggggaggatgagcaaaatgattcccttcactcttccagcttctcccagacccttcaacaaaccgaatctccaccatcacaacacctctctcctaccccataccaaaaagagaaaatgaggtatctgtccttcatagctgcctcaccctgaccattataagaaaacatcagaaaacagccacccaacaacaacaatcaatttgcatcgcctaaaattaaggcatttttaggaactttcattggtaagataaatgaatattatttatggtgaatagtttttggaaatcatttcataataaaaagacgttaaacatgagggtgatattatgtttatacaagccaagaagttacaaagtatactatcactggctcatatttatagaaaaggtaaagcactggataagtaattaaagcacaaccactcactgctatggttttttccttttcatggggaatgtttagagagattataatggttaaaaaaaattaccagtatttttaaaaatcaagagaccacttaaaaagcatttaatttcttctcattagcccaaaatcccagtcaaacatgtttaagttctgttgcatatcagatttgtgctcagagcacatcacaatctccactcggagaattaatgagacagcagctcttatctaccattccttttaactgaagggacgaaaaaacccatttttacccagggcatttatgtgataaccatccacttctaccccctccccaaagtgaaggcatagtggagactccatgaatagccagcagagtccactccctctgtgatacttttgcatcttgcggatttcactttacccagtttacacactgcaactcatctattttcaataaccttcaagagaaaggtagagccctgcggaggggtcagggtaagacagaggccaggatgctactcacgtcggttttcatacatgctcctggactgggcccagattttaaaaggatctggttttttctggccagagctgtcagtttgatctggagcttgggcctctgcaggtgggaactcggggagcacctgtgtgctgtggcttggggatgctgtgtgcaggcttcggtggctggaaacactgtgctgagaactattctggctgtctttcctttccagtggttgctgaaagtaagcaagtgagaggggcaagaagaaaagattattattggttctctgaatgggtgctttccaccagcttgtctttgtttagcacttttgcatacacatacatatcaacagtattttggctcccacctttctccagctaatgctgaatgtagataaatccccaggtgactggcagacaaacagaggggtgggccagataggaagacataatcataacccatactgctctctgggctacagcggaaaacaaatctgatattcatcacaggttctcagctaagacgctatgctcgtttactgcaagatggatcagttttaacattttcattttcacaaaaatatgtgacaccaaataccatgagtggtttaggataaggctataatatccagaagaaatataatcagggctaaagatgctcctcaggactccatgtcttgtaccttttaataataaaatacccaattcctctctaagagtttgctatccattcttttcgactattaaaaaaaaggaggtcagatcttttaaaaatcatgcctagtattatatgtttactggtatttctaggtgtagaaattactaatatatgaagaacttccataattcttagctaatcaatttggcaagcattacacttcacctcttaaactgccgatagtactgttggttgaaaaccaagatcaaactttgtatatgagttgacctctgggggccagccttcttagatctgcaacttctccaaagtccaagtattataatattcaaaggggaagagttccatttaaatttcagttgaataaccaagtccttgttcattaaaatctgctcagcaaagacccttctcattttacaaaaagctctgttagaatggggaatgaatggagagtaagacctaatggaaaggaaaatagtgggtagaacagaaaataactgtagttcttattttctccaataaaagactgtggtaatctcaggtgtttagcattccctattcaaaacaaaaaatcctgcagtcatgcctcatataccatagacaccatgtcactatacttagctgatttaaagcattgtatggggtagaggacaggaaagggctctccattctcttttatagatcctgtagagctcgtggttttaaagtactttataagagctttgaccttgatcattctagatccctgaagttctttatagagcccaaatcttccaccaggtgttccgatcaatcctatcaaggccattcttccttgctgtctccccgagtatccttcatctttcattcccctggaattctgctggaaatttgcaaggtcccttcatttaattctcaggtccctatacttcctctccttccagtaattgctttgaaacaagtatctgaagaaagcccaaggaggacaaaaacttcatctgctcttgactattacagatttgaatggaggtattggcaaggattcaaaattgagaacaattggacatgcattcaatgaaggcaaggtagactgtttaaaattatacttgatgtgcctgcaggagaaatttgaggaccatattctaacctatcctggaggtcttgggaaaactgtatgagaggcttaattcacttcaattcaaggggaaaaacatacactgttgcagatgccaggaaaacacgctgatgtttgggtgggaacaaacaccatcataatcccacgtcaccatttttctcttttgaggatcaagtgctcagctcagatttggttgccattccagagttgatagaacctggctctgccaacttcaacagtttctcctccaacagtgaattcagctcccagggccagagtgagaaaatgtaaatgatggataccatactcattttcttttgcatgcacatgggacagttgctttttttccccccctcttcaatgtggtctttacaagggtcttgattataaacaaccatgtacagtatcagccctttttttgtgtgaacctacataacaacacatagaaaaaatgggattatgggtggagtttttccctcttatcattatactttcccatattacctaccttttttacttttatggtgcatagagaatactttttataatcaagacaaaatttaaagtcattttcatttcaaaatgaaccttggtaaatagaattaacgggaactgctacttcctatttttttacattttagtaatgttttacttttgttcacctctgaaggggaaagatattttaaatgtaaaagcaaaaaactcaataaaagacctctgcatttaccctgagagtggcatgcctcccttcaaaggaccactctcttttggttcctcaaattaatagatgccagattgattccagggtcggcctataagcactaaattctgaccctggaagctctggtctcatcgtgttgaaattacgcttcacaaaggcgtgcacactgcaggattacctgcaggaaacagccttgtgctgctgcttcttttgtagggttattggcagtttctgttccattgtcttcttgggccattacctcctgaagcctaactcaaaccttttccacttgattcttcttcctgaactggagagaaatatccttctggcatccctgacccactgagaaagtctgataaaagtactggacctgtctcccagagaaaatgcgtatgtgcttttacatacatacctgtacatgcatgtgcagagattcagcatgtcacgtcatgggtttttgaaaccctctcatgtctgtcccagtataagaaatccctgacatggaagaacctagatctcttacatttaactgaagagatggttccaccagaaatagagagtgcaaatgaagtctactggaaatgcttgggccatttttcaaattataacaccctttctcacctccccaataaatgactcatttaggtccaatttaacaccaaatgacagacacaatctggaatgagtttgcaaaactgcctctcggtcaaactgcacctctgagtctcctttaaatgccatctaaactttatacctcaaactggaaaataaaagtaaaggagcatcctgagaatatgctctaaaaactgtgccaccactcaactatctctaactggcatatataaatggcacaccagtgggctaaatacacaataatctggaagctttttggatgttctccctgctaagacttaacctcattctatgttccttctcaagttcaattatgaaaactcattaatttgaagacatattctgtaatttaatatcttgtgggcactctggattttttaaaactatgctgtgggtgtgaggggagttcaaagtaattttttttttattttctgttagcattctaattagctatgaggttgtcctttatctggttagagcccagaactgtccaggagaaaaaccatgtttatatatctcccaaattaaagtcaacttgtgtgcattttcagcagtctggatcacctcccagaagactaggggcatgagaatacgttcacttctgaactatttatgacacaggagcagatttgcatttaatgcaattgtatttcacctcattttcctaggtgagacactagcccaaagacaagtagctgtagttaaaagtatacttttaagtctgttaacgaaaccctgtgcatactaagaacatggaaaaatggaaaaacctagtacacaaatgatataacatccagcccaggccctcctaagtgtgctgccctacctgcaatagatttattcacttaacccaataaatacataggatcacctgctgtgtgccagatactgagggaaacaacatgtaaataaggaatagatggtacctgagctcttgaaatttatccctgggaatgtatctaagtgtgtgtatacatagtgtgtgtagatgaatattaataaaatataatctattgatagcaacacactgcaatgtcctttagaaaggtggtaaagagaggactctggaagaaccctactaacagaaagagaaggctgggcatgatggctcacacatgtaatcccagcactttgggaggccgaggaacacaaatcccttgaggtcaggagttcgaaaccagcctggccaacatggtgaaactccatctctactaaaaatacaaaaattacccaggtgtggtggcatgcacctgtaatcccagctacttgggaggctgatgcacgagaatcgcttggaaaggtggagcttccagtgagctgagatcacactactgcactccagcctgggtgacagagcgagactccatctcaaaaaaaaaaaaaaaaaaaaagagggtgtgctaagtggactttctgaagaacaaaaaagctaatgtgacacagcaagggagggtggcctgagaggaactgggaggccacataacgcatgagccctgtgggctacgtaaggagtttgggtttcattcttagtttcaagagggggaatccattaatgaatttcaagtggggatgttccaagagccaacatgtttccagaaagtttggtgtcgctactgggtggtgaatggattggtggggaagaggagtgaatgcggagaggccagtcaggaagccccaggtgcagtcaatgtggggacctgaggtgggcaacaccagggtagctggagttacccaggaaaagaacaagtgaggtcagaagacactttgttgccaaattcaacagggattgctgacagactgaatggaggaggcttaggagcaggaggatggaggggacaggagagaagggaggtgaagaggatcaccaaaaggaggagagcttagaaacaaggatatccatgcaccacatctctactgtgagtaactggttgagaaggggtgccacatattaagataggaatttccaatgctaattgttgtcattatgctgatatttttgaagcaagagtcttattgctgagtctcaattcatagccaactaggaatatggaaatgggctcaattaaaaaaattccataaaggtctttggccacatgttggccatgaacctgtatcacaagaccttttaaactaaaactaaaactgtaccaacctctctgaaatgaatgattcccttacttactgtcaggccagggaaattgggaagacataatggtttttataaatggaaatgcgaaaaaaatcaactcatcagtatttcccagaatgatttcaaaatgtaggtacttagaaagtgaactgaaaatatttgcttggaagagcaaatgaatacagacagcacttaggagcttaaatgatgaaaagaattcatgtggcttaaaaatgacaaattgatccattttaaagcaaaattatttacagttcacttatctgccaagagcgaaggctactgcagcgatttacatggacaacaggaaaaactccaagtgctgatgaggtattaggccaacgtcattaaagggtgtgtgaaaatcagagactcgaatccaagccagtgcagaggatggtcattccttttgtttgtttcttttatcatttatgggtctaagtcaaacgatttcttccaaaaaggtgggcgagaggagttaatgcagaagaaaaggcaggcactgactggatatgaaaatgggttctggttcacattgcatgttttaaaggaatgtaatacaatggcaaagtccatcttccagggctccaaaaggcagagaaggggagttgccacgggaagtgagaggcaaggagactgactgaagtgatcctatgccttcacccatctactactctcactgtttcttcttgtaggctgtagaagctttgatgggatcaatcatcatgctggttgtcacacaagtggcatcagggaaaaggaagacaggtgccacacaactgtgtgagtctgagaaagaggcagggtacataaaacggaatgatctaggccagggtcacttagtgtgtgtgtgtaaaaggagtctctccctcacatctcttaatgactagttttcagcaatttcctttagcatctcttgcaggggaaagggacagagaggatagtggaacaaaaacctatcactgtggctaccctgccgacagcttgctatgtctgctctaaagaggctgttgaagagactgcttcttcaatgcggatgggcactggatgctttgcccaccatccagggtcctctatataaaaactttttgtaggatttttttttttttttagtgaacaggaaactcttgtctctttagtgaatatggtacactttctttcatctgacaataatagctaagtaaagaatgtggtttcctatgttgcctaggctgctggggaactccaaagtactccacagctcaatcacagcacttattcaatcgtgggtgttggcattttatgatgacttataagttattataattaagagtggaatgattacattatgtgcgtacttgcttccatgttatatttctgctttattaatgctcatcacactttaatccctatgaggtgaggatctttgtagatctgcctgttaatgtggttattatttctccctccccatttccatgagggcagggatgttttctgattaattcttatccaatattggcactgggtctggcacacataaaataataaatacttattgatgaaatgactgcataaacattttggaaatttgtggcaattaatctttttttttttgcaaggagcaatcaatacacggtttgtttgcaaactgcaagaagagaggtgccatgaccaccttatttattatagtatttccagtgcttcacaccaaacctgttatttaatgggttctaaatactagttttctgaataatggatgaatgaatggatgaaagatgaatatgtaggtggagcaacagatggataaatagaagatgatagctaggtgtggtggcacatgactgtaatcccagcacattgggaggccaagataggaggagcacttgagaccagcctgggcaagatggtgagactcccgcctctacaaaaaatataaaaattagccaggcatggtggtgcatacctacagtcccagctacttggaaggctaaggcaagagattgcttgggcccagaagttcgaggctgcagtgagctatgactgtgccactgcactcagccttgatgacaaagtgagacctcatctcaaaaaaaaagaggggacagattaagggagaagagttgggaaatgaattcatacgaaaacggtggatactgacttaaaattcagggtttggtgtgatatttagttttaaattctcatacacaacatccttgtgggtgatttagactgagagtctcagtgaaatgagttttcagtcaggatgattaagttgggccacagaatcagtttcccagagaggtctaaaacctgacagaaaatatgtcttgtttttgtctctgctatttggcagaaaaatccctgatgttatgaaagtccaggtattaaattaataaatttttattaagatactgccattgtccccaatgagtatataaaccacaatttcaacatttaaactaaatcttgaaggtgaaattgcttattaagagtaagctacagggactatccaggagaagaaacaagataaaaaaagataagtccttctgttctaataaaaactcaactacttaattattgaaaatcttaagaaaaaaaaaaggtatgagggcaaaaggaagctgccaatcacatgagcaagccaacattgtcaggagcctctaataaaataaacaaaacaaccacaacacaatggtcctgagctaagaccactgtgcacatatgcacagagctattgccaaatctaagtgagtcacaacccaggtacaatcagtgtgcttttaattatgcatcctgcataattgaccttatgtgtcattacttgaatggctttctggtaccaggacatccagcttccctgtgaattccctctgaccccaccagaaaaatcccataatcatctgtctccctggcaggacatcatcaaaattcaaactgggaaagggaaaccactttcaagccacctgtacagaactctcactgatcacagatgttagcagcactttacatccaacagcagcccttggccgacagctcccaaattttgtacagcaactgccagtgtgtgccagcaatgctgtgaaaaccctcaaccctgtcctggcacagaaatcaggtaaggacaagccccaagctgggggcttattattttctaacccagcaacacatcactctcttagcttgtggtaattaagaaccagcagactatgggtaaagcagttgagagcttctttcttaggaatgcagcccaagtaattggcttgctgcttgctaatgatatggcttctgcaaaaattaactgtcatagggaattctcttaactgacttggtgaatgcaggttcaatacctatttgatagcctttgggttcaccaggtaattccaaaacacttgggggaaacagaaatgcaaatgaattacaaaaatcctttgcacactaaatttaaatggaatgcaaaatggaaaagaacaccttgctacttgacgtcatgctacctgtgcaaaactactatgtctccctcagcacactccttgttaagactccattccatgtagggtgtgtaaaataagcccatgtatcaacatagcatggctggggttggggagaaaaaaggagggttcgtgctaactcaagcttatgagacacatcttctggatttccttccatttctctgaaggcggatgggttactggctatgaccaagggacagggagacacacatgcgcacatgcacacactttggcatctttgtggttccaatgtgggcaccaaccagcacttttctgcctggacgttaacacacactgacaaggaaaccagccctgaagtcaaagttccaatcaccacggcactatgccatcggaatcacatcaattattgcaggtttttctctttggagaacttaggagtgaggtttaaaatgcaggaagctccctctctcatctccttaataaacttctgcctcatgctgccaggcttggagacaggtggaaagaattcagctgcagcgccgtaagccgcaaagttttcaaggttctcccttcctggatggcacgaggctgtacattttccctcccccaaatcttctaaaccacatggaaacatccctctttatcctaatgttaatgaattgggaagccccttccacccagatcaatttcacaggcactggagttccagatgttgagttaagcagcattttaatttgtcattagtgccccgggagcataaacccataccaccaagcaaaacactatagcctctaagctattagctaacatgtcaactaggtaatgcatcttcagggaaaccagattggaaaggacagcaaaacattgatttttttttttttttttttttttttttttttttttttttaagaatcctatacctgcagcataatgctgctaaagctggcaaaacaacaaaggacatttctacagcaaggaaatgtcctattctcagtgctggggcagtgaacattgttccatctgagcatggtcacatatatggggcaaagcaattcttccttaaacctacaggctttttattttgtaaataattcatcctccggcgcctaagaaagctaagggagagaatgggtagacatgtgaacggctgggaacaccagttgagagcaatgctactcacggagcaggtggagctttctttttttctctccttccaaaggaaacaatagcatttgtatcaagtgaaaacggctaagaaactcatccctttgaaggagagtgtggatgcatttgtatagagaagatttcaaacatgcattctttatcctggctcctgcagcctgcccacaaatcactatacagttaaagacaagcccaaataccttgtataacaaacagatccccagaacttaagaaaatgagccccggctcctgtctcccccatccactgtaaaacacatttagtgaagtgaagccacacagagtaccctcccacctccagccccccaccatccaccccagccccaacaagcaccaagtaactgacaagtccttaccgactttgggctcttcttgggaactggcagccctggaaaaaatgcaacaaggaggggaggggggaagaaatcattagcatataaatgttaccttttccttaaagaacaatccccaggtgttccatggcaacctagccatctgcagagttatgtcagatttctccccagcatcggagttaccaggctgttcatatcgaatcaaagcagagggaggaggagagcgagaggcaggagatctatctgcattagctatgctgacttgtactgcagcagcctggaggctgggaaaagaaattcacagacctcagcggcctgggaaattgaacacttggacagaatctcaaatgctcttctggattaagagagacttaacttacaattaagtccaggttatttcctttccacacgatccacttgtcaattgaaacggaccaatcaggacagaggaaagggtatatatttagtttcaaaggagtacatggttaaaattaaaaaaatttttttggtcttttctttttttttcctctgcctttcggaagaggaaatgctttctttatttggatgagctcaataccaaaacaaagacggatgctcttttgccaacacagaatgctaacaaatgaacacaaatccaagttgctctagggtcccctctggatcatcagcacatgtctgtctcaacgtctgccagtcatccaagcaacctcctactcacagcttgttggaaaggaatggagcaggattagccctcaggagggaaagcatgtcatttgggagtgaaaaagaaaaattgcacaaagctgaaagaaaaagataataatggagaaagaaaggcaaaggtggtcattgaatccagctggctcttccaaaaccctgtccttagtgggagggctggagctggaagggacaagtgatctcctcaattctagggaagtcaggagcaattgggggcagacttatgggaaatctaccaccagggaagggtgcgaaagacaggcgagaaaggaaaataaagcgtacactggtgtttcaaaagtaatcatttctgcaagctgttgcctcttttgatttttttctttgggcaggagttagaatgcaaaatacagattctatctgtataaagcacacaagagatgcttgggatctggtgatgctgcaccggagatttcaacctgtttttcaaagtgattcctagggagtgtgacgatctcaactcttttggaagtgacttgtcaaaccatgagccatgctgagttcagcacaagtaatatgaggcgaggcaaggcaagtgggtgagtaaggaggaagcagcccagatgagccggcagagtgcccactgggagtgaggcatgatgaggattactcgtcgtgggaggcatgagggcactctctggcaaggttccttgcatcaccaaaatgaggtcaccatggaagcctggctcccagacctcagagggcataaggcacactcagtagtttgtcagaaatgcagcagcccaggtcccaccactgggggccgaggaatctgcagtattaacaaaaattccaggagattctgatacagagaatctgaggaccatatttaaggaaactctgatatggtagagtattactctttcaaatcaggcaaactcagataggcatcctttaacaaagtgctttggggccctctctgtctcagtttctccatttataaagggaaaatagtaagactcacttcacaagattattaagataatgaaacaagagaaaatgtttaaaagcctcctacctggcacagaggagttactcaaatgtctacaccttttcaccctccttagctaatttacatcattcagaaaggaagtggtatagttatcttgcactaactagagaaaaatcatctgctaagcatattaaaatataaaaaagattataggagaaaatattttacctatggatacaaataactgtgttgaacaattttgatatgtctttattttttaaaataacgattaagtgctttttttggcttattaatatgattcccttaagaaattttattaggttgtataagtgtgggtcactgtataaacttcaaaattatataagatgacatctttaaattcatattttctcctaattcagagagaccttcttagttaattggaatcagcaaggtttcaccatagttatcttttactgcacttgactctgcccaggatcccaatgacctacatgaaaatttggaaacaatcccccattaggtaagtagagtcagggaaaatggtttcaatctatactctgctaatcatttgtaagactctggctgatcttcaaatcccttctcttaagagcttcatatataaaataaagggcatttttcattctctagcaatgcacattcaaaggtgcattcacaacgatgttcagtgcaatattgttggtagaaaagagaactggaaacaactggaaattctaaaaaactgtggggcagccaacctacaaagctaggttaaaaggaatgagctatctctacaggtaacaacatagtctttaaaacataatgttcagtaaaatgccacactgcagaatggcaggcacagcaggagacaggtgttccacacactcaaacacatgtgtggcttttgccttccatgaacgtccacatcaaatggataatggggatatgttcaatagtggcaaggaggggcaaggatcagagggactcatttaaggagactttagccttatttagaattcttttttaagaccagcattttcacatatcactgatgcaataaaatactaattcaaaaataaatattaattaattaatggccccttcattgttaactacacaaagccaaccagtctgaaggatatgggggtaaccagttgaggtctgtttcctctgaggaagtagtccatggaatattccagaagatcccagctcaactgacacaacaaaccgtatattacaacaaataagaaaacctttgtttaaagaggcatttgttcctctttgccggctagttgctgaaaaccttcattttaaaaagccacaccttttacagcagcccaaaagcaggttacgaccacaaattaatatttaaatagtcaaaatcaagagactccacttgattgctttttaaaaaaagaactcaaagatttgttttaggcccacatggtcattaaatcttaaaatctaatacatatgaatgctggaaaaaccttactagtttataatttattttagcccaaactattcagatggattgaaaacagctgggagacctaacagaaaagactcaaaaggtcactgcttgccaagacagaatgctccaagacctatcaaaggagatagcgagtatgtaactggttaactgcagacatatccctaccagccaggccataggaagcaacatcatcccatacttcatggcataccagtggtcttccctagacaagcaaacactttgtatgccttgtggcagcaggaagtctgtgttctacaaatcatgtcacatatcacatataaggcatacatataaggcatacggcacctgtcttaatgggcttgtctggtccattcagggtaaggaaggggaactctcagaagaggcagaagaaagagtttatggatggcagcatccgctcttagggccttagaaggcagcaaatattacttctaagggatcccagaaaactattccagggaagtgtatgttcaaagtgtgatctgcaggagcgagaaaagcttgggacttgagtatctaaagttctctattaaaatggtgtcattttggaaaaaacgaatggcaaattctttgctagtgactgggacctgaccaactaatgtaaggaggagaaatctgttttcctctaaatatcaaggccataaactataactaaatggcagaatgtcatagttggtgaaattttataatgcttgtacacaaataatttatatgaaaaaagtaaagctgtaacagaatacataccattttgcaaagaaaggctagaaggttatgtgcgaaaacagtattttctttggctcatgggattatgcgtggctttattaactatttttagtatctctacatcaagaaaagctttatttatttataaatacacacatacatatccacagataccacaataaacaaaactctatactgcttctttttttttttggacagagtctccttctgttgcccaggctggagtacaatggtgtgatcttgcctcactgcaacctccgcctcccgggttcaagcaattctcctgcctcagcctcctgagtagctgggattacaggtgcacgtcaccatgcctggctaatttttgtatttttagtagagacggggtttcaccatgttggtaaggctgctctcaaactcctgacctcatgatccacccacctcagcctcccaacgtgctgggattacagatgcacgtcaccacgcctggctagtttttctatttttagtagagatggggtttcaccatgttggtaaggctgctctcgaactcctgacctcatgatccacccacctcagcctcccaaagtgctgggattacaggcgtgagccgccacgcccggcctctatactgctttttaagataaatgcagcatatttcagaacattttgttgcattttaaaatcccttgagcatcattgatctctatatcctccaagagttgcttacttttccccaaaatgaatgcatacatatagttttattaaagaaccctcatagattaggacctgtgcttgtcctactgattaaatgtaaatacggaagaagtaggagagctcagctgggctgttggggaaaccaagcagaagccgagcattgccatttcagcactgagacaaacaaaacctgagttgctgggaaagagagtggacctctctggacctaatttcctccaggtttaaaggaagtgggaatgccaaccaacctcactaactgaatgaatcaagaaaaactgcacaaagaggctttgaaagggtgaatcctaaagtgtctgtcacatacaaaatggatctacgcataagaaaaatgtactatttttgtcatcaatttacattttttcattgtgatattcattcccctctgcatttgggtctcccgacttcagcattttagtggaaacattttgctttcctcctaagcattccaacaaatgctgtgtcactaatccacatgtcactgaacacatgggataccttacagtttcgcaaggcaaatgttgcaataaaaactgaaaaactgtcctggagttggattaggtaatacagtgtgcaaggggcagggaactgtgtgtgtgtatatatatgtatacacacatacacacacagttatagatctctctctctctatatatatatatcgagggggagagagacagagagagtaggagctagagagggagtcatcagggaccactgaaagccactgaaagaaaatgactgtgaggtcttggtcaagggctggtcttagataccaaagaagataaaagtacttctgagcacaatctcagaccacatgagccttctctgttattcgaaaacctatcaatgcataattctaaatgtaggactttaaatttacaattaattttaactcagtaaactgatcattaggagtttgtattaaggaaataatcagtcttgcaaaaattcctataaaaagatggtcgacacagcactattttaagatgataaaaaatggaaacaggcagggcgcggaggctcattcctgtaatcccagcactttgggaggctgaggcaagtggatcacctgaggtcaagagtttgagaccagcctggccaacatggcgaaaccctatctctactaaaaatacaaaaattagctgggtgtggtggcaggtacctgtaatcccagctactcgggaggctgagacaggagaatcacttgaacctgggaggcggaggctgcagtgagccaagatcacaccactgcactccagcttgggcgacagagtgagactccgtctcaaaaaaaaaaaaaaaaggaaacaatctgaacttccaagagcggaggactgagtagagagatgtgttatatcaatacgatgaaaaattatgaaaccattaaaaatgagcacaacaaagaatattcagtgattgggggaaataataatgatataagacatgaacagcagggtaaaaactgtgcatagaatatataaactcattgttaaaaagtggatatacatatatattcacacacatcatatacccaaagactaaaggaaatgcactaaaatatttttctaaacactaggattaataagtaattcatattcttattttcagtattttcaaagattgctggattttacacataatgtggcaataatcatcaacaggatcagtactgcagccaatatgtagcatgcctggacaatggcacatactggccttagcgcagtgctagattaaaaaacaactggagtttgttctatctctcctttggctcaatgacttactaccattctactcaagtgtttatgctcctaaattactgggtcatggccttgattgaaaaatgtgacacaaagctgttatagcccctctcaagcaaagctgcacagaagcacataattttgcatataatttcagggagtctttgaaaccttcactagtgaccctcagaaacccactctattggggcctatagtccttaagttaaatcatccttgtccaagtatatggctatagcattagaagcaattcctagggtgagatttactttagcttagcttttattttcagtaagagcagcatataagtagaggggccaatgggaaggatcaaacagaaaggtaaaacttgcattgcttacttcgccttctttcttggaaagatttaaaagacacatctgaaaaaattatgaggagaggaactgtattaaagaacacaggtaattttcagcaaaagtgctgctccctggtaaaaggaatgtgcctcctaggccatgcttttatttgttgggggtagtaggttgatgagtcaaaacagtaagagattatcgaggcaaagtcacaatggggtgcaggaaagacaaattgagaacaatctgagacttccccagccaatcagaattgatgattatttgactgcaatccagtggttctaaacaatgaacatcaatggccggcaacccttctaaaaaaaagccatctgcatcatttcctgccaaccagttttttgttttctttgtttaatagagaatatataagccatgaaataaatttaaactgttctctctgtaccaataaaaagctaacgacagtccagaaaacaggaaaaggtacattcagccttcacagtttccactgagggtaggaaggaaaacagggaaaattcactcactcatgtaaccaaactgtgctgacagcctaggaactggcatgaaataaagcaatgggcaagacctacagggtcctgctttcacagcgctcacattctgtggggagacagaataaacaacttagcaaacaatttcagagagtggtaacttctgtgatgaaaatgacgcaggacaatggaacaggctgtgccggggatgcacaactactttatgttgggtgatcatgcaagcctttcttgaagagaccgtatttgagctaagagctgaagtatgagaaggaaccagtcatgagaccattcattcatacaagatttattgagctctgccatatgcctagcaaagcatcactaagagataaaagtaaatcagacatggcccctgccctggaggagctcatagtctattttaaaagagaaaaagcaaagcaaccgttttataattcacagtggtaagtgttacatgccaggagagaagggagcactgttgctttcaggaatacagggaagagaaatctaatccgatatgaagaagggggcagagggaggagctgaagtgaagaatggctagcatttaatcgtggggtgggggagtgggtggaagcacatgcaatgattgatgcttgagtgaataatgatgataagcttttcttgttgttgttttgttttagctaaatcagtgtaccagcataaactcaaggccaagctgaaaccagagtacattttcactgaaggactttataaacactatatatcacaaaattgaatccataaaaaggaatgaaaaaacgatcccagtttgaacatgtttcattttttttttctccttcttctggctaaataccatcataaccccgtagcataatttttcaatacaaatatgataccagctgccaagaacataagtatcagacccaatgtctccaaaaagatgaagacattctttcctttggggacttaataatggtcattatgaagtattttgaccatcataatttagagagatagttggacttcagatgtctgaaataagtagctcccaaggcagtgtcagctggcattttgtgaagaagattaagaacatagttgtactggttttacagctacagagaagtctgcttcaattacacagtacacatagtctaataaatatgtcccagtagaaataaatggcttgcaaagctggtgattcctgatggcttacagagcctttcacctcaaagtcacaagccttgacctggcacaggtaagaaagacctaaagtcataaataccttggactgctcaaagacctgggtaagatggatgaattgtctccatgcaattcctgagaaataaatggtcactccagagaaggtgtcattgaaatgatatggatgatcctattgttgctactcttgaaaacatgtgaagtatgcctaaaggttgaaagcttagtgcaaaaataactaaaaagtattcagagcctgtctttgacataaatttattcttcgtacctgcactctaagtactaatatcttctcattctgcagaagagaaaaccaagacactgatggtcaagtaacatggccaatgtcacacagtcaggtgaatagctggggatacttggtctaaaaccaagcctgtgcttttaaactatatgctgtcattcaaaggttccttaattattttggtttagagtctactacgataagattaatcctatagccattcatacataccaaatgcatttacagaaaatttttaatatagctttatgaaatacatggacctaccactgacaactgctaggtcaacggggtcaaggtatctagggctcataactgcgacatgcatttgggaagacagttcttttctacagatagccgaagagtgtatgcacagtcaatcaatttcttaacacatccctgatattttactccaagtctcagtacctaaatcactggtcattcaaggctacacatgctaaaaatacaacgagatcagtctctgatttgggacaatgaagcatgtctttaaagctacacaactaacaggttgactggccacaaaaactcagtttcaaagtgggcaggagctttttctagcttgcaaatgtttcctgacgctacctaataacaaaatttcttttttattaatgggcttagagaaaagatatggaatgagtcagaagtggagtgaactatggcatcttctctccagaaaggaaagaaaaagaaccgttaacttaaaacaaccactaatttgtcaagatgtacctaccacgaggtcaatctttctaccctaggtaatattcctaccaagatctactttttaagggtagaattaagctagtttctcatatggttctaggaaagctctctaactttatgtaagttaaaaatatttgtaattgtggcatttagaagtcgggtcttgtcttcatctaaaaatgcttctacctctaaggaagactccttaactaccataccgacaacttgaggcttctagtacctatatttcaaatttgaattgctttttatgcaaatacttaagggttgaccatgtaacccattcctcttatcaacagctcattcacagaggtctccctaagataggtgaaactatggtggcctgatagccccatgcagttcctacaaatttgagagggtgatttttaactacataggatgtacggggggattatgaaacaatagctcaaaatagctcaccaaaagaaaacactgataaggattccttttctgggttggaaaaacaggatgctgtgtgggcccttattttaaggtcaccggccccaaaggaaaacctatcactgtaattggtgctgagaagcttgtaggttaaaaaatacacgctggggcccttttcttttgcattgctgacttttaggttgtttcttatcccaactgcttatttttagtaatgtaagttaggctcaggaccaagatagaaacccagaataatatccgggcttttaaccttataggacaccaaacccctgaaacctaagaccctgcctgaggcttctttttctctctcccaccatatccgtctccaaacgcattctgaatccatccaagttcatctccactgccactaccttctcttgcctagatgaccacatgagtccagaaactggtctctgctttatggtttatcctctttattatccgcaccgaggccagagacaactttaaacggcagaaatcagattgtactgtctcctggctccatgtccctatggcttcccaaaaccatttcaattaaagacaaactctttgttcagtgtcccactaagccctcctggatgtgacccctcctatctctttacttcctcctcctggacacacactccagccaggttggcaccctccactgcggaactgcctccttgcaattctctgggcattttctctggctgctccctctgcctggaactctatgcctgcagatctatgtgtgggtggctcctgcctttcactcaggaccctcctcaaaggtgactccttcagagagccaaccagagatccaggcaggctaccagcagatctgaagtggcccttttctgacccactttattcacacaacccagtgtctttgttttcattgagcctatcactctctaaaatgaccttgtttacttgtctattatttatattgtttattgtttacttattgattgtctctatttcagggacctattctattttatcggtctatccctagaacagtatctggtcaacagttcaataaacacctgtatctctcaaatgcatgtatgaatgtgcagagctcatgaaatgagtttacaccttgaaagctgcaggaagagctgatgaggcaaaggggaggagctgcttggcctttctttttatagccatcattgctgcagtgactgtttaacagctcttgatccttggtctgttccttgatttattggtgagctgccaggttcggctcaactcacaactgcctcactcagcacagagaacaaggttccgctgtgccacctggtgtcctgacttcccatcaccacagatgagctttggtctcagaacaaactgaaagctcagagggaaacaccaaaccctataagctccccactccagcaaatggatatgttctcaaggattctttgagatctaaatcttcaggtaaggatagcttcatatccttacttactaaagcaaacttttattacagcactgggttcaatgcctctcaatgcctcactcttccctacaaaaagcgaacacatgctgatgaaaaaaaatctcagatccttttcttagggcaaatccatgaatctcttgagcagtttcaacagactgattgatgtgatggtcactttttgtcacaagatacttctgcaaaataggaaaattttccagcttgctctggaggggggtacattgtttggcaatttcaattagctttattcccaaactgcttaattgcaacagaggccatgcctggtaccatatcaagctttactccaatatcttaaatttaagaaatcatataagccttagaaaacacaggtcatggttaacaacagcaaggcgatcgggcttcaagtcctgccgcactgcattattcaaagtgtctgcaagtcagacctaaagaagtcatttactgaggggtcaggttttccaaagagcatggacatacagtgagcagccccattcatctcccatggagatattaaatgtcttcaaaatcctcttgctgaaagagtatctgaactggtctaagtgattatgtgacttagagggaaaaaagctgtttccttgactatgtcaatttctaatgaattgctgccccatatagctatgaagggcaggagacgcttgggctttgttcagctattagatttcaggtttcggtgaggcagtgctcactgtaccaattggatttgcttaaaggctgagtacaggaatcagtttcacccacatacaccccaacccacacactatcccagttaggacaagcctcaattagaagtaacttttataggtccagtacattggagatgcaggaaaatgcaagaactgtgaggccgtttaatgaaatattttagttgggaacaagatgtgtaacaaagcattgcatttatggcagggaagagtaagtacaatggaaacgaaatacatgctgacccagtaagcactcaagtcaacaactttctcactgtggaaaataaatgccaagatccttttgctttctctcttgtctgattctggctatttcctactgtttatttatttcttggtaaatgaagctctaatcaggctttgagtcaatgcagatggtgatcttaatgcaagcaaacacaacttgaaaggaatttttgaaagctgtcataaagtttctgagactgctttttacatacaagaaaccagctatggatattttggggtgccctcgagcacactaaaggtgctcggttcaccccatttttgtcttgcttttggatttcacttctctgggttaccccgataacttatataggacaaaagagtttcataaaagggcgtgactaatagatgttatagatgttgcgttacataagagtgacgaatataaccccggccttgaatccgaacgctttcttcctgaatgaagatctaggggaagcaatgatcaaagaaagaggggagctcccatttgctcttcccgaggtttggatgccagagccccactcacacattacttcggcagctctgctttcgtatcctgttctattctcaacctcctgtgggcctttccctagagcagtgattcctggattttacatttcataagccagcagattttgaaaacatagaactgagcaattgatcctaagttgccaattctttcttttgtgaactaagaacattaaaaaggaggagataaatgataacaaccttttcataagaaaaaaaagaggcactgggtgtggtggttcacgcctgtaatcccagtaccttgggaggccgaggcaggcagatcacctgaccagccagatcaacatggagaaaccccgtctctactaaaaaaaaaaaaaaaaatacaaaattagccgggtgtggtggtgcatgcctgcaatcccagctactcgggaggctgaggcaagataatcgcttgaacccgggaggcagaggttgtggtgagccgagatcatgccattgcactccagcctgggaaaaaaaaaaaaacaaaaaaaaaaaaaacagaagaagaagaacatcattacctataaagaagaatctttcatattggaaaatcttcacttcatgaaaaacctactactccatcctggtttttctcattattgtttactgaaggaacgtgctgtcacagaccaaaaggaacacatctcctaccacctttccttccaggctcttccttttcaccttccctaaccttttctctactccagacaactaagtcaaaggtactgaaaacaggaggtctgcttcagcctctcctccacctcttttctcttaagctccattcaatatgacagagcaaggggccagaaaataagaaactcttcatcagaacagggcagcgctgaaggtgtaacaggccctcttcttattccatcgtcatgacagtgctgagaagggtgcagtcctacccatacttcagatgataatctggaggctcatggacacagcccagggctggctcaggctgcactgctgggtgacagcagagatcacgctggagaccctcacagctgactacactgccactccgttactgaggagatgcagaggcaacactaagaagaagtggggaattctccaataaaatttcttcaatccatattcaacaaaaaataacccagaagtggatttcatttgtacctaaacaaacagaacacagagtttctaagaagcaaaaccaaatgggtgttgaaggggttaaagcagtggttctcaagcacatctaattttgctctttaaaggacatttggccctgtctgaagacattattggttgttaaaactggggagacgggggtgctaccggcagctagtgctaggttataaaacagccttctcttcctcctttagttaccaaagtctacgtgaaagttgatttgcagatgcagacaaactatataaacatagaatcccattaattcatgggcagtgctgttattttttcaatgcaatcatctgccattttggtaagtggtctctatggcaaaagtaactacacagaatgcaagccatttttaaatttagaaaaaacaaaaatacctaagagcgtgtagacctaattccaactatttccaagcgatttttgaaaacaaattcatgtttatgtaactataagaaagctttttaaaacatagcttttacacaggttcatcatgccaagaccccttttgcataccgattgcaaaaataaaagcctaattaaaaactcaggttgctgaatgagtggagtcaacagccaatgctagggaaagaaagggattccctccatcacaaagtcatagctggtccatgttgcagcttcatagttattatgactgctattctatgacacagtggaaaaggacctttaaacaaccttgcaacaaatacaaagatcacaaaaagggtctattagaatttttcatggcaaaggtaatacaccaaatgagatttctagaaaaagcattaggcatgagacaatggggaagctgtgattaaccacactgtatttttgatgtttccttcacggcactcctctataatgagagaatagcacggtgctaaagtttgttgaatgaatgaatgaatgaatgacacttattgcatatggtgaggaaccaaaaatgttgagaacattagaaatgcaaaaaggaacactattaacaagagtctgaaataagcccaggtaacaacttggcaaacaataaagggcattttccacgttgccagtggaatcatattactcctaagggctccaggctatttttgaagacattaagattctacctgcaagatgtttgaaccaaaaaggattatgttcacaaataggggacatgattaatatttaagcagaaatacaaacaaaggaaataccaggtaaggtagaagttttaactttacaggtgacactgcaaagacagactcagtaagcaccatggcaaatacttccctccagatggtggtaaagaacgtgtgatttcatttgagggaaatgaaggaaggtgggaacattttacacatggtaaactctgtctcagataacggtttcgaaaatgctcagaactgaaaaatgcttccgatagaagtaggatgatatctcttgcaataaagagaagttcaacaaagtgaggctgcaagcacacactggggcctgtcggagggcggcaggggtagtgacagcatcaggaagaatagctaatgaatgctaggcttaatacttaggtgatgggatgatctgcagcaaaccaccatggcacacatttacctatggaacaaatctgcacatcctgcacatgtacccctgaacttaaagttgggaaaaaaagactgatataatggaggatgctaatcataataatattcctcatagcaaagacttttcaaatgggaaacattatccaaagttgctgacaactaatcaactaattttcacatggaaccaaagtaagggtaggaaacaaactccaaagttaaggggggaaatgtctgatgatatatggtttcttttttttttttaaagcataaattaaaccaaaaagaaaagaaaagttgccagttactgggattttgagatgatggtgaaaagaaagtcctaggaaatggatccacaacaggcctgcacattcatgtatgatatcattgcctttcttgatgtttttgtgtatgctgtctttgggtctcaaactcaggtgatttgtgggccacaggcacacaatgggcaagagtaaggacagatgtaagaaacagcaggccagggggaagctggaattgttggctccagctaaatgcattcagatctgaaaatattttttttaagactgattaaaaaatacatgatgagtcatgtcaaatactgcccatggaccagttggtaactttaaatccttcctatatttcaaagcactgctttagtccagctgttcttagcagagggcgattttgccccttaggggacatctgtcattgtctggagatgtttttgactgtcaccgttggagaaagggggcaggtatgtgacaggtacctactcagtagagaccagggatgctgttaaacatcctacaatgcacaggaggagttcccgcaacagataactgtctggcccaaaatgacaaactgtggaggctggggcactctgctccagttccagcagactgttgtccatcctccgtaccccaccattcacctattatccaaatatgtatggcacagactcagactacatattactgacggtaaagctcacttgttagtcttgcctccctaactagattgtgagtactattttctccttatttcagaactgtgcacaaacaatatcctcagtccttcatgaagaacaagaatgggtcaaatggaaagaggcttgtggctattactactaggactatgaaattaaataggaaagcctcaaataaatagaaatttcaatagtttgcttttagagggaaaaagaatgatcaaatctagttccatcttctgcacagtttacacagactaaccccaaggcctaccccttctcacctatgttgcatcccatcttcttccccttcttaaatacttcactcctgcaaagagggagtgcaatgaatcctcctttctcctccaatcattactttcttcctgtcttttgagtcatccctatccatacacaagaacgctgtggtatctctcatcttcaaaacaaaacaaagccctctcctttgactccacacccgtctccaggacttgttccactgcacagcagatcttctcgaacagcttaccccaatccctatcccacctcctcccctctccagcctctccagcccgactgcattagtagccacacttcatgggtcctgccctcaggggacgttatgccacaggcagtgttttcacccctgcaggcctccacctcttgacccatgagtgctgctacaatggtcttgtgacactgtcttctcttgggttctgtgatacaacgctttcctgttctttcttctatctgcgctggcggctccatctttactggggcctcctgctcagtctgacccttgaatggtgatgtgcctcagggttctgtcttgcactttttctccctccttcctgctctttccctcagtaatctcattcagccccatggctctaaataacctctgattctatcttttacaaacttatgtgactatgttccacaatgggaaatacattttataacacattcatacacacacacacacacacacacacaagtgtatgaatgtgttacaaattgtatttcccattttatgaaatgtgtgtgtgtgtgtatgcatgtatgcatgcgtgggtatacacacacagtaaatatttcataaaaaaggacttatcttcagtgagtgtgatacactctaatgttttctgtttcacttccaagaaaaacactgggtgtagcccaatacattgatttcacagcccagtaataggtcacagcccacagtttatagaatactcattgagacaataatggctcataaatgcgtatttttcctgacctaacctcacaaccaccaaaccccagattccagacaactgcctacatttctgtttcatttggatgtcaaatgggctttcacaattaacaagtgtgagaagaaacccttgattttacagctcaagtcctacctgtttctaccctaggatccacatctcagcaaagattcctcccaggtcaaaaattctggggtcattttggctccctcccttttcctttccttcagttggggtcagcaaatacagcccatgggacacatacagttttcttggaacacaaccaacccgttcctttacatatcgcctgctacaagggcagagtagagtagtggggacagagactgtagggcccacaaagcctaacatgtctaccctttgtctctttatagaaaaagtgtgtccccccactttacagtcaacctgtggagtcctgctgactattctttaggtgtcccaagtcccccactgccgtgatcctctgtctgccctacagtccaagttgctaacactcttgcttgaactactgcaaaagccctcacaggtctccccttcccctcctgttcccctaaaatacattcttcatatatatgccacagggactatctgaacacgttactgagagcctgtcccttcaccgtgtgaatctggacctcacactgcaaatggaattcgaactccaggtcctggcctccagtctctgacttcagccatccccatcccctgctcccctttctccaggcacacaggtctctgttccaattctttcttagggtctttgcactaactgtcccttcctgctggaataccgtttccttctctgtggtcactcaagtttcacctctaatctacaagagccccctcactgccaggcctgccacacctgttcactttacctgctctgatttgcttcacagcacttttctttggctggcatgattttgttcatttgtttatttttgccctttctccccttcccctagaataaatgcctcatgaaatcaggagcctgtttgtttcatttgcagatgacgctgctctattcccagtgcctagacgatgacaggcacgtgatgttaatgaatttgtcccccaaaaagagacaacaaagcaacttctttatattcaaattccacacttaaataaaagcacagaacaataattctacagcctgccagccaagggaatgaaattctaccactcttccagaaaggggaagggatgacaccacaccttaatgagaactataaatcacacacgaacacatttgtaataaataatgcatataagtaagtaactcaatgcattaagtttaccttcaaggagaatgagacattgctttgtagaacaaaagtaaaagttttaggtgtgccaaccactttgcattgtgaatataacagaaataaaactcaaatcatccaataaagtctgagttgcatacaaatgttaaataagtaaagcttgcttaagtttaaaaaccatgagatcaaaaatccgtaaagaaaccagaattccttaagatgtgaaagtgaggaataatttttaagcattatataatgaaagacagaatcaaaatagaaacatttttatatttatctcatctcttgctgtaagtcatctcaaatataaatgtgacctgtcactctacaaagaattctcaaataaaatccctgataactttaaaccatggcaataaatcaaaatagcaacttaaaactgcattatgaataaaggccagaaggctcctttaataccaaattggaatgccatcctgtttagcatggtggaagtgctagaaaatttgctaattttaacttgaacaacttttaacagctagaagatgttaggcagcacgttggatgtgacaagaggactcaacttacaaaattattagaaaatacaagcaccacagatagtggtgagtgaggtcaatgagtttgagatactgaatcaatgaatcagataaatacaccaaggagacttcaaagtctcccctttaaaacagacttctgacaaattgtaacttgctgatagctcatatggcagattatacatatttgatatataaaaattttagttgagtttttctcgtgttttgaggtttcttccattttttagattaaaggtactttaatgaaataatttaatttaagctccttaaataacatcagtctagtataaaagctgagatgcttcccagccaggtggaggtcctgtaacccgcttataaacttgatgacaccatgccaggattgagaaagtggagattgcccccaagcacttatactttacaagtcttaaatcctctgagtgtgaattccttgcatcccctaacatccagttaacacatataaagaactcagagcagttactaaacatggaaatgatgtaataaacaggacctatgtttatcactctctgcataaaaataaatccattaactatgcacgtgccttcaatttcatatttttcttctattcaaatgtataaaaacaaaagaaagggtaaaataaaggatatccagcttctcacttctgagggtgcaataattaaaatctctagaactgtgctgcgtaacagtacttcctgcaatggtggaaatgttctctgtctacactgtcctatatcgtagccactcgccacatgtggctatggagctcttgaagtgcggacagatggactgagaaactgaaatttaaatcttacataattttaatcatgagatagtggctacttgacaagatgctggagaacaggctttggaaccaacatgattcactgacatgaagctcccacatcttggcctatggacacaatgaacaatgcatctactagctgtttagggcagcctgtgaacagagcacacagctatggcaaacaaacagacccgggttcagagtcaggatctgtcactttttagctgtgtgactggggggtggtcagtctattataatgctcacaacctcagaaagttctctcaggattagcacttatgaaatcaaagggtcctgcattaactcatcttttcattcaatgcagatgattttctgaatacctataatggactaggcaccattttaggcagcagggataaagtagtgattgcaaccaagtcccttatctgagggggatcacaggtaggtatagtacataagaaagatcacgagaacagacagtgatcgtgggagatgctgcttgatttatgaggaatggtcacggcagactcctcagatgaaaggggatgaaataacctccgagccgaggcctgaaagatgtgagtgaggaggtcctgtggctacctgggagaagaaaaatacagacagaaggagatgtaagtgctagggccctgacacaggactttggagttcacgcttaatgatgggaagctattctgacatgaggaactgccttgatctgatgtactttaaagcactgtagctggagggcagactggaggaagcactgagacctgttgcgaggccactgcaaggccaggtgccctacaatgggtggtaaaggccagggatggggtgagatgtaaaccaagtttgagtacactgagaagggagaactggcagtatttgctgatgggaacatataggaccccaacattattaagatatcactctatacacaacctgaattcccctttctggggccctacagctcaatctgagacattgtggcagtcaagcacttaagcagtacaatgtacaattcattctctggtccaagaccagagggcaaagaggagaagtgcctgatcacttgggtttaactctctgtgcatggcttaccgtggttctaattatgatggttttgtatcatttcagaaaaacacacgtgcgtgcacacacgcgcacacacacacacacagagaagagctaatgctaatgatgcacttagctaacgagattagatactgctttctctgtttggatcaatgacgatttaatgaactaaatatcatcagtaaattttgatgagaattaagaggcattactttgcccacagacttcaggctttactcatttctttatgcataagatatagtcttcaataattatggtactggagcaatttcttgcctgtaaggcaggaggcttttgggcagagtgtttaagcactgtctggagccagtcttcctaggttccaatcctagctttgccactaaccagctaatttgggtaaaccacagaaactccctgggcctcagcttcctcttctccaaaatggagctaagactgtatttacttcagaggactcttatgaattatgatatgtaaaatgtctagaagcatgcctggcacactgtagaagcatttattgttttcattccaaatcttatgcaggttttcccaactaaaacagaattttctcctttgctttatactaatttataccaaattaagctgtgggaaaacaaaaacaactccttcttgtattttgtcctagcatagaagctaacaatcactgccttcatttcacaaggatccaacccatcatcacattgcaaattggtggcagtttcaatgtggttgcaacaatgaagtcttgaaaggttttatttaccttcttgggcatgtgtgtgtgcatgaatgtatgtatgtgtattgcatgtatcatggtaacacagcttgaacatagtaagtactcaggaaatgacagtagtgacattatcattaccatcaccaccaccattttcttatctaagttttgccttttaactctcattatcatttttctagagttacaaagtgtgcttataaagctagaggattaatcttccattgtgactggtggatcaagtttaatttattcagctatgacttactgagaccttatcacttgccaggttccccaggaagtgccagagacacaagagtaagagtcaaacacattactgctctctaggaattttaacatttcatgaatgtataatcagaccctgaaattatttagcggcctgaccaaagtattcagtatatggtctgtgcaaactagaaaggacaatttcacttccattactgttgtgatcagcaaaagccagtgggagatggcactctaaatgagcatctccaatagcaagtcccctttctattctccttggaagtagaaaaatgtagaatgtgggagctgaaatggaccttagggaagactgaaaagtctgtcacttacaaaacagactttaaaagttgaacattactcagaaacgaaaatattaaaataagctttataaacttattttcatccaacttataggtcaaagaatcaaaactagaagggaccgtagaggcagaagcctaacattttttgcaactctggttgtatatcagaatcaccagtggtacctgggcaacacagtgagaccctgtctctacaaaacaattttttaaaagagattagcctcacaagatggcacatgcctgtagtcctagctattcaggaggctaaggcaggaggttcatttaagcccaggagtttgaggttgtgatgggccatgatcatgcactccagcctgggcaaaagagcaggaccctgtatcaagagaagaagaaaaaaaaaacctaccagtagaacttctaaaaaaaaaaaaaaaaaaaaaaaacaaaaaaaaacacacatgcctaaacatcatacaatctgtacggcccagctagaactttttataaaaaataaaatattaatgcttccccacccaattgccactattgctttatcatgtgatgactactacgtcaggaattggcacaaatgctaccttatttaatctatgtacatcatgcccatttttttcagaagtctaactaagctcagagaaggcaagtgacttgcctaaagtcacaatgcaagtagagcagaagccaggatttaaacttgcatcctctgtctccacagtcctgtggtctttcctctatacaacaataaggtcatcccttgcataaaatttgagccagaatggagtgcctgaaagattctctagctcaaaacattcatcttttagattaaaaaaataagtgtcagggtagaagtagtacccttctgaagcatatgcagaagcttacgggcagagtttgtactcaaggtcagctcctggtatcccaagttcagttttctttttaatacatgccttctctcaaaagtaaaacataggatcttcacttgcatacagtgctgccaaatcttttcttgaaacggagtgttgtgactcaacatgaaattacattttaaagagtgtcacacctactgataggtgtgaatttgccgaatatccaaaatatttgacacagaggggcacaggtagttacgctatctacatgagccttttttaaaaaaagtaaaaaatccttatgggacaagttcgatagcttttacaaattaaaaataaaaatccacaaactagtttgattttccaaacacttcaaagaagtctctagatgcacactgatgtcaggtgacaggatttctgaatgcagatgctatgttcaaaatagaagggtaaaaagcactttcctgactggacagcagagggagaaggagtaaggacacacaattggaagaggggagccagacacagagaagaactgccctttaaaaacctgagtgatcgactggcaagcagggagatgttgatgaagaggagatttgtaagcaaatcaggactggtcccggctacttgggagtatggatgaacactgcacagcagctctaagcctgactcaggaaactgtctgaccctggacatttacaaatgatatttcaaccttcagctcgatttccagatgagggaagggggatggactaaaactactaaaaatgaaatgtattagatcttgacaagaacaaatgtcaaaaacgagctctagagatgaggaattaaaatgggtgctacaaacatagcagccagttctgtcccaaagtaaaaatggcccgttctttaaagcatagaaagccacaacctcacgacaggaattcctgagactcatggaacagtgtagatgagtttatcagtcatcttactagcagttacaaaataaactagattcattagaaagaatcggtaaagtgggcatttactttctcattgaacctagctgttgtcttgaagcaccttcatcaagccttctcattacatccccactatacagaagagatgattaaatgtcagccctgattcaagcaactaatgtatggcagaaacagatatatttatatgccttccagaaagattaatagtatctagtgctagcctgccaactgcagatgtacaaactttctatcctatacataaatcatacacaagacatatggtgtattttaaagactgctgatgtcacagtgattttaaattactcatgttctgaaataaaccatgtagatgttgatgaatatggcaatatattccggatttttcatataaatgttataaaatgtaacaccattaatgagaagatggcattgggaattaagaagagagaatgcaaacatatttaaaatcaaggagtatagtcaggtgtggtggctcatgcctgtaatcctagcacttcgggaggccgaggcaggtggatcccttgagcgcgggagttcgagaccagcatgggtaacatggagaaatcatttctactgaaaatacaaaaatcagccgggagtggtggcatgcacctatagtctcagctacttggggggctaaggcaggaagatcgcttgaaactaggaggttgaggctgcagtgagctgagatggcaccactgcactccagcctgggtgacaaagtgagaccctgtctcaaaaataaaaataaaaaataaaatcaaggagtacgtttctataatcagttgtttgctggcttaggcgaattcattacaatatggttctaatacatgtgtaagttagttggctataatgaaactttatgtttggtctccttagaagtgaatctaatgggataataaaccacatcaataacagaaatgagaaagaggatagatgagttaggagaacaaggtggtttgtgtctgtcaaatgagcagtggctgaatcagaggtgcacctgatgtaccaagaattatttgaaagtttccaggctgtcagcctcagtattaagcaactatacaaaaatcagtgttattcagttaagtagggcagaacattggactggaaaccacagagccagggtgaacagctcagaactactgtggggtggcaccttcctacctcacagggaagtgacaaatatcagtggagaggcacgtgcaggtatgaaagtgctttgtgtatcactgattcttctataagtgccaggtttcatcatcaccatcatcattattgtcataatcgttcttatacccaagtcatttcctactacatacatcttggctactgtttaaaaccagttctctgagcagtcaagtgatctaggtacaagaagagacttgaaaattagttggtggaaatgacattttaaaaaaaataaaatttgcacaatgccttttataactgcctaagccaggctcattgagcatttcaattcacatagacagctactctgtattttgggtttccttcaaatgaccccagccattctgatcgcagaacacacaggttcatgaaaacatgagaatctggctgctgtgacacaaatgagctctcctgttgcaacaaaccaaaaggaagtcaaagtctggttcttgatctcttttcaaaaggcctgaatatgttgttcatgaaacaaatcatggtagcaaggatcagggaaacagccattctcaggcccactgtgtaaaactatcagtcacgactaatcacatataagtatatattccaggagcaagacacttcaatatggtggaaagtattgctcagtgtgacgtcctgtgttttctggtgaggcagagggtgggatacggactcaaggagaaaggaggaagcttaatgcctcgagatttagaataacccagatctctgagatcctaaactactaaacgcgagcatgtggagggaagtgtttaatatgattagcagacctcttgtttctgccaaatagaaataatcacatacctattcacttaatacctattcattcataaatacctaaaaggagtcaggtgttgtgttaaatgctggggataacagctgtccacatgcacacatgggccctggctttatggagctttatattctaatgaaagacaaataatgaaaaataaataaaagcatgaaataacgtcttgtgctaaaaaggtgatgatgatcaaggttatgaaaaactgtgataaagattatatggaagtgttgggagctactttagataaagtgatgggagaagccctctctcataaggagacctgaatgggactgagccagctgggaagagctgggaaaggaccattccaggcagaacggacagtaaatacaaagggcctgaggcaagaaaaggcttgaagcattaaaggagctccataaaagcagccagtgtggctaaagcaccatcagatggaggagaggaacatgagacaagtttggagtgaccatagccacattttgcaggctatgcaggccaagttcaggagatttaaaggataaaggttattattttttatatatatataaaaaaactttttagagaatggggtctcaatatgttgcccagtctggactcaaatgcctgggctcaagtgatcttcctgcctcagcctctcaagcagccaggactacaggtgggtaccaccacacccaacttaggtttttaaatcttaacattttaaaaaggcaaaatctgatttctgttttaaggtatcattctaactgcatatgtctgtcataatgtataaaccacaatttttatgctaaagaggttagtatttggagaaatcagtaggcattttgaaacatttaaataaatttaaaaagcccccagtggtcatctgaagatgagtaagttaagcaatgaatttgggataaaaaaaaaattcaaagaacaaaacaaccctacttacctcctcgttgcaccaacaatgtgacctcacttcccttaggacactcaaccagcatatccaccacttggttgtgagttagggcctgcacgttcttcttattaacttccactatgagatccccttctttcaggcctcggcaccttgggctgtcaacaatctgtttcactctttggccacccccaccaggactgtctgcgatagtaaaaccaaagcccattggccctttgacaatatgaacagttatgagttctggctgagtggctatggaggaagccaaagaaacagtgtcattaggataaccatgagaactatttgaagccacgtccgctgggctgcttggcctggcatccttcatgccattgactttgcctgttttactactgtggctagctggtgaatcataggtctcttgcccattcacaataattggttctttatccaaaatggctaccgaggtcactaaacttgtattggggtcatctggatcaaaaggcaatggataacctcggcagagttcaaggtccacgctggcaccaatggggatggactggaagatcttcacaacttgagcatgtgtgtgtcccaaaacacaggtgtcattcacacttacaatcacatcccctgtagaaggcaagagtgtgggggttaagaaaacagcacccagaaaattgtcatcagtattataatatctcccactaacataaagctgaactgaaactgcatgtgggtgtgatactatagggtataaagtgcttctattactgattttaacagctaataaagtgttctttcagcacctagtgtcttccctgctaatgagaatgtaataatcactcacagaacattggagctttctcctaaaaaaaaatctcactgcagaaatccaagtttagaattcatttatttaaatggggatctacagttttagtaactcattgctttactgtactcaaacagtttcccaaacttaaaatgacttcacaggttttaatctgtcccaagggatgaatttatgtaatgtggagacctggctcattctcaaggtgtttaaagctgtaaacatgtgcaatcatgacgttgcttggtcttgctcaaacaaacaacatcatgattgcacatgtttatctcctggattggagtctcaccacacagaacacactaaggccatgttgacgctacctgtttccatcttgccatccaatgcagcaggaccatctaggaccaagctcttgatctggagaaactcatcaggttcatcccctccaaccaccgtgaagccaaagccacgactgcttttccgcagctttgtgtgaatgaacttgcctttcaactcagaagggtttcgtgtaaaaaagggtttgcctggattaaaataagaaacgcataaggaatgtcaccactggtgaaaaggagaattaaacaagatttgagacaacatatagataattcttcacgcttatgccctagagcctttgggcatatagcatcttaagaaagtcctctcttaatttgaggaataaggatgttcctaggccccagtgttgatggagggaggtaaagcattgagtatgtcaactccagggtccaaaagaaactacaagagagggatgaaactagtccctgtcaggtgacacacttcttggtttccattcatgcactttgacaggaattgagctgccacaaaccccttcacagaaaatggaactggtctgttttatgtcttttgttttgttttaattttattttgctatatggcttctgatgtgctgctttgggcctggcttccacttgaaaaaccaacagaactaatcaaacggaaaatccaggctgaaaatgcacagataataccagaaaacatattatagtcacaaataataatttgacaaaaatgtagaatgactattttcaaaattaagggtcattactttgaattgaattctaaattcaactgattttttcctatttatctgatcttttattaaatttgtgatatagccaacgcatgcctagggctaagaattactgtttaaaacaagtttaggatatttgtttaaaaaacacaaaccaaaaaaacaaacaaagaaaccccccccacaacacacacacacaaaatccctaaactaagtagttactaacagtagccacacagctccaaattcagctgtcttatttaaaataaattaggctgggggtgtggtggctcatgcctgtaatcctagcactttgggaggctgagtcaggtggagcactgaggtcaggagttcaaaaccaacctggccaacatagtgaaatcctgtctctactaaaaaaaaaaaatacaaaaattagccagatgaggtggtggatgcctgtaatcccagctacttgggaggctgaggcaggacaatcacttgaatccaggaggtagaggttgcagtgagctgagattgcgccattgcactccagcctgggcaacaagagcaaaactctgtctcaaaaaaataataaaaataaaataaatttacagatagaggtatcgctaaattatttccaaacatgctacctaaggttttattgagttttcttgatacattcacaaataacattttgaacataaaccaaaacgttttcttttgggttttactaggcacttctctgtaattgagaaacttactggaacttctctgattatcccaagtagtagacctaatttcatgagcagcttctttcatctcttctaactttacttacttcttataccctgtccttgccacacacagcttctccatctgccctgtttcttttctatcaaaaatgttatccaaaacaaaaagagagagagaaagagggagacattagtcccctacacccctgtactaggagcctggcacctaggaaagaaagttatttttggttagttatatctaaaagagtttaaaaggtctctgggcatgcatacaatttttaattgcatattttaaaagtttctggctcttgcaaagaaggctcttttaaattgcctgcaatcagaggtcctttcgctaacctgctctctagcgcagtcccaaagcttattggaaggttgacaaactacagccctgtcatagtggctaaagaaaggcaagacttacaaggattcgccacgcaaagtcatctgccaaggcgttgggagggtggtgtcacttgcaccaagagctttggggagacagctgccaagacaattatcagatggaaattgaggtgaggtaagataacccccaaagtttactttagggggaggagggtgactggcctacactcttgtagcaggtgctgctagggcattccagggccctgaagggaaacacatttcagttatgcagagacatcaacagccattaccttcgcagcaagaccttccctaaccaccttactaaaaattgcagtacctccaacattcccaatccctttttcctgctttatttttgtccttagcatttaccaccttccaaaagaatatacatcttacttattgctttggttttcttactatccccaactcccatgcatgagtggcattgatatgcaggtacataaaaccactagaatgttagctccatgaggatttttatacgtatatcaagtatctagaatattgtctggtacattttatgtgctccaaaaatttctgttgagtgagagaatgaatgaacaaataaaagcacacagaaatgatatttatcatgtctttgagaaggctgaaaagaggtgtttggttgttggagcttttcactcttattataggctaagttagaaaacgtgaaaatgtgcctggcagtttatctacttaaaaaaaaatacattagcatattttgtgctgagaatgttaacttaataaagacatgagcagagctttgaaattatacgactgacttccttttccaatgtttaacaagggaaggaaaatcagagggtttcacatttatgcacattttattattttttacgtatgggtggatcattagttaatgtagcttttggaaagaaacgcttttcaccccataagcagtggaatttggagctctcagctgcagccctgtggtacatgtaattttctaagatcctaacctctgtttaccagtcaccagcggtaagacttggttgtgtcttacccagggaaaatcccctgggtagctttttaaaatgtactcattttcacttccttccttagactcactgatcaggatgttctgggtcttggcccaaaactctgcacctgaatgaaccttaggtgcatgtttccctgccaggatggggggaggggaaagaaatgtcacttcttgacactagtgtttaaataccctagaccagtaccgtctaatggcactttccgtgatgatggaaatgctctgcacctgcactgttcaatatggcagccactagtcacatgtagccactgagcccttgaaatatggctagtgagacagaaaaacttaattttttgattttttaactgtaattcatttaaatttaaatggcaacatgtaaccattggcttccataccgaacagcatagatttagactacacaaatgaggtatcccacaaaaactaaaacaaccaaaaacctttcaaacagaagttaaactattcctcatgtatagtgttcaaatctgtgctctgctacttagtggctatatggccttgggcaagttactaaacctctctgcctgagtatcacaagtataaatggaggtaatgatgatacctatttcacatgatagttgtgagaaacaaccatggcagataatgtaggtaaagtgcctgggaaggtacctggcacataataagagctcaataagtgagttattgttttgatggcggtggtgatagagtgagtgtggtggaggggtagctgcaaaaatctctctccaagcataagcttgaagctggagagttttcataagagcaaatctccaaattatcacttgctaagattagaagtacactcttgatcaggggagaatttagttggcctgtgaacttggcaaaattactaccaaacaatctaaccaaattagctatatggcttcttcctgacagtctatcaacactagatactgcccaagatacaagacactagacactagatggctaatcaagacacttaaccggtaggcaggtaacccagagttataaccaatgaggctaaagtctaggttaatgtttattgaaatcacagcttggagccaaatggtatggattttaactggtttctttggtatcagttatattccaaagattataaaagtgcttgaaacgtgtggatcaacagagagactacacagtagaagggtggtaagaataaacgagtcaatctcaaggagagttcagtgagcctgaaccttcagacactattgaatggtatttggaagtggggcctttgggaggtgattataccatgagagtggagcccacatgatgggctaattcttacaagaggaagagaactagtactttctctctctactctgcaccacatgaggatacagtgagaaaatggccgtctataaaccacgaagtggaccctcattggacactcgatctgccagcactttgatctttgacttcccagtctccagaactgatagataaatgtttggtgtttaagccacctagtctatggcaacttgttatagcagcctgaatgaagaaccagtggatgtcttagtcaatcattagatgactaaagaaagaaggaagagatataaggaaataaggaagaagagaaaaaaagaaaaagaaaaaaaggctgagttaaagaaaagtaagaatctgagatgaagtgtctaatacagacaaataccgtctcaagtcttagttggtgcactaagcatttggcactcagaacctgaacctttacagctttaatttatttaatttctaagataattatgtaagaaagtctggttggctattctatatgtatatgtggatggatggatggatggatggatggatggatggaagatggatggatactgtttcactcaataataatgtcatcagaaaatgtatatcaagggattatgcctagtttgggattatctcacagtgaaaaaacaaaaaacagagaatcatagtctcttgcctccatgggatttaaagtctaatgaggaaactattgttaaataatagcacacaaatgaacactagttataatggttaaatttcataaatgtgaagtacaggatggttaagagtaaacatggtaggggaatctagcaaagacctgaggtgaacaggagttagcagagtaagaagtaggaggaaaagacaactgcaaacagaaggaacagccactgcaaacagaaggaacagcctctgcaaaggctcagaagcggttcacagttttgctggttaaaagaactgaaaggaggctaacttactgtgagagaggggaaggtaagaaggcatgagcctacagaaggaattttatgtttacaaaaaaccccacaaaactgaggactccacagtcatgttgatactaatcaacattattatctactatatcccatctttattaaagccattatcaccattaaaaagtgcattcatgccagaagaaattattttacataaattgatactaattctaatctagtgacaatgtcagctagcagagaaacaatttctttcttatgaaaattataatgaattaaaattaaagaaatgaattattattctacttatctttttatatgtaacacaattaaatcttttaaaatatagaaaggaagacaaattttatagtatttttattgtttctgtaccacaaacatcccccaactctgtcaaacatgatgcttgtttaaaagaaaaagaaaactaaacacaaatattttctataatttaagagtaatgaggcctgaaagttgcaaggttctggagcttccaattttcaagaataatcctctataaaggcctcatcctatgtgtgaatgtaaacaaacaagacctattgaaacgttgtaaacatgcataaataccaaaactgcagcaagaatagggaatgagaactgaaaacacaatatcaaaccattttcatttataggaaagtcttagacaaaacctaatatgttggctagactcttgaaatatctaatgctgagtttcagatttatcttttttaacatactattaaatatctgtggtctctaagtcagtgattcctatctctgggatgggtttgctccccagagacatctggcaatgtctggggacaatttccttgtcacaatgagaggtgggctgtgtgctactggcatctagtggccaggggacatctcacaatgcccaggacaaacccacacaacaaagaattacttaccccaaaatggcaatggtgctgagattgagaaacgttggtttgaatgatcatttaacaagtagtctttatttttaaaatattacaaatagttggaaaaaaattattcaggaagattcctaatttttcttgacaagtctaacaatacatttatcattgttttcattatttatggttttcactatcaaaggaatgacttgggagttacgagattccacttttcaaaataccttaaaaaaaattagattttgagctaaaaccatgacacaattagaaagacaagtactttaccctgaagtggaacttctctggctggctctggattgcttggagggtggtttggaataacaggaggcacaagggctgagtgatcttctgtccattctatgaaaaagaaaagaaagtttcctatttttccttcaaatggctcattgagttacttatgattcaccttattattaataatactcaaggcaataaaccaagggcagatagcttagattaaaaagaagttgttatctgacctcattctatgaagctctttttttttttttttcttgtctaagacgttttgggaaagaaatattacgatataatgaataagaactccagttctctctggctggaaagtccaaagtgaagtcagttaaaaaatgtcaggaaagacatacagtcaactaatggcagctgtataagggagaaatttctctaatctgattcagacatgagctgggctgctgaggccagcttgtcttaggtagggaggaagatgaaggtagatttcagcagtttgctaagggtgtgctcttctgttatctctgaatccaaatgagacctattacaaatactcctgggtcctaattgtagtcttattcaccttggaaggccagacataactcacagtgagtgacccttgagatggcaccccagaatcacttccagctcagctaacatattcaattgtacattctcatttgcaaactgcactttctaacactaccaagtttcatcagctcaggaaagatacattaaaaaatttttagacaaaaaataacagatgttgataaggatgtagagaaaagggaatgcttatacactgtcgatgagaatgtaaattactgcaacctctatagaaccaccatacaatccagcagtcccactactgggtatctgaagaaaaagaaattattctatcagaatgatacctacacttgtatgtttactgcagcactactcacaacagcaaagatacagaatcaacctaagtgtccatcagtggataactggataaagaaaatgtggtatgtatgccatggaatactgttcagccataaaaaagagaataaaattatgtcttttgcggcaacatgaatggaactagagaccattaccttaagtgaaacaactcagaaacagaaagtgaaacaccacatgttctcacttctgagtgggagctaaataatgtgtacttacggacatgaagtgtggaataacagaccatggcaactcggaagggttggagggggatgaaggatgataaattacttaatgggtacaatgtatactatttgggtaatggttacactaaaagtccacacttcaccaccacttaatatacccatgtgtcaaaagctgcacttgtacccactaaatgtatatgagaagagttctttttagctagaaaagagactaaggtagataacatttcaatgggtgaatgtacacagacatacatacctactctctctaaattgtacagtccagggcagtggttggcaaactatggcccactagccaaactggggccaattcctgtttggatacagcctgtgagccaagaataacttttattctcaaatggttgaaaagtaataaaaaggagaatactttgtgacatatgaaaattacatgaagttgaaattacagtgcccataaagttttatttgaacacagctacacctattcatttacataatgtctacagctatttgcatactacaatggctgaggtgagtagttctaacagagattgactgtttaaatcacgaagcctaaaatctttattatctggctgtttagagaaaaagtttgccaacctgtagtctatggtttacatttgttatattcaatattatagtaacagaagcattatacttgatattctatttgatattcacatattatattgatgggagtattaagcctatgattctaaaagatcacaatgaaaaactggggaaagccagagtatctagtaataaacaaatggctaaataaagcagaggcattcatgaaatggaatattacgtcaccattaaaaagtataagctaaatctatattagccaacttagtaatatgtgcaagaaataaaaagtgagaaaacaggtctcacatacatactatatacgtataaattattatcagatttttgttaaaatatgcgtatatctatatccctagaaaatttctgcacagggcttatctctgagaatgggaagggggcaaccaggggagaatttaatgttctatactcccgaattgcccatatttttacaaagagcatgaattagtctgtaatttttaaaagcacccaaaactaccagctctttctgattctttacatgtaatgttcctaaaattaaaagttagtttcatgcccagtaactccacttaaagtaaaaatgctaaaagtggtttggatttagctaccagttgcaatgcaaatactgcgggggcaagaaatttcctcccccatcagaaagttctctgatctaatgatgctcctttctaaattaaaatggagatttgagtgactttgaattaggatctccactttggccatccagaggaacatggagagggggttctcttcctccccacaggacatcagctcttcagtgtggcaagagaggactcaatcatcgaggccagttctgaccacacgagggtgtcagcgctcagatttcaccccatgctcccctgatcaagaaaaagcctagaggaaagaggccaaccttctgtctgctgctgctgctgctgctgctgctgctgttgctgctgctgttgctgctgctgctgctgctcaagctgcttcttccgtttggcttctagaaccgggttctcatattgtgtcttcctgttgatgtggctggggaagatagcaaatagtattcagcttgaaacagttcatcccaccagcaaaatgccaatcagaccaagtccctggaatcaaactgagcagagcaggtggtctgagatgctaaccctcgtgtgttaaaatgctcagttagaaagaggaaataaaaatgaagtttccattactgactgcttatatgcactaagcactgggctaccagttttatatgcattttatttaaaagtcctcagtaaatgccaggaggtaagtcctatttttattcatatcttatgaataaggaaagtaagtgtctgggcagttaaatacttcatctagcataatatagctagtaagcaggaaacaggcatgcaagctcagggttgcctgctttcaaatcccaggattttaaccactgaccccactccaaatgtccaagataccacctgacaggggaagctgctttaattcaataagaagtagattaaggaattattgagacataagattaaagtggctatgtgacattgtctgtaacatacaatgccagaactgctgtgtaactgtctgcagtagggttcacagaagcataagcattcatccaaacaatgaagttaaacaaagaactccactcacatctgttaactattttgatcactaaacatagaggcacaattaaaagtacaggccttaggcagagagaatccaaataaagttaacctaagtagatgtgatgtgctcaaaatgacaaagatccaaacacttagatggctacaaaactaattatatatatacacatatatatgtatacatatgtatatgtgtacatgtatacatatacatatatacatatgtatacatatatatgtatacacatatatgtacatatatatggtacatatgtgtgtatatatatatacacacacacacatatacacacacacaagcatatacgtataaatatacattatttattgttttttgagacagtctctctctgtcacccaggctggagtgcagtggtgcgatcttggctcactgcaacttctgcctcctaggttcaaccaattctcctgcctcagcctcctgagtagctgggatttcaagcgtgcatcaccatacccggctaatttttgtattttcagtagaaatggcgtttcaccatgtaggccaggctggtctcgaactcctgacctcaagtgatccacctgctttggtctccccaaatgctgtgattacaggcatgagccaccatgcctgaacttatttttcttaattcaaaataatagtttattagaaatttaggagcatagtattgtgattatttagaactctaagttttttaaaaagctaggctttatttttttaagcaggtttatcaatagaaaggatagactgattgctcttaatttctattaaaggcctacatgtttatttcctaattcttgtagcaatttcattctaagaaatggtctaccattaacaggcacatgaatctgaaaagacagatggagaagtgtgtggtaagataataacttgcccctcaaactagtgtcttcacccataaaagcttttgtcatctgttcctgctctctcttaatgcataaactagttgagggacaattcaaaatgagcttcaaatagcaaaaaccccacagtacatctgtgagaaagatgatctttggggcacacaaaagaaatttattttctgagggtcagaggggcagccaagtttgcctctctgatgccccatattaccaatccctcttgttaggcaaagtggaggtaaaagttagtactggccaaggacacttgctatattgaactcataatttctacagtaagatgctgggcatctattttatggcctggcacttttttcatcttgtgttcatatcaccagggtattatacaaatgacttttcatcaccagcagcataaaggaaagaaaatatgacagttacatcttcagtgtggcaggtacgattatgtttctacaacatttatatggcatttgcttcttttgaagggacttttattagttacctctcatttttctctgaggaaactacataatacaaagctttttttttttttcaatgtcctaacctttgggtttcttttaatatcatcctatccatcaacagttttgatgaaaggaaaaagtgggagcccaatgctagaataaggcacacagtaaagtcacgagggttttagacttttaaaaatgggaaaccagaacctcaggcaagagagaaacaaagaaacacacaaagtctgcatcctaggctagttctccattttctcctcaatcctggcaacatttcataaattaccgtggctgaaccttttgaaatgtatgaatgaataaagaagtaattgctaaggagttcagatctgggtagagcaaaaagtagacgaatcagatactccttgtaaagataaacaatccctcttcatctggtctactgaatcctggcttttctcattcattcattcattcaactaatactcattaagtacctgccatataccaggacgatgttgggcctttgtgatgcagtggtgaacaaaagacatggatcctgcccatgtgaatttaataatatgatttgctattttcagatttattgaatattttctcattcattaatatatgcatacatattttcatcataaaattaatattgttaattggtttgtgccttataatgatgtcaggctgtacttaacacaaatgtacataattatagagaggtataaactaatgtgtggattgtgaatgggcacttactctacatagtagataccatagacagggtcttcaatcttttcccaaccagcaggcagttctgaaaaataaaagaacatttagggcaagaagagcatattcttgaagagcctgggtgttttcaacaactgagttaggcaaaaagagaaagactcataaaaatgctttaaatccaattaaaactgtatatcctaaccaaaaaaaaaaaagtatctattattttataagtgtatttttctacatgaacagcatttctttatctactggtattttatgcaagaaaataaaacttaacaaaatgcagcctttattctaaatcactattaaattagattttagtgaaaatataggttaaacttgccttgaatgcctagttcctatcttaaatgtttacggttttctcattttgttcctaggccatcttattacacaagcaaaaatggatgaaaattaatgtttcattttcagtacaatagtgttgttttgctctccttgaaataaaataaaatctgcatgttatcttctccttgttcctaatgaaaatgcagttgggtttttgaactgcacacaactatcactcaattgctatctctgggctggcccatctttctcagcacttaacctgtgaaagcagtaacacagctcctgatccctaagagctcactatctaaggcggatgattttatttctttaaatgtggtggtacaatggcactgggggatgtatgtgcctttctgaaaactcaaccatgctctacagaacttcctaaggtttcatatcaaaggccaaaactttattaaacaggtaatagttctgtctgaacaagaatctgttgtggaaaggcccactgcaccatattattttacttggtgaaagaagggactaggttgtgggttttttttgtcattaaacaatcctttcaggcagaacaacagttattcaacttaattttaaagcttccctgatacacgtagtcaaggcaaacttatgtaacaccacactctaaagtgaataattagtcctagaagtagctattaagaccaactttgatagaatactacaaacttgaaatatttgaaatagatttttgtttaattcaaggaatcatgtggtcactaatttaaataatgatgtcatcagggcagaaggcttacatataccacaaacagttccagactgaggtagaggcatgcacatgcacacaaacacatacaggctaattactcaaagtttatgttttgttcagatttggctgcacatcaagagacattaatttcatagtttttgctccacatgttacttgtttgcaaacaaagagacaggttttccccccttttcttctaaatcaaaaagaaaaaacatttagcaagttttaaagaagtctttgacttgtaggagacataagctactaaaatgcaagacaggtccaatttgcagatgttgatacaacttggcatttgtatatactgagtcttgcggaccgatgcaaattgaatgcctaggaaatgctttccccttacaaagctggaaattaccatttaaatgaaaatgaaccaggaaaatattaccaaagagttgggaaatcgaagattaaaaaaatgcaaattggtgcacagtcatacatttgtatagggcagaagggtgggtggatgtgaggagaccgcattaagtttcatagaaacgccatctcttttcaaaatctgcaaactgagatatgtggcctgattatctttagataaaacaggggaaatactaagcttttaagttactcagttattaatttgacaaacatttgttgaatgcctactttttgcccgagggtgtgttaggcaccagggacacaaagacaaacgcaagtgcatcatctaagcagaaaattcagccacgtggtatgtgctttgatggagggccgaggagggtactagaaaagaaggtacccgtgacttcttttctagtgcctagtcaacaacttaatattctagagttgaaaaatgggtccagtcaactggcatatctggacatttgtcagtttaaacacatcttttggaacagatgagcaaactccagaaattgaaaagatagtttctcacttccaatgtggtcattaacttaatcatagaaattagtctcctaatgcttaaaatagaaatgggtcatcgattttaaataggaagatggttgtcctagaatttgccatttggttctaaaagactgaaaaaggcagaaaatatttaagtccagaatgacattataattttttaagcaaacactctaaagactcttaaaaaggaatcctcgtatgactaaccacagtcagggagcagattagacagtacaacctatcacagagatttgaagtggctaagatccttttggcattgcccagatataagattgagccttaattctttcatttatctctactactctgtggccttgggctacttacttaacatctctgaaccacatctttctcctggatttacctcaaaagtcaatggtggattaaacaaagatacttctgaacacttagcacagttcctggcacatagaaagtgtccaacaaatggcagctgttccaggaaagcacaaaaggaataggacagatgtctgtggcctgtgtacttgctactcctgcctctgaaaatctcatgctgcactattttgtctccaaagagcaaacattgagcagtcaaaggttctaagttcttttcaaagagatttctctgtatatagattgaaaatcatgttcaaaatcagagatacatttcaaaactgtgacttagttttgggtgggaggagaacttactttcttggctctatctcccctagttggtttcaccacatggataccctataattccaaaagaaggttctgcaggtgctttttaattctggggagatgtctgcagaggacgtgataaattctgcaaaccaaagtacataatggagcaactgacccagctcaaacaacagagttcagaaatgacaactctataatcaaatgatctgtgtccaatacccaagccaactgcccacgcctctcagaggccgattacaaagagggtttccttgtcacatctggaattacattgttcactgaaaacctgacagttgctattgtttgaaattaggaccctcttattaagaaaatgagcagtgagcttgtcaacagaatctggagtgaatgcaacagaaaacagtgtgtgtgcacgtgtgctactctttacacagtggacatgtgcaggcaaaaatcaaaggttttatctctacccttcctacaagaacacatttgggccatttctataatatagaacacattcctcccttgtgctgtgttaatggaaaaaagtaccataagaaagtactgaaaaatccaagaagagggaattaggtaataaataacaacactgcaaatagctaatagaatgtgctgatcacagggacaaatattaaaacacgctttcattaagtcacctcataagcaccatgggagctactcttttggcccctctttatggataaggaaagggaagctaaaagaaggtgaatagcttgtctaagtttgcatagccagtaagcaggggagccacacagtttgatctgaacccagagaaagccaagagaactcatgtttagagtctttaacagcacaagcaagtcaccacgatatcacagttacatgtgggtaaaatgcagaaacttctttcctgaaaatttcaaattcaaatttccagagaagcaaataaggttgtgctcctgtacacagctgtgctatctccactggctgccagcagacagcagagtgatctgtcacacctattacttaggtagcaagagtggttgaaattggctgaacaaatgattaagacactcattttgtgtctggaaaacctatttctgtctctttcatttactttatctaatatcattggattgacaaattctttttttgatcaaattagtttcaaattgttctatcattcagggtgaaccttaagtcatccctctcacaatgaccacaaagacaacttattaaacatctttaaaaatagatccatcaatagttattgaccattgttggcatgtgcatcaattacaacagacaggttccaaatgttaagaaaaacagagcttggttctattctatcataattctagccaaccatgactgattatctttatctcacgtaacaaaaataaagaaaaccaaatgaatgcaataatctatactaaatagacttatattttcaggtctttaggcaatctcaaaaatgccaggcagattcaataatcttagtacagttccactcatactgatgttaaacaatcttctacttaaacaatcttcaattgctaaagaatcttccatcagccgaggctttcatcagcaatttagctgaaacttatgctttcctatgtatccatcagcaaatgtatcagacggaatgcaaactaattttaatgttgttcaaggttgaacataaaggactgaacgtaatagcaaacgtaattcaatatattccaatagcaaagaaacaagaatttggcatcatctgctagtataaattattcctaaacaacaataactagagtagtcaagacttgatttgcattgacacaactctaaggcaaacagtacatacagatgctgcatcactatataaacaaccactcactacaatggcaaggtcaacaacacgtggtctgggacgtaataacaacacaatcctaagacttaactattcaattcctcagtgaccttcttttattgcaagtgctcctataatgttccttaaactagtcttaattgatttttgtttgtcctgcttggcttttttgtattacccaaataaccatccgtactaaacaaataaagaaataagactgagacaggttatgccaaagttcaagggacacagcgagcatctcttcggttctttcccaatcctcactttacaagactacccattaccaatttgctaactctcgttctagtctctgttcagtcagacattttctttgtaaacataatgtactacaactccgcgtgatgcctgcaggcagacacgcaggttgtaagactgacctttcctggataagctagaatgaaaatcataattggaggagtgcaaactaaagaaacagggattaagcaattcactggggaagaaaaccatgcaggccatgtcatgcacgtgtcatgcagcagcagcaggcagggagggtttacctagttcactgtccagctcctcggtgtgtaccccttcttctccaaaggaatagcaggaatgagacagaaaagagagaaagcaaaattcagacaccagcaccaagaaaggaaatctcctcaggaaaacagcagcaaacacatcactctagttcatccttacctgcattgtggcttatttcattggcttggatagtaaacttgcgacctcagtgtaaatcacaaaacgggaagagctgatattggcaaaataattacatggctcatttccttgcatgtcaaaataggatttgattggttgtaaaagatgacaaatacctttgcggtttcaatgttcttaagtgggaagtcacttattacagaccttattgggagtaaacaaagctgttagacctttcattatcagtccttttaatccttcaataatcctctaatcagtgaggcaattatactcacaattaaagcattatttaacttacaagtaacagtgctgcttgaaaaatggaaggtgaggtcaaattgaaagtgcagactgtataatgagctaactttgatgtctttcaaaaaggagctggaaagatgaattacgtcaagataaaatatatcaaagaagaaagccttgaaaactgccctgaaggagtgttgggaggcatttaactggttttgtgagaaaacacatacacacacacacacacacacacacacacacactttctaagtcaaggagctcagaaatattagaattaaaatgtcctcaaaaatttcagggagcaaaacaagtccaaatcctttctgttcttgacctcgtcctcttgctgtcagtacaacattttcttattgttgagaagaaaacatgggagaacacacaaaaatcatttcatacataatgtttccccagggtcagggcaagtggctcctataagcttcacaaacacaggaattgagcctgttttcagtaccacaatacgctcagtgcccagtgtagccttctgcacatgttaggtactaaatatttcttgatgaatgaatgaatgaaccaatcaatcaatgattgacttaaataaccaacatgggcctagacaccttgtaaactcttgatttgttgtggggtggggggagggaggagggatagcattaggagaaatacctaatgtaaatgacgagttaatggatgcagcacaccaacatggcacatgtatacatatgtaacaaacctgcacgttgtgcatatataccctagaacttaaagtataataataataaaaaaatgatcccactgccagcggtaagttttgattggcaccgtttcttaaaaggagaatctaatttacacaaagtcatctgtgaaaatgcccatttggatattatctaatgtctttgggagcatttgttcacttcttcagtagttatttatcaagacctatgatgtgccagtcactgtgctaggtgacatatcaaaatgaacacaatcaggggccaggcgtggtgtctcatgcctgtaatcctagcactttgggaggccaaagtgggtggatcacctgaggttgggagttcgagaccagcctggccaacatggtgaaaccccgactctattaaaaatacaaaaaaattagtcaggcaggtggcgctcacctgtaatcccagccactcgggaggctgaggcaggagaatcgcttgaacagggaggcaaaggttgcagtgagcagagatcatgccaccacactccagcctgggtaacagggcgagactccatctcaaaaaacagaatcagacatctctacttttccagaacaggagacaaatccaaggctcacacaaataaaactaaaattaaaaccatgataagttctcaacagagtaagatacatgagtgacctaatcatatttttgggggcaaagtcatggaaaaattccctgaagtataacctgaaggatatgcaaagtttaatgtctgttgtattcattgacacattcgaatacctaggatgcacgtgacatacagaaattattcaataactattgtgaaatataagagtatagtgaaatgtaagcgtattctaagagagaaatgcacatttaactgacatgaggcaggaactcaatgaggactagtggggatgaagagcagagagcagagaaatagtgtgagaaaacctagagaggctgaccacacagggctcagagtagcaagctatggacctggcatttcctaagcagaccctgtggaggttgtcagcgataacatcatcacatttacattttaaaagatttctccgagtacaacataaaaaggagagtgaaaagagtctgtatgggagatgagcatgatcccagatgagaatggaagatgcggtgaaaaaaatagtgaatggatccaagagatatttaggatgccaactgaattcagctggttcacgggttagaaataggtgtgaagaaaagtgacatatcaagggggaattttgagtatgcataaatttaccatgaatggagacaggaaacactttgtatattacgtaatttggggggaaagatcatcagttttaatggttttaatacgactaagtcgaagtatctttgagacaatcgttgacattatcaatcacatggattacaatattggtctggagttcaaaggcaacactgagggcttctaactgaactggacacagcagtgacagaaggagtcattcactaacatcaaaatctcaaaccagtttctcgattttctgagataggaaatagaacatattaaatctttataataattaagtatgatgctatactgttacacctcatatgtatgacctacagagaacagaaagaaatacagggacaatatttgcaaccaatatgtttttctgctttgtgttataaataataacaaggcagctttgcgttaactggcaacagaaaatgcaaactgatacttaccataatctgattatatatttatactgtttgtgtgtacaggcacacagatatacatagaatttctactagaaacagaatatatgaattctaatattaaagagataattataaactaactgcatttggtatgaatacattcttgttccaaaggaaataacattaacacaaaaagataagaattttaagaattaaaaattactagatttggtaacaaaaatgccaattccattcaatactttcactctatgtacagtttttctcagtaaaagctattgcagtattctatcacttataatattgtattaacaagcattttcatacattcccagaataattacaaaagggatattgacattgaagaccctatggtaataagtgcctaaattgctttcaaaatcataaggcatcaaataatgattattgttccatgaaattttagggttgaatgtgttttatgctatgatctttgaaaactggttatttatgttcaggttgagtagtcattatccaaaatggttagaatcaaaagggtttcagattttgcatattttcagattggagatacttgtgtaatatacttactggctcagcattcctaatccgaaaatccaagatccaaaatgctccagtgaacatttcctctgagcatcatggtgacactcagaaagttttggattttggagcctgttgttgctttgtttgtttcttttaagacagggtctctctctgtcaccaaggctggaatgtagtggcacaatcacagctctctgcagcctcctactcttgggctcaggtgatccttctgcctcagcctcccaagtagctgggaccacaggcgcatgccaacacgcctagctaatttttgttttattatttgtagagtcaaggtctcactacattgcccaggctggtcttgaactccttggctcaagtgatcctcctgcctcagcctcccaaagtgctgagattacaggtatgagccacaccatgcctggccagttttggagcattttggacttcaaattttgggatcagggatacttaaccagtattacatgttaaacagaatactgaaataatcagtatagtctattatctcccaagcatgcaaaataccagagctgaatgaacctgttctattccttcttcaggaatcaaacaaagcaaccaagataaaacaaagcaaccaagataaaacaaacatcttggtcatgcctcctaagttagaaggacttttgtttccatttgaagtaactcagataaataccaacacaatagtctatgtcatttaacgtaatctgcaaaccatgtataatagaaggatcatggagtgcaaggttttcacagtattatactataaaatactgccttgcattttcaaaaaatcttcaagtttatatatacaaccattctgcactataggacgaataataaagttctgttatcttacagtaaaatacatatttaataattatactactaattcacatgccagaattgaataatgagtagcaaagcagagcgaagcaaaccatttcccttttcattcttccacatcaaaaaataattttggtagaacttgggatagacgttggtgtactgaaaagggacacactagctctgtttcaattttttttttttttcattttggagaagtaattagaaaacccaaagccttgaaatgaactttttcaacaaaagctcttacagccagttagttcatttccaagattaacagggagagtggtgctctaggtaacacctcaacctctgtctcaaaagaatacacttactacatattgtgggtatactctaagttacacagagattctcaaacatgtctagatctgtttcccctacctccaagactagggaagtatgtgaaatatgtacagttcaagaaaaactcccaacttttccccctaagacttttataagatagggttaaacctgagaatgtgtgactgaccagaccgtctttggtttctttattcctagagactttctagaatttactctaagttcctgaagacagaggacgtatcttcatttgaacagtttctgactgttctgcttctaatggagatattagtaagcatctgtctttatgtgtaaacaaattcttctcttgaaacaactctgactttcttcctgcttttgtaaaccacagtccatttagcagaaattggattaccttttaaaaactcaacataagacccgactgacctggctacgactctttaaaatttgcacatgtgaacagtgcccccaattcacttaacccaagacctgcctggccccttaccatcatcttcacactcttccagtggcttctgctgcttgtttaggcaccgagggtctaaccaagatgttgttttcgtgttatggctgcaatccagaaacaaaaataagaaatttgtttgaaaaaaaaaaaaaaaagcaagaagcccaatgacggaattacacactcttgaatatttcttccttaactacaacaaagatgctttccaacagcaaatccaaaccagaagagagcctgagtttacaattataaaatggcttggggagggtcttaggtaggctttttacttacctaacatatgattattcaattactgaaagcttaaaaaataataccagttttatttttgaaaaataagttacaaatgataccccttgcgtataccatctacccttgtctagattattttaggctttgcatttgccacagagaaaacttccatttattttaagtatatctatgacttgagtcttggatgctgaaactcacaaagagggctgctatttcattcattatattacataagaattctcatgacagcatgaaactaccttaattcacataaatgactcaaaactaccaatacacatcattaaatcacaatgtcctaaattatgctttggacataatgaaggcagccccaaattactcgtcataaatagaatctggaccaaggataagcttggagaggctaaacatgtcactcaactgccttttaagggataaagttcaattctagatgaagtatttcaacagatggtgactggggccctgcagatttgaaagtgtagagacacattcccaaagatatcgccattcaatcatattagaaatgtcaccagaatggttggaagcattcagcttttgtgcttcccaaagcagtggctgggacaaagttctgcttgagcccccagggcaccatgcagctaagtgggtggggcaaacaactccagtccagtagttctggctacaaactagacatgaaaacaaattggaaatcatcattctcagtaaactattgcaagaacaaaaaaccaaacaccgcatattctcactcataggtgggaactgaacaatgagaacacatggacacaggaaggggaacatcacactctggggactgttgtggggttgggggaggggagagggatagcattgggagatattcctaatgctagatgacaagttagtgggtgcagcgcaccagcatggcacatgtatacatatgtaactaacctgcacattgtgcacatgtaccctaaaactgaaagtataataataataataataataataataataaaaaaatacttgttttacaaaaaaaaaagaagtttttttaaaaattaagttcaggcagtaacttaaaactttttttgaactgtgacatttcggttgtaaatttgggagttggcagggaagagggtttgccaaagttttttatttttgattcaaatcttattaattgtcaaaaaaaaaaacatatggcttaagagaaaaacagaatctgcgaatgtatacacgtcatatcaactgtgttaaaataaaaataacaaaaggtaatatagcaaccaccaccatcaccaccacgtatgactgccagaatctgttcttacaataaccctatgagagaagtattattagcattaaaattattgctccccatattacaaatgagaaaactgataatagaaaggtaaagcaatttgtctaaggacaccctgctgagacatcacagaactgggaattaaacccagaaagttttgcactagaatccacagtctgcactactcctacacagtaagataataacaaggatcattgttaggagaggagattatgcaggattaagaaaaaaactgtgtttaaaacaaaaataactgtagattcacattcagttaaaagaaagaagagagatcccacacaccctttacctagaacccatcaataataacatcctgcaaaactatagtataccgtgacaactaggatactgatactgacacagtcaacatacaaaacattttcatcatcacaggggtccctcacgttgctcttttatagtcacaactggttaccttccaaccattccccccaaccctcttcttaatccctggtaactacgaatctgtcctctatttctataattttgtcatttcaagaaggttatatagcgctgggcggggtggtacatgcctgtaactccagcactttggaatgtcaagccaggtggattgcttgagctcaggagttcaaaaccagcctggacaatgtggtgaaatgccatctctacaaaaaaatacaaaaaaattagccaggtgtggtggcacacactagccaggtgtggtggtgcgcacctgtggtcctagctactggagaggctgaggtagcaggatcacctgagcccaggaggcagaggttgcagtgagcagagactgtgccactgtactctagcctgggcgacagagtgagatgctgtctcaaaataaaataaaaataaaaataattttaaaaagaatgttatgtaaatggaatcattgtatgtcttactttatgactggcttttcccctcagcataattctcatcaagattgttgtatatatcaataatcaattcttttcattgctgagtagtattccatggaatgaatgtatcacagcctgtctaaccactcaaagacatctggatcatttctagtttttggctatttggacaaatttgttataaacattcatgtacatgtttttgtgtgaatttaagtgttcacttctctgggataaatgatcacgtgtgtcgttgccaaatggtatgagctgcatgcttagtttcttaggaactgttttctagaatgccagacaatcccaccagcaatggatgagagatccagtttcactgaatttttaccatcacttagtgttgtcactattttttactttagccatcttaataagcaaatgacatctcattgtggttttcatttccatttccctagagctaactaattttttccctagggctgaactaatatttcatgtgcatatcttccatctatatacccttttcagtgaaatgtctgtccctctgtccctctctttagttcacattctcaatgaatggtttgatattttttttttttcactccggagttttgagagtcctttgtatattctacataccagtccttttttaggtgtggagtctgtaaacattttctctgtagtttgtcctttcatcctctatcagactcttccacaaatcaaaaaattttcattttaatgatgtcaaatttatcattttttctttctcagggatcttgcttttgatgtctctttgcctagccctgtatttcaaaaattttctggttttttggttccctaaaagttttattgttttatgttttacatttcagagtctgaattatttggggttaattttttggtatgaagtgtggggtttaggtggaggttagcttacatgcctctggtcgtccacttgctcttggaccatttactgaaaaggctatctgccctccattggaatgctttcaaattgaattgcttttgtaaaaaatcagttgggcacacttatggatctatctctggttctgccttctgtcccattaggttatgagtctattccttcaccaataacacacagtctttattattgtgactatataataaagtcacaatatgtaaattagtacatttgatatcaagcagactaattactatgacttcattcttcctttttgtaattgttttagctattctctttcctttgcctttccatttatattttagaataaacttgtctgtatctacaaaaagactgagattttgacagaaattacattaaacctgtatatccatttggggagcactgacatctctatcaattctgagtcttcctgtatgtccacgagacattgtctcaaaataaaataaaaataaaaataattttaaaaagaatgttatataaatggaatcattgtatgtaatactttatgattggcttttcccctcagcataattctcatcaagattgctgtatatatcaataatcaatttcttctattgctgagtagtattccatgaaattaatgtatcacacagcctgtctaaccactcaaagacatctggatcatttctagtttttggctatttggacaaatttactataaaaattcatgtacatgtttaagtatatctctccatttataaggaacttctttgacctctttcattagcattttatagtttacagtatataagatccaatatatggtttgttagattgacacctgtattatttttttgagcaaccttaaattatattttatttttgattttggtaaccaagtattctagtatatagatatacacttgctatttattaaattttaaatttttgtgggtacatggtaggtgcacatatttatgaggtgtagaagatacttcgatacagacatacaatgtgtaatgatcacatcagggtaaatgaagtgaccatctccctcaagcatttattctatgttacaaacaattcaattatattcatttaattatttttaaatgtacaattacattattattgactacagtcaccctgctgtgctatcaaatactaaatcttattcattctttctatttttttgtagccattaaccatctccacttccccttaccaccactccaccacccttcccagcctctggtaaccatcattctactctacctccatgggttcaattgctttaatttttagttccacaaataagtgagaacatgtgaagcttgcctttcagtgcctggcttatttcacttaacataatgacctccagttccacaaaggttgtcgcaaatgactagttctcattcttttttatggcagaacagtacttcattgggtatatggactccactttctttatccatttatctgttgatgaacattcaggttgtttccaaatcatgactatggcgaatagtcctgcaataaacatgggagtgcaggtatctcttcaatatactgatttcctttaggtatgggtacatacctagctggatcatgtgatagctctatttttagtttttctgtttgtttgttttttttttttggaggaacccccaaaccgtttcccatagtgattatactaatttacattcccaataacagtgtgagaaggtttccttttctccacatcctcgccagcatttgttattgcctgtcttttggataaaacccattttaactggggtaagataactcattgtagctttgatttgcatttctctgatgatcagtgatgttgagcaccttttcacatatctgtctgccatctggagtcttcttttgagaaatgtccactcagatctttcccccatttttcaatcagactactagatttttccatagagttgcttgagctccctatatatattctcgttattaatcccttgtcagatggacagtttgcaaatattttctcccattctgtgggttgtctcctcactttgtttccttttctgtgcagaagctttttaacttgatgtgatcccatttgtccattttgctttggttgcctgtgcttatggggtattactcaagaaatctttgcccactctcatgtcctggagagcttcctcaatgttttgtttcggtagtttcatagttggaggtcttagactaaagcctttaatccattttgatttgactttagtatatggagagagatatgggatagtttcattcatctgtatatggatatccagttttcccaacaccatttattgaagagaccatcctttccccaatgtgtgtgcttggcacctttgtctaaaatgagttcaccgtagatgtatggatttgtttctggttctctattctgttccattggtctatgtgtctgcttttatgccagtactgtgctgctttggttactacatctctgtactattatttgaagtcaggtaatgtacttcctccagttttattctttgactcaggatatatttggctattctgggtctttcgtggttccatataaattttagaattgttttttatatttctgtgaggaatatctttggtatattgatagggattgcattgaatgtgtagacttctttgagtagtatggacattttaacaatattgattcttccaatccatgaacacggaatacaactgctatttatatgcttatcttttatcttgcaaccttgctgaactcgcttattataaaattttctttgtacgtttctcatgattttctactaagataaccatataatctgcaaacaggagtagttttatttcttccttttcaatctgtatggcttttacttctttatcttgaactataaccctggctagaaattccagcatgatgttgaataaccacgggaacagctcagcactttgggtggctgaggcaggtagatttcttgagcccaggagttggagaccagcctgggcaacacagaaaaaccctgtctctataaaaactacaaaaaattagctgggtgtagtggcatgtacctgtagtcccagctacttgggaggctgaggtgggagaatcacctgagctcagagaagttaagactgcagtgagctgcgttaacaccactgcactccaacatgggcaacaggagtgagaccctgtctcaagaaaaaaaagaaaaaaagaaaaaagagtggggacaactgacatccttggcttgttttcacacttgcagggaaggcatttcatcttttcactattaagtataacgttggtcattggttttctgtagatgctctttaacaagtcaaagaaatttcccttaattcctattttcccatgtgaagactgctgaattttgtcaaatgctttttctgcatcgattcatatgagcattgattctttagcctgttaacatggtgggttacactgattgatttatttgaatactgagaaagccttgaagcactagaacaattcccacttgatcatgggaaattgctgattactacttactaaattttgttaaagatttttgcatttatgccttttttgtactgtgtttagttttgttatcaaggtaatattagcttcataaaaataactgtagagtgttcttcctcttttattttctggaagacattatgtagaaatagtgtaatagttcaatattcctttttcaggagttcttaaatatacaaattcatccctcattatcttttttttttgtgatgagtgactcctcatttaagcctgggaatactacttgcattacttatttcttcttcttttttaaaaaaattatacttaagttcagggatacatgtgcagaacatgcagatttgttacacaggtatacatgtgccatggtggtttgctgcacccatcaacctgtcatctacattaggtattactcctaatgctgtgcctccccttacccaccaccctccaacaggtcccctagtgtgtgatgttcccctccctgtgcccatatgtcctcattgttcaactcccacttataagtgagaacatggggtgtttggttttctgttcctatattagtttgctgagaatgagggtttccagcttcatccatgtccctgcaaaggacatgaactcattctttcttatggctgcatagtattacatggtatatatgtgccacattttctttatccagtctatcattgatgggcatttgggttggttccaagtctttgctattgtgaatagggctgcaataaacatacgtgtgcatgtatatttatagtagaatgatttataatcctttgggtatatacccagtaatggaattgctgggtcaaatggtatttctagttgtatatcctggaggaattgccacaccgtcttccacaatggttgaactaatttacactcccaccaacagtgtaaaagcatctctctggcatctgttgtttcttgactttttatttatttatttatttattttttgcgatggagtcttgctctgtcgcccaggctggtgtgcagtgacacgatctcggctcactgcaacctccacctcccaggttcaagcaattctcctgcctcagtctcctgagtagctggaactataggctcgtgccaatacacccgcctagttttttgtatttttagtagagatggtgtttcaccacgttaggcaggatggtctcgatctcctgacctcatgatccgcccatcttggcctcccaatgtttcttgactttttttttttttttttttaagacagagtctcactctgtcgcccaggctggagagtggtggcgtgatcttggctcactgcaagctccgcctcccgggttcacgccattctcctgcctcagcctcccgagtagctgggactacaggcgcccgccaccacgcctggctaattttctgtatttttagtacagatggggtttcaccgtattagccaggatggtctcgatctcctgacctcatgatccacctgcctcagcctcccaaagtactgggaatacaggcgtgagccaccacgtccagcctgtttcttgactttttaatgattgccattctaactggcatgagatggtatctcattgtggttttgatttgcattcctctaatgactagtgatgatgagctttttttcacatatttgttggccacataaatgtcttcttttgaaaagtgtctgttcatatcctttgcccactttttgatagggttgtttttttcttgtaaatttgtttaagttccttgtagatgctggatgttagccctttgaatggatagattccaaacatgttctcccattctgtaggttgcccattcactatgatgatagtttcttttgctgtgcagaagctctttagcttaactagatcccatttgtcaattttggcttttgttgccattgcttttggtgttttagtcatgaagtctttgcccatgcctatgtccggaaaggtattgcctagattttcttctagggtttttatggttttaggtcttatgtttaagtctttaatccatcttgagttaatttttgtataaggtgtaagtaagagatccagtttcagttttctgcatatggctagccagtttttccaacaccatttattaaatagggaatcctttccccattgcttgtttttgtcaggtttgtcaaagatcatatggttgtagatatgtggtgttatttctgaggcctctgttctgttccattggtctatatatctgttttgctactgatactatgctgtttcggttactgtagccttgtagtatagtttaaagtcagatagcatgatgcctccagctttgttctttttgcttaggattgtcttggctacatgctctttttctggttctatatgaaatttaaagtagttttttctaattctgtgaagaaagtcaatggtagcttgatggggatagcattgaatctataaattactttgggcagtatggccattttcacaatattaattcttcctatccatgagcatggaatgtttttccatttatttgtgtcctctcttatctccttgagcagtggtgcgtagttctccttgaagagctgcttcacatcccttgtaagttgtattcctgggtattttattctctttgtagccattgtgaatgggagttcactcatgatttggctctctgtttgtctactattggtgtataggaatgcttgtgattttttgcacattgattttgtagcctgaaactttcctgaaattgtttaccagcttaaggagtttttaggctgagatgatggggttttctaaatatataatcatgtcatctgcaaacagagataatttgacttcctctcttcctatctgaatatgctttatttctttctcttgcctgattgccctagccagaacttccaggtggtaagagagggtatccttgtcttgtgccagtttcaacgggaatgcttccagcttttgcccattcagtatgatattggctgtgggtttgtcataaatagctcttctcattttgagatatgttccaacaatacctagtttattgagtgtttttaccatgaaagggtgttgaatattattgaaggccttttctgaaactgttgagataatcatgtggtttttgtcattggttctgtttatgtgatggattatgtttattgatttgcatatgttgaaccagccttgcagcccagggatgaagctgacttgatcgtggtggataagctttttaaagtgctgctggattcggtttgccagtattttattaaggattttcacatcgatgttcatcagggatattggcctgaaatgtgtgtgtgtgtgtgtgtgtgtgtgtgtgtgtgtgtgtgtgtgtctgccaggttttggtatcaggatgatgctggcctcacaaaaagagttagggtggagaccctctttttctattgcttggaatagtttcagaaagaatggtaccagctcctctgtataactctggtagtatttggctgtgaatccatctggttctgggctttttttggttggtaggttattaattactgcctcaatttcagaacttgttattggtctattcagggatgcaacttcttcctggtttagtcttgggtgggtgtatgtgtccaggaatttatccatttcttctagattttctagtttatttgcatagaggtatttatactattctctgatggtagtttgtatttctgtaggatcagtggtgatatcccctttatcattttttattgtgtttattctattcttctctctttcagggatgccctggccagagaggaggaatctccacctcttattatcttgaatgactttagggtccatagtgactccttacttaattcctaatattgacaatttggtctgctctcatttttttctttgtcaatcttattagaggttcttcaatttttttaatccttttgaagaatcagctatttctttcattgatttttatctattgtttttcagctcttgacaatttctcctcttacctttattatttccttccatctttttgagcttaagttattcttctcttcccaggttcttgcactgggagtttagattgttaatttgagacttttcctcttttctcatatatatgtttagtgctgtaaatttacctctcatcactgccttggctgtgtcccacctattttaatgtgctgtatttacattttcattcagttcaatttatttgcttatctttaatttcccttgagacttcctctttgacccatagattatttaaaagtatgttgtttagtttgcttctaattcattggagattttcctactgtatctgacattaatatgtcaactcttgcttctttcgattaacatttacaagatatatttttccatcctttactttcaacatacctatattgctacatttgaaatcatgcgtcatagatagcacacaattaggtcatgctttttaattcactttgccattccccatcgttaaagtgctgtatttagttcactttattaaatgtagttattgatatgttagggcttaagtcttccattttgtttgtaattttctttttgttctgtttttctttcctctgttttatttttctggcctttctgtgggttacatgaatattttagaattctgtttttatatatctacagtactgttgagtatatctcctttgtatagcttttaagtggctgctttaggtactacattacatatatatgcacacattttatatatatatatatataatctataaatatattttatatatcttatagtctactggcattatcattttaccgctttgactgaagtagataaaccttatctccattgatattcttttaccctccctcacttataatgaattaccttaaatattctctctacacacatttagaaacattaaacagtactattattgcttcaacactcaaacctaatttggaaaatttaaagagatgccaattatatctcaataaaaatgggaaaaaagaaaactcaaaagatgaagaaaagtattttatttatctatagttttactttctccattcttctcttttcctcattgtttttgttggttgtttttttttttagaattttggtattgttttagaattctctttttgtttagagaacatccattggccatttattgagagtaggcctgctggcagcaaattttcttagttttctttcgtctaagaatattttcattttcccttgattcctaaaggttattttcactggatgtagaattttgggttaattcttcttttctttcagcactagaaaaatgctatgccacttcctttcggcctttgttgtttctgatgacaaatatgctgtcattttacttgtttcactaacatacatagggtgtcatttctcatcgctttcaacctttttctggttttagttttcaaaaatttgactatgaatgtgtcttgctgtagttttctttggattcagccagcttattgaatctgtaggtttatttcttttgccaaattcagaaaattttcaaccattagttcttcaagtacttttcttttcagtcctacccactttctattcccctgggactccaatgaaataaatgttagatcttttgttactgttccaaatgcccctgaagctctgtttgttggttggttggttttcttcccccagttgattttctctctattgttcttattgggtaatttctattttcaggtccactgattctctcctctccccactctcttctgctgttgaatccatctactaagctttttgttttggctactgtatttttcagttgaaaattttctactttttttaaatcatctatggctttgctgagactttctatttttggctgaaacattctaattttctacttggcttaagcatggtataactgcttgctgaagtaattttatgatggctgcgttaaaatctgttaggtaattctaacagtgctgttatcgctgtgttagtatctactcattgccttttttcactcattttgatatcttcctgattcttaggataataagtgattttttttattaacatggattttttggtattacattataggggtctggatcttaaaccttctatgggcttttcctaatatggccgaaaagaggaaagggggctatctgttacttttaggtggggtctccatttggcttttgttgacaccggagaggggaatgggctccttcttaccgctgggtggggatagtggcttgagctccccaccaggcctttgttgataccagctaggctgggaggggtaggactatctcactattgctcccaagctggcctctctgactccacagggagagggtgggctcttcaccattggatgggggtaaaaatcctgattctcctctaaacctcctctgacaccacaccagtggggaggaagagggtgtttcattactgccaggtggggtggaagtcctgagttccctcaagtggtctccactaaatctatgtggaaataaggggaatttccttactgcctggatgcaaagtgccagctctacacttggccttttctgacgccacccagcagggaggtttcagctcctagtcccacagcctgtcaagcttctacccttggggcgtaggaccacaggtttttctgcactgttgctggagtagaatggttgttggataaaagttttctgtcttgtaggatgcccctttcctgatcctttggctagagagagcacgcttttatcagggctttatttgcctctatctgtaggcatttctgggttgctggctctttagctttaagtctggataaatggagtaaaacagaaagggaactcaccacctagtattcctttgatcccatgctccctagccagtctgtcttatttgctcttcctttcaaagtcttcttatgtttgttttctatacaatgccaaaggtttataaatccatgcttgattttttaatgttcttttaaatttctactatttcttcaacttcccaaaaactataaaacaaatgtgtatatatttgcatgtgagtgtacatacacgtacatgcataaacaaggtagatctggttctaatgcggtttaatttgctattcaatggaagatatcctaaaaagaagtgtttcggaatgaaaaacacatgaaaacaaagtaacaagtatatataatttaggctaaaatataaatgatatgtatctaatcacttaatatatatgaaatttgatagttgcagcccaaatcccataattatcattagccacatttttgtataagttttctactaaaccttaggtaaatgaaacattggcttcacatcagctaaaacctaagttataaaaagtaggcaaatcactacattctcttgtaagccagccatagtttaggaggccagcatcctgctaaccatcaagatatccaccttccctttttccaatatatcaagtcagtcttgaacaaaattactggtacattcttttctaagaatctgagtttcacagattattctgtaccaggaacacctattatccttcccttttctcagcgtaattcttctttactaatgtgacataatttcgaaggcaatttaatgcaaaagctaagtaaaaaatcctgagtttatggttggtatccatttttataacaatgtttaaactcctcagaataaccacagataatgatgatgaaaatggtaacaataacaatagtgatcactaattactactagcccaagaactttagcttctctatctcctctaattcttacaacagtctgacaaggtaggtacaattcataatattcaagtcctctttttatatatatgtatagaaagctgagatgcaagaagtaaactcaagttcctaaggtcaaataacttgtaaatgatggaaacaacatgaccctttagttgagctcttaactaatacacttcttgactctcaagaaaagactgcttcttttatccttatctttaaaaagcatttgtcattaacatgaagacagaaacatgggttgtcccctctctctggctggaaaatagcacagaagctctatttcacttatctcagaactcttcccgggtagattctcaaagagggtattctttttttttttttttttttttttttttttgagacagagtcttgctctgttacccaagctgtgcagtggtgcaatctcggctcactgcaacctccacctcccaggttcaagtgatactcttgcctcagcctctcaagtggctgggactataggcatgcaccaccatacctggctaatttttgtatttttaaatagagatggagtttcgccatgttggccaggctggtctagagttcatgacttcaggtgatctgcctgccttggcctcccaaaatgctgagattacaggcgtgagccactgcacccggctgtcaaagagggtgttctgagttccaagccttttctctaactctcatatgtttagaaaaatcatactacctaattttcattgttttttctaattataaaacatatgctaagtatgtcatgcttggtgactcacacctgtaatcccagcgctttgggaggctgaggcaggaggatcacttaagcctgggagatagaggctgcagtgagctatgatcatgctactgcactctagcccaggcaatacagtgaggccccatctcaggaagggaaacaataaataaataaataaataaataaataaataaataaataaatgtgtgtatacacacacacacaaagtataaaaaattcacaacgcatatcaatgaaaaatgtggttagaaagtaagttatttacttaactcaaacccaactgttaatagatacttctagaactttctgtgcctagaacttgatctacatattaacagaaacaaatgctcacagagaatagatgtaggatatgtgtgtatacatgtataatttgcaaaattgagatccttctcatagttttctgcaatgtcctccccttcgttattgttgacttaacagtagatcagtttcaatctatacgagtataacagatgaatctgtggtattttttttaaatttaatcagccattttctttttctttctcagtggtacattaaaacatggtgaatctcaatgataggataataaagtcaaaatactgcatttaaaaactgactactgttggttaggaaaaccacattatcttagattttccagaatggtttcaaatgtcggcttttttttttccttttcagaaaagctagtatttacattttataaatctgaaagactttcctgtctctctgttctcaaacctaattcatacaccttgcaccatggaaaaatattaacttgcgcattacagacctaaacacaaaatgtaaaaaatgaaaatatttacgactctgtgttaggcaaagatttcctagctactacagcaaaagcacaattgactaaaaagaaaactgataaatgagactttatcaaaattaagattttgatggagacaatgaacagaaaagccagacttagagaaaatgcatacaaatcacatatatgataaaggaattatatccagaatatatgaagaagtcttaaaacaataaggacactgtagttcaattaagaaaaaaaagcaatatatttatttttaatatatttatttttaaatatatttaaatatttataaatatatttaaatatttattaaaatatttaaatatataaaaatatatttatttttaatggttaaatatgctctttgaatattatgtcataatttctatataccataatttagttgtctaaacctttagggaaatgattaaccttatgcttcctcaaactgttgagaatcgataagttggtaataattaattacctttttatgcaaaacttattaaaccttattaaaaaataccatcagtgggtgatcaatcccttaaatgtaatttacattggcaactgctagacagagggaaggaagggaaaagaaagagagagagatttaggtagaaataatggtatactttactctataaaatagacttctccattttcagtataggccatctcccagttttcaggtagaggacctaaattatcctctgcagaaagaggtaggtattgagggaacttctgagaagggtccgtgatgggagcagcgatgatgctactattcacaggtggtaatgctgtttcttggagagtgtgctcctcttgttcaccagaatcggctgcttaatcatgtgaagaggtgagagagagagagagagaaaaaaaaaaaatggtattcagcaatcataccccatacccgggaagtatgcaactatacacatctatattcttaaatgctcttatcctttcctaattcctggccattaactattacttcgatttcatttagatgtctgtgccttaattagaaagcatcgaaatgatcaatgaaatttattttacttaaaaagaagggggaaaaaatcccaagtaatgcattgctcacaatcttggaaatgtcaaagaagaaaccaattcatgactcaaactcttaaactaagaaggccatcaaaacacagatggatctgcaccctcattccataggtatcatttgatttcattagtcagaagatgtttgggcacaaaaaagtatccagggtgaaaacacagacacagtggcattactgtccactcttgtataaacgattttataagttatttttatatttgtataaatatttttggtagacactggcaaagatcaaagaatggttaattaagctgaaacgtatacaaaagtttagaatatggagagagctataccagtgagtcagattggaacctcttttgaaaaagttatgttcctgtgaaaaccaagagttacccccagaacagtatcatgtgggtggactgatatgacttgagtcttaaaagaaggctcgaaatacttgagtctccttgccttcttattaactagaaacatcaggggtgatgtcatcaaagtatccccgaatggcattattgacattctggttgaatttttatagaggccgatgatattaaatgtcaatctccacagggctttaaaactgaataatcagggtatgtagtgaatttctatctcccacagtaattctgtagacatttctgatttagcaaaaacagagtgaagaatgataaaaggctgttttcaaagctttctctgatgagaagctcccaatgacacacatgagagtaaaggtaatctgaaagctggatggaagacatgccaagcctactaaactaacaccaccaccaccaataatctaccacccttgaggaggctgcctgtaggtattcccagccctgcatctatttgctcttctcctgctagcaccactcaggtatccttgtggtgcccctccccactccaggtccacatggtccaggacgggacctactcctggctctacatcatactccttgccaatcaggagtattctatcatttttgtctttgttattaggtcaggaataggtacatgatctaaggcaaacaaatttgaatgtcagacatggaagatttactggaaccatgaagccagaggtggtcgcttgaggctggagcctgtttgctaataggttctcatgctgcaggtgctggagccatcttgacaaagcttgacatgacctgccagagaattaagtccacacagaggaaaggagaggtgaaagatgaagaaagtcatctaatatcactgactgagcctctgatctctgatttcatacttgaaatcaaggatgtccctcattttgtttgcttgaacccccaaattcactttcctgcttaaaccaatttgagttagttttgcaacttgcacccaagagtgcagattaatagatcaactataagtaagggaacagaaaggaattaggccaacatagaagaaaaatttagaaattactaatcaataacaaaataaattcaaaacccggcaagaattaaaggagtcacctttaattctctagaagccaacaaagattcatttctggcatatctttggaaggtagacttttcacacttaagtgcataaaagaatcacctggagagattgttaaaatgcatatttctggctctgtcctccaggaaacaggtttggggtaaggttccaaaatgtacactttttaagtacccaggtgatgaatattcaggtggtataataactacattttaaagacaaagacactaagagttctcccatgaactaaaagaaaaaatgatgtagaaaaccaattgtttaaaaagttctaatttcagttgggaattactctacctgcttcttggtttgaacctgtcattttccagaatcaccaggacctccagctcttaggacaggtgttgccctgccgccaatgagcagagagtggtgcagtctctggctacacactcctccgtgcaccagtgccaggccagagatgcaaatgagacgtgtagagagtgggtctaggctgaagggagctgggcactcagtgccagacagtttgtgccctggaggagagtggacttggggttgccaaacttctgatttttcaagacaagttggaaatctgtatttttatgtaaaatctcccaagttttcaatcttaatttctttaaaaaataatgcagtatgacatcagtgaaaaatgaaaggtcatgattacggacactgaccctggagccacactatccgagtttgaatcctggctttaccatttactgatgtgggcaaagtacttaaccttgtgtgccttcacttgcttatctggaaaatggggacaaaaacaatctctacttcacggggttgtggggaggattaaatggataaggcgcttagaatagtgtctagcacatagtgagccatagtaggtagttgccagcagcaaaagtacctctatcttcatcaaaattatgattaattttgtcttcaggccagacctgtcccccagcctgcaaatacattacaaataggtagaagaaggataggttataacatcaaaccacagattatagtcttgtctgcttctagctgtgtggctttaactttctgagcacatatttctcgatctgtaaaatgggcataatgtacatggcataagaacagaattaacacatgcaaagtgcctggcacctggggcatgctcaatgggtgcttgggactgagacctcttattgcaactacaactgtccaaactcggtgacagccttttcaattaggaggcagtaaactgttaggatgataaggagaaagaataatttcatttgaaaattttaattaacctattttaatagaaactggatataacaggaaaagggtagtgccactacatatgaaatgagatgcactcaatttaacgctgagtgtctacatgtttacaaaaaaaaaaaaaaaaaaaaaagtcctgccaatgttcccagacaatgcgtgaagatggaatattagctctctgggaaaatctcttagtaattttaatttcctggaggaaaaaaaaaaatcccttcagcaacgagatcttactttaaattatccaagtatttgtttttattttatatgctttccatatcttcttctcagctcaacagaatctgaatctcattctctgaaagaaaatggaaagtccaaaaatgagctgctggcacagacacacggcagactcaagaattcacagccttagtcatggttttgactctgacacatgctgtgatttcaaaaaaatcttttgttgggcatggtggcatgtgcctgtaatcctagctatttaggaggctgaggaaggaggagtgcttgagcccaggagttagacaccagtctaggcaacatagtgagaccacatatctacaaaaaattaaaaattagccgggtgtagtggcacgtgtccatagtctcagttactggggaggctgaggtgggagaatcactttaacctgggaggttgaagctgcagtgagctgtgattgagccactgcactccagcctgggtcacagaacgagaccctgtctcaaacaaacaaacaaaacctttcatttaatttaccaaagatttaggagcacagccaccactttcttactaaaggttaccagtgaatccaaagaggacaggtagaatggaatactggaacaagatggaatggggagacagggaacctggttttcccattgttcagtggtgtaacaggtacacagtccttcagggttctcatctgcaaaactgggaagttaatatatggattgcttctctctcaagattttcaggaggtttatggaatacacataaaaatcgtttgtaaaacagaaacgaacatgaatgacatttttattaatagtaaatcagaagcttccaagcttttatacacacacacacacacacacatgcacactcactcactcttggggacttttcaaggtgacttcaacaacataagccaagtcaaagaagatttctgaagctcgttttaaattatacatgcttttaggtttatgtgtatctcccactgtgtacaaccaatcatgatctctgaggctccataaagctgatgaacttgatttaaaacacaaatagcatactaggtgtgcactcaggctgtggaatcagactttctgggttgcagtggcagctctgaccctccctcaccagttttgcgatactggacaaggtatttgacctccctggtatatgcataaagaactcagcaaagtgcttgccatatagtccatacttgagaaacattagctcttatagaaatgattatctcttaactttccaaagcaatgctttatcactctctaccaacaaaaaagaagtgtcagcaacctaatgtttaagaatatcagggattattgggaaaaaaaaaagcctagaaacatgattaagaaatgttttgatgtctctcagaggtgttcatgaatgaatctgttactttttagttgtggtgatttgttacacattttctttcttctttcttttttttgagatggagtttcactctgtcacccaggctggagtacaatggtgcagcctcggctcactgcaacctctgcctccggggttcaagtgattctcctgccttggcctcctgagtagcttgtattacaggcacccaccaccatactcagctaatttttgtatttttagtagagatggagttttaccatgttggccaggctggtcttgaactcctgacctcaggtgatctgcccgcctcagtttcccaaagtgctgggattacaggcatgtaatccttgttacacactttctaagttgtctctaataaacacaatatttttgcaaaagtctttgtttgtgtatatatctgtgctttggccaacagtctaactctaccttcattaagcccacataggaagtgttctttctcaagggctctttttaggtcaataatttgggcacaatttgtagaagactgtcccattgctttgtgttcacagtcagttccatggtgagcatctgggatgactgctcactgttcagcttctgccttaatcaatgactgcagaaaggaggggtgggctgccttcccagatgcttctggccaataggctccttgatcttttgtctgcacagtcccaacgttacttaggcgtcttagtgagacataccttcttcaaaacactcaagcaaaaggcagctaagatagaaacagcagcaagttattaaaaatatcctggtaaatataatatttaatggcttcataatatttctacattttgatatgatgctcatgcctttatcatagctggcccaagcagaagccgacacctcattatgccactgtcactttacgtgcaaactggctggtggattcctatttaatgtggttcagaacacaaaatgctttgataccactagtttcacatacttatggactgggtagtgttaattatttgaaagatttagcatgagttagtgtatgacagattgtcagctgtcgcaggtacactgttgtaagtgaggggacagtcaacgtgctccatacattgtgaagaggtcccatcacgtgcatatctcaaggccactttttcctcagtgcaccctattggccttcttggtatcagacaagaacgtgaggaacacaatcaggtgtcacttggctttctgttttgtgtggaaactaatcatcagactgattttggccatgatgatctgggcccacaagttgttctaagatgccaggatttcaagtggggattttatgaggtcagattttctgaggcatggcttctagagagagagattgatagtagttagaaacaggaaattgcatctagacttacagtaaactacctctactttgttccttctttctaccaaaaaatctatttaataaatagaggacaaatacaggcacacaagcttcttggggaccacccaatctgcttggcagaactgttttgccgcacactacccccaaagtcttctgtttctgtgaccacaactatggtttaggttataccatgatttgctattcttatttatcaaaatatcaaggcattaaagtatgagattttttgaaagaaatgttaacatgtttcatgatctgttttcattttggtaagggccactataaacagatgaaagattcctaaatgaatgaaaacagctgatttcaattaaaacataggtacaaggtggcaaatttcttctagatattacaactattgggcaggcactggcctaacccattctaattgagaaaacagaaattttcatggagtcaaattcatacagctaaaaggggaaactcagacatgatccaatcctagcgagtcattttacatatggatgagttaggcataatgtttctaaaaagacaactaccaagagccaagccagggtaacaaacaaatctcctctgtctttacctaacacttcttgcacagatgtttggctatcctactgctatgacaataaactcatccaaaaaattttatttccatttgataaattttagtcctctgagcttagctaataaattttaaaaaacctaagtgaggcccatacaggttgcaaacagcattcataaataacaaacttttcctaaatattctgttagagttggtagcacaggggaaaacagtccactcatctccaccttcattggagctgatgctaatcaaacaatgaccaaagtataataatgtgagaaaaggccactatgggagaggataatctcatatgttgaaaacggataacttattcatggctataactctaaaatattaaaggcaatatttaagtacaataacaacagaagaaacaaggtgttcgtctaatccacaacactgtagactgaagttactcctatcttactcagctgttacatttggagttactatgtaaggtcaaatcttcatatagtaaaaaatattcttgagctcttctgggtcactgcactaacccaaggaacacgcaacattattattattattattatttttttttttttatttatattttttgagacagagtcttgttctgtcacccacactagagtgcagtggtgcaatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatatagaatgcatatatagatataatgttagaattttacttttccatctttctcccttttaaggcatataacaattttgcgtaagttaactgaacacataatatccttccattatatctctgctttcaaagatataagaggatgctgctggccttctatacagcatcaactgacattaaactgataaaacacattctcatattttgcttcatagcaaccagccataatgatagagatgctgcaagttaccccccccaaaaaaaatcaatgaacaaaatacagatatttatatacatatatcattttgaagagaaagaaaccatgctgatttctcgtttgccttcttcatacattcacccccagctcctttaaggtattctgatgaagttaaaatattcttgtaaaggggcatgaaaagaagaccagggaaaggaccatctcttctgcaagcactgtgtggtccaagtttgaattttggcgactctacaaaatccctcctgagaacagcatccttttcaaaactctatgcaaaagcctcctcgtcatcccttccccaggtccattgagggcaacatgatctgacctttacctgtaaagctgctgttcatttcaggaacgtcatcctcctcctcattctccgcgtggactatgccagcattttgcatatcattgtaggacttggttcgcttcggggtcgactgcttagagccagactgaaggctgtgcaaggcatccgtcgtgatcactttcccactgactggctggctaggaggcttgggtgtcccataatagtttcctaggtgatggagagacacatttgcatgtttcaaaaggaatactttgtgtttttttttaagacttcacatccaaatctctaggcacattaaaaaaaaaattaaactagaaaaccagaacaaactgtattttatttctggagtgggttagaagagatatctttcctatccagctagacacagtaatttcagatgggaagaggaaagctgtattgttttagtgcaaacaacctactagggctaaaaacaaaggaggctatgctgaatagtaaaccttcctcctcattacatttgaatatcaattggtcatctttttacatatatgcaccagcataatgctgaatccaatttagagcaagcctcacagaagattaaaaaattcattactgccggcatccttacaggcctaaaaagttgaggtcactttcccttaataaggggactcgtcaagagggaaccagggcaatatttaaaaaggaggacagtaaaccccacgtggcgcctctttagctgaatggcaggcttgactctcagagtcatgcggggtaggaaaaaacccttgccaagctttaacagaaaaccctgtgtcaatggtggcacccagtatgggtcactcttccagtagtggcccatcttcactttcagccactctttcccagtttgatttaggtcccactatagtgtgctatgtgactctcacttgtacataaatagatttttacattttaatttttttattttaatagatacatatatttttaatttgccatagagaaatctcactggtaagttatgataccaatataaagtttgcctttagaatttaagaaaaaaagcaatactttaaaaaattgacttatttttcacttaaagtttaaaaagacagttttatataataagaaattaatcagctgaatacataatagggatggtagtaataagagtttccttttgaaaagttaaaaagtaagctatttttttaaagttattttaaagataacattaaataaataatacatgttctcatatgaacaaaatcacaaagggtggttcatcaagatcaaagtttgaaaaacacagttgataatcaataatattcagcggctacataataaaagacatcaaccttagaatgccatcgatccatttaccacttcacatcttttagagtaaggccaggaagacaggaaatgattctgagatgctggatcaatcctaactaatgtttgtaattctatgcttagtaaaacagaatttgtaaataataataaatcctgtacacactgtatcttcctaaggatccaaccccattgtctaacctcagtacatagttacataacaaacacattttattacacaagcaccaaaaaaaaaaaaaacacaaaaaaccacaaaaggagacggtaatagcctggtctccgtgagacatacagataataaagaatttgcttctcagcagggtacagtggatcatgcctctaataccagcacattgggaggctgaggcgggctaaccacatgagctcagaagttcaagaccagcctgggcaacatggtaaaatcctgtctctaaaaaatatacaaaaattagccaggcttggtggtactctcctgtagtcccagctacttgggggtgctgaagagggaaggatttcttaagcctgggaagtcaaggatacagtaagcagagatcgtggtactgcactccagcctgggtgaaagaactagatcctatctcaaaaaaaaaaaaattgcttctatcaggctttattcttataaataaggtttcttttttttttttttttttgagatggagtcttgctgcatcacccaggctggagtgcaatggcacgatctcggctcactgcaaccttcacctcccaggttcaagcgattctccagtctcagcctcccaagtagctggaactataggcatgcaccaccacgcctggctaacttttttgtatttttagtagagacgggatttcaccatgttggccaggttggtctggaactcctgacctgaggtgatccacctgcctcagcctcccaaaatgctgggattacaggcatgagccaccatgcctggccaataaggtttcttttttaagataaaaagttttaaaattttttaaaatgttttttgaatcatcaaaatttatagagatacacacccactttctttgagaggagtgtaatagtctgtatcagcaggaaaactcaacatacacatttttttaaatgcagtacatgaaagagcatcacgttcaaatttgaagggtgccaggtagaaacctgatacgcacattctggtggcttatactcaactcaatcattcaagtgttttcataggaagtaatctatccttatcttcaaaaatcttctttcaggtttccaacttacaggcgctagaattgagtcgaatcagcttgaagaaaggcattccacatgtgtctttaggggctaacacttgagcaaagaagaaattagcacgtgtcaaacaagaaatgcacttaatcttgcatttctacagtggttgtatcaaaggatgtctcatgccttcattgaaggtgtaagtaactaggccaaactgttaactttctcattaactgaagactctttagtgaagtttaggaaagtatgatggttaactattttaaaaataatctgcatagtgagaaaaaaaggagagagacaaagctctaatgaatttaattttcattccttaatcattattatatcacgacatcatgtacattttcaagttagatgttaaattaaggccaatgtctataaataagaaacttctactgaaagatgtggaacccctccctcgtaatttttatatgcataatttcctaaccatatcactcagtttcagtgccattaaactgaagtagcattcataaaattattaatcatttaaaatcaatgaaaacttcaacatctgcatttatggcagaaataataagtgcttggaaaataaaagttccacttaactttgacaaatatgtgtggattttccattaggtacctaccctcacttttcaagttcaaaatctttcttaagttaataaatgattagcagatttgttaatgcaattacaaacaacccaaaacaatccacttgttcacaatggtttcctgtttctgaaaattagtttaacattgaatggaggcagataaagtagataatattagattgaaccatatgaaattgctgttgtagaagatataaactgtcaaacataagcaatttcactggctttaatctaatgagtggcccatgagcaatactgcagagccttggcacaccatatcatggggtaaaaggcttggaagagacagctcagagttgaaagcccactactaactaactggctgtgtgactctgggccagtctttgtccgcctttaacttgggattctaagagaacctagtttacacctagaatagctgttaggaagacaaaatgagacggtctgcctttaacctatgctgaagtctgccactatggtgagggtagataaatgctacctaaagttgctatcacatgttttcagtctttaaaatgacacccatactacattgttttgaggatcaaagagatcatgtatgcaaagtgctgcacatggtaactgagcactaagcaagcaaacctgtcaataaccaaataaccaagtcttctaacactcagtctctctagtactttctctgtgaaatgggaatggtagcaccagctgtagcaacctcataggattattgtgaaaattaactaatgcagagttttcaaaggtactctgtaaactataaggtgttaaatatgagatagtgttataattatccaaatctctccactatttcttatttcccgtactgaaacctacaacctttacagaaaagattctgtctagtggttttctaactgcagagtgttcaaactttcatacgccactgtttcaaaataatttggattagtgaccaacatttaaaattagaaagcttctagttaagtctggattctcaatgctgtttgacaaactgtaaagtctggttccagggactccatctcttatagaggatgttgaaaagcaagtatgtgtctaaagccaattcacatgaacatactaaatcaaggatttctgcagagaaatttttgctcctcctcttggttttgcctgacccttgacagacaaagatcttggaccccatctagaacagtgccctcaggctgctgcaatgcaagggcataggcagatacaggggcatgagcagaggcatgagtagatgtaaaaaaaccttaaacttcaaaaagtcttcaataattcacagattagcctttgagtgaattgatttttggagagcttgctttcggccctgggcttttggacaaaaactctggctgtcttatttcaactctggctctcttattctgctgtgaactgcccttaccgtgcagcaatgggcaggatgggtcatgcttgctccagtttgccacagtcaccagtggtcttctttgcctctatgcaccctcttacctgacctgtctggcccctcaggcatttgagttcatgactctaaccttccagaaagtattccacctttgcaatggtttgcactctcatcacaatcaagcaaagtctagccacagcagaaacacaaaccttacaaagtctagccatgtagaaacacaaaccttacagacagtatgcgcgacttaacagtattaaataaaaatcatctgaaaaattgtaagtgattaaaaacttaattggggctatcacttggcaggctgcacagtgtctaggagccgtgaggctgattatcccacaggctctgcgttatccaacacacgtttcctgcagtggctgggctccctcccaagtggaaacttgttctctctgctgctattttcagaactggttctacaacaaatctcaacagggagggtagccagggaggaaagcggagggcaaaggaggacttaagaggaagccactgctggccttaattaacaagcaaaatctctggccaggacaaagccaaagaaaatatttttctgacacacatttaaaaattaataggcactgcaaatcaatttttagggctttataaaatatttaaggaggattgtaaccctggaatttaagctaggatgaatcaaatctatatggctttcaaattatacaaatttactattcattcattcatttccttacagaaaacctttttaatgccaggcatgggaaatacaaagtaaaaattggactgaaacacgatcttcacaaccattctatatggcatacatcagttttgtcaagcttcaatgtgcaaacaattaaattacattaagtaatgatcagggtgggcctgagatccatggatcacactgtttgtgtagcaaagccatttgggacagagaaaatcattcctcttttgcagatgacaaacataaaggcccaaagtggcagaaacgcctgccatggagttacatggctggtccaaggtaaatgggggtgggaattgggggtacttgtctgtcttcttcctatgagacaagcttttgcaaataagcctgagaacaggatggtagtgaccacctatggctgggaatctacagcatgcattttcaacggggcaatatcacccccaagggggcaaaaattgttttcttttttgagggggagagaggtacaaaaaccttactctctttatgtatagtgcaaatatgtatagagtacatgaatacatggacatccagcatatctgattttgccttggcctcacggtcctgagtggtctgccccatgcccactctccaagcacttgtcctgattgccttcaccttgttcttttcactctgacctcactggttgcctttcagcccccagcatgtaaactgtgcccccttcccccatctcacagctcttgcacccactcctccctctgctcctcaccctgttactacctgctcatcctcagcaacagtatctctgaccccacagactagatcaaagctgtccttatcagttcttatatgttctcaaggaaccacatacctccccttcctaatgccctttattgtatatagcagactgtttaattaatcagtacctgtcttcacctctagactataaactcaaagaggccaggagccacatctgattttgtgtaccactgtgttctcaggcctgacgcagtgccaggcacataccattacccggtaattcactgcagaatgagtaaatgaataaaggcagatagtgcacatgaattccagcctgggatcctcctaaaaacctgtattgtggatccagtttttaatagcatgactcacaacactttctttccagtcggtcaattacatttgaattaccaagatctgcatcacttcactttgctacttgcttgctcagcacatgatagttccttcataaaactgcaatactttctttttactcttccttttcctacctgccccaccctacaaaaataggatgttcatgcacagaaggacaataaaccactgttctataattagcagtttgttcttgccagtgccatttggtttctaatacaagaccaaacaggagaacataagagttttacgaccctgagtgaggtaagggacctctctctcttcagcctcagttcacacagtataaagacaaaaatcatggcaacctaataggtttttgtcaagattaaattagataatgtgtataaagcacccagcactgtgcttgacacaatgttagcctataatcaactctgccagtctccaatcaggcctgatgttgtagatagataatagggttaatgtgtaaaagagtgtattatcacaacacatattcaaagaacaacattttttaaagttacctttatcgtgcacatattaagtgtcactacgcatatattcacttactctaatctttataaacaatcttagagaaaaaaaggcatcaatattcccattttcacataaagaaactgatatttacacaagtcaaagatgatgactggcatttaaatacagattagtctgtctctgacatctacacttttaactccaggaatatttggggatctctaagcagggaattaaagaaaacttcgccagctccccccatcttcataagcagaagaacagccaattatagcacagatttcatttggtcactttcattatcaacagagaacattctacgacagagtttgccaacagagctcatcacaacagactgcttctaaggcctgccaaagaacaggactctagacagtctcgctttctttaaccagaaacaagaactctcttcacccctattttatctctgtgtccccaaaaattataccattggcagctgcctttttgcagaccttctaggaagcaaaacaataacattattgaatgctgacatcctcttcctaattaacatgcagaaatatgcaacccataactccaatttgaaatgtcaccctggcactgcacttctatgctgaaggaaaacctttgcaatgctcaaagtgtataatcagcctcttctacccagaggcatttgtaaaacagccatgtctggatccccaccctccactgaatagttcatcccttgtaaactctctcctagagaagtcccaagggctggctgaggcagtgacctgtcttgcagagcaaaaatgtcaacagaaaaaaaaagaaaagcaagggaaaagggaaatggttcagctgatttattttaagcaccatatcaaataaataagctcagtgccacaattaggaagttgggccaagttggaaagatgtgcttattcttgtcttctttaccttgctttgatgccaattctgttcagtgacagaatgaggagctggttcaaattgtaaagcagagatcaatgacaaactctactaataacttctatgccttgtgagggatgataatcagattctttacatcgccaggaaggggctctactctgttgggagtataatgctactctcagcattacagctgtcggtggatagaaagtttcaggatggagtccctgcccggcaaacctaccccaattatagtattttttattttcacaaatggtaccactatctatccagtaatagaagacagaaactaggagttatcttaggaggattgtcatcatctgtcttttctacctcgttctcacaataaccaatacattaacaaattcagcttttcacataaatatctccagattcagctgactatttaccaccaccatcaccaacgtggttcaaagccaactccaactgtggttgccagatgaaatgcaagacagggtgttccgcgtttttatttgctaaatccagcaacctaactccagctcaaccatcagatctcacttcaattactacttctacagaggtactttttcttgattccacagacatccactctccctgtcttatggtctcctttaaagaccttcgcacacttacaattggatattcgtttatttaaataaagtgtcttgttcactagacatttaagacccataaagacagtgaccacaaccatatctgcttttgttcagcattttatctttaatgaataaatgaatgaactcacaaactagtaactgaggctacaaaagaagcattacttttcaggcaaagggaaataaaagcatcccagtcctgcaacatttggccaggctatgtccctaactccctgaagtatcttaaagcaagctctctctggatttcagttctatcatctgaagaaactaactttactgcatttccagctgtaaagtcctacaaccgaccaatgtaaatcaagcaaatattgggcctgaaagagaattctgaaggttactgggccttgaggcttcactggttcactctatttgtctgccatcttgcctgtcatagaatgtatccacaaaagaagatcaccactcctctgcataacatcctctttgggaagattcaacacgatgattcttttttaaaggagcttaactcttaagacctgctttgctttgtgaagtcagctggtgaggacagagatcttgttgagcaggtcctcaaccttcctttcagaagcttttattctaaaactgaagccaccagccatgtgtggctacttaaatttaaatgagtttatgttgaattaaagttaatttaaaacttggtttctcaatcacaagaaccactggctgccataatggacagtacagaatactgaacattcccagcatggaaggaagttcttacaggatagcagtggttctaagggaaacagggtgtgcttgcttcccctccctttctagaagccatccttctaatcctctcttggttcatcatcacatcgttctctgtggattcaggccccatggcccatgctgattactaaattcaaacaccatctcccagcctctcacctgacctaacacagtcctctcatagcttcgcctcctctagggagtctgccaaaactagatgaagctttctataagcttctggagcgctgtgtagtttctctcaaaacactcataactttttttcttttttttttgttttttgagacagggtctcactttgtcacccaggctggagtgcagtggcacaatctcagctcactgcaacatctgcctcttgggttcaagtgattctcccacctcagcctcccaagtagctgggactataggcatgcaccaccaagcccagctaatttttatatttttttttggtacagaggggattttaccatgttggccaggcttgtgtcgaattcctgacctaaaatgatccgcctgccttggcctcccaaagtgctgggattataggcatgagccactacacccggcctactcatcacttttcttaaaattgtttacattcattcattcatatattacacagagtcttgctcctgttgcccaggctggagtgcagtggtgtgatcttggctcactgcagcctcgaacttcccaggatcaggggattctcccacctcagcttcccgagtagctgggattacaggtgcacgccaccgtgcccagctcatttttgtatttttttatagagatggggttttgccatgttgcccaggctggtcgcgagctcctgagctcaagcaatcctcccacctcagcctcccaaagtgctgggattacaggtatccgccaccacgcccagcaaaattgtttatgtttaatctgcctcacaagactgagtgtgggaagagtgtagactctgtggccagagtgcctgaatctgaatcccagctctatctttgatttaccatgtgaactaagaagagattactggcatttctgggcctcatactcctcttctgtaaaatggacataaatagaacctacctcataggcttgttaggaagattaaatgaatttgtgcatataatgcactttgaagagcacctactatgtgccacacaagccctagcaaaaataattaattaaaaaacataagcaccttcaaagtcaggtagttttggtctactgccctgtacatcatatcccttgcctcacaaaaaaagtctgacctgaaataaatactcaataaatatttgttgaaataaactatatatgcattaaaaggcttgctttaaaactgtgctgccagaaacttaccctatagttatgctcataattgcgtaacaatatacttgaagcactgtttataacacgaccaccaaaaacagaagggggaggtgaggcaggggacatttaaaatgtccatctgcagggggctggttaaataagttatatatttatatacagatagacagatagatacatagatagatgtagagatatatatatactcattcactgggacactatgcagcatttataaagaatgaggtgaaactgtatgcggtaatgtggaaagatctccagggtatgttaagggcaaacggcaataacagagtgaagtaaacgagatatacatatatgttgtgtacatataagttttctgaatatttgcactagcatctttaatagtggttacctatatggaagaggggaaacaagtaggacttagctagttttaaggcttttgctgtaggaactattccatcatgtacacttattactgttacttaaacatttatatatgtcttcctttaaagagtgctttgtgttgttgtggtagacttttcctctctggaaccagcagaggtctggagaaagcaatttcaggaggggaaaaaagatggtgagtacctgggaagtaaataaagacattttactggcaaatctgctggtttactgactagtagaggggaaagggatccactacaggagcaattttgaactaggtgcgtgtaaatacaaaagctaatgctgaaggagagcttacatgtgtcagacactctgctaagccctttccaattattgtctcatttagccctacctctgaggaagcactattattatcctcattttaccaatgggaaaatggagacatgcagcattaagcaacttgccggagggcacacagctcaatagcaaaggggctgagaatcaaactcaggcagtgtgacagcagggcttgcatgcttgttagtgtccaccaatagacagcagccaccatcaggggacttgtccaggggaggcaaagacagtggaagttctctaaatgtctttccagccctactccgatgagggtatatggcatttaataaacattccatttggctctcagcttttaagagtcaatataatatactctggtcagttccaaaaacttatgagccatctcggccaggctcggtggctcacgcctgtaatcccagtactatgggaggtcgatgcaggcggatcacgaagtcatgagatcgagaccatcctggccaacacggtgaaaccctgtctctactaaaatataaaaacttagccgggcacagtggcatgcacctgtagttccagctactcaggaggctgaggcaggagaatcgcttgaacatgggagggggagggtgcagtgagctgagactgcgccactgcactccagcctgggcgacagagcgagactctgtctcaaaaaaaaaaaaaagaaaaaagaaagaaaaattatgagccctctcatatggtaaggaaatttcgctgctaataggccaaaggctgaagaacgctgtacaaatgggttagaactggaaaagattagtcctgtgcctaagaaaattccaattccaaaataactatgcaacattcacaaaggcaccgttttctacaagacaatcagacattttctgaaaaccattcctctactgctatacaccaggaagttagcttcaagtactaatgggttattttccttagcttcttagttatatctaggatattcttcgggtttttaggaaagagtgtaggatctgagagtcacactgagctgggtttggttccttctctagcattctagaactggctgtgcaactctgaaatagttatttaataccacttggcttcagtgtccccatctaaaaattcagtgaagataatagccgcctctgttgcaatgataaaattaaatgagaaaaagaactgactccacctatatatcatttgttccattaacatcgaataaagtgagtttactttccatcttccaagttaaattggagtctaaatcacaagtttttcctttccgacccaatcctcttttgctttgtacaaccactcccaccccagcctctccaaaaatgcaaatagatgttttatatatttgacgactgaagccccccagatgggcataataactgattgcagatgaggacatttctctctctgctaaccaaagaggagtcacacatgctctcctcttcacatgtacaacatgtgaggacagcatgctgacaacatgttgaagaagctccttgtaccttcccgcagcccccctcccttccctctatacactcctagacctcgattactctcagacccctgcccagcccaccagccacccagtcacatcccaacatgtagtttcaggaaactaagccaactgataattagcaacactcaaaaacaaacaaacaaaaattcctgattcatgagcaggaatttgattaatatacactgtctactgtatattcacaatttggaaaggagcagtatgtacaaagacaatgctccttcccgtcttctccaaagaacatcaaaccagaaacagccatctctaagattcatgatcatgatatgagtgttagtcactgtaacagaagcaattatcacattaaagctataatgtccctaataaaataataatctactttgtatttaccctttatgtttaagtctaatctttaaaatgccccgtgaatgcctaataaatccaaattttaaagagtttgtaaagagatacacataataacttgaccaagttaataatctgtcctagttaatagtatcattacaccacttctgcctcaaataataataacactccaaaaagtaatcaagctataatactgttttcagaaaaatgtgacttttttccaccacatttggctttgacccagcaatgggatctgatcctatggatatgtttgcacctgtatgaaatgatacatccatgtcattcgactcagcagtgtttagaaatatgaaacattgaaactgactcaaatatttgttcagagggaagtggttaaataaattacggtatgcccatacaaaggaattataatttttataattatatttcaaaaagaagaaaaccagaagtgctttattactgaattgcaatgacctattaagacatactgttaaacaaaaagagcaaggtccaaacagcatgtactatatactaccttttggggaaaactgggaagaaatgggaatatccatacaacaggcatgcacacatgtacatacgcatgtgcacacgcatgtctgtattgacataaacttcagaaggtaatcagattatttataatattgaatcctaaatcaggcaggtgggagacaggtatatgaagattacttagctaaatatttttaaaataatttgctttcctgtaatcccagcactttgggaggccaaggcgggcggatcacgaggtcaggagatcgagacgatcctggctaacacggtgaaaccctgtctctactaaaaatacaaaaaattagccgggcatggtggcaggcgcctgtaatcccagctactcgggaggctgacgcaggagaatggcatgaacccaggaggcagagcttacagtgagccaagatcgcgccactgcactccagcctgggcgacagagcgagactccgtctcaaaaaaaaaaaaaaaaaagtttgctttatgaatcacataaaaatacattaaaaaccaatcagtaggaaagtgatattttatttcttcaagattaaaacaacactacttataggatcacattttgtgattaaccatgattcttccttctctcctaataccgcacatgtccgtattaaaaacaaaacacacccacatacttgaataggtaaattaaaaaagaaaactcctagagaaaaactaaaactatttttaaagaactccacaaagccttattccatagactttgtctattattcgtcatattaaggtgaactgaaatctcctgttatttgtttagacctccagattccacaaaacatttttgcctggatggctctggctcctctcaagtacccaggagagaagctttttatgctgtcgtacaagtaactcaccttcataggtgccgacttccagaagagtcccactctgctcgaggtccaagaactccttcacagtcagaaagttatagtccacgccaggcacttctccttctctgggagatcgggttgtgcctgtagcagaaaatacaaaggcacaacaaaccatcaatcaactaaaacaggaagttccacatccaggtgtaattaaaataacctgttcagtaagagggcgtacctaagactctgctgcctcatctgtccagacagggacacagtaaaggcaacttctttctaatacaacacaacagcattctcatttccacactctagtgcctgggaccccaaatgggagagagagaaaaccaagcaccgctgggtaacctagagagagttttataccatttttgataatgcactgaataaaaaaggtgaactggattttatacagacaacattcacagtcagcagcttttacgactccagtaaatactaaaaacgtatccaccttaagctcagagcctaaggggtttgtgtttttatcacaggccttgagattctcgtattcctcaatacaaccggcaagttccaaagccctttaaagaaaatgacacctgctgcataaacacatcaccagagaaatatgattgcctgagatctgtggttggacatctcccagggattaaaatgctgctgctcctcatgtaattaatatgttgggcaaaaagaggccgtccatgaattctgactagggagaaaggacgctgcatttgctagaaaattctccccctgcattaatctggtcatcttctcagtggctaacaaatgtaacgcttcctcttatgaaataaggcagagcatccagagtaaaaaagtcatccagctcaggtgctgggctatggatttatcattttagcccaatctcagtcaacaaagtggaagcaatgagcagaatgtggtttacacataagtcaagaaaggaaaataaaccaaacagcaattatgtaccctgtattaggagcctatgttaaatattatgagacgaaaaaaaagagcaaaaaatgtgacttctgctgttacattcaacagagctcatttagcaaggcattattacctgcggtggtgatttaaggtcaacgttttcctatataataagcaacgatatttccctatgtctaggatctcttcgttgaaatgtaatgcaattaaataaccgactatatgtgcctagtggcgctgaagttcttagcactgtgcagtctctgatcatctgcccatgtgaataaccgcatccacacctacactggatattcacaattttcataagtcaaaaacactcaacacttagtacacactttactcaggcaaaatgtatttttagtgcacataattcttctatctgaaatctgaatattttaaatagctgcaaattgggcataggatggttatagtatagatgtttgcttctcataatcagcatgctagaaccttcaggttaaaaagtctactcttacactgtttcctaatttgttcccgtttcgtgcctcccctggcaggtgatgacaaatcccttgaggtagttcacaacttttaaatttacatctcaagtgtcaggcacaggaaacatagagacagtatcatatactgttaaagaacagtggtctggagtgggaatcctaggttcatggtctgcctctccaacctgtggtcttggacaggttccttagtgtctatttctcagtatccttgtttgcaaaatagggataataatagcacctaatccataagtttgttgtgtgtattgaatgagataatcctttttgagggctttgctcaataatttttagtagacattatagtttatgtttttgttagaatgaattgatagaatcttaccgttcaaatcccagtataataatctgttattatatacatataaatatatctctgtttatgtatatgtgtgtgtattcatggcattatatattgtatttattcaacaaatatttactgaggccccaacacatgccaggcactgggaaaacactggtgaacaagacaaagctcatgccctgatggaatttatatgttactgtgagacacagaaaacaaatatgtatataaataaatatagcatataatatcaggaggaaatcattcttctacagactgaaagattagaaagtatctcagagcaacataggttaaaggtttagacagtgtcttggagggagggagcaagggagaagtagggaagctatattagctaggtgatgaggaagagcctggctaatagaaaaggtgatggggaatgcatccaggcagagggaagggaaaaggctttgatacgggtgtgatctggtgtgttcagggaagggcagaaaggccagcatggttgcggtacagtgatgaaaaaagggctggaaacgaaagcaagcggcaagattacgtaggccatagaaaacacttcatattttattctaaggataatggaatgtcatccttagaatggttttgagcaagggggtgcgttgatttggtttttcttttattttccttttcagagacagagtctcgctctatcgctcaggctggagtgcactggaggaatcacagctcactatctccttgaactactgggctcaagagatcctctcacctcagcctcctgagtagttaggactacaggcacgtgccaccacacccagctaatttttttttttttgtacaaatggggggtctcactatattgcccaggctggtctctaactcctggcttcaagcagtcctcctaccttggcctccaaattacttggattacaggcataagccaccacactcagcttggttttcctttttaaagctctttgacttcaaggagaacaagttttcggagagtagggcaggaggtgggcaagaatagaagcagggggaccagttgggtggttaccatagtgtccaggtgaatggtaatcaagatatggactagaataggacagaagtgataagaagcagtgagatttctattacaaacatgagtattttaaagagctacagcatagtccatagaacagacatattaaaagtaaaacccatcatcaaggtattaagcgccacatgcattagctatttatcctgatgctctccatgccacccaccaatggaggacagagagcatcagggggatggagatgcaccaggataaatagctaatgcatgtggggcttaatacaaagatcaggtgcagcaaaccaccatggcacatgtttacctatgtaacaaacctgcatgtcataggtaagtatcctagcacttaaaataaaaataaattttaaaaagtatgtcagctcatcacaccatgctaggtctatattttgaagacagaactaatagaacttgctgatggattggatgttgtatgtaagaaagacagaataaagacagaaatacctattttgtgacctgggcaaatgggctgtgccatttgcagagattgagaaggctgaggggaaaggttttgggaaaagggaaaatcaaaagttcacttttggacatgttaggtttgaaatgcctaacagacacctacgagcagagagttggagcacagctgaccttaaaagtctgaaggtcagagtagagggtggaatgtaaacttaataataatattaagagtgatcagttgattagtaaaccaatggcatttgaaggcaagagacagaaagataaaatctacagagagagtttaggggaaaaaaagccaagaagtttggattgaacactaagaacttttaacttttcgaagatgagaataagagaaagatcgtcaaaggagactaagcagcagtagccagcaagataggagcaaaggaggagggtgtgatgtcttggagccaagtgaaaaagctgttcagccagctacctctaaaacacaaacagtctacatcacactgggaattccagtgcagtgcaagaatagaatctctttgaaacttgctgtgaaaggatctgtcctaaatatgttctatatggcaactctcatcttcagcctccataccaaagttccattaacttaatccatcttgaaaaaaaatgaggacaaaataaaacaaaacaaaaaatctgttgagtttcatagtcttgccaaactagacaatgttgatttttttctcctgcagccatctttgccattctttcaatgatgttttcagatccaatttgtcaggtttaccttaaagacaacaatcaccctggggtcttaatttcctgagaggattcaaaataatcaagaacgtcaaaaatgctacatttcagcagaaacatgaaactagcagatcccatttttccatgtaaataaatatgcttaggatgccttagagcagcatgggaagggagtgggaaggcgggcaagtctccacccacaaaacgttcagggtttattacccagacaaaacctttccatgctcaggctagcaggaggtttcccagctatcctctgagcagcccgccctgggtctgggccaacctgaccaggctctattcaccgatgttgtggagaaaaggaccgagggaggggaccccgccttctcttttcttgtagcagaatggcaggctgctggctggacacacgcctggcagatggcatttcaaagggttttcaggagccatctgggttgggtacaattattataaaccatgcttctaacaaagccagaagggttacttcctgacagaagacgagtcaaacaaattctaccatgtttctcagggacagcgtactaatataaaaaaaaagaaaaaaaaaagcgaccaggctgacaaactgggattttccttagcctacaatactgccttctctttttctagctagaaattgggccaacgatatcttgcagttattagctttaagctaataataagcacagcgtccaaccccccaaaaaagaaaaaaaaatatataacgctgggaaaaaaataatagcttccatttctcagatgttcacttatgtcccaagcaagctgttaagcacttaatcaatactattattgtatataatcttcacaagaaacacagaagtaaggattattattaccctcattttattgatgaagaagctcagactcagagaagtaacctgcccaaggtcacataacaagttgggcagagccatggtctgtctgaacacaggcaatgtgacagcagcatccctcatccttaaccatcactgtctgatggaacctgtccttcatggaaatgttccatatctgtgctgtctatcctggtagcccctagccacatgtagctattaaaaagtggccagtgtgattaggaaactgaatgtgaacttttatttaatcttaataactttaagtttgaatagccacatgtggctagtggctactggcctggtcagtacagctctcaaccatgagaatatctgagttgccttcattacactacatccagtaccatgtcccaaacaacttctagcactcaaaataagaacaagaaacatacttacctgaaacagcatgacatctcaaacagatagaagaaaaccgctcttaaaaaaaaaaaaacaaaaaactctcatatgctttgaaaaactatctagtcaactccacgatttgttttaaaaattccattgattcctattggctgtggtctctaggaaaaaaaaaatgttcttagatatttgtgacagcatggtttgtagcaaacaaaacaaaaaagaccaaaacaaaagcagccctccaagacacagaaaaaatgagtgtccacgaatatggaaatgattgaatgaaatatggttgatccacccttgggaaaatgttttagctatgtaatggtaaatggtaaagaatggttaaattggccaggtgcagtggctcatgcctgtaatcccaacactttgggaggccgaggtggccagatcacgaggtcaggagatcgagatcatcctggctaacacggtgaaaccccatctctactaaaaatacaaaaaattagccaggcatggtggcaggtaactgtagtcctagttacttgggaggctgaggcagaggttgcagtgagctgagattgcgccactgcactccagcctgggcgacagactgagactccgtctcaaaaaaaaaaaagaatggttaaatctacatgcagttacctgaaggaatgcctttaatgtgcactgaagtgatataaacaaattacagattaagatgtaaactatcactgcatttcattgaaaaacagaatatggcttgttttacaagtttatgagttttatgagttcacatagttaaatgggtataataatactatacccttaacagtggtaacctcaggagggtagcttcagaaatgggaagagatgaaatgattgtttaaacaactctcatgctccaaatggtatcaataggcaggtaactgtcttggcattttataaactgaatgaaatcattatttaagaaatattttaagacctgattcttggatattttattcaagtactttcaaaagtaacttagtcctcacaaaaaaacatgcaaacgacttatagactccagctgaatcacacaaacaatgtttcaaggtttcccatctcatagaaagccagcctcaaggtcaacaatactttacttgccttaccgatgaataggaatatactacaagtagatttgagaaagtggtactattttttccacttgattttatttttaaaccccaaactgctcatcacttaaacagggtcctttttaagtatttaagtacctccaagatttgtactagaatagtgaatatcaacccttcccaccactagataataacttaagtaattaatttgagctgtgtcctagtgagtgtctcagaaagaattagcaatgcccccaaacttcatccagtaaagcttgagtggctatctgcttcttacacacattttatggttcataaacttgcagtgtatctggcttcagagactcctgctgaggaaatgagaaagtgaccttccttatcactgaaatccacaaaccatgactacaaaaaggaaactggactgggaacttatctgcgctatctttttattctagacattctcttgaaatatccagttgaggcagaaaaagaaaaatcctactggtgaaattctgataagccatttcccactgcttcaccttcccaacgccatgcggtttcaagatgttgagatctcactcaacaactgtccaaatggtcttatggccagactgttaaaggaaaataatcagcccacaaagattacattgtcaatattccatgatatcacctgctgttaaattaatcagggtcctgcttgtcaaaatctaacaagacttcaaaaaatgacagtcactgcaactgcttacgtgttaagaacagatcatcattttcctattctaacacaatcatttgcatctgataaatatccagagtatcagttggatatccaggacagcctcatgcagttcattctttagctgatagagctagagcacagtagaatgtattagtcctccaaattcactcagttacctacctctcacacaatttttgccatatatgacaatcagcactacaatttacttgatatctatccctcaaatcaaactgccttttgtggtgaaacagacatcttatttaatatgaaaaaccccttctgaaactgcttttaaaaaaaattaaacaggccaggtgcggtggcacatatctataatcccagcactttgggaggccgaagtggatggatcatgaggtcaggagttcaagaccagtctggccaagatggtgaaaccccatttctactaaaaatagaaaaattagtggtggcaggcacctgtattctcagctacttgggaggctgaggcagagaactgcttgaacccgggagctgagatcgtgccactgcactccagtgtgggcaacatagcgagactctgtctcaaaaaaaaaaaaaaaaaaaaaatttaaacatatttgggtaaaaagtaaatacttagccaccacaaacctattagaatggtttaaaaatgtttctgtaataccaaatgctggcaaaaatatggagcaactagtactcacatgccttattgggaagaatacaaaatggtacaaccatttggggaaagagtttggcagttagttaaaaagttaaacataaatttctcatatgacctaacaatcccactcctaaatgtttaccccagagaaatgaaaacatattcacacaaaaccccatacagaaatgtttagaagagctttatgcataatcaaccaaaactttatgaaaacaaccaaatgtggttcaattggtgaatgaattcactgtggcacatccctacaaagaactactgctcagcaaaactacagatacacacagcatggacgagtctcacatacattatgctcagggaaagagaagccagactcaaagattacacactgtatgattactccatttatattctatatattctatagagatggagaatcaagcagtggttaccagctatgtagggtgggagcagcacaggtaattagggaaaggaggaggacactgttttgtttcttgcctgcggtggtggttgcacgactgtgctttggtcaaaacccatagcgcacaccacgaatggtgatttttactgtgtataattttttaaaaaaggaaacatttagctttacctcaaatggaaaatcagcttcatcctgccataaacagtaagtaactaaaaataaatgccacaaaaataaagccattttgttttatctgtagcctaaggctctgagcccgaggtctgaattatcctattatcacaaaaggggattgacaaacattagaaatatcttagatacctattaatgtcaatttgagactttctgcttagcataaggatttgtcttcgttagtttggactgttataacagaataccatgaactgggtggcttaaacaataagcattgttgagacaggcattttgacacacacctggagtcccagctacaagggaagctgaagtgggaggattgcttgaacccagtagttcaaatccagcctgggtaacataacaagaactgtctggtgagaggaccctcttcttgattttcagacagctgcctttttgctgtatcttcacatggcaggaaatgaaagcccttcccctttttacatggggcattaattccatcacgagaatctgacctttggttaattaactcctaaaggctcctcctccaaataccattacattaggaattagggacccaaaggtgagagagggagacagaagggtgcgttgaagcagaaacaattccaatgtgaaaagaaaaggtgtgtgggtaaggtggtcatggtgccaaggaaagggctgaaagaaaatctatggctcatactactttggagggtgggagtggttagaaaacgaacagtggagagagggggtaaaaatccatgatacaggtaatcccagatgagacagctatgtagactcaaaagggtcacgtgaataaatgtgactcaaattgttagtgtcactaagcaacacacacacacatacactgccccctccccactcccaggtgtgctgtacctccagcagaacaaagttgaaaaggtaagatccttgtcttctgagaacttggaatcagtttgggtctgtgtctaatcagaattgatgcctcattgtaaatgagaaagcagctaaaagagacttgactgattgtcatccctataacacattataaaataaacacgaataaagaaggccagcctcctcctcaggaatcaggggaagttgttgagttatttaacactttatatgtggtaatctacaaatcacttcacaaggaagcaaggccactcagggcaacataaatggatcctttctagaagcaccattttgaataatggggcattctctgtccaaaactctcaactatgataacaaaggtcagaaacaggacccttattttttctatcccagatctcaacacagtagtgtcagtaattgtgtctcataaatggaataatgccaagccattcaacagcaggtgtgtaaagacaattattttattccagctataacttgcatgtttgggatcagcagaccatttcaggttccatcttgcatggaagaacactgtgtgatgaaggtattggaatctcgttttaaaaaccacacctacaatacttgaaataaataaggacttggcatttattccattgtactgatgatttgcaaaagtggcctagacatgagagatgggaagcatctgatctggttttcatgatcctacttctagctcttttctctatagctatgacatgggatgaaggaaaagaagaagttttgagtgccaaatccaagtagctccaaaggaactattcaaaccgtccatgtatccttttcctggaagccaggtgctctcagttaagtgtaaacatgttacctttcaaggagatccacattatgtcaaagaaaaatgtgaaccttccagattgttgaatgaatcatataatacaaaaagagagtatatgtttgtctagggcaagcaaatggttcccagtaataaacaaaaacagcagctcaaggagctgatgtaagaagaaccagtcttgatccagctctgccactaaattaattatgtgactaccttggaacattcccttttatgcactcaatgtccttatctgtaaaacaaaaagggtaactactgctctgactatatcacagaatgattgtgagaccaaatacattcatgtgcaaggatacaaacccctcagcaaattaaaggcattagaaaattatgttcatttaaaaaatctgtatttaggccaacgtctattctttatatgcattatctcatttaatccttgcaacaacactataaagtagttaatattattatcctatgtcacagatgagaaaacatgcacacattatgtgacttgccaagaattacacagctggtaagtgtcaggaccaggacttgaaaccaggtttttgttactaggtgggaacttctgtacacaaagaagacattggggaggggtgggaggataaactagtggaggagcgaggtgcagctgaatttccacagctcttcacccagggttgaataaatcaacactgtcttcatccaggaaacatagcagggagctgatggagttgacggtctgggagaagaaagctggtaaaacccttccccacaacctctttgatcccaaacctaaactgtcaggaactatgtcttactgcctcttaaccagaatactgaggaggaccagaaaacattccacaggaaagtcaacctgaacatgaacattaaccatttttcctcatttttcagggaagggaactttggcacatacaaactcatggaaacctcgcattcattaaagtcaggaacatgagagttctcaggttgtaactgattcatttcaaacagtattaaaaagcatccaggaaataaaggataagaatcttcagcattagatacacatttatcagaaatcaacttttgaggattatccttgaaggcatttttgttccaagagggattcaggaaaccagtaacgctataccctagcgctaaaagttgtctatgagaaaaggggatgagagcagatagactctctccattatggcaggtaataatactttcactttctctgattaattatagcaattgtttgtgtaaaatggaatgaactacttccaacaatttcaaccagataattttcaaaagcatattaaaagaaaataattattttggtgaaaagctgtgattaattaagaatatcaagtttccacaaattaggtgactttgcatggttaatgctaaatactgaatgtttctaatattcggcagctttcttgcttagttaaaaaaaaaaaaaaaataactggggccaggcatggtagctcacgagttcaagaccagcctatgcaaatagtgaaaccttgtctctaaaaaaatttttttaaattagccagatatagtggcacgtgcctgtagtcccagaaactcgggaggctgaagtgggaggaccacttaagaccagcagaggttgagacagcagtgagccatgatcgtgccactgcactccagcctgggcgacaaagtctaaaataataataataataataataataataatagggaatgactgctaatagctacatggtttctttggggaataatgaacattatttaaaattacatcgtttcaatggttgcacagttctgtgcatataatgaaaactaaagaattatatactttaaaggagtgaatattattatgtataaattgtgtatcaataaagttgttaaaaaaactcttacactgcagagatgtaaagatgggcaaaacatgatcactgttctcatgaatattataatttagctgaggcattgttacatttccataaataataataaatagtataatttactcttcatcaatttaacagctgctttcattagtcctcccaatatgggaacttaaagagtgaaatcagcaatcactgaccatgttatgtcgttttcctaaaaattgcagggatctaaagctctttcagaatggcagtccagagaaactgttaaaaaatctacaaccagatttggtgagttcaaatctcagctctggtatttgcaaactgtgcaaccatagacaaggtaaacattttgggtcttggtttcctcatctctaaaatgggaataataataatgcatgcctcataagactgtgtgaggattacatgagataacacaagtaaaatgcttaacctggtcataatatgcattaaccatgacaacaacagtatctgcccacgcccgcccccaacaacatactctgtgcttctaaagggaaatggttatggaagaaggaagactatggatcacttactatatctctaacaaagagcacaggttttctatacataatgcctaatttaattcttccaagaggggtatatttttccaaccttgatgaaattttccatccctaatcaccatttttcaaagtcacacaagaatctatatagctcctaaccacaactttttggattatctttcaataagaaatcacaaagtcaacacattctataaataccctcattctagtcattagccactagcacggatccataagaaaatgcctacttattgaaatataatgtctaaatttgaggatctcaattgccctaattccatgttaaccatgttattcttcacataatcaaagccttctataattaaatgaatgtgatatttattgagcaaatattatataactagatataaaacgagaaataaatttgtatcaaggactaaaacaaagcaattacaatagcaattcaaaacagataaaagaaaaaaggagtttatgcccatttaacaaatacattcgttctcagttgacataggcatgatagttctgaagccttctcaagtatacagcgaaatagtcacgaacatgtaaattttattttcactcccatcaagtatacatatggctacatcaaagtaaacaagaggaaataccacagagtgcaacatataacttcttgaaaaaataaagaagaattgggtacaatactaagcctacaccaaagaaaggtacactatagtactacctgtgcatggtcttcatagtattgaagaaaacttactggggcagtaaaatttctagccacacagcagtatcatgttgaagcaggtctacagagtaagtagcataaaactgaacatatctttccatttgttaacacatgcttttttccctcatatttatagtggtatttaccttgaaggggttttagatttggcatcaaaaactcaaacattcaaaaagtgtctcatgagcaaaggctgagaaacatgagcatttaaatatcacataaaattgtatgaggattacatgagacaacacatgtgttagcctggtcataatatgggttctcaggcagctgatttcactcttgggactctggtgttgttcgtaacatgcttatgttttcccccataaataatgacatcagcagattcctagaaaactaaactacagctttgattcccagccccttccattaccttatctaatgtttgccaacgatctctataactataaatcacaatccaaaaatatatggacttggagcaacggcaaaatcatttagacccagctgattaactgttattgccctcatttcaattagttcatgtttcagtgagcaattacattctcacattatgtggtacttctctggctacaactatagctcattttatgttatggactatatagtttctagatagatgagtcatagaaattattttttttcagtctcattgttaagccaaattaggtagcttttagaggtgattttttttttaacaacagcaacataaaaaacccaattactaatgcttctaaacatttgcttggaaaatgcagacagtgaggaacagaagcctgtgctgatgtgataaacccaagttctggtctttacccacactgactttaaaaataactatctcattagaatactatatgaggtatcaacggtattatcagaaaagtagtggccaatttttaaaaaataaaatcggccgggcgcggtggctcacgcctgtaatcccagcactttgggaggccgaggcgggcagatcacaaggtcaggagatcaacaccatcctggctaacacggtgaaaccccgtctctactaaaaatacgaaaaagttagccgggcgtggcagtgggcgcctgtagtcccagctagtccagaggctgaggcaggagaatggcgtgaacctgggaggcggagcttgcagtgagccgagattgcgccactgcactcctgcctgggtgacagagtgagactctgtctcaaaaaaaaataaaaataaaaataaataaaatcaagtagcttttattattataagttactttgaattattatgttatataaagacaatagtctttaaatagaatctaatagaaattgggccttttcaaacaagccttccttatttcagagatgtcaggtgagtgctttgccttctaagacagtcacattactttaagcctataggattctcattaatccaagaatgcagattatgcctttgtcatctattcaaactggacccaatgtgagtccagatacaatccagtcaatgaatctgtattagagataattttcattaaaaggaaatggatacctttgttgtgacatataaataacaaaagaaaaaactggggagttttgtttttgttgtgttttgtttcatgtgtattaagtgagtgtcattatcacacaatgcttactggttctcactcttgggttccatctgatttgtcatccctgtcaacagcaactgctgatcaagggcaaagagagggcagaggcaatctttatttcctccatttggcagcagggtaagactgccattagcttcctgtgagccagggaagacctggtgatacgatgcatgatcctggagctcttacaagaagttttcaccagatacttgcctcttaacctatttatctagcagttaggctctcattttctgggaaacccacatttttgcccagagggaagcaaagagtcaaagtgtttaattgaagctattgccttggcctccaatgggttgtttcaaaacaaaacaatcaaaataaacaaacaaaacacaggtatttaaatgaagcagtagggaaatccagagagctcctaatctcaacacataacatatgttacatttgggttttgtttttggggaggagccaagatggccgaataggaacagctccggtctacagctcccagcgtgagcgacgcagaagacgggtgatttctgcgtttccatctgaggtaccgggtttatctcactagggagtgccagacagtgggcgcaggtcagtgggtgcgcgtaccgtgcgcaagccgaagcagggtgaggcactgcctcacttgggaagcgcaaggggccagggagttccctttccgactcaaagaaaggggtgacggacgcacctggaaaatcgggtcactcccacccgaatatttcgcttttcagaccggcttaaaaaaggcgaaccacgagattatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagaggagtggttctcccagcacgcagaaggagatctgagaaccggcagactgcctcctcaagtgggtccctgacccctgacccccgagcaccctaactgggaggcagcccccagcaggggcacactgacacctcacactgcagggtattccaacagacctgcagctgagggtcctgtctgttagaaggaaaactaacaaacagaaaggacacccacaccaaaaacccatctgtacatcaccatcatcaaagagcaaaagtagataaaaccacaaagatggggaaaaaacagaacagaaaaactggaaactgtaaaacgcagagcgcctctcctcctccaaaggaacgcagttcctcaccagcaacggaacaaagctggatggagaatgactttgatgagctgagagaagaaggcttcagacgatcaaattactctgagctacggggggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagccccaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttcaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcaagactaggaagaaactgcatcaactaatgagcaaaataaccagctaacatcataatgacaggatcaaattcacacataacaatattaactttaaatgtaaatggactaaattctccaattaaaagacacagactggcaaattggataaagagtcaagacccatcagtgtgctatattcaggaaacccatctcacgtgcagagacacacataggctcaaaataaaaggatggaggaagatctaccaagcaaatagaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacatattaataatgggagactttaacaccccactgtcaacattagacagatcaacgacacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctcccagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacactctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaagattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaaatagaaaatctagaagaaatggataaattcctcaacacatacactctcccaagactaagccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacagccaaaaaagagaattttagaccaatatccttgatgaacattgatgaaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaacctctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcactggaacacaacagagccctcagaaataatgccgcatatctacaactatctgatctttgacaaacctgagaaaaacaagcaatggggaaaggattccctatttaataaatggtgctgggaaaattggctagccatatgtagaaagctgaaactggatcccttccttataccttatacaaaaatcaattcaagatggattaaagatttaaacgttagacttaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaactgggcgaatgacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaaatcagtgtggcgattcctcagggatctagaattagaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcaaatatacaccatggagtactatgcagccataaaaaatgatgagttcgtgtcctttatagggacatggatgaaattggaaatcatcattctcagtaaactatcgcaagagcaaaaaaccaaacaccacatattctcactcataggtgggaattgaacaatgagatcacatggacacaggaaggggaatatcacactctagggactgtggtggggtggggggaggggggagggatagcattgggagatatacctaatgctagatgacgagttagtgggtgcagcacaccagcatggcgcatgtatacatatgtaactaacctgcacaatgtgcacatgtaccctaaaacttaaagtataaaaaaaaaagttacatttgaagacagcaattttttaaattaaccactttataaaatgttgtgcaagaattttttgttttgttttacataagcaaaacagaaaatgaaacatctaagaaaaaaagtggctttctaaatgcttaaatgaatactaactaatgtcaatgaatgacacttacactaaaagcaagccatggaaaatataaaattcacacaatagggcctgatcaaatctttggtagttgtcccttatttctcttttcagatataaaaagttaatgctgtagacaatgtagaatctacgaaagaacacaaagacaacaagtacccccaccatccagaaataaaccctatcaacagttaagtatccaaagtctatggcaccaacccatggcccaggatgaattctgggaatcttcagccaaactctcagccatcagaattgtcacttgtcacttcaggcttcattgtaatcaacaccaaatcatatggtccaatactttacagagaaaaggtattgctattttttacaaccacaacagcaagcctggcacttacatgcttcaggttacacaaatgctgaaaatgagggtgagaacacatcataaagtttattggagaaggcagtactgactgatgcacagttcaaaaatctttacaggggcacagggaattgaaatagcagaaattatcaaaaacaatttcttgccctagttttcaagctctgggtcctttaaaaagtgtaataataagctgggtgcagtggcacacactgatagtcccagctactcaagaggctgagggtgagagaattgcctgagcacagaagttcaagtccagactggacaacataccaagaccctgtctccctctctctctctctcttttttttgagatggagttttgctctgttggcaggctggagtgcagtggtccaatcttggctcactgctacctccacctcctgggttcaagcgattcccctgcctcagcctcccaagtagctgggactacaggcatgtgccaccccacccggctaatttctgtatttttagtagagatagggtttcaccatgttggccaggatggtctcgatctcttgaccttgggatccgcccgcctggcctcccaacgcattggaattacaggcatgagccaccgtgcctggccgaccctgtctctttttaaaagtataataataataaatagtagcatgcacttaactaataatagaggtctgttaatatcactatcaccacaacagagttataaagcacttactacatgtcaggcactgcaagtactttgtactctcttttcccctaaaaccttatcacaatcatgagcaaaatactaaaataagcccacttttcaaatgaggatttgggaagaaacatagtacatcccacctctttttttttttttttttttttttttttgagacggagtctcgctctgtggcccaggctggagtgcagtggcgggatctcggctcactgcaagctccgcctcccgggttcacgccattctcctgcctcagcctcccgagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccccatcccacctctttaagggggctgaactgggattaaaacccaggttttcctactctggaagctaagctctaaaattttacactacctggcttcatatctcattctgcatcaagcatgttgtcctctattcttagactactccagaaagaatcatgcctcagggcctttgcacttgctattactcctccctacaacactcttgtctcagttggccactctttctcaagacagccccagtgcttgctcccaaacttccttcaagaatttgctccaatgtcaccttcttggtaaagagcttcctaatggcttactgtaaatcgtaagctcttcctcccacccttgaactacctatcctgctttatctttctccacagcacatatcaacatctctgctggttattaaactagtggcttggctccaaatctacccttccaaacactcttctgcaatgctcaagttaggagtctacaaactgtatttcccaggattattctgcaataggggaaaactgaagaaagtgggaggtcagagtggactagctacttcccatatgtttgctgttcctgtcagtatgtccccagcagaggcccttcgccctggcagcataagttggttccagtctccaactcccgagtcagtctcatcgcatcctaagaggtaccagtgccaccttctcggacatctgagctctctgccacagggatccctcctctgagcctcgagactcaaacaactccaaactctttattttgatcctcccacccaaccatgcaggctgctttctgaagttatttcctttgtgtgacctcagagctctctttctgctttttcagatctccaacaccaattccccataacagagtccctctgttgaaaaacctagtatgatttttgctttcttgactggatcccaaatgatatacttaatatgtaataactttagatttttaaacaaaatttagaaaataatctttccacagtagcattagaacagagggttttgtctgtctcattactgttgaatcctaagcacctggagtagtatctggtccatattaggtgctgaataaacatcagctgaatgaatgtatccctctagttagcagcttaaaactaaccagaagacattgtctaggtttcagcctaaagactatcttaaccccaaaggcttctctgaccctaactaaagtagatcccctctagttctccttcacagaccactgcataagtctaccacggcacattttacaatctgtaaaatgactttctgtatctgtatatttatttatctttcttattcaccataatattaacatcataagaattagaattgtgtctgtcccactacatcttcagtgactagcgcaggctaggcacgcagtaattgcatgatttttcgtggaaataaaggtacactggggcttaacttcacgagaaaataatcatttggacattttattgctcttcccacaagaaaaggtaggagatgggaattagtagtgatctcagtgggatcctgtaccctaaattccttgatgtgacttggaatcccaaatagctgttaagccaaatttgatttggtggtattatgagacattgttatagtcacaaattaaaatacttcacaaacatcgacaccatgaaaaattaaaacctgtgttgaaatcctctatggtttcagcaaatatgtactaaacacatactatgtgccaagtaatgttgaagacggtagatgcagcaaaaaaaaaataaataaataaaccgagtttacgtctccatggagttgatattctagtcagtagagatacacattaaataaactagtaaatatgcaatatgtcacttaacgtgagggagaaaaagcagaataagagtggtaggaaattttcaatggtagaagtagaagtagaattacaattttacatgatgagggaattcctcactgagaaggtaaaatatgcacagaggactaaaggaaatgagagcaggagccatgggccaggcctggaagtgttctaggcacaacaggtaacaccaaacgcaaatgtcctgaggcaggagcaagctatgtgtttgaattacagtaagaagcagagtgggtggggtaagagaaagatgttattaggttagggcaaacataattgcggtttttgccattactttctttattgcaccaacctaatagatcagagagacaatgaggacttgacaacacagagagatagaggccaccataaggactttgtatcttatgaggaagatgggaagccactggaaagttttcatcacaggagtatcatgatctgacacacacacacacacacacacacacacacacacacacacacacacacacatatatataatttttttttggatggagtcttgctctgttgcccaggctagagtgcagtggtgcgatcttggctcactgcaacctcagcctcctcagttccagtgattctcctgccttagcctcccgggtagctgggattacaggcacctgccaccacggctggctaatttttgtatttttagtagagatagggtttcaccacgttggccaggctggtctcaaactcctgacctcgtgatccacccactttggcctgccaaagtgatggaattacaggcatgagccacctcacctggccctgacttagattttaaagagatcactccatctactgaattgagaataaactctatgatggactagagtggaaagaggaacaacagtttggtggttattacagtaattgaagttacagattgtgataggttattcttcccattaagatgtggagtccaattccaccccctgtgtatttgtgttggccttagtggcttgcttgattgaaggaataaggcaggcatggtgctgtgttacttccatggctaggtgagaagaatacttgcagcttctgctttggtcctttggcacagcagctcttagaacataactgcctcactcggagaaagctggagagacccacaaggagaaaaaaggaggctcccagccaacaaccagcacagctttgcagcaaaatgagttggccatcttagaagtggactggctagatcccgttgaaccaccccacctactcttcctgaaacagacacaagccatcccgctgagccctagtcaaattacagattcatatgcaaaataaatgcttattattttttaagccactaagttttggagtgatttgtgacacagcaacagataaccaaaaaaagaattcacgatagctcaaactagccgtaagggaaaagatagttcctaatgcacttatgtggaagatccttcaataatatggttaagaacttggggttttggagccagaaaaacttatatttgaacacagttgtatcacttaacaggtaacccttggcaaattaattagttttcctgaacctcagtcagttacctcatctgcaaatgggaagagtaatggggcctagtttcttgagatattgtgaggttacaaggagataatgtaggtaaaatgctttgccccatgcctgacacttaatgagtactcaaaaaaagtgagctattaataggattgattttttaccattttaaaaatggcaccatatcattcaacattctcaaaaatggaagcttctgtggcacaactcccggatttccactacattaagaggccagatgcaaaaagagttatagtcccaggagaaacaagagccacagttgactagccatcttctatgcatcaacagtgtttattaagatgtcataggattaactgccagactgcctttcagaagcctttcgtgacttataaaccatggtagtcatgggagctaactcaatatcaccaaccctcagcaaaatagctttccaaaattttaacactatcacatctattttggcaaacatattagccaattcagtggagggcaaactattatgacaccaacttaagagattctgcaaattcaaggagaggaaaaagggcatgattttatcaatccatcccaaatcttgctgctgacaattagtgcaaaccccattatataagtctagatgtgagatgtaatatgtaccacagacagtggaaggcacttcaaacagaaggatcaatttaccactttattaacctaagcttgataacagatctctgttagagatactactcacatcccacttccactttattacagagattacgctgaatagagaactgatttttaacaataaaactctttctatggcctttagccagaagcaataaaattctgacctcacagctataacaaaacagagaaacctcctagcatatatctctatattaaacaaccagccttcaagatatatcactggaaggatgttggaaagaaatgctgctttaaaaatatcaatagcccacgatttaggagcaagtacaagagatgtttagaattggtttaataaatatttaaatacatatgccaacatgccattagtttatgaaatatagatttcagggaatattgacttgaggcctgtattacttactgagtattaatatacaatacaatgaatattcatggacaatgaaaactcactattttaatgtaaatatgcatacctgagttcctgagtgatttatcttcctcttgggtggttgttacatggtaataaatgttatactctttgccatacattaatgagtcatttcaggcccaagagctttatgaaaagttggatgttatgttgtaaggcattagaaagtcattataggataacaatcagaaaactcagtttttacaaagaagctaccatttctctgctgatgcataaaccatagctttgctattttaaattataatggtgattaatctgattgcttatttcaatgggacttaatgtatctgggatgtgttcctctgacatttctattcttcttcatagctacataagcttaaggtaatgatgagttcccaaatctctattataacagaaaagtagcaatacagagggaatactatcacagaggaaaaaaatccaaacggaatttcataccctccttcactcttacaatggccttcaccaagagcagtattttctgccacaacatggcctaaaagtgttaatatatatccagcaataatgagatatgagtcaaataatgtcaaaaagcactgagttcaacccaattaaaaagaattcttcactgcaagacttctcaaaggtgttgaatatgctgatattaattgagagtttccaaaaagaataaactatgctgtgtttacccaactctttcttcacggagcatttcataggactagtgttctataagcacaagcataggctgctggagtttaagtaccactttccctaatctcataggtaacttacttgggtttttaaaggatctctaaatcaagaaaggattcctgttctcattttctcccctacataaagccaagttcaggatgaaatctcacaatgatgtatgagaaagggtacactttctagacccagtgtacaacaacaaatacaaatttaattacatcacttaccggtttaaagtccctccagtagcttcccaaactctacacagtaaaacacaaattctgtcaatcaagcttttgaaagtttctttatgacctcctcatcgtttcttccccagtcataggtgtcagtactcaagacttcaatttgggtacttttagctccccacaaacctctccccaaagtaaatgcttcaaaggcagacaagccctggctaatttagctgaatgtggtacttctggcacttagtttgattgtctgcacttggagattctatacctataattccactaccaaaaaaatatttatgccaccaattcctgctgcagtaggggtgggaagactcccatatgtttttttggcttcaggctcagcttacacatcacttcctccaggaaccttgtctgatacaaaaaggttgggcttagtatcattactatgggttctcatagcattcattcctttcccacactttagaatatcccactctccattggaatgacacccttactgatctcctcaaccagaatgtatatttcctgggtgctaaagatggagtctaagcacacatattatgtttgccagagtcttttataccacagtcaaccaataaaatacatataatcttactgtgtatgatactattaccatattagccaattattattgaactaatgcatgcccaccatttatctcaagagtagaaaactctaattcagataataggaatgtttcatgaggccatgctctagtttacacaactgtgaaagttcaacagagggttactggagtcactataaacaccatttaatgtggcaaccttaataatataagcaaggtcagaaattttaaaaaggaagagagggaggcgaagagagggaggcaaggggtgggggagggaagaaaaagcaaagaatgcaagaaaaaaaagaaagttaaagagtagtgttgtttctccctgtaaatgaacttctgtcctggagtgaccaggtgactggaggctgttctcccactagtctctgtttcacatgcatcctgttccatggagtgttagatattgcacagattaagagaatttcaagggaaatcttgacctcaaacaattttgtttgcctcatgtgcttgaaaaggaactcatatgtaagttagaactcaactgcacaagtattttaagaaagaatttttctctcagtcctggaaataactggaaatagtggttagaagtgaaacacaaacagtaattagccttaggggtaaaaatatcccttctacaattttgtatcatttaaaatcaccagcacaaatactttcagagtaagaagcctgagagtgcacgctacagaagagcttatgatgtcctattactgctgtcaccaacagaaattcaaacgcaaagatcacatgaaacacagacctcaagttactacagtgtttgttacaaagcaaatgctcaatgaaactttgaaaagggaagagaggaaagcagaaagggaaggaaagcaagaagaaaaggaaggaaaaatgggaagagaaaaggaaaaaggaagaaaggtaggaaggaagaatgaaaagttgattttggtctttgggaaagttttgacagcaatctttcacaacgaacattttactatgtactctcaaatcacaaagttggtgtacaatggcaacaggcaatactacccagtggaaaatatctgatgcattctatctggaaacgatggagtctctcataggtttcaagagaagaaaaacaattgccataggtaaaacagaagtactcttttctaatcagcagctcataaaattgctgtaagaatgtctaagcaataatgaatagaaagtttctctcacacaggactgggaacttacaggacttaatatatgttagtcatgtttcattactcttatagaaaagttagacatgtagggtaaattggactgtcttttgtcaaattcccaaagcaaatatggaagggtttcagtgcatcattcaattccacagtggaccatgctcaaatagaaacgaggatgtagaaacaatgaataaatgcatcccagtcgacaaagtgtcaacacatcctactctgctgccctggtgtgtgagtctgaaaatagtgaagggcattgaagttatgtagactctactgcagaaccaagataggctgaatgatagatcgcaacaggtggatatctgatacatcaggccatgcagaattcctagtggtcactcgcattctaactctctctcagctccaaggggctctctctggaggttggatctcatccacaaggttttggccaggatccagaaacatgtaataggaaaactggcaaaggtcccaacccagcccattaatgatctgcaaatggtaccctttagatcaaatactcaagccacaggacttggaggtgcagcctcacgtttgtcttccagaaacaattatttcaccatcgaggttcacttgtgctgcttgctagaaatcattctcctctccccttggctccagcaccctcagtcataatttcaaacacctacttggaattgcatccctagactcaaatttacacattctcatctccctataatgcacccatttccagctcactgccatcaatcagcaagactgccagacactactatcccactgcaccgatgtcaaagccacaccacctctctatggacagacacatgctgagcagaggagtacctttctcaaatctgcaactctgcttcaatatgaccctcacaaacaccctcaaccctcagtaggtttttctttttctctcttctcctttacagtatttgtagccaaacacattgtctgctgtactgggataatctgcagagaaacaactgactaacctttggaatgcttttaaaatctgtagaactaagatacacacatgctacccaaagatttcatcctcactaaggaatcaacagtaatctgagaaatgttctgtttggaatgttgagtttttaagtccactaacatggcttctgaaatggtaaaataaaatggcatctttactttcaacgaatgctctggtctggaataagcactgtataatcatctgagattataattacatggtcattcaattacagtcacagagagcccctgagttgtaaaaatttatgaaaaaacaaaagaacaaaacaacttaccttgtcaataatatagcggtagaatgtgcttaactcaacatctgggttttgatggtgggaagccacttattaattatacaattaggtatcacaattgtacaagtatacaattagtaggtattatttcctgaatacccactgtgttcaatcagcgtgccccatataagggaggcacacattgtcccctgttttaattgcttactttgctggggacttcagtaacttcaccaagtcacagggggaaatcacaatttatagaaaatgtatatggaaaaaggcttcctaatctttgcaaaaacaaagaatcttttgttatatgtaattagtttttaaataactcatggtaaattctccacttctatcataatctacatcacctaataaatgtgatttgcaagtgagaaatatttattgtgcttttccactccagtggcggcagggtgggatatatgcttgtttcacttttctttttttcctgccctccttgatgttcagttcactgtgaaggtgttgttgacatctttgccattttttgccaaaatgactgctcaaattaaggtaacttgggaagttactgcctgtaaaacaaatggggcgtcactgaaatggctattccttgattgtatttcatttgaaatttaacaaagtcagagagatgggtcccacaagcatacctctagtaaaagctccagctcttacttgcaacgtatgttatgcagcaattatgctaccaagctgcccagaattctttatctgcatgcaaattagtttatatgtgctacagctgccattatgacagtattaaagaaagaatttggtaatgaaactatcctctttatggaaatgcagttcaattaccttaataacacattggacatacctgcaattgcttataaagtgaaaagcccaattctctcctcacatgcccagaccactgtatttaacccaccttctcatcactttaaatacaagaacaaccaagagggggatttctaggctaccttttacaggcctgactctttcagtgctatgatgggagcattccctcaactgacattgtgggtaacttggtgattaaacattcctacaatcctctaatagttaaaaaattaaacggtcatccaacccacagctgttagcgcccagttttgccatcaatcattaacagtaactcctgggaccttcaaaggccaccagcaggcaggagtgagaaaggaaaaaagaatattaagtccttaattccaggcctgaaagatacatataaagcaaagaaagcaggctttaaaaaactctagaatggttatgatattttaggaaggctaagattcacgtatcttctcttcttccattggtgattgtcttgacttctcaaacagccaacctaaatcactgcttttaggctgagattgcagaggatgagcaacagctcctttgtcacaccagtggctccttttaggaagcaaagacccagcccttaacactggcatttccacagcttgccgaacttgggatgctaccataagagcactgagtctcacacctaacttacattgttcagagttaattatatttcagggctgggtacggtggctcatgcctataatcccagcactttgggaggctgaggcaggtggatcacttgaggttaggagttggagaccaacctggccaatatggtgaaaccccatctctactgaaaatataaaacttagccaggagttggccgggcgtggtggctcacacctgtaatcccagcactttgggaggccaaggcaggtggatcatgaggtcaggagatcgagaccatcctggttaacatggtgaaaccccgtctctactaaaaatacaaaacattaactaggtgtggtggcagacgcctgtagtcccagctactagggaggctgaggcaagagaacagtgtgaacccggggggcagagcttgcagtgagccgagattgggccactgtactccagcctgggcaacagagcgagactctgtctcaaaaaatgtatataaaaataaaaaataaaaacaaaaataaattagccaggagtggtggtgcatgcctgcaatcccaactactcaggaggctgaggtaggagaattgcttgaacccaggaggcagaggttgcgagatcatgccactgcactccagcctgggcaatagagcaagactccatctcaggaaaaaaaaaaaaaagttaattatatttaagagagatcataagaagtaccaattggcaattttttaaaaagtggggtggggagtactgatcttcacataaaacaaaggcatttttacagactgctttttttcagttgggtgaaagactacaaagattttaagagtatcataagttaacaaaaaatggctttttaatttctccttgctccactgctatcatttacatcaagaaaaaaactgaaacaccttgaaaaaggtgttctgaaatttagactgaaaactaacagaagcactttatttttacctcgcttttctttcactccacgtcaactgtcacaaattgatataacattgcaaaattcatccaatattgcaaaatttatctaagcgtttctcaaaactaagattttcaacacagcgaaattgctgtcaaacatggtgctactttacatagccgaagtccttcattcattcatggaagagattcaatagatacaccatggcaggacagggactagggcctaaagtcaccatggatatataaggagatgtagtgtctgtccccatggagtggaaactccaatgaacttatacctctctttagtaagataaaaggcgggtcacagaaccatctgcatctcaatttctgaacctgtaatgtgaagaaaatatcacctatcacaaagggctgttgtgatcatttcaatttgataatctataagagttaagcactttgcaggatgtgtagcagagaacaaatgctcagcaaatgtcaactcccaatatttcccctcttctcaaggtaaaaactggcccctgtaccaaaacattattttaccattcaaaatactatggagtcaggcgtagtggctcacacctggaatcctaacactttgggaggccaagacaggaggattgcttgagcccagaagtttgagaccagcctggacaatagagtgagaacttgtccctacaaaaaaatttaaaaattagccaagcattgtggcacacatctctagtctcagctactcagaagctgaggtgagagaatcactggaaccctgaaagcagaggttacagtgagctgagactgcaccactgcactccagcctgggcaacagatggagaccctgtttcaaaaccaaccaaccaaccaacaaaaaacaaaaacaaaatattgtcattaagtaatgcctaattggtaaatattctttttttaaaataaaaaaaaaaaggcttggactttctgctcccaggttaaaagaaagagattttgagtagatacttttcacattttggtaaaatacacttagcataaaagtcatcatttgagcaattttaaattgtataattcagtgacagtacattcataatgttgtccaaccatcatcactatctagttctggaacatttcatcaccacaaacagaaactccatacccattaagcattaattccctgttctcctctcccccaagttcctggcaactactatgaatttgcttattctggatatttcatacaaatggaatgatacaatatgtacccatttgtgcctgtcttcctgcagtgtgatgtttcttatagtgaaacgttttcaaggcatgtaatgtggcatgtatcggtacttaattccttttcatggctgagcagttgtattctctcacatggatataccacgctttgtttatctattcatcagttgatggacatttaagttgtttccaacttttggctactgtgaattatgtgcagttatgaacattcatgtatgagtttctatttaaaaatcttttcaattcttatgagtacatacctaggagtgaaatagattttacctatgtatacacacacatagataatatatggatacagacataacacacataaaaatgtatatacacatataatatatacacatatatacataaatataatatacacacagtagctcatttctgcagtagtaagcctttgctatacttgcctggttaaggcctttccctctctttctccatcattagctgatcttgaccctctcccaccttcacatttggaatgtcttaaatgactttaagtcctctccatatcccacctgtttacatattacccatatatgtgtgagagtgcctagctagggattcagtaggtatttgttggaaaaaaaatgcatgaatgaatgaatgaagcaataccttgcatatagcacaaatacagcaagcacctgtagcaagatcaacgccataatcatatccaaggttaaaatagagaaggtgatccctagtgttcagagtgctactttgaatgtcactttctggatacctgtcattaatgtcatccatgtcactgaattaggcgagtgctaattcatccatgtcactgaattaggcgagtctttcactccttttctccatcacaaactcctccagaaccatatagcacagtggctaaaaatataggtttggagaggctgaggtaggtgtattgcttgagcccaggagttctagactagcctgggcaatgtaatgagaccccgtctctacaaaaaataccaaaattacccgggtgtggtggtgtgtgcctgtagttccagctgctactggagagactgaggtgggaggattgcttcagcccaggaggcagaggttgcaatgagccaagattgcacacgactccagcctgggcaacacagcaagacacatacgtatgtgtgtgtggtgtgtgtgtgtgtgtgtgtgtgtgtgtgtgtgtgtgtatatatatatacatatatatatacgtgtatatatatacacatatacacgtgtatatatatacacacgtatatatatatgcacatatatatacacgtatatatatatatatacacacatatatatacacgtatatatatatatacacacatatatatacacgtatatatatatatatacacacacacacacacatatatatatatatggagagagagaaagaggaggggtggggtttggagaaaaacagcccagtgttggaatccgcattggctctgttattattcgtagttcccataaatttctatttgcatctctgaaaaataaggacaataatccccatgctttgaagttgctatgagaattaaatgacataagtcatgtgtaatgcttaacaaagtgcctggcccacagattaatggtactgcttaccattaattaagtaggttcctagcataagcaaaatctctttttttacattaaattctctcaggacacaaaaaaaaaatctgaaaaaaatcaaccccaaatgctccaatccagacctacagctttatatcaatatactaatggatctcaaattgtatctcaaatttatagctagggttgtcatctgagcaacagacttgcctatcatccaactgcctacatgaaatctccacttagacccgtaagagacagcttagaattaatacagtgcatgcctaatacattatcgtcaggggaactcgggtgaagggtacacaggaactctactatgcttgcaactttatatgagtcaaactatttcaaaatttaaagttataatatttatttaaaataatagttataacacacaattattatttacagtataatacttatttctagtaataataagattaacattctcaaactgaactactataggtttgctctctggctccaattccctatccatctttgtaaatgaaccactgtccaaacaattgctcagatgaagcacttagggcatcaccctcaagtggaataaaatagcattaagaacatacacgccttggggccagactgctgggtttgagtcatggctcttccagtttccagctaagtgacctcaggccagttccctgactttccaatatttcagtttccccatccataaaatgagaataaatagaacctatagcacacagttattatacagattaaaagagtgagttaatacactaaagtgcttcaaatggtccacttctcattgtaagttttcaataaagaattagccatcactattattattttcccttagccctgcacttacatcccacatgtattctaaacctgaccacttctcactctctcagctgccaacaactctagtataaccccaccaccatcatcaattcctataaatccgtacagttccaatcatatctctgttcccagccttctccttctaggattcattttctgtaatagttagagaaaactttctaaatcctaaaccaaatcatcttatcttttactccaatggtttctattcaacgttccaatcatttcctattgggagcaatttttttgaaaaactcttaataatggcctaaaaaattctctatgatctcactcctgctttcttctctgacctcatctgcttttgttctcttcactaagacacaatggctttgagcatgccaaagcttttgcacttgctgtttgtggcatggactgcgacttaatctccaacattcattctcccgtgctttcgaacactcaatttgtcagggccacatgatgccctggaatacagactacatatgtggcctaccggcagctagacataaccaaacaattacattctatcaatgggatctaagcagaagtatgtgtaactttcaggaaaagaccttaaatagagaaggcacatctctcttttgctctttctgggtcagactggctacagtgcaaaaacagcagcccaagcttggagcgtgtgtttggaaaaatgcaattaacaagagagaaggagccaaaatctgtggagggaaaggcaaaactacagaaggaatctgggtccaggtgatcatcaagctgcatcatcagctctaggttacttaccttggagaagaagaaacatacaatgcactcctatcctgtaagctgctttaatttatgatcattccccttttctttgcagagcaattttccccatggatccatgtgtggctgcctccttctcaccggtcaagtctcccctcaaatggcacaacgttaggggtgtcgctggtttagcaggaccgtctctctctcctgatctataccacgtgactctatgctttcttgtttgcagcatgtgatagcacaggaattctttatctactttgtaaatgtctgcctccttccacctaaagataaacttttggggggcatccactgtagccccgcacacttagaacagctcctggattgcaaaaagaatgcaatccctattttttgactggcttacttatggtatgttgaatgacctggctttgtgtttcttccaaatcctgggtggttttccttctcatctcaaattagtagatttaactcagtccaacatttacggagcacttattgggtggagacactgtggtagacactggagagataaagaccaaaggaggtgtggtcactgaccccaggggcttcatagtaacactgcaatctgctcttctcatcacagaatcaaatactgaaggaatagataagctgacagtaacttttgcgttgtgtttacttaggaagaaactcagactgtacccgtaattgtcatttttggatccatttcttaaacacactgcaatcattactttagtgttgtgactatcacaaaatattgacaacttccaaaatacagtttcaaaaggtcattaaatacgtaattattgaaaaattccatcggtgtaccatgatcgcctcaaaatcactttctagaattcaaagactttcactaccctctgaggaaagtgacatgtagaattctaccaaaaccatgtagaaagctatatacagagttcttttaacaagaccaaatattcccccaatgaggcagcttctaaaagatctcctctatcaaaacattctctgagcattagaatccatgtggttaagaccatttcttggtggaggctttaaaaattcaacctgcaaagtctcatgaaatcatcccaaatattacatccatccaatccaaaattctccactactaggtaagatcattcatgaaaccttatatggcttatgtaaattctagactcagaatgttttataaaaagcacaagcactagcttagaggtggattctctggccatactcaagactggagatgactgaagcctgacagcttgattgcaagcttgtgagacagagaactacccagaactacctaagccagattatggattcctgttcctggattcctgacccttagaaacctggtgagagaataaatgtttgttgtatgtttgtgtgtgtgtgtttctacagcatgatcactggcagtcctatttccaaattatacacataccataagtgcagggctcatgcctgtaatcccagcactttaggaggccaaggtggtaggatcatttgagtccaggaatttgggaccagcctgggcaagatggcaaaacctcatctctacaaaaataaataaataaatgaaaatcagccaggcgtagtggtgcacaccggtagtcccagatactcaggaggccgaggtggaggattatctgagcccaggagttcaaggctgcagtgagctgtgaatatactgctgcactccagcctcggtgagagagtgagaccctgtctctaaaaaagaaaaaaagagtgtgggatttggaaagagagagagatcagagtttgaaactagcccaagccatgttacttgggcaagtgtctgcataaccattccatgccacagttcgctgagagctaacatgacaaacaaacaagatcaggaagtgagaccacagtgcctggcatacacatacagtaagcactcaattcacattgactgtgatgtcagtgagaacactgacgatgatggcaagagagcaccaagatttgaacccaggtctggctgcctccaaattcaatcccatttcactatttcttgttcagttttttcattcttggccaccaatccagggcatcagtaggaggtttcagctctgatttctaaggcatggatgctgccgagcctctacggggtgagtttgttcaaccccatcaccatggcaggtaatttgtgcaacagaaaggatagagattgaatggaggggaagtgccaactctccatgtgggggacaaggcaccatatggcccagcaattaggaaggaagaagactgccaaggacaaaaataactctggcagaatccaacacggctggtagaagtcagcccaggtcagctccttcttggtggtgttgttcttgttccccaagggactctactgacactccttaccatgaatttgaaaaagatatgaaagaggaaaaggaagtctgatgatagtggagagttctaataccagctcattaaaacaattttcctttttcctaaaagcctggtgcaggaatagctcttcaaagggaagatgtgcttcaagagattattgttaactttgaagaagcttaacaacctcactctccttgtctctaaaagaaggcaggtgaactaaatgagatgccttgtctcttgcagctctgaaataagctgttgactccagtcaataagccagagatagcaacaggaagaggaagaaggaagctgtatagattcaaccctacccattttctacgagtaaagtttgtgttcaagaaaaagaacagggaacaaggactcagtgaatttctgtaagaattcaggcatgcttcacaccaggaaaacaatgaacaccgtactctttcaaatctaaaaagcaatccaaatgttcagtttctttctcttctaatggaatgaaactatcaatggcattcaaataccatcactcattcagctgaaagctgttttatgcatgtaactacaaggggatgattcaaaggaaaaaatgtaaggttttatttggcaaaatgaaaattaatatttcttaaaatagagatcagttaggtaacctctatcttaattatgacacttcagtattttttcttgacagcttaaagtcaaaatcacccttcattgctgtttctttggttaaacagcagctgaggaagctggcttgagtttaaggaccatgttgaattttttaaaatatagagtaagacactagaataaacacccacttggtgaggtgctcacaccatgaggggcacatgggaactgaaaacaaatggagaaatccaactcatgactaaactcctgttcactttgggacctttacacaccatatgcaaaggcagctggcatggactgtgttatttacacttatacgttttcccctgaactttaagttagtacacactgttgatttggtgtctgttacatacatatatactgatgtttccctgtatatttttgttgtttttctaatcttatcacccctactaagctacaagttctgtgaagcctagattcacctttgtataataactcctagcatactatagattcctagcttctagaacttcccatatcggaaggtctcaggaaacctgcatgggataatatgaatgaaaataaaaagtgacctggatacatacatatctctctccctgaaatattgctagagcatacccttcctgggtatttgtacaaaaaagataatgagcattctggctggctcctttgcaacagttataaaggcaaaaggaataaaaaaaggattccagggtcttttcaaaggagctaatacggtagggtgagatttatattagaaatgcactgtttcagtctatctagtcactattacccattttctggccaccagttcccagctcctgaggtgcatgtgaccctgagcaagctaatcagcatgatccattctctagtcaaagtgttcagggctggccatatgatcctggttaatctaaccagattcaatcttgggacattggttgtaaccattgagaaaaaggagaaaaagaaattcacttttcatgaaggatgctaagcttcaaggatgggactctaacactgctaggaacaatcctcttcccaccagagataagactgagaatggcaccaatacagcagagggcagaagacagatacaaggacagattgctaacatggtttgggtacccagagccagccatgcccgtaggtagtttatctttggacgttttcattaggtaagcacataaattctcttttctgtttgagtatgaattcttctggctatgacaatggaatgaattttaagtgaaatagaagtgttacgggggattgcacaggctcataaaactcaagtcctttacaatatatcccaacctacgctgtctaacctcctctgccatcatccctcatccattctgtgaatttaagttctaaatgcactccactatacactgtccgtgaatagatcaaacacatttattccaacatgcctttgctcaagctattacctctccctatgagatctttccttctttctctgcccaggaaactcctattgatcctacaaagcccgtttttctgtggaagccataccattcataagcaggagcaggcactcccttctccatgttccctttcactcctttctctgtgttcccttttgcattttccccataatttatggcaccttgtagcatttgccacattggctcactgttatttattcatgtgtttctccccaaactgtaacttattcatctttatctcctcatagtttaatgttcaataagtgagaaggaggaaagaatggcagtgggggaatgttatggtcatgcagggcaaagaaggatagactctgaacaagagtcttcagaacttgggtataccttgcaataaaaacaataatcaggaaatcattgctggattaaaaatgacctcccaacttttcgccttccactgaaaaaaatcactagattttttaagtgaatgcaaaggaaacaattgttatttaatagtcaaattaggatctcatgctgttccccaaccccctgaaaattacacatttaaagagaaagattatgaagataattatcttttaaatgtatcaaacacggtggctcacacctgtaatcccaacactttgagaggccaaggcggtcggatcacctgaggataggagttcaagaccagcctggccaacatggtgaaacctcgtctctactaaaaaataaaaaattaataaaaaaataaaaatcagccagtgtggtggtgggtgcctgtaatcccagctactttgaaggctgaggcaggagaatcgcttgaacccaggaggcagaggttgcagtgagctgagatcacaccaatgcactccagcctgggcaacaagagcgaagctctagctcaacaaaaacaaagacataaataaaataaatgtaaacagttatgtttacaacaccctctgccttttccactaacttataggttggagtataaggataaaaccagaagacagcattattgggaaccagaaaaacaatgacctcaagacttgtaaattctccatataaacaacaaaataccacagctaagaataatgctttaagtggcatggactcaggggatattctctggccagattaaaagatacacaccatccttccatgtggtgataaaaaacactgatctctatctacctccttctctgtcatccaaaaacatttttctcatgtgttcagcattttctaaaacaagtaactatgcagaaatcaattccctacagttaaatttataccaagttaggctggcattgaactgcaatataccaaagctcttagaaatctggcaaatacaatatgaaggatatcaaaagaagcctgtaattgagctgaaaaattaattatagccctaatgtgattctcttcaatcaggaaggtccactagatgccatgctctcatctaaccctcagagcaacattaatatccacaccagacggacaggaagggcagcagtcagacccagagcagactcgtttctctgttcgatcctcaacatttttcttttattaactaagacaaacataccaactatagtcaagcagtcatacaaaccaactaccaacaaacagacacacataccaactgcctactgtcaaccagaaacacatactaacaccggcaaacagaaacacataccaactaccgtcaaccacaaacatgtactaactaccatcaaacagacacatataccaactaccatcaaccagaaacatgtaccaactaccatcaaacagacacacataccaactaccatcaaccagaaccacataccaactaccatcaaacagacacacgtagcaactaccatcaaacagaaacacataccaactaccgtcaaacagacacatgtaccaactaccgtcaaacaggcacacatatcaagtaccatcaaacaggcacatgtacaaactaccatcaactggaaacacataccaactactgtcaaccagaaacatgcaccaagtaccaacaaacagacatacataccaactaccatcaaacagaaacaaataccagctactgtcaaccagaaacatgtaccaactacatcaaacaaacacacataccaactactgtcaaacagacacataccaactaccatcaaaaagacacaccaactactgtcaaccagaaacacatatcagctactgtcaaagagaaaacctcttctgcacaatattgccaagcaaccatctgaaatggataccgtgttctctgggaccaagaacaaacaaaaaagatgcctgtgtccttttaacctgtatcctcatttgtgatcatggccaaagcagaagtgctcaatgaggagggtgcaaggaaatatacttggatcaaaagcctggccaggctttccacactattcctagacacaaagggagctggtttcctgggcactctagcagactgtggcaactatttagcatatgaagagaggcctgtgcctttacccactttctggaaacaaaagcagtctgtcgtcaatataaatacagtttacataccaatgctttctaattaacctttcaccacagtagttttcaccacaagtgcattttccttcttagcctcaggaacctgggagagcactaaccctaggcttctcagtccttgctaatgataggtttccaggggctttaaacaaagtttggatttcaggatcagctctgccacttactacctgaactcaggcaagtaaggtaacctctctcacttcccctacactcacttccacagcaaaggcttaagagctttctcataagatcaatgggaatattaaacaacatatggaaagtgcttaacatcaagatgggctcaaagggaaagtcacaaaccacatacaacagcaacttatgctataacaacttatgctatatgttatgttcagtaacttctaagctaaaagaaatattcgagatcagtaatcacaaccaataggagagagacttctcagtttatacatgccttcctggactactctatctaaaattacatcaaacccctttattctctatccccctcaccctgattcattattttacataacagcatatatcacttcctggcattttatatttattttgggtgtttttttctatattcatgctccataatgtaagcttggttgaattcactactatattcccagtgcctaaaaaagtgcctggcaaacagagaccctcaataaatacctgcaggatggtagaatgaatatacattttaaaaatatagggggctatcaatttttacatttgttttgagagtgggttgtattttattaaaaggatttttgatactgcaggttgctttacatctaaaatggacttcttatctatttattcaaaaactatctattggacagagcatttcacaaagctgtttgccaggtgctaagaaagaggtaatgattcatcagagtatgcccttaaagaggttttagttcatacacactgggttgcatcctcaatgcacaatcattcttccttcactggtaagtgcctctctcccttcttccacatggtgactgcaaatgcagccatgttggtaaaatataataaccagtctgctgtgagagaggaaggaagcagatgtgctgggaagagcagccaggctgagagagggattcagggctccccgtggtgcagcaagccccagggcccaactgttactaaatctggatggtgtatgtatcaaaaacaatttttaaaaaataatcaggcaagacataaaaaagtttgaaaagatatattctttccaagggaaatctatcctaaagaaaaaaactgaaatctgaacatatattaaaacactgatcacacagaaatataaactaccatcagagaacactataaacatctctacgcaaataaaccagaaaatctagaagaaatggacaaattcctggacacaaacaccctcccaaaactaaaccaggaagaagtcgaatccctgaaaagaccaataacaagttctgaaattgaggcaataattaataacctactaaccaaaaaaagcccaggacaagacagattcacagccaaattctaacagaggtacaaagaagagctgataccattgcttctgaaacgattccacacaatagaaaaagagggactcctccctaactcattttatgaggccagcatcatcctgataccaaaacctggcagagacaaaacaaaaaaagaaaatttcaggtgaatatccctgatgaacattgatgcgaaatcctcaataaaatactggcaaaccgaatccagcagcacatcaaaaagcttatccaccactatcaagtcagcttcatccctgggatgcaagtctggttcaacgtacgcaaatcaataaacgtaatctatcacataaacagaaccagtgacaaaaaccacatgattatctcaacagctgcagaaaagacctttgataaaattctacaccccttcatactaaaaattctcaaaaaactaggtactgatggaatgtatctcaaaataataagagctatttatgacaaacccacaacaaatatcatgttgaatgggcaaaaactggaagcattccctttgaaaatgggaacaagacagggatgctctctctcaccactcctattcaacatagtgttggaagttctggccagggcaatcaggcaggagaaagaaataaagggtattcaattaggaaaagaagaagtcaaattgtccctgtctgcagattacatgattgtatatttagaaaaccccatcctctcagcccaaaatctccttaagctgataagcaacttcagcaaagtctcaggatagaaaatcaatgtgcaaaaatcacaagcattcctatacaccaataatagacaaagagagccaaataatgagtgaactcccattcacaattgctactaagagaataaaatacctaggaatacaacttacaagggatgtgaaggaactcttcaaggagaattacaagccactgctcaaggaaataagtcaggacacaaacaaatggaaaaacattccatgctcatggataggaagagtcaatatcgtgaaaatggccatacttttcaaagtaagttttagattcaatgctatccccatcaagctaccattgactttcttcacagaattagaaaaaactactttaaatttcatatggaacccaaaaagtgcaatcctaagcaaaaagaacaaagctggaggcatgacactacctgacttcaaactatactacaaggctatagtaaccaaaacagcatggtactggtaccaaaagatacataaaccaatggaacagaacagaggcctcagaaataacaccacacatctacaaccatatgaccttcgacaaacctgacaaaaacacacaatggggaaaggactccctatttaataaatggtgctgggaaaactggctagccatatgcagaaactgaaactggaccccttcctcacacgttataaaaaaattaactcgagatggagtaaagacttaaacataagacctaaaaccataaaaccatagaagaaaacctaggcaatatcattcaggacataagcatgggcaaagacttcatgactaaaacaccaaaagcaatggcaacaaaagccaaaattgacaaatgggatctaattaaactaaagagcttctgctcagcaaaagaaactaccatcagagtgaacaggcaccctacagaatgggagaacatgtttgcaatctatccatctgccaaagggctaatatccagaatctacaaggaacttaaacaaatttataagaaaaaaaaaacaaacaaccccatcaaaaagtaggcaaaggatatgaacagacacttctcaaaagaagacatttatgtggccaagaaacatgaaaaaaagctcatcatcactggacattagagaaatgcaaagcacacacaatgagataccatctcacgccagttagaatggcgatcattaaaaagtcaggaaacagcagatgttggagaggatgtagacaaacaggaacatttttacactgttggtgggagtctaaattagttcaaccattgtggaagacagtgtggcaattcctcaaagatctagagccagaaataccacttgacccagcaatgttattactgggtatatacccaaaggattataaatcattctgctacaaagacacaggctcacgtatatttattgcagcactattcacaatagcaaagacttgggaccaaaccaaatgcccatcaatgatagactggataaagaaaatgtggcacatatataccatggaatactatgcagccatagaaaaggatgagttcatgtcctttgcagacacatggatgaagctggaaaccatcattctcagcaaactaacacagaaacagaaaaccaaacaccacatattctcactcataagtgggagttgaacaatgagaatacatggacacagagagaggaacatcacacactggggcctgtcagggatgggggggggtacaagagggatagcatttggagaaatacctaatgtagatgatgggttgatgggtgcagcaaaccaccatggcacgtgtatacctatgtaacaaatctgcacattctgcacatgtatcccagaacttacaagtataataataataaaacacaggaagatgtttatcacagctatttaaaaaggaaaagccaatcattttagacaaaataatgaaagaacacctttctattctcatatgacaagatactcatatgacatatgagtatatatggggaaagggagaggtgtagtagacatagaagcagatatataaagtagatatatccagatattcaccatgattattactggattataaaattaatgcatatttttcttttattcttggtgccttttatatttttatattttacaaattataataaatgatgactactttattttaaaatgctgtattttaccataaaatactacccaatgacttctgcaaagttcttctgtttgtaaacaactaaacagcaaatgcttccaagaccattaggaacatacctgtagttgtgctagtcaacgtatcactcaatgcagcagggataatgcacactgtggggaactgggggatctcagaaagaggagattgcaaagaacttttataggatttgtgcatgtgttgggtaattttatgtgatttgggggagggttcaaagtagtagggctttgttctagactagatgctgttaagacatggaggtaattccatgattgtgtttcctaataaatcttacctagcatgcagaaagaaggaagcaatgctacaactctaatatttaaagaagcagcagtcactcataccagccagaatgggaggatgtgtggtcttttttgtggtttggacaattttcatgttttgtctgtgttaaggcatgattaccaggggtctcgtttttgttctgatccatcaccaagccacgagcaaccccaatgcctaactgatagcaccgggccagttcccgaatagcaaagaatatataagctgtcagaaatattcagaggcaggtagtatgattagggttatttctgaaaacaaacataatgcaaacctgatggggttattttgtagattaagtaatacatgtgagtgtgatttataaatataaacagccacatgcatgttaccatttgctaatatcttcaccatcactgtcatttatatcaatctcatctagtgcaggaggatctatatctttggaaaggggcgggctgcaacggaaacttgtacattagtttcagtttaccaaaatggttagagatgacggaaattaagacctaaatcttagaaatggacacatatgaaaacttcagacacaactcttaaaatacgcatcccctcataatgcgtcacttctgacaaacccatgagaaagcaaaaaatttaacacctatcccaaaatagagtaacttaaaagaaacttgagaaatggaaaatgggggcaaaggtgaagtggcataatgtcagccacttacttttgatggttcagccaaagagagagagagagagatggcataccagtaacatgtggtgtatatatgatattaaaaaggtaacattttaaaaatgtatatacatggaactcctgaggacttcttcctgtattctcatgggtcatttctcactttggagactacttccttaaaagacctaattacaagaggtcagaatagtggaattgtacataagatgtgtgtcaaaggccaggaagtacccatagtgaagtaaaacttccttactttcagacaggcctttattgtgatgaaattataaattcttagatgactcatattctagccatctattcattcttaagcatctacagagttcctaagaaggaccaagcttgatctaaggtgtcagaggtccatgaagacttctcgagaggcctccctcatgagcaatctctacaggcaggatgatgcaccatttattttataggaattccatctagtagacacccttcccctcaaaaaaatgtgatgatcccatcaaaagcttgcaggcacttagccatggcgagaaaattaaacagcctgtatgtagtaaacgggtcacagaaagggtaggttatgcagaataaaaaataagaccaaactcaggggaaccaggtcctctgaacttttatttttaattagtacatgggcataatggggtatgatctcacacacacacacacacacgcacacacacacacacacacactctcaaactacaaaaataaatctccctctgtcccaaccctagccttccagtccctccccagaaacaaccaatgttttctatgcacacgcacaattgcatataaacatacatttaaaatcataaatggccactaactatagaccctgttaaatactttgctttgtctcgttgaacaatattcactccttcatttacttgtcattcagcaattattctaggaaccactaaaaaagcagtcaaaacagacaaaactcttgcccccatggaggtggtatctcagtgggccattccatacagcatataaacaatacgtcattatttcgataactgtattttcactctattgtaagtacatgctacaatgtacagtcctttatggatcaacattcagtttgctttctactttgcacattcttttttataaatattgggcttgcagcaccctcttcttttataagcaaatattttggccaaaccctgaacaattgtttaaaacacgttcatctatgtcaaggttgtattttgaaaatgcctcattcaatgacttagttttcacttatcaacatctataaaaccacatcagagaagatattcattctagaattgtttaactaagttaagattccagttgattatttgcaacagtttagcaaattaccttacagtttttaacagcctatgaagaaagtaaatgtcatagtcaatccattttttttccttgcaactgttaggtgtggtgttaattctcccagctggttttcagacagctttaaaattaactttgaagtttctctaacccttaaaaaaaagtcaatgattgctttgccaagaaaaacagagcccttactgaacaagtcagaattcactaaggtcttctaatttcaaatgtagaccttctgggcactgtgtatgtgtatagacgtgtatatatgtatgcatttgtgtctatgcatacatgtgaggatgcatgtacatgtatgtaagctaacattcatagaaggtctatgatgcactgcagctgaaggagtaatgctgaaccactgttacatcaatccatcttacaaaataaatacataaccaatacaagagtccatgctgacttataaaacaataaccccaagatttcttgagcacctaaaatgtgtgccaggctctgtgctgttttaagcgcatctcttatgcaaaataactcaatgtaaggataggaaagctgactcttacagtggcttagatactttgccacgttaattcaacccctaagcgatagagctgaatgtcagcgtagacagcctctgctttaaaatctctataaagggtatgacactattgttaacttctaaatacatctgataatatctgcttataaattatgagatggcattttatatctattaccagagtataacatatcacgtaggatttatacaggttaccttatgatttttataaatgtgggatccattattcaacccacatctacctactccacatctgggtattcttttttgtcacctcaaggtaccccagaatgaaaccatggagaagttgtactgcccactttctgcaaagaagcagggttaaaagcaggagctctggagggctactgcctagattcaaatccgagcacagtcacatggtagctgtgtgcactggacaaatcccacttctgtttatctgtttagtgggaatgatattcttggtggctgagtgtattgaagaggaatatatatatgaagagctgatagcagtgtttgccctatgtttaggtactccatacagcttgcaactatggttatttgcccatattcactccataacagaattacaatcaggtatgttctatcccagactcagggcagagcctggagttcaaacataccacatgttgagaaaaaaggtcaactatgaagttcattgggagcttagaacaatgaagaaaagttaagaacaatgttcaaatgaggagtaaatgaagtaattgaggaactccaaaactaccatcccagagctcctcaagcaaaggtctccaataacctcctgcaaccctgcggcaataaccagcaataaccagctctgcagactggaacccattcagtctgatgtgaatacgctttgctctggaggaagaagctctgctcatggcagacaggcctgattgccagaagttacatttcctgtgagtgagcagggaagccacagaaactagagccatggggtattgggggcatcccaggtgaaatgaggctctcaccacctcagaggagccttccgcccacagatgaagcatcccaatgagggacaagaggggcagttggcacacagctcgcaagaaggcctaggcaccctaccatcccctctccctgcactggggaccaccagaggctcagggccaggggagaaaagtggctctacaataaggctctgcacaaaagggcctcccttttcaactcctctccatttgctccagctgagcccagctttatgcaaacaacactctttttttttttttttttttttttttttttgagacggagtctctccctctcgcccaggctggagtgcagtggcgcgatctcagctcactgcaacctctgcctcccaggttcaagctattctcctgcctcagcctccctagcagctgggacggcaggcatgcgccaccacgccgggctaattttcgtattttgaatagagagggggtttcatcatgttggccaggctagtctcgaactcatgacctcaagtaatccacccaactcggtctcccaaagtactgggattacaggtgtaagccaccgctcccggctgcaaacaacactcttaagctcaaaatgcaggctactggaggggtggggtgagccaacagttcattaagtggcagcaggccagggaagcggggtcggcgggaacgggaggcagcaagggggaagggaacctggctctcaacccactggagccaaagtaaactgtacttcaagggaccctggccctaggcggaacgagcctgcggctgatgggccgcccgcgtctccttgcacctgccctggcgccgcagccaaggcggcccctgctcgggccctgcgctccggggcgcgggccgagatgctcgcccaagaaacatggctggctggagcctccgggcgcgggagggacgcgaccgccagcctggggaggcgggaagggggaacttgaacgcccgggcgggcggcaagtgcagcgcgttccagccgctccccggcgcggccacttcctcgccttctccttccttccctttcctccctctttccgtcttccctcttcctcattcccgcccagtctccttcctcccttcctaaccccctcccctcccctcttcctgctgtcacttccaaacccaaggacaaaaccgttacctgcgggccccggagcggccccggagttcgcctcggtcactgccggagcccaggcgcgcgctcggtggccgcccgcctcatccccgcgcgtctgagcggcccggcggcagctgctccttttatggggctcgcaggcagtaggctcggccagggtgtccccagcccgctcgggcggcagcggcgtcaatgcgcgctattcacactccgggctgcggctggtacccctctacacgccccccgggagtgcgcgactgcctgcccgcccccatcctcagggccttggacgggggtaggggtgggagacaaatatggctttcagggcacccactaggggaagggagtcacatggttctggccctgggtagccagggtaagaggggcccaccaagagctgctagcaccttgaaatgaatagggaggtgccggtcaaacacgggagtgtggggttgacttcgaaatacagcaggaagagagctgaacctttcattatcatcatcaccactattttacttatgattatcattaaatagcatctgccattttattaagtgattactatgagccaaaaaattctcttctggtacagaacattttaaaagcctgtgtgttctgggtccaccacctggcactttggttaatacagacagaatcacatcttccctcttctcagtggaaacctctgctggccccattccatagaagaaaagctacccacattagctctgcattcaagggcccttaagtttctatcctggtcctactctttagcctcaaatctgatgcatctcaccctcaagagaccccaggagggggttaagtatttgtctttttattaaagatcagaaagacaaagctcggagaggttaagtaattgccaaaggtcactcagctaagaaatgctggagcaatgccccaggtcagtccaagttcaaagtcctggatcttggtctctccatgctactgtttttagtaaacttctaaggccaagagggcatcacacccttttgagttctggatgatatctcacctcttcactggcaagaataaaacttgaaagaaattggactctctaggccaagaagaaaatcccagagagccctgtttgaacctgtcacctccgggcagctcttccttttattcatatacaactttagttttagtttcaggtggaccacagcaatagtgatgggaaacaatcaatttgactaaactgggattggcccccagcatgctcacatcactgcctggaatggcaagaagaactggaattcccaaggctaagcaccatagctcatgcttacaatcccagcaatttgggaggccaagacaggaggatcacttgagccccgaagtttgtgaccagctttgacaacagagggagaccccatgtccacaaaaaaaaaaaatacaaaaattatctgggtgtgggggcatgcacctgtagtcccagctacttgggaggctgaggtgagaggattgcatgggcctaggagtctgaggctgcatgagctgtgactgtgccactacactccagcctgggcaacagagaccctgtcttaaaaagaaacggaattcccagtgataggtttggttctgtgtccccacccaaatctcatctggaattgtaatccccatgtgtccagggagagacctgtaatccccatgtgtggagggagacaggtaactggatcatgggggcgatttctgccatgctgttctcatgatggtgagttctcaggagatctaagagttttataaggggctcttctcccttcgcttgcttctctttcctgctgacttgttaaggtgcctgcttccccttctgccgtgattctaagtttcctgaggactccccagccatgaggaactgtgagtcaattaaaccactttccttttttatttttattttttgagacggagtctcacacggtcacccaggctggagtgcagtcgcatgatcttggctcactgtagcctctgcctccttggttcaagcgattctcacgcctcagctccccgagtggctgggattacaggcacgcaccaccgcgcgcggctaattttctgtgtttttagtagagacagggtttcactgtgttagccaggatggtctcgatttcctgacctcgtgatccgcccgcctcggcctcccaaagtgctgggattacaggcgtgagccaccacgcccggcccactttcctttataaattacccagtctcagggaagtttatagcagtgtgaaaatggactaacacacccaagaagaaagccaaaagcaattatttgttacacttcacataatactagaatgatttttccatgtgacttacagaagcagaagactatacaatccacactaagcatctgaaacagaccttccttcacaagtgtggaaatgcataaatgcattagctaagagagtaacatcacatttactcctgtctctttttaaagcagacaaagaggagcaatttgacatgagaggttcaccaaagcaaagctggtacaatttccctgtgtggggctcatcagaggactagataagcctgatgctgataagaggcagaaaaggaatgtgtaagttgctaactccaaagtgggggaggcagtgagatattcctgtcagagtgaaagtgattttcaatttcaaataattatattaggtcattcattgtttggaatggagtgtctgtagtacacggcattcctgctgagagggttctcaaaggctgagggttaggaggcagaaagcctgtaattagaagccctgaagcacccaccctctctgatgaagaggattggagtacagcctgtccaggtaatagggctcagctcaggagtgtgtataggggtgtgtgtgtgtgtgtgtgtgtgtgtgtgtccccattccaatttcccaacatgaacatctaattatgccaaatcttataagcttcaggggagtgggaaaatgagaattaaaagcaaacagtgatttagagaaaaaaggtatttgaacccatttccaaaagaagcttccgtttaatacaggggtaaaagagtggcttatcctttgaagcagccagcaaaattcctaaccactcttggattctgagctacacaacttgctagtttcatttgcactcatgatagattttcttagaagccctctcaagactatgggtaaatgcaactggggacaagaaaatgagggcttggtggtgatgtcaccattcttttgtctgtctccactcatatagatgaaaatgggcctcctttgagcaaatctagcttttcttggggccctgatcctatgaattacttacttcgggaagggcctgtgaaaactgaaatttgcatctgcctacagagggaagtttaggaaatctaacttaattcattccacagccactcttgacatgacatatgaaccttcaaccagatgcatgtgttatgccttggtttaattatgagatgaattaataggttttgtgtaatatcctgattaacttatgtctcctgttcacagatggtaaacgtaaaatttctccaggagagggaattatatcctcctgcaacttgaggtttttgctgatctgttcagcgtggtaatacatctaagggatgtttagtccccacttcaaacataaatagctattcctgatactcagatgaaaaagaaaaaaagatgccttaattataacttcactcaactgcattaataccattctatttaaaataacaatactgagttgttggtttttttttttgagcccctgaagatggatggaaaaattaagtctgatttaatctatcagctatgcacggtataacaatattaagtcatacatttggagtgtaagtagctagaggtagtttctacatcaaactcacttggccacccagaacttatattctctgtggtaggtatgagccttgtcctacattttggtcatgttcatttattttttaagtgtaaacagtattgccctaacattaaacagaatgaattcagtttggctttgaaaaaaaaatttttttaatataacatcccgtctcctttattcagtcaacacattttttaaagcacttcatatgtgctgcattgttctagacaatggagatgtaacagtgaacagacacggtgatgagatacctgtgcctgaccagaatcctgacatcaatgtcgcaagtgtatatagagtgcactataattatcagccctaataacagcggtgcaaggggacatattaagacaaatgaataaataagagtccaaaagtttttccctggttttaggatatgctatatattttttccatggactttctatttgttttttaatgtgagtaaggttacaaatggacagcaatgaactatgtttagaccttggactctgcagtctgtctgtcctgagtgggtatccccatgatccatactcacttgggctaattctcagtttcgctaattctcattatctctattacaaaatacaaatgaagaaactgagaatactttcctcgaggtaatgttataaaattaaatgagacaatataggcaaatcatttggactacagtagtgttgctcacccttttcttcgttattgctctaagcaatgagcttttttagatttttttctcctaatcaacccctgctttccagtgaaattgtaataccacagatatactgtatatctgtttaggtattgtaggtagatctgtactttctacataaaaagggtaagttttgtttcactccccaagaaccagtattcacctcccttaggagagacatcacttccctttgagaaggcatggtcaagagtcactttggcactatgtgatatagagtcatgcagtgcttgctaaatattagcaaatataacagtaataatcatcaaaataaacatatgattctatatccctagactagagaagatttgagtaaagtctgacaaaagatgacaagaggcacatcagctctgacacccaggaaaccaaagcctgaatccaacaataaaaagtctgttggaggctggggttgagcataaaccaagaagaccttcttactttcttaccgatgggaaaaagagagacgcaaagcatcagggcagctggacaagggtgatcacctctcttaatgagtcagctaagattacccatcatttacacatgcaaagaagaagcaacacaacaccaaagtgctccagaatagatacttttaggcacagttcattttgcctgaaaaatcctctttctacccttctgtccatccaagtctcatacctacatcaaacccaccaaaggtcccacttccttcatgaaatctttctagcacaaagaaccctcagtcatcagacaaccctgatttaaactgaagggcattctatggaataactaaccagaacatttcttcaaaagtgtcaacatcatgaaagaaaaggcaagactaaggaactgtctccattggagacatgacaaagatatgcaatgtgagacactggtttggatcctgcaacacaaaaaggacattagtggaggggaaaatggtgaactccaaatagtcatggtttaggtaatagtactgtacatgttaatagtacatggattagttaatagccaatgttaatttcctgattttgatcatgataccatggttatgtaagatgtcaacattagggaaagctgagaggagaataaatgggaacacgccatacaatttttgtaacttttctctaagtctaaattatttcgaaattaaaaggtttttttaaatggtgatttactcattcaattttttcaacaaaagtattttaaaggcccacccatgctaggcccttccagaggctggggaatcagctatgaacaaaacaagacaataatccctaatatcatggttaacatagtattttccggattcctttctgcctcagaatagctatgaggccatgctttataagtcttatcctgtccactactgccatgtcaaattcatctgctcttgtcatatctcctcacattagggacaggatatggctcctgttctctgccttttgctcatgggagtggatggggaggtgagctcctatgtccaatgcctggtacgtagcacatgcctagaacactgcttgaacacagtagatctttgataggtgagaggtggtgccatttaaaaaaatatgaacacccagcctggtatggtggctcatgcctgtaatctcagcaatttgcaaggccaaggctggaggaacacttgagccaaggtcaagaccaggctgggcaacaaggtgagaccccgtctctacaaaaaaataaaagaaaattgccaggcatagtgatgcgtgcctgtggtcccagctacttgtgaggctgaggcaggagaatcgcttgagcccagaggttgaggctacagtgagccatgttcatgccactgcacaccagcctgagagagcaagaccctgtctcaaaacaaaacaaacaaacaaaaaaccaaacacgcttgatacagagcctgatggaaactaggcattcacttaacatgtttcttgcctagaatgtaagaatgatcagctgttggtctctgcggactctcaaatgttataattttatgacacgttatgcttgattctttgacaaataagaatgtatgtgtgtttctgtgatagggagagattgtatgagagagagttagtgaattagtgtggaagtagcggaacagagaaatagagacctgaactagtacatcccaatggaccttaacacttcaaaacataagctggtacttaaaagattgcatcttctcactttgaaagacaagaatgatcatcaaaaaagaaacaccaagaaatctctgatgtacttttccagacattagctacttacacaaattaaaattaaaaaccaaatttgtcatatggctttaaaaatgcaacatgcttttgtcgcttagactagaattacatttttcttggaaacacctccctgctggtccccatgccctgaaccacctgagacatttactcactacatatagtgatgtctctaatttcaagatcagttctgtaatgtatttcataagcctggtccgctttcagagttctcattatcagtgaatgtcatttgcatccatctcattataaaagctaaagcctgagaattcatcctggacaaccctcttcactttgtctttaaattctgacaattttcctcctaaatatatttcatgcattcactacaatttctcctgccaatattctcatccaccatgatcttttgcctagactactataatagctttcaagctggctttcctacctataatccacgctgttacagaaggcagagagatctttttaaaaagtaaaaaccaacacaaagtaaatctgactatgtcattccaacagcttgagtctccaaagaacaagatccttaatatgacctaaaaggacatgtctttttatggtctggtgtcttgccaactgctgcagcatcatctctcagtatatgattccagacttgttctgctcaatccgtactggccttcgttcactgtttcagaacattccatgctctgaccacctgggaaaggctctctaccaaagtacccttccttccacctatttattctttgtgtgtcaacttgaacagcaacttatcagaagaactttccaacaaatccccagactcggtatgttgttgacctccaagatggccattaatgagccccatttcctggtattcagactcttgtgtattgtcttcccacagcgcacaaaactggtctggatgactaatagaatataggagaagtgacagtatgccacccctaagattaggttataagacactgtcccttccaccttggttctgtgcattctctctgtcttcctcttggagtattcactttaggcgaagcctgctaccacgtggtaagagccacacatagtgaggaactaaagcctcctgtcaacagccatgtaagtgataatcaaagtccatccttcagccccagccatgctttcagatgactgtatccctgcctgacagccagctgtatcctcatgagagttcttgagccaagaccacccagctataccacccctggattcctgaccctcagaaactgtgtgagatcattaaatatatcgttttagctttctcagtaagcaattaccttaaaacttagcaatagataatgaatatgcttggttagatgcctctgtcatatcctcttgtggaatcttgctccttttgcatatctcacttggtaattacgtatttgtttaacgaaatcgatcagtgccagtctcctcatcagttttgtctcctaatcttaccacagtatttccagaactctgtgacaggcctcaaaaacattaggtgggtgaattaattgtcctagcaatacaactggaagacttcccttcaatcactgaattgctctgataaatttgcttttggtagggagttaacatgtaacgtgagccctaaaatcaatcagtaattaatagaagataaccatgtagagaggtcccccaaccatggcctcatccaccatcagtttcaatctgcagtatgccttcaatagggagataaactgccttctacccacgagtcaattaataacaataaaataggatctgatccaggtctgtccggactgcagtctctctactgtcactgtcttacagatctatgagtccagggcaccaataggctttctcacccttgaaggataattatcatcattctcatgttaagtacaatgtcctgcttattaatagacgtagaggctatcaatacccaatcaggagtccaagtgcccccatctgtttctaaacgtttccatttttaattggttgatttttatttttcatggatgacagacactttattggcctcctctctggaatactatgactattggttgcaagtggaaagaattactaagcaaaatacagccagtagtatcacgaagagagcagacaggccatcagcacacaatgtttaatcaaagctgatgatagctgaggcaagaggatcacttgagactatgaacttgagaccagcctgggcaacatagcatgaccctgtctctttattagaaaaaaacaaaaacaaaaaaacagctgacattagatcctgttatcttcttacatcattctctctcattcgtttcctcaaattcagttattatggtacagaaaagctaagtttcacttccacgaaacccatgagttttagccaacacttccaatgggttggctgattttcaaatggggtgcatgctaaaaacaaacaaacacacaaaaaaaaccctgcagatttgggaccccatcctgatctaccgaatcagaatttccagaggacgagcctggcaatctacaattttaaccaccaactcagaaaatagattatattaccagacataaaagctcatatgtcacctaaaaccccttccattataataagctacaaatccaaatatttgttctaagtcatatgacagaaaactgaggaaaacaatgaatcttctaaagcaaaaaacttaagtaacttcattctcaagtactactcctctgctagattaggcttctcacaaaggaactaaagggccaaattatacatagtgcacacgtcacagctcaagtccttttcacaataggtgaagtttaaaaaaaagtcttacaacaacaaagaagacaaaagaattcttcttggagtccattttcctcagtgaactcacaaataaaaaactgactttagtatctctttaagaatatccctttcagaagctgagcatctaaggaaaattagcagaaatgttattttctcatgtcagttattcattacattaaataacattatgttccaaattagaggattaaataatcctaacagttttcttagccagtctttctcatccttcatgggtcatgaagaagaaggaggttttgaccacaactctcaagctacttttaaatcaatctatctgaaaatttcagggatacttccacctgattgaatgagtccataatattttcagtttccaaaatactaatcataacttgaaaatatttatctacatattactttaaattttttaatttaattctacttgtttttctttgccctctgttgaaatagatttctctctaatattctaacattcatacagtgcttactgtgtgccaggggctacactatgtgatttcatccactacttcttttaatcagtccacactcctacaaggtagggatcgttattccctttttatagatcagaaagtggaagcccagaaaggctacaaaacttgtctaacttctcttggctcatgggtgacaaaccaggatttaaaacacatcttggcctggcatggtggctcacgcctgtaataccagcactacgggaggccagcaggaggatcccttgagctgaagacttcgacaccagcctgggcaacatagtaagaccctatgtgtataaaatatacaaaaagctagccgggtatggtggcatgcaactgtagtcccagctactcgagaggctgaggtgggaggatcatctgagcccggcaagtcgtggctacaatgagccaagattgcaccactacactccagcctgggcgagagagtgagaccctgtctcgaaaaacaaacaaatgaaaacacacatctgacttcaaagcttgtctgtttagcaaaatacaaaactccatatatataggataaaatatttaatatcttcccactgtgaaattaataatactattttaagagaaatatataggggattccctggtacatatcagtgttgattttctatcactttagtgaaagtatcacattactgccgctaaatcagcctgttttgaattaaaagcgtccattatgatggtgcactgaaaaatgtacgcctcttaactggattgtttgtaatacaaaggataaacgcttgaggggatggatactgattttccatgatgtgattatgatgcattgcatttctgtgtaccccataaatacatatacctactatggacccacgaaaatttaaaataaaatttttagggaattttttaaatgtactcatcatcttttctatcctttaataaggagaaactataactgctagaacaaattctaaagatagttctagattctaaaggagccggtcatctgcaattaatttaatgaaactggaggaaatgtaaactgtttcctgctactcccactcctctccccctccagataggaaaagagggacataggaaagaaacagctctgcaaaggacaaagaaaagccaccaagtgaaacccatctggtacaaagtcacaatgatgaggcaggccaatgtgggtgggttttctactatggtgcccactaaaaacaacaaaagacatgtggcaaaatctccaaacactagggaagtctgggaggaagactgctcagtgattagtccagatgggaactactacattcgctaatatgagcatcagagaaagtgattcataaatttttgcatcagcacaaacgaagcccactttttaaaaatggttacgccagtagatctttccttcagtaattcttagggatacaaaactatcagtatggcagatatacagggaataaataaaaacaagctgtccaaggcacttagacagcgttagacctggtactttccctgtttctctaatggactctgtacctgaggtttttgtcaagactttgtacctccaggtagaaaaagcttttatagatcttcaaacactgctaggaaaacttggaaatgtgacagctatcttctttttctatcaataaatcttccctatttggcagagctatgagttattcatagcagaaagctcattttattaaagtattttgagagcttttgtttcccccgtattgttgtattttctccctcacccttaacaacaggacacccaatctatggctggggcaaatggtactaagaactctaacaggactaaggaggggattatttgcaaaggcttgagccttaaggaacgaaacccaccactcagaaaaatctaaacacaagaagcaaaattcaaggaggtgcttaacttgaactcaaaggatcctgaagtgttcaggaacaagcttagggggtctatgaacaccctgaaaatacaagagacatgagacagattaagtatgaagttctggtttcttctagaaaagactcagaatcttgagatgcacaagctgaaaaggagttttagaaataatttacatcaactctcgttttatacatgacaaaactaagacatacagatgtgatatttaccaccttcactgaaagaaaatcaaatgagtttctcacttcttaaatcaagccattgcttttaaaactttattagcaagtggagacagagtcagtcaaactacagctgggcagaaatacgcaactcaactctaacaaaccagtgattcacattaatttaatatacagtaacccccccaatacagtttcacttcctgtggtttcagatactctcgttcaaccacagtttgacaataggtgcttatggtacaataagatatttttcaagagagaccatattcactacatgtatttattcacaataaattttattacagtatatcattataattgttctattttattaatagttgttagtctcttactgtccctaatttataaatttaacataggtatgtatgcatgtcacaggtatgtatgtatgtataggaataaacagagtatatatagggttatgtactatctgcagtttcaggcttccactgggagtcctggaatgtacccctgttgataagaaggggactactgtattttctaaaaaacaaaaccataaaacttaccacgttttatcaaatctgaggcaacaattatagcttatgaagcaacaaggcagaagaaatactgccaattaagttacagaatgccactcattgtagaatgcattttgaattctgaaatattaaaatgtagaacactatgcatcttagaattgataaatatagtattgtaaaaaagtaatgacttataggactcttggcttgttttgttatgctttgttctttgttgtgttttttgtttttgttttttagagacaagctctatctctgtttcccaggctatagtacagtggcaagatcatagctcactgcagccttgaacttttcggctaaagcaatcctcccatctcagccttctggggaggtgggattacaagtgcaagccaatttgccaaactgatttatgactcttgaaagaacacaatatggtaaacttccttttgtaataattaacaggtaagaaagaacttgtgggacatctcataaattaaaagcccttgttccaacacaaaaatgagaccagtaaacgatgagttaattcttgcacaaagcaagaaatcatataaaattattcatatgtatttaaagcattttattttaacacacacagtgttcattcttgcatccatcttttaaagtagattaactttttttgaacctaggttccctgtttgggatctgtagtatctttcatgatataaaccatacttataattcagtgtctatgatttctaatttgggcttatttgaaacacagtgataatgtaaacacacttgcaaaccaatttgagtgctttagattttttatgacttccctttatattttacagtctttacgtacacctaatttaacacaatttttaagcaagagaactttattaagttgtcctaatggattccaataaattttcagggaaatatcagctttccctccccacttacatttcattggtttatataatatttaattaaattatattgttagagtaacaatgatataagcaagtttgaaaacaaacaacagactattggacagcttgcaactcacagtgggaacatcagtatgcaactgaacaccagctttcaaggtgacactcaatgattcttgcccccaggtgttcaagctccagtgtagttagtctccctcccacatgaagagagctggcctgatgttgcagaaatgatggaatgtgattcctgaagtgaggtcataaaagacattaaaacttccaacttgctctgtctttggtcttttgttctagggatgctgcctgccatgccatgagatccctcaaacaaccctagggagaagtccacatagcttcctgccaaaacccagtgtgaactgacctgacatgtgagtgagacaccttgagagtggaccaaacagtcaaatcagaccaacctggatttgaacccagacttagccacttagtagcagagtaaccctgggtaaggttactctgctctctaagattcaatgttctcttcagtaaaattggttgatgatggtgctgattcattaggtagttactaggagttgttacaaattcaagacaaatattgctggcaattgatagttactgactgcttacttgtatgagaccagtatgccaagcctttatattcatattcattattatcatggttacaagccttcacagtccttctcatttactgaagtagataatggtgcctggcacatgggaaatacttaataaatgtggcttccagcaatggcacatgtaatgacatttaggctttcatgcaactggaaactgggctcctagggaacaagatgcatatctccagaggctgaaagggccatcggagctcctgcatttacgctttcccattgtttcactcttctcaaagccgtcctcctgactaggtcaggaaaaaccaactggaacggagtgcagggctggcaaatgacctcatgaagcctggaccagctcccctgccttagacaaggctacgaaaatggataacaaatcttctaagaaaaaaaaaaaggcagaacaaatctattttcaagattctttccttccttttacaattacaatgtgctgcatgaatgtcctgattttaataattccactgccatcttctgcccctgtttttggccttcttccatatctaattctgatttttcttgtttgctgaatagatctagccaaggcaaagagacaatgagatggcataagaatgaatgagattttaaaaagagatggcttataaataactcccagcagaaatcttgaaataactatggacaaagaattgtcatccaatttacaatagtaacaacatgaagaccaaaaataaataaataaataagtaaaaatagtaggccatgcagtggctagtcctgaatcccctgggaaattaaacatagacacagcctcgtctcatgttcaatagcaacggaaagatttatttgtgtgcattccgatgtcctaacagtactctaacctgcagctagggtctttagcagagggattagttgtcaaaagtgctcttaaatgatatcacaatttttttctcatcattaaatgcctgtgtgagaataagtttactggccccatactgccaaccagctcatcaatggcagaaacacaatatgcttccaaagcctgtagaccaagtgaggtgacaacttagagatgagccagtgggggctccatctcctgaatactcttacccagaggacctaaaaacaatcgaccttcagtcaaggccagctgaactgctgagatactgtgacgattatttcattctttccaaacctagataacacgaataggctccaaaacaagcctgcaagcacatcagcatacacacgggtgcacacacatatatacgggcacaaacaattcattaaaggtgaaacacatctctagtgacagctgagcaagagaaaaaaggtgcatgatttaagacatctttttccattcccttttcttcagtatctgatgctgtagcttatgtcaggtgcaggctaactccaatagaaaataattatttttatcaatagtctatcatattccttaatgttaatccacaatatatagccaaacctagtatgtcaatactaattagaaatacataggaccattcatggccagaaaatatttcaagacagtagtagttaagaaaatcaaaagcaaaacaaaaaacaaaactcagtggtcatttgtgttcacggttgttaaagtcagtgttttgagtgacttcacttctcagatcctcaacttctccagtatgacagtgtggctcagtttggacaacactactctcattaagaaacattgcttatggtcgggcacggtgactcatgactgtaatcccagcactttgggaggctgaggcaggcagatcacttgaggttaggagttcaagaccagcctggtcaacatggtgaaaccctgtctctactaaaaatacaaaaattagccgggtgtggtggtgcacacctataatcccagctactctggaggctgaggcaggagaattgcttgaacccaggaggcagaggctgcagtgagccacgatcgcatcactgcactccagactgggcgacagggcgagactccgtgtcaaaaaaaaaaaaaaaaaagaaacattgctatcacacaacggacagtggatttggaggaagtccttaccacatgatgcaacagtaatatttacaggcagagaaaaacgtcataatattttaagtttgtggtggctcacgcctataatcccagcactttgggaggctgaggcgggcggatcacaaggtcaggagttcgagaccagcctggccaatatggtgaaaccccatctctactaaaaatatgaaaattagctgggcatggtggcaggcacctgtagtcccagctactcgggaggctgaggcagaagaatcgcttgaacccaggaggtggaggctgcagtgagctgagactgcaccactgcactccagcctgggcaacagagcaagactctgtctcaaaaaaaaataaaaaataaaaataaggacataaagcaagtttggttaatataggcacatgtcacttatctacatatattatctatgtactcagaaaggcatgaaggctgttaacatcagaacattaacagggactgagtagtaagattcagggtgatttttatgtctgctgttttgctcaccttttttttttttccatagttaacacaaatgatctctgtgatagttacatgtaaatggcagcaaaagcaaaaagcatatacctcccactaataacccagggaaatctggttccaaagttaaggctttgtctaaggtggcatacatactcagaagtcagttttcccaagtccgtgttactgggtttttgtttgtttgtttgtttgtttgttttggaatgtggatcatataattgtgtccaagagtttagtcattcagcaataaataacccaaaagacaatatatttttaaatgtatttttaaatggcattgcttctgaaagcagacaaaactggcaggacctctgagatgtcagaagaggcccaggacactcataatttttgagacctctcctgacccggtgatccacccgcctgggcctcccaaagtgctgggattataggcatgagccacagcatccggccgtctttagatatattaattaaaatcttgtgaatgcatctacatggctgtacatcgacattgtttggagatcatgataaaagtctacatttgaggccattcctgctccctgctccctccacagggagggagctgacttgtaaaaagtatgaaaaggaatgacatacagacacttttaagtggcattgcttctgaaagcagacaaaactggcaggacctctgagatgtcagaagaggcccaggacactcataatgttaagacctctagtatgagatagctaaatgtggttttaaaagatgagctttttttagatatattaattaaaatcttgtgaatgtatccacatggctgtacatcaacttttgtttggagataatgacaaaagtctacatttgaggccattcctgcttcctgctccctccacactcacgctgactgtgtaaaaagtatgaaaaggaatgacccccactgaccatgaaaaaaaaaattacacaggcaaggctgatggataaagaccagaaaatagctctaacagaaggacaactactaaaatttaaaaataaaaaaagtcctactacggaaagcattgatggaaagccctgtaattgtatcccaaatcatttcatcacatctaaccaaagaagaaagaggaaaaggatggctgggcacagtggctcacaccagtaatctcagcattttgggaagctgaggctggtggatcacttgaggtcaggagttcaagaccagcctggccaacatgcgaaaccccacctctactaaaaatacaaaaattagctgggcgtggcagcacacacttgtaatcctagctacttgggaggctgaggaaggtgaatcacttgaacctgggaggtagaggttgcagtgagccatgatcatgccactgcactccagcctgggtgacacatggagactctttctccaaaaacaaaaacaacaaaaaaaagggaagctcatgcaatcttcatacgttgctgtaacgtatcccactggcatgttatgtgatatttatatttaatttaggctgaacatgactctagcaaatctctttggtagttaaatgtttccttcaaagggatatcaggatataaatcctgaggtcagaatccatgtcaattccaacacagaaacctttcaaagcacagtcctaagggaatctatttaccgggtaaaggacacaaccagaggcacttaacgtggaagactggtgaagggccaaactcccacccaaagaccaactcatcattcattcttcacacatctgggtaaggagcaggcaaggcacttgttgatagtgaagcaggaattgtttccccatatcatttccctctcgtttccccagttcatatcccaagcttcatggcaataaaaataaaatattttttgactggacacttttttttttctttttggttgtgcacaggagctagaaagcccttgttatatccatgcaggcaatataggtgattccttgttatggttgatcaggtaaaaccttaaccatcatcaaatcagggcacataatagtgtcaacttggtgaaacagtgagtcggggagtcactgcgtatgagcaaggagctctcacttgattatactcatgctctgctcaggttggctgatttgccaatagatttcatttctatagcagtgtactggataatagggactgcacactcaagtctaaaatgtattcattcgttctacacctgtttagcgcctgctctgggcaaaaccttgtgcagggtgctgtatgttggctcccaaaggagaaggattgctgccaagtttgctctagggcttgagccatgttgactattaaataccagttcagggtgttcagtaaagtctctgataatgctccataactttctaattagtcaagcctttaaatagaaagaggtctgtcattttattgtgatttccagggttactttatcctccgcatttccaaagtttctatgacctatagcaatgagttcataataatatccacgtataattttattttccatatagagcagttgacatcaaatagcagcccatgtgctaaatccagccagctgataaatgttttgtttggctcacacagtactttaaattctttttaaaaataacttgccaagcaacccaagtgcctatagatagatgaatagataaacaaaatgtggtacatacaattcagccttaaataagaatgaagttgtgacacatgctacaacctggatgaactctgaagacattatgctaaatgaaataatccagacacaaaaggaaaaatattgcatgattcctcttataagaagtacctagaatagtcaaattcatggagacagaaaggagaattgtggttaccaggggcgagagggaggagaatggagaactgtcatttaatgagtacatagtttcagtgtaggatgatgaaaaagttcttgagttggatgttgatgatggttgcacaatagcataatgtatttaatgtgactgaaatatgcacttaaaatggttaaaatggtaaatttttgttatgtatattttaccactataaaaaagattgaaaaaaccttctccacttatacaaatgaatatgtgtgcactgtggaaatcaaaactgtaggtaagtttaaagtatataaatccttccacaattttaaaggatcctttaagatttaaatgtttaagacggcaggcacggtggcttgtgcatgtaatcccagcactttgagaggccaaggtgggaggactgcttgagcccagaagttggagaccagcctgggaaacataatgagaccctgtctctaaaaacaaaaaataaattagccatgcatgatggcatgcgcctgtagtcccttctacttggggggctgatgggaagatctcttgagcctgggacatcaaggctgcagtgagccatgattgtaccactgcgttccagtctgggcaatacagcgagaccctgtctcagaaaaaaaaaaaagtttcaagaatatttatctggtgaattatttttactgaaatacttgaattatttttactgaaatacttagatgggacaaggcaaggaggactttgcaacattagaaagatgagaggtagtatactctctcaaccactaggtgagctctttccattcctacagtgcttctttctttctttattatcattattattattattattattattattattattattattattattctgagacacagtctcactcggttgccaaggctgaagtacagtggtgcgatcttggcttactgcaacctcagcctcctgggttcaagagattctcctgcctcatcctccaagtggctgggactacagacatgcaccactatatccagctaatttttatgtttttagtagagacagggtttcaacatgttggccaggctggtctcaaactcctgacttcaagtgatccaccagcctcagcctcctaaagtgctaggatcacaggcatgagccactacacctggcctttctacaatacttcataaaaaaaaaaaaatgtttaatcagctcagattaaaaatataacaatgaagaaaaattatatatagcttagaaattaaaagttgcactaaagtataaagaatgtcaaatattaggaatgccatttatatttaaggcttataaatcagattgaacacatggaaatgtttaaaaatgaaattgtatgatatccaggatttgctacaaaataattcggtggcaggaaaataaaccagaatggtgatacagatgaaataagattggctaaaagttgaccactgttgaagctacatgatgggcatctgggcatctaagttcattgcaccattcttttgacttatgtggaaaaaatccagatcatgttacatataaaaacaaaataagcaagaaatagagactaaactctttttctcactctcctaccccgtttcaggctgcctggttgtttggggggctctttcaaatacaatggttcaaaagaactgctaggacaaaacaagcaaaccaaactcaattaccgaataacactcaattttgccaatggtatctgtagaaacggaggcttacatttttttggaaagcctcaaaatcagatgcacttgctaattttgttaacttgaagagaagaaacagaaaagtcatctctttttccaaaaacctataaaccagtttgctttttattgcttttcattacaattttgaacatgaaatatttccagaaaatgaaaaacccaaatgcacctgcctgcattagggattaacggcttggaaaattctattttaaaaattgcagtgaatgaaactgagggtcattttcctccctttactcaactgtatacaaattattttatataagttttcatcaaggcaatacaaatatatgatacaaatttttcctcaaattttgtgtttcagaaaatgtggaagaaataaatgctctttaaatggtattttaaatgatgaatacatgtgatgagggcttatcactcaaagaaaatggtatagtgttatttataaaaggatccaaatgatcttaaattgaatccctagctaaaatttcagaagactaacaagtcttactacttaatgagttcactaaatgtatcctttaaaagcaagtaatgattactagaatataccataggtttattcagaaaaagcgataagcaaccaacttctctgagtaatttattacactttgttttagacaataggtcaaataatacagcaaagggcaactagatttcaaaaagacatttggtagggtttttctataaaggaggagccatgcgtaacaggacaactacacccataggtgtagttgatgaatacgttttgagagatgtcactggcctctgtgtttgattttgtcccattaataatgtgcacatgtattaaacaaaaacataaatggcatgctgaccaaaaatagctataagacagtactgatcatttgatgcacaaaattaggcaccaaatgagggctttaactcattttttcagttttggcaaatatacccaacctcataacagattaaaaaactaaagttctactctttgggtggagataaaaaataagcatatatgcacaaattagaaaaaagtatacaggagaaagggacagaaaaagattatcctttaacaggacaataatgtgaaaaacgaggaaggtaatcatcctatttaattctgactaacaaaaatgaggcagagtagactagtttacaatactgagcatttattatgtgccaggtaccatcctcaatactttaagaataatatcttatcaatatcaccctatagaaaggaactataattatctcatttttataaacaattaaattaatactctaagagatcagaggatgatctaaggtcaaatgaccttaaatgaggagagctgaatttgccaaggctaagagggcagtaaatgtaaacaccaggaactaggaacaagcaaatggtgttaaagggaaagaaagccagccaatgtttccagagtgcattctattgcattgcacaaaatgaggggaaactgaataaccagctggggagttactactgtccactccaggggaagaaagactgcatcacagggtcacagacatctatccttcaaagtagttaagcagaggcaagaggctgcctgtcaaacacggagacaggactcaggcattgagtgcaaagttgaactagagaccttgagtttctctgatcctataagtagaagcagccatagtagtggtagtagaaattaccatttatgatatgctgttttcctttattatccttattatccttataacaatattgtcccataagtattattatgttcatcttaaacgcagagaaatcaaaggcccatagcaggtccaggattcaaggtcagacctgtctagttacaaaaacccatgcccactacactaccttttttccccaaagcagcaactagatcataggaacatttgatttgtttccagaagggtcaaactctggccaaagaacagattgtttctctccaacatttacatttctcagaggtgtagtctattcaagaattttaatttagacttgcacgtattttgacaagtaaaaaaaatgttatacagatatgaagacaaagttactcatcttatccctatctgccaattacattccccaaataaccagtgttaatatttttgtgtttgatattcattcctttcacaaaactataaacatatagatacatatataaggggttaatttattttaatcaaaataaaaacaaactgcacatattatacaactcattttttctacttaatattatagacatatttaaaatcattagaacaaaaaaattgcaaaccaatatttcacaggaacaaagatgcaaaaattctaaataaaaatttaaccaatcatattcaacaataaataaaaagcataatacatcatgagcaaatagggaaatagagtttatcccagtcatgtaagattattttaacattggaaaatctattaatataatttatcacactaataaattatatatcacactaataaactacataaaatccacatagtcctctcagtagacacagaaaaagtatttcagaaactcccacatttattgctgatttaaaaataaaaaaaaaactcctggtaatctataaatggcaaagaacttcttcaacctgatgaaaagaatttatgaaaaacctgcagctaacatcatagttaatggtgaaagagtgaatgttttttccctaaaattgagaacaagaatatcttcattacccttttctgtctaacactttactagaggctatagccagtgcaataaagcaaggaaaggaaataaaaagcatttagaatagaaaaggaagatgtaaaacttttattatttctcagatggcatggttagctgtgtcagggtttggcaaaatgtggcagttttgttattaagtttcataagaacacagtcacacccattcacttgtgtattatctacagctgctttcaccctactaattactcaactaccatgggcagttgagtaattgccacagacacacacaagcttaaattatttactatctggccttttaagaaagtttgctgacccctgatctatgtagaaaatctgataaaatctacaataaaactactgggagtaataagcaagtttagacacactaaagaatacaagatcaatatataaaaatctattatatttctttctgcttgtaacttgtaatcagaaatagaaattttattttttattttttaacttttattttaggttccgggatacatgtgcaggtttttacatatatatatgtatatatatatacatacatatatgtaaactgcttgccatgggggttttctgtacaggtaatttcatcacctgggtaataagtacagtacccaatagatattttcaggaacaaaaattttaacacagcatttatgacagcaacaaaatatataaaatacccagcagtaaatctgactggagatgtaaatgacctgcatagaaactaaaaaaaaaaaaaaaaaatgtactgagagaaattttaaaatctaccctattcatgggcaatacttttaaaatgtccattctccacatattcatctatatctagatattcaacgcaatcccaaccaaaatcctaccatacgttttgtcaaaatggacaaagtgattctaaaatttacatggaatattgaaggacctagaatagcaaaaacaaatttgaaaatgaagaataaagttggaaaactaatagtacctaacttcaagacattataaatctccagtaatcaagacagtgttgtactggtgtaaagaaaggtgagtatatgagtgaaacagaatagagaatcaagaaataagccctcacatatatggacaactaattaccaacaaagatgcaaagacaattaagtggagaaaggaaatcttttcaacaagtgacactaaaacaattggactttcacatttaaaaaaattaacttcaactcggaatggatcatagacataaaactaaaaccgaaaaccataaaacttatagaagaaaacttttgtgactttaggttaagtaaaaacagatatcacaccaaaaccacaatctattaaggaaacaattggtaatttgtattgcttcatagttaaaaatctctgttccccaaaagacactgttaagaggatgaaaacgtaaggcacatattgggaaaaagtatgtacaaatcacatatctgaaaaaggtcttatattcagaatctatagagttccaaacaaaacaccaactaaaaagagagtaaaatatttgaattaaacactttaacaaaaaagacatatggatggcaaatgagcacatgaaaaattagtcattatagaaataaaaattaaaaccataatgaggtaccaagatatactattagaaaggttaaagttaaaaagactgaccaaagcaagtattgatgaaaatgtggaagaagtgaaactctcctacactgctgggcaggaatataaagtgatgcaatcactctgggaaggttaagagatttcttaaaaagagagatgaccatgtgacccagtaattccacccacagatatttactcaagagaaatgaaagcatacatccatataaagacttacacacaaatgttcatagcagcttaatctgtaatagacaaactggaaacaaaccaaatacctatcaatgggtgaataaacaaacaaaagatgatacatccataccatgagatactactcagcaacaaaaatagtgagctgttgctatatgctacaacatgaatggctctcaaaaaattctgctagtgaatgatgtataattcactattatgctacgaatgaagtcagattcctgatgccacaaaaaaaatacataccacatgattacattcacatataattctagataaaacaaacttagcaccagataacatgttactggttgtcttgaaatcgggagatacagggtagaggagagtgattataaaggggcacaaggacatttttgggggagctaatgtatgttcgttttcttaattgtggtgctggttttatgggtatatgcacaagtcaagacttatcaaatcatacattctaagcatggacaggatattgtatattaattctacctcagtaaagatgtttttagagtcattagatatttgtctaattttgttttctaattactttatgtatatatacacacagattttataaaatgtagagcatgcatacttagcatttttagcggttttctgtttgcttcttgtttctaaatatctaattaatcaagtaacacgtattaataacctgtttgataataattctaacagtggccctctgaaaattcagctcagggtgctagaacaatcaatatagtgacaccaatatcatgacatgtgtgacacattagcatgaaattagtggtgatccttgtcaatcctacgtagacaatgctaatcaatccccgcactcttcctctctgagcctgaataaaagattccagctctaacaggctggagctaatacaaatggtgaacccgctctgccatccaggggtcttgttgatgatgctgatgatgcctgactgaagtaggcaaatacgtttttatcttcatctttttgccaggctgtctctgtgctatcttgttgctttgcttaaatcaagaaaaatgggcgttgtactgctatctgcattttgtcttgcatttaagtaacggtttcctttaagagccaattcagaactcatacattccaggaagcctcctattgactaagctcaggtcataataaacttgactttttctgaatcctttcactactagattccttgctacacaataccacatttaggtatctgccaccaggattattctctgagcttcacttttcttacctgtaaattgatacttatattgcagagttgtcttcaggactagagatgatgtatggttacccctgggatgtagactccacaaattcagacattttgtctagtttatataaccctagtgcctagaacagtgccagacacagagtaagtgttcaacaaatagctgtaagtaaatatgtaagtagtctttcacataccatggcacattaagttcgatccacatacacacttaatactctataataactcagctacttgaagacagtcaccctaggtgctctttttgtcccttggagttacattttactcagggtttctatagttagaagtcaaggcaaatatcacaggcagagctggactagagtgaaacaaatgaatcataatcctggaatgtaaatttaaaggatacgccaaaaaaaccctccacatatgaaagaaataatatttcatgcaatattttttaaaataaaaataatgcaaagaatccattatgaataaaacatcagttttaaacaaaggcaaaatcagagcagtgcaggactgagccatatcaaagcctgaggcaaaatgaaaaatcaaacacggctcctatcttcacttaaaataattttgattaaaaaatattacattaaaatattatttatcctcattactgaggtttctagcactcccttcaattctgtgccggtggtgagtgcctcctcgtgtcaccccaatcctggccctgcacagctgtcaaaacagtccttgaagaatcccttaaactatccacaaaatataatattctactctcactaaattcaacaccaccagtttgcctttagtgttagaacagtgctacgtttctccaggtgagccctggatgaagaagatggcttacacttaaggagccaggctgtatacaaaatgtgtgtctttacacagcagactcacacttggctcatcaaggtgctgatgccatgggaggcttctgggaactgagaatagtcgaaccatgtctctcatctcaccctggctcaggcacagactctaaggcaggcagaatcaaccacattcttttatttgcctttattcgctcctgtttgtggtctgtctctgtctctctttctctctctcacacactctcacacacgacttgtgtaacttgaatgaataaataatgtgattctactggaaatgcaatgctgtccgccccttggccttctacccagcatgcctgcttgttgagcgactgacgggttctgcctccatcctcaggagcctcagctcccacaaatcactagtgatttcctccagccgccaagacaaaggcgactctggcaaccaggctatgtattccttttgctttccctaagcacccataccatgttgcttcccataaattcacagttttatcctgagatgaaatcgcaccatttctgccaggaatcacacacagaaacatggttctgttttgtttctggacatactgtatttgataaaattagaaagaaatcaccctaccaacatttgcacacaagaagaaagggaaaaaaaagaggagggtgaaaaatcaaccagctatgagatccagtatagagaagatatcagaaaaacattttttgcaggttccaaatcttgaagtataaaattatcctctcctattcttctttgttcccacttgtggcatctagccaatcactaacaaatataagagctggatgccaacttcagtaaacatatttaaccctacaaggagagacagtcatgggggaaaatgaaatcttcatgggtccaagtctctcaatgagaacagatattcaggccggatgccatggctcacgcctgtaatcctaacactttgggacgccgaggtgggtggatcacttgaggtcaggagttcaagaccagcctggccaatatggtgaaaccccatctctactaaaaatacaagaaactagcggggcgtggtggcacatccctgtacccccagctacttgggaggctgaggcacgacaatcacttgagcctgggagatggagattgccacaaggtgagatcgcgccactacaatccagcctgggtgacagagtaacactctgtctccaaagagagagagagagagagagagacagagagagagagagagaacgaacagatattccctgcaagctctcctaaagcgatgcatttttttgcgggggaggggtgggggtcactaatacaaaacatagacttggcactgagcctcccaaagcagaaagaagattggataattacattcatacacatatccattgtgtatgaatcacattgtccagccccaccactgtgcaaatcctggagtcagaacatctcagattctaccagctcatcccaagtattttccagataaggtaacagaggcttagcaagaccaggtgacttgtcttacccaggtcatgatggcagcaggtgcaaccatctacccaagcttctgccaaaaaactaggatgctttctgctgctctgtggtgggaccatttgatcccaggactgccacatatttgggccttatacagttcctttctgtggttaagtgaagtgattacccatgccctatgactaccagatacaccacactacacaagtgacttccaaaatgcagccaggagtccccacagtcacaaatgtctgttcttagaccctctgagacaactgtaacagggataaacacgaatggagaatgatccataaagaactctctcactggccggactcagtggctcacgcctgtaatcccagcactttgggaggccaaggcgggtaggtcaccttaggtcagcagttcgagaccagcctggccaacatagtgaaaccctgtctctactaaaaatgcaaaaaagtagccgggagtggtgacaggagcctgtaatcccagctactcgggaggctgaggcaggagaatcacctgaaactgggaggtggaggttgcagtaggcgaagatcacgccactgcactctggcctggggaacaagagcgaaactccatctcaaaaaaaaaaaaaaactcgctcagtatcattgggacattaaaaaagccaatgaaactagacaagctcactggcactcttttttcattaattactgtatcttttttctgattaaaaaattataacaatttcacatgatcttatgaaactattagctctctgagggcaaagactttttctgcctcgttcactggtctatcccaagtccaggacttaactccatattaaataaacatttcctgaacaagttttaaaaagaaaaatgtatctgttcattgagaaagtcctgaaaacataggaaaaaaatttaaaatgaagcaaactctcccatcaattagcaacacagagataacaactgttagcactttccagaatgtattctgtacatgtacatacaagttttcaatctaatttgagatgagactatataaataattttgtatcccatttggtttgtcttttcttttttctccttttttttttcttggccaagtaatctcgcatcttgcttttaattttaaccttctcttcagttctctcttcttcaattcaagtgcaatgacagctacagacatcagaagtgagcaaatcgatacacagtgacccaaagtcaaacaccaaaagttcttcctggagtcaaacaacttttgcagaataaaaagaatcctctgaaccagttcttccttactcctaacacaggttatttttttcaattaacaagtcacgcaaacaccaggacaattagagctgtactgaactttgtggtattttctgcacataaagtaaatatatctttctaccaaagcatgaataaagaagtgaaggacaataaaaaaaaatatgtggcagataccaatcttgggctatcagattactcaagcacctctgaatgcttaagactgacaagtcgcttctataagaatcacagatttttttgtcagttgtttctcttacagtgtgcacaccggtttccacacattaatgtgtacatttcaattcagcagccttccctggtgatacctctgcttgcatatctaatagatatttagattcaaaatacccagagttaaacaattatcttccccttcaaatgggctccacctgcaagcctgtcccatctcagtaacggatgactccagcccttctctgagcttagggcaaaagtcaggatattaatatcatccttttctcctgtcttattctcataccacccatcaaaaatatctacacaccctgtgccagctcccatcaccactcaccttgatagctgtgcaagcctcataactggtcttctgcatccaagtttgactccctacagtctgagaggcacactctatatccaaagagcatccagaatcattctttgaaatgttgagtcaaaaagggggcagcacaaaggacttttctggaatgatgtagtgacgatatgacttgtatatgaacctttactaaagatcacagaaatgtacatgaataagagaattttactgtccagtaaaaaggaaaattactgtacaagaaaaaaaaaggcaaatgaggccacggaagttctctgctcaaaaacccaaaaacctatattgtacatgctgaagttgccacatgacccgattctctattactgctttaacttcatcttctagtactttcacttcctctgctcactttgtcccagccacactgtccctgcccccttgctgctattcatacaatttaggcatggtcctcccttagtgacctggcactggctgttccctttacctggaatccctcttcccctgccatttgtgaagttaatactctccactctatctcttgcacaaacatcacattcctaattaagccctactgaaacctgccattcatctcccatcagcatacccaataccccttaccttgctctatttttccttttccattcacaggcattatcattttcagatataccatataactcacttactaatactttgcggtccttatctaactctcccttactgacctccagctagaatcttaaactccctgagaacaacaattttccttccaatcctgaatatattcctgacacttagaaaagtgccaggaacatagtagatgtttgataaatatcttttgaaaaaaagtgtacacaactggaacctagtgtatgtcaggcattgcactagcccctgtggtagattcaacatgtaaaatgactgttattttgttaaataaatgggttggcctacataatcccccagtcctctctagctcataaatgcattccaagtgagtgttttagacatgattataggctgtacttgaatgtaagcgccctgaaggcaaggattttaggctgctttccagctactgcattccctgccctagaacagtacatggcatagagaagcatgcaatatttagtgaatgagtaagctccctgtgaacaaggaataagagtcttgtatgtgttatgtttctgattctacccagcacataggaagagcaccaggcacgtgggagaggctcggccctggttatgtactctacctagtctcctcatggttggttcaaaaaaatcacagttagcaacaatatgcacaggccttcctcaatattctcaggagtagtaatggagaggatgattttaaacatgctgcataagcgctttacttcaggtggcagctctttggaattcctattaggtgcatcacatcaaagagcggctctctgatgttgacatgcctgacgattctgagtacaaaatccaggtcaaataagacttactgttgaaagcaagcttctccagagaaattgcagggatttccctttgcatcctggttacttcaattctctgtcttgaactttacaccaaggccactacgaccccaaagcctcatggaagtcacctcagcagtcatctactccaatcacctctgactggccatgactgttaaaggttttgcttccatgaatgtgtgttttccaaagatacatacgccacatcagcaaatgaacgctgacatgagacatgacttctccttctacaacttctagaattacaggtatcattgtcacaccagtccatcagcactgtgcaacacagacataatgtaaaccacatatatgattttaagttacgtaatgttaaaaataagtcaaaccaaacaagtgaaatgcacttaatagtgtattttctctaacccaatatatccaaactactgtaatttcaacatgaaatcaataaaaaattattaatgagatattttgccttttatctctcatactaagtcttcaaaattggggtccactttacactgaccacgtatctcaatggccccaacagtcacatgtggctagtgaccactgacctggacagtgtgagtccagatgtcaagcaccttctctcccaagttgttattgctgctcttagatttacactatttaaggatcttagaactgattttgaaagtcttctaacctatgatgacactactttcattactctcagcaccaaaacatgcgtcttgcaagacagctgaatgaagctatgttacagtgggagagggctgctaaccaggatagagttaccctgtctctcagagtcacaaataatatatttgtttctctaatctctaactagaaccccattttgttgaattccagtgacattcctaagattctaagaatgatatttcttactgacagcagggaaatgggaactaactacaaggttttttttttaaacagctctgccaacaccactaccaaaagataaactgaacagcaacagaaaggaggttgaaagcaggagaaagttcaagtacaatcaccttctcactataaactgcactcccatggaccagctcttagtgtttgaacaggtacaaaatgaggctgaagaagaatagggctctttaaggactcaaaggaatgatctaaccaagttttaaatgaagaagaactaaagaacacattcaggttaggtgctaattcaccaggtgaaagttgttttgaaaatctatactaagaaaagctctgtcattttctccctgaagatgagactgtgacctctactagtctttcaaaggtgaaacagatcacaagaatatgaaaggcagttcaatctggagaactttccacagtgacagtggtgtgaagttcatagcaataaaataataattaacacatcacagcacatccagactctgacattctctacccctatttccattagtcagggcctcaaaaatctactcttgaaaaaaaaaaaaaaaaaaaaggcaaactggcttaaagtgaatttttttcctttccatggaaggttgttatcaagcattgcccagcctacagaatgagctactttggcctaattctgacagctgactcagcagagaccagttggaacaatggttttcaggaggccaatgctggaattggtgaggctctgacagtaccctgccaaagtcagcaatttctttaaaatagggtcagcttataggaacccagatgctatatctattggcctggtttcttggagaaagaaaaaaaccagactacaacatacccactatcctaaaaacagccaagacacaactggcagcaacctcagtagacctgagcgataagcagtgtttgacacaaagctgggaagccattgatttacttagcaattactcaaagatttcacattcaagtggacgagaaacctaggaacaagacacaggtcacagctcttttggcctttgaaaaaacatataaaagcagaaggaaggaagcaagtacaacacatcctcacatctttatgccctcagtctacctaaaaataaatttgaagtgtgtggtacaaagattatcaatgactacagcactaaaataaatggaaaatgtaataaagatatagttcaacaaacatttctagattcaggatagtgcctcgcaaaactatatttgtgatattcttgccaagtcaagtataacagtactcatttttatctcattcatttatccattcgaccagttcatttaaatctttcttgtaccaggtactgtgctagacactggtgctataatgggaaactgaacccaacaaggacccgcattcagggaccttcatatccattgtgagaaaggcagacgggccaaattgattcacctaagtcagtaagacttattgatgtgtaataagaactaccattcactgaatgcctatcatgtttcaggttctatgtgagggactcatttaatcctaacaacatcagcaattagtcattaagaccatttatagatgaggtaactgagccttacagaggtcaaatgatttgccagggtcattcagacagtcaaggacagagccaagatataaacccagatctgtccaactcctatcataagcttaatgtctgaaaataagatatcatcttggtattaaaagaatcaggcaaatcaatggtgagcaggactgactgacagcttgtgcaatgcattaaaatgtatgattataaacaacccaattttaaatgtggataaaggatttgaacagacacttcacaaaagaaaatatacagatggcaaataagcagatgaaaacatgttcaacatccttaatcatttcgaaaatgcaagttaaaatcacagtgaaatgtcaccacactgctagaaaggcaaagaaaaaatgtttttaattttaataccaagggcaggtgaagatgcagagcttctgtaactcttagatgttgctgatgaaaatgaaaaatggtacagccactttggaaaaagcttgacagtttcttataaagttggacatatatgtgccatactacacagagatctcaattctaggtatctacctagcaaaatgaaaaccactgttgacacaaatacctatctaatacatatttagttatctctctggccctctgaacctattctcttgctgtctttgaagtctcctttagcaactttattcttaattcccaaaaatgagaacaattctactgccctttaactggtgaatggctacacatactatagtatattcatacaatggaataatatgcaacaatacaaaggaacaaaataatgacacaagcaaaaacacaggccgggtgcagtggctcacacctgtaatcccagtactttgggaggctgaagcaggaggatcagcggagcccaggagttcgagaccagccctggcactatagtgagaccctgtctgtacaaaaaatttaaaaaattatcagggcgttggtggcgcatgcctgtaccctcagctacttggatgactgtggtgagggtatcgcttgagcccaggaggtttaggttggagtgagccatggtcatgccactgtactctagcctgagcaacagaaagagaccctgtctaaaaaaaaaaagcaacaacagggatgaagcttaagtccattttattaagtgagaaaagctaaatctaatacctttatacactagattatcccacttacatgatattcagaaaaaaaggcaaaattattaggaatagaaaatggatataattgcttggaggaggtggaaaggattgactacaaatggtcagtagaaaataattttaggaatgctgatttttaggggtgatagtattattattctatagtttgaatgaagtggtagttacatgattgtatgcaactgctgaaactcagagcactgcataccaaaaagagtaacttttgttgcaagttaattttcaaaatgaatacaatttgcttcaacaaatgtgatttgaatgacagaaattaaacacaaagatacacaaaaatactaaatacacaaaatactaaatacacaaaaatatacaaagatacacaaaaatactaaaattttgcctaaagccatcccaaactacaagacgtattcttaatgacaaaatgttggaacatgaacaatttcaaattggcaagtaacagattttttttttttaacaccttctcactagttggcaagcagaacagttcgctccaatatcttcattctgcattctggaaaatgcaaacagggcacagggaagcttctggtatgggcgaatgaaggtttctccttagcctgtaacaggtcacaaaagctgatgcacagtttttcttcacaggagaagctaaaatttcccaaaggcttgctgctttcccattatggaagaggcactgtaagaacaacctggtgaattaccccgagatccctaactattgctgtgtgagggctttgcttttgaggttggggttgaagctcatttgaaatctttgacattccccaataagatattgctgggcccaagactttgctacttttttcttaatgccattgggatacagatgctcctcgactcactttggagttatgtcccaataaaccactggtttactgggaacacacctaacctactgaacatcatagcttaggctggcctatcttaaacgtgctcaaaacatttacattagcctagagctgggcaaaatcatctaacacaaagcctattttataacaaagtgttgaatatcacatgtaatttattgaatactgtactgaaagtaaaaaacagaacagttgtgtggatactcgaagtatggtgtctactgaatacatatggcatttctttgccattttattttattattacttttttcttttttttttttttttttttttgagacagggtctcgctctgtcgcccaggctggagtgcactggtgcaatctcagctcactgcaacccctacctcctgggcttccacctcccagcttccacctctcaagtagctaggactacaggcacatgccaccatgcccagctaattgttctatttttttgtagagatgaggtttcaccatgttgcccaggctggtctcaaactcctgagctcaagcaatccacccgccttggtctcccaaagtgctaagattacagacgtgaaccaaggtgcccagcctactttaccattttaaagttgagagattgagttgtaactcgaccgaccagctgtattaaccacaccctccctcccttcttcgcattacaacacaatgaaacaacagaagcactcaatcagggagtaattctacaaaatgtatggcaagcctgagagaagctcaacttcccagtgttgggatccatctggatctcaattctccagcacacatttggttcttttcccaaggctctagagcctattctccggctttccttagaggctccttttctgaacagccccaaatcgctggctcatctgcctaccaaagactcgctaaaaacccatattacaagcaattcaaagcatgaaatgaaaattgatgctttcaactcctgtaacgatgaaaacgggaagctgccggaaactctatgctcctttattttccaagaatatagatagccttccaagaatatagatagtcagttttcaagaatagagatagcagcatgttatatgagataagaacttgctctaagggtgaagcattcctccctaaatttgaccccattaaggtggagcgtttgcattcaaaggcaagtctggtaggggtgtattaataacaaaaagaaaaaatgctaccttcagaatcaacactgaccaaagatgacaaactactccccatatgtaaaaggcacattaaaacaatgagtgactatgcccttcagtgtgaatcaaatcacatttttcaatctaggcaatgtagatgaaagtctcactactctaatggtgagatgggcagttcaaattctatctctgtgcaggttaagtatctgtaaaatgagaggattgaacagaaataacatctctgagttctcttgcaatattatgttctatagttctaggacttaaggaagtacaaagggcaatgtactgtctgtcattctctactaaaataaaagttccccaagggaaagaagtgttaattattgtacccttggtaccttgcagagtgcttggcatatacaacatgctcaataaatttttattgaacgaatgatgaatgatagtagagtcaggataagtttgcctggctccatcatttgattatcgggttccgtaattaagaaataaatatttatatacctaaattgtgacttcacaacagacgctaggaacacaaaaatgtatgagacactgaagttatccttaaacttatattctagatagtgaaacaagaaatgttagcttaagaagagaaccatctaggaagtaaagagttttctaatgttgttaggttcagagcagggataggtcagagtaaacagtttacagtatgcatggacggcttcctgcagtatgtggacagaaaactggggagacaggaaacttgaatagttgaaaatgatttaaaatgatggcaagaaggattcatttccttacaatggggcagtgaaataaggtgcttctatatttttatatattaacaagatactatgaaaacagattcaaacttaaacacgctgttttggacaatcacttaggccactcccaggcttatagatcccacactctgctggacagcccacttgcatgccccttgtgactttcccgtctactaagtcacccttcctaggaccatgcatgtcatcttggacctcttcctctcccttgcacttcctgctccagtattcaccaagtcctttctctccctaaatatttatttattgggtatctcccctgtcttccttgccttagcttgggctttttcactttgaccgtagcttccttgttgaccccccctgcattaacttcattccctaaatcaagggttgggaaattttttctgtcaagggtcagataataaatagaaaataggctttggaggctgtgtagtctctgtcacaactactcaacactcccaatgtggcataaaagcagccataaaaaaaaatacaataaccagatgaccaggttccagtaaaactttatttaccacgacatgcagtgggccaaatctgacctcaggaccctacttgaatgacccttgctttagatggttgccagggtggttttcaaaaaaaaaaaaacaaatagtaccatgtgactctcctaaactcttccaagacacccatcaccttcaggataagttccaggctccttggcatctctgtgtccatccccgagtctgtgtctcataactcttaaaattgcacactcaacgatccatgacttaatcccttcccagaaacaccagcctcttatgacttgatatacacatggttgcgtcctcttccaggaatgtcttcatttcctctgaaaaactcccatccagcctttaaaacgcatcaccagtgtctcctctactatgaaatcttccctgacctgaattctagacaaagtcaggtcagtctctgtgctcccccagcaccttgacatacttctcttacaacccatgtgacggtgggatgtcattggccatgtatgtgtctctcaccaccaccaattcccctgtgagggtaaagctattttgtacatctttgtatctttaacacccagcataatatcgggctcataaacatatttgggtcataacaactatttgtttgattaatcggtaaaaaaatcataaagatttcaacttggtactcctttgaccttgtataactgtaaagaaatctgaattcactcggtgctcttaactatcttggttgtgccaactattttaattcaacacttgctattaaaacttgtccaaatgtcagaataaactgttctttctgaggatgatataattcaaaatttccccttttaaaggagatgtactttaaaactgctacttagctgtcccccccattcgtctttaattagctgcttgaacaatgctgaatatattacatccttgcagagagctaagtcctcaagcaattagtctgtcctaccaaatgtgacctacatcactactgtgcccaggataggcaaaccttcacaggacaggataaattcctacatcttccagaatctagacagagcctctaaggccaaaggaaacatgaacttgcggtaaagactataaaaagtccatgttttttcacctatcaaaccagcaaaactttaagaaacaagagaatgaacacgcttacacatgctgatgagaatgtaaattatataattcttttagtggaacaatttgggagtttttcaaatcctaaaatgtgcattctctttaactcagtgatgccactctcaggagtttaacttacagaagaattcacaatacacacaaagctacgtgtgcaaggatgttcctttcatcaccgtttccatcattcaaaaactggggaatgttgggctaaatcatggtacagcaaaattttccatgaactccaccatctacaaccactgacttcttgagagtcctgactgtcaagctcactatgtccaaaatgaaactcctgatcttaaactaagagatgacccacccccgcctggtgtcccccatctagcaaatgactattctgtccttccagttgttcatgttaaaaagcaaaaaaccaaaacccttggagtcattctcaattcctctctttttctcacacccctcaggtcatccatcaggcatgagtctactctcaaaatatatataaccactttgtacacctccactaccattactctggtctggccactataatctcacaccaggattataacaacttcctgtcataacaacttcctgtcagtgctctctgcttccgctccttcggaaaacctcatcctactaccttcagtgaggctttgtgaatgttcattgggagcatgttactgcctggatcaagactctgcaatggctcctatttcattctgggtggcgtggttggttagggtctaaaatgtctagcataatctgtcattcttccttatactctgacctctcctcccatagttctaacccttgttcactctatttctgccactccggcctccttgctgttcctctgaaaatgcaggtaccacttctgccacagggcctttgcaatggattggcttttacccagttatgcacatggctccttccctcatgcattcaggtttgtgcttatatgttacttttccagtgaggtcgacccttgacaccttgaaaactctatttaaaaactgcaacatgcccaatctccacactcaacccccttactctgctctgctttttccctcgtataatgtcccaccttctaatatacgaaatgattcactcaactattacatgtactgttttgatttcacctgactagaacataaaccctataagggatcttcatctgttttggttgatcatatataccaggcaggcagaacacagttcctagcacataaagattgttaaataaatacttgttgaataaataaatatatcttagtgtttctgtgaggactaaatcagccagccctagcacatagcaacctaacaaaagtaggttccaattattattagaaagaataaagtaggcatgcatctactgacatggaaagttgcccagatgtaaagacaataagaaaagtcaagttgtaactgaatacaaagtgtgcaactgaactagcatgcaaaggggagttaatagagcattatcaataatactgaaaaactagaaacatgctaacaggtcaccatcagggcaagggttaaacatattataccatcttcccaccatacttggggacattatgtggttgtcaccaagaataaggtaggatatttgtgttacatattaagatgtcaatttcagatggggaaaagaaattgacttactgactgaacaggaggtagagtgtgatagcatcttctttgaaagaaaaaagaaaaaagctatgtgcatatatatattagtgcagaaaagttaggagggaaacaaaggaacacacgcacatgcagttacttttggagagttggacttcagaaagaatgagggctagtgtgtaattttatgctgcatttttccattgtgcttgacttttctgcaagcaacgaacccaacttttgttttgccaaccacagtaacttctgggaaaaacttcccatagtggaaagatctcattttaactaatcatttttaccttattccctattccctgatcttattagaagtaaattaagatgggttctaatacaagctacaggagggcagggggtttttatattttgttgatggggctatgattccccagtgcctaacaagcgcctaccacatagtaggcactcaaatattataagttattctcaatataaggtcaccttcaggtaaaattaaaagtagtaaattaaaaagtcccaagctagaaagggatatagcaaaagcatccataaactggagtgttaagcctcataaaaaggagtttaaatgtttacagacttttttggcttccctttcaggtcactatctataatcatgtatttttaaagcaactctctttggcatgactccacaattaatgagaaaattatagcacttactgtcttatagccaagttatttcatacagtctttgtcaaatttgtagattcccactgatctaatctttattgtggcaaagaaatatacccagtgcaataattcagatgcaaggactagtagattgtgaaggatgggggggaaaggagattctttaatcaggcgagcagtatgaacttttcagaacaattcaacagtgagcagagtagaaatctaaatgattttttacttccaatagaatataggataaactatctggttggtggaaaataatatgtatcattaaatacaaacaaacttatgtttcattttctattttcaaaatgatttttcaaggagttgtacttttttgcattgctttgataattacaatagcactctaggaaacagcctgaacttcataatgactgcataaggtcaaagttcttaatgtgtccattcattcaagtatttattgaacgtgtattacctgctaagcattgtgcttacgactagatatagaaatacgggaaacatattgatatctcattatatggatatagttatattgggatattgaaagagaaataatttaaaaatctccacaaacaaaagcctcacagaatggaattaaaagaaatatgtttttttcttttcctgccctttcaggtcagataatcatttaaaaatcttttcgctcaagaacattcagcctgatgagtcactttcaagcccaagacctcccctttactctcatgcctcagatcttctcaaacattttggtaaaagtcaggtaacattttctccatcctgtttttattcttgaatctggccacctatcaaaactttaaggatgtcaaccgccatggatgaagaaataataatcagcaacagcagctcaaggactgtatttgaaaaaacaaaaccaaaccagatatctagatggcatcagtcatcaactcactagattcttgaaaagcaagtggattgagtgccatttttatcaaatggaatcacttgtcaaacaggtttaccaataacaaaatggcaaatcccagatcccactatttagaaacattgtttagtcataattttcctgagtgttgacatcccaaattagtcatgtaaatttactgaaggccaacagtagcagaaacttgtcaacaagaccgaggaagcaaaggaaggcagcatctttacatttttagtgtttataacacttcaaaagcctaaaagtcatcaacagctggcctactatcagacacagagatcagcagagttactgaattaatggctggcattgttgctttcttcccaccagacatctcaaaaaatgctatgacagtttttctggtgccagagggtgtcagtatgactgcgagggatgtgcttacattcaaatatttggggtctgattatcaacataagaaatttttttttcaaaggaaaaaacaaacatgctgagaaaatggtgattactaaatgaacagaattttgttatgcaaatacagttgcaaagaaaaagaaatatctgcagtattctgatgggggggtgtcttttgatttagctttttctagtactatcaactctatatttactttcagctttagaaacccttttaccttcagtgctcagtgtctcccaaattctattccatgcaagcctaataagccaacatcagaataatgcatgggtctgtgtatttatttattgaaatcattaaacaggcagtttcagtcggtatcacatcacctgctttatattacgcagcacagggtcaaagagaaattacaattaaatttttcaataactggtgtcaattaagcacggtgtttagctcctttgtaaatatggagatcttattctctctgtcttctttttccactcctctacccccatccatatgccaagaatgaatagaaaacaaggggaaaggagaggctgcctcatcagaagcctttgctagatgtgtcttagtaaaatcagctatagtcattacttctatggcaccattaattcatgggcatagtttctgttcttatacacaagaatgtcaaagatccatacaactgtttatcacaaaaacagtcttgggtatcaaacgtataggttcaaagagctcctttctgttaataaagcccatgtgaaactgttttgccacaagcttttagagaatctagactcagggttggtagttccagtggacacaccaggggccacctcacaaattgcctcttctggccacagttaaactgaagaggcagtgaggctctagtctcccctgggggtggtttcatatcaaacacacatgcccatgcttttgctcagcaaggatcgggagaggagcctcaagtctaatcataggaacagaccgatttaagagccataattgagtaaaaagaataacggaccgattccacgtctctctagcacaaacacaacaaatccaaacaccaaacctcaagcatctttttaaacacagaaatacaacttgaaatatacagcctaagaaagaaactacatggggaagcaaatgggtaagcttccgtttttaactctctggggtgggtagggtgggtagggtgggggtggggagttaggagtatcctcatcaagaatcctttccctctgccccatcccctttcccaaagccaaaagaggaaaggcattgagagacaggggcagactgcttctgtttgctcagttgagaaatggaggaatcgagtctctgttgataccattaaactgctaaagctttcaacagcactaaaattcattggcaagtgatgagctgcgccttgtcgacgagtttcagtgcaagttaaatcacgaaaagaatccaacttcatatctaattaatacaggcttccaagtgatcaaaaaacaacagtttttcagaaagtatgagccttatagatgataaaagacaagcttttctcaactaagaaatgcatttattttcccagaaccccaaagacagtatgtcattccgtgggttaccatgtgcatatggaatttttatgttttcaatataaaagtcacaatgccctcatgcaaaagcttcccgttttactgaaacccccaacaaatgtgtccgaatcttttgaaagcactgaatactcattcaagaggagtagtaaaacaaacaacactataaaccagcaagggttatttggctagcacacactcataagtagtctcctaattgattctcagttgacagggtgttgagcatggtaaactctgggaaagagaaaagggcccaacatacctaatccttaaaaataagccatacataccctcaaataatttagttcaggcacaaatccactccctttgtgtgtgagacaaagtctatataccaacactgtggacaagacagcttccttgtacactccattgccccctggtacccaggtcagttagacttaggacttaggaagaggaagggaggcatagccttcctgaatcttcaaaaatcccccagccttccgggtttggcccattcacttacagaaccagacagggagaaaagccttttagctcccaagcactcagcaagccagactctggattctgttttctgatgcccacagacatacatctcttacctagataacacagtgctctaacatacaaatgttaatttccaggaagcaaacttaaaaagccttccgcatgtacattcttccttttagaaataggaaaacggacagaggagaatcgcagcccttccgtttctaattttccccgagagcttacaaagccctccaaagtgcaaaggcatttgcccaccgcgctgcccggggaagcagctctccctctcccctgccttccccagcctgggcgccggaacaatgcagcaacatacatttaccaacacctgctggagcctattaatatgcacggggacgtactgatttttcccccctcccttcccctgccctccacactgagcaggctttcatctcctcctttaccatccatcaggaactcatttcgccggccccctccccctcccacccccagtccccattcagccgagcccctcgctccaaaagcccgggctgacgagcacactttggaatgcacttcattaaaatttagctgcccgattccaacctgcaatgcggaggaggcaatacaaagcgcgcgccacacttcctccagcatccccttcaaaagccccattgttcgccaggcatctgctccagagcccggcctctccctatccactgacctctgatttttttttctcccccctcccccttcctcccagcctggccaaacgggcctgcctggtgaattaaaacgcagccgcagccatctggccctcccaagctggccgggtttctccccgcccctcctccctggtccacacaccacacacggcatcttcacctccatggatattcccacaacccaagctcaaacctccggtggcagggagcctctgccgccgcctgcctgtccccaggcttcctccggcagcggagcgttcgaatccagaggtgggcagggggcggtggaggggtggcgagaggagatcatggaccacttgtacttgcctgcaaaccccagcccaatcgccaagattaatccttccctttgtgagcctgaaaccgcctcccaccacgctggtccttggctctgcagcggctgtaaagagaggcgggggtggggggggggtgggaccgaaccccttcctgggagagctgggggcgcctcggccacctgaccacagagcggtttttcgagggaagaggtgctggcagcaggagcagctgatggtgcgagaagggagagaagatgcccaggcttgcgccttttatattactggcgacatttctaacacatgacaacaatttccatctgtatttaagccgggagtgtgaaaaaagagcattacatcacagagcccgggctcctagaggctgccggatatctaggccggggggattagggggctgcacctgcggagggggcggggactgagcgagcctctccctgctggggcgtgtcaggtccccatcacccgcatggccctgtgggagcccctggacatggaaaggcgggaaatagggttgccccatttgcgacatgctggaggctgagtgcatgagtgggtgggtgagggcgagggaaggggcgtgactccctttcttggttagggatacaaccctgacttcccaagagcaagggacagaagtcccttctgatgaaactgacttctgcctttctgcctcttccccaactttggaaggaattccaatagataataactcttatgtttgaaataattgtcttcctttggagttaaaataaagacgatggagtggcttagaaaatgaatttgaaggatccactttcaaggaattgacacttcaagaatcaaaggtacaatctgactcagaatcaagctgcttctctactgctcacctctatgtcattaaaactcactgtttttaaggagtgataggatagtggatagggggaggctggcctctggtgcagatggttggcaaagctgcctctttaaaagattctctaagagccggcggtatcacctccaccctgtttcttttgagggatccttcctcttcatccaccttagtgagaaaactttattgagagacctctagctttggaaaggtaagttttctctattttcaaatggtcagtcattgctgaagctacaccttgtagcaagagagtgaatgcctccagactgtcaaagaaaggacgctatccactgccttccttctcataatccaggtgctacagagtcacgtgcaagcatcctccaagaattcattactacaacttggacaggaggagataaaggggctgcaagatgttctgagaggaagaatgccaagaaaatagggcaagaggggaaaggaagcaagggcatacctctttctggggtatgttgggggaggcaatgcagaagctagattacaaatgggtggatcataggatggcaaagcaggctttacgggtgcgggagaaaggtgagagggcagtgggccatttagataacaaggcagcacagatctttccttcgaatgcagtatcggctggatttcatagcagatgagaaaataaatgttgttccttcatatttgctactcagtaaacctaggcatgtccatctgaaaaatccagggtgtggaaggacagcatgtctaaggccccttttccttctagtcactcactgtggtcaaaagactcaatactggagtcagactcactaggttccaactccatctttccattttccagctgtgtgactgtagataattacttgcctgtttcccctggtgtacaaaatggaacaaaaactctctacttgttatacagatcacacatacaaagtgcttggtacagttcaccatacataacaggtgctcactaaatgtcacctatcactactgctactattatgattgtttctatataaaacatctcaaccaaatgaaagtgttcatcttctactactgaggggacctgcaaaatggaacagctcccagggcttcaattagtgaaatgcaaacaccagaaccctagacatcctggacctgccagaaaaaagcgagtaagatgtctcggaagaaacacagattcgctggcttcattcttgattcacatctacttgcaggaaggtgaaaggccttaagagttacatgcaaagtatttgcttacctattttgtttgagagaaacaataaacttaagggaatactttatcaaccatgtacataatacatacgagcatttacatcacttttcctctcaatcattatttttaaaaatggaaaaagaaaagcagatactacataaaactttcaaaagccttttgccacaagctaatgctgaaaaatggaatttgtattttattagttttccacaagaaaatgattgtacagtacaaattaaattgctcttttgcaaggaatctgcatagagacttccctgaagggaacaaaaatacaaaaggcattctttttatgagagaaagaagggaacttttattcaataagtattcaaggatgtagctttccagtcttcaatagggaaagaaaaatagccgtcattttggttaggaaatatccctaataataacaaattattttcaatcagagctccaaagaccaggtttctctatgtgcaagagaagcacaggaaaaagagtccatgaaaatctacttggtttttctcagaggtgtagtatcttgacacactcaatctcaaaaaccaaggctctcccagcttgtgtggtctccagcagaagccaggagagatgcttagttgcatttcttttaaagtctcttttgtcgcacacacaaaattaaaaccagtaggtcctgggctagccagcttcatgggcgcctggcttatagagccaagggcaagctatggctgcagtgccttgagagcacagtttagagaggcagtgaaatgtagacacttctttactggcaatttttgagaaataactgtgagaaaaaggccaagagtttctctcactgaacacattgaaagtaattagagaaatgtttaggaatcacaataaatgctgtggaaaagtgaccacttgcgaggcagtagaacatactggttatgagagtgggatctggggctagaccagttcaaaaccccacctctggctttctcagtgtgaaccactgggcaaacttgaccttacaatgactctactttttcacctgtaaaatgagagtaaaaggagttcctgcctcatggaactgtgatgaagactaactgggtgaatagagggcatggtacttagatctgagttcccggcacagagaaagtgctgactaagtattattactggcacatcaacacgctaactcttaggtgtggattccctctaaatgcttgctctgcatatgtttttccacaaatatttattgagcacataccaagcatatagctctgttggatataataaagaggcagaatatatccatggggtcagaaaggggttttatagtttgtttgtttttttaatagaaatgtcctttggataaaatatgaactcacataacacaggccacattcactgactaaaatgtagtaagaacagccattaacagtcaaagggaaagcaaaaattcataataaaatctgcaggatgtacccatatgcccacacagaaggaaattatagccttaaatgcatttattagagaataagagagacagaaattaattatgctttctatgcatgatgctgtaaaagttaaaatgaaataaattaaaaaacaaaagtagaaaattcaacagtgttgggacaactggatatccacatgcaaaagaatgaagttggacccccacctccacaccaaacacaaagattaattcaaaatgcaccatggacctaaaattataaaactcttttaagagtaagataaaaaagcagtaaatcttttttatcctgggtgacaccaaaagcacaaataaaaaaaaaacagaaattagacagattagagtgtattaaaatttaaaacttttgtgctgaaaacaatatcaccaagttagtgaaaagacacccatggaaagaaaaaaaatactggtgaagcatttatctgataaggtccttgtatccagaatatgtgaaaaacttctacaactaaacaataaaaagacaaataatccaattaaaaataggcaaaggaattcaataggcatttctccaaagacaatacacagatggccaacaagcatatgggaagatgctcaacaaatcaaaaccacaatgacatcccattcatacccactaaaatggctataatcaaaaggacaagtaagtaacgatgttgataattggaagtgtcctgtatgctaatataaaatggtttagccactttggaaaacagtctggcagtttctcaaaaagttaaatttatgatatgaccaaatgattccctcagtatacagccaagagaaataaaaacatacatccacataaaaacatatacatgaatgttatagcagcattattactcataatagccaaaaagtgaaataattcaaatgttcactaactgatgaatgaataaaatgtggcacacccatatgagaggatactattgggcaataaaaaggaatgaaatactgatacgacatggataaacctgaaaacatcacgctgagtaaaagaagacacaacatgtcacatattgtgttattccatttatatgaaatctacaccataggtgaatgtatagagacagaaggtaaatcagaagttacctatagctgtgggagttagaaggaaatgggatgtgactattaatgcatatagggtttctttctcggggtgataaaaacattctataattttgtggtgacagttgtacaccttgagaataaactaaaaaataatgatttttaaaaataggtcaattatgtagtatgggaactatatttcaataaaactatttttaaaaggtagaaagaagaaataatgaaattaaggtagaaatttatactggacactattggcaataaggaaaaaatagagacaaaaactgtttctagggaagcactattaaaatagaaaaacctttggcaaataggaccatgagtggggaaaggagaaatcatatatgatcaaccttaggagcaaaaaaggaggcaatacaaatattaaaaagatttattttcatgtataagagaataccatgtacaactttataccaattaatttaaaatctagacagaatggttcattttctagaataataaattaatgaaactatcttaagaagcaatagaaaatgtgaatagagcaatgactgtaactaaaatgaagttaaagaactatctcctccttcccttttcctagctactgcaaagaaaaaaatacgtaccaggccaggatattttatggacagattttaccaagctttcaaagaaaagtgtgataccctttatacaactccaaacacaaatactttccatactgtttattatatattttctacaggttcatacatattaagaataattagaaaaagatctcagatgaatatttaaaaaatgataatctatgattaacagaccaaaaaatatatatagcacagtgttgagatggtcaaaggggacaatgaaattcacgatgctgcttccattttgaataaaaaaatttatatgacaatctacataataaaaatttgacaattatttggaataaaaaattaaggtattatttggaaacatgcattaaattttctgtctagttgattgaaccatagaacgtagataaaagggaggcattactgccatcgaacagaaagttattctaattgtaggtaaaatccctaagaaactgaaaagcctacatgctggtcttgtaagcctgaatataaagttaaagcagaactaacaaaaaggaatagccttgtctttctttgtgttgctataagaaaatacctgagacagtcgtttataaagaacagaaatgtatcatagttctggaggcagggaattccaagatccaagtgctggcaagtttgtcttttgagggcctggtctctccttccaagatggcgccctgttacagcatcccccagaagggtaatgatgggtcctcacatgacagaagactggaagaaaggaaacccactctctcaagtctgtttaaaaggatcctattcccatccatgaaggttccaccctcatgactgaatcacctcggaaaggccccatctcttactacatattggccattatgtttcaacacgtgaattttgggtgatacattcacattatagcactttgtaattttcacaatatcaaaatttccttagttctaagatgtaattaattataagattcaactttcaatttatggcttttcaggggaaaagaaaactacggcattaaatatgcacatttatgtttaaaaacatccaaatgcaaaaaaaaaaagtatctgaggatcaagaaatattggtgttatatgacaaagaagacactaataaaaatgaaaaacactcttccaatgataacatttgaagctatgttggattctacagcaaagttgtgcctggataatgatgtttagttatatattgatattaatatataatgattatttaagaaatagcaaatactgctggagaaaggcaagcaaaacaaaagtgcctcaatttatctgatgctttttaaattggccaagggcctaaaaataataacagagaaacgatatcagagttgctactgtggatgtttttcctggcttgtggaatacgatgactttcatataatgtcagagacaaataataaatcacttcacagttatttatatattcatagagatgggggttttccttataagaacctttgatttccatcatataagaaaaaagaaaccaaaaacaccaacttgaaatgctattttcctactggattttaacttgaattgccacaaatgtgtgaagaagtgaactgcttatttaaaaaaaaaaaaaactattgacaagtctctggcttttattagtcaactggaaaatcaaacagcaaatggggaataaacaaaattcctatgactgtaaatttcaacaagaagtgaaaatagaacagatgtggaacattttccttaatgtgttactatttagcagtacttccctccaaggtgcaaaacatgaccatcttcttggaatgtactcaaatgggctcttttacaggctttccaagaaaacacaaaagcagcaagcttccagttgttatgcctgaaaatgactcatgccatgaaaatatgcaacttaagatagctaatgagagaagaaccattctacgacagctctaacaaagataaagttccagaaacttcaaacatttattgtacaagggatgtcataacgaccctttcaatttgcatgacgagacctcactataaatgacctgttttacaagaccacatccacttatccttaaaattgcacaatttacaatgaacctgtgctggtatcatccttttgtattttgtgttgtgactcttgctggcttcagaacacaaattatggctctcagcatcatgttcaccatgtgcatctttgaaaaatttcacctgtgaaactttacactacactcacataccagccaaatgagttcctgaaaaaatctgccacagtgaataaataaaggggggagaaattatagatttgatacttgctggggagtatgatatgaaagtaattgtgcttcctgtaggccatgcacaactgtaagaagtgctcttcttcctgcagacagacaaactcaatgatggagagcctaacagttggcaataaaagaaaaaccagcccttgtaggccaaccagacccttctagagtgtctgacctacttttaaagcatgctgaagggctttcagcagataagagttaatgaaggagagagaaaaaataagtctacaatatcacacttactatttaagtgtgcccatcagtgtgccttatattagtaaagtatacattgtccaactcaggttcaatggtagattacttatataggaaacatatctcaattgcaactgctctaggaaacatcaaatattttgacgaaagaattacagaatcaaactctgaaatgaaagtccacttctacccacaacccagagaggagatccggcgagtcctactttgtgcagggtagttacatgtaaaacatcccttccctcctcctttgcatccattcaactctgcctactaaatgattatttcaattagcacagaatgtgcatttctactcatcagatacatggacatatttttgcagtttgagcacctactatgtgccagagcctctcttggtgcttttcatgtattatgttaattaactctccctacaagtctatggggataatactattgtcccaattttataaattgcaaaacctcgggtaggaacttatccaagatcacaaagccagaggacagaagggctatgagtcaaacacgtatctttccacatccaaaacctatgtttactcagcaaccactgcaccgtgcctctcagtgccctgaaggttattttacttttactttctttatttttttattttgtttatttatttatttttttgagacaggatcttgctctgtcacccaggcaggagtacagtggcacaatcttggctcactgcaacctgtgcctcccaggctcaagcaatcctcccaccttagcccccagagtagctgcgattacaggtgtatgccaccacacccggatgtttatttatttatttgtttgtttatttttgagatcgaatcttgctctgtcacccagactggagtatagtggcatgatctttgctcactgcaacctccacctcccaggctcaagtgactctcctgcttaggcctcctgagtagctggaattacaggcacccacaaccacgcctggctaatttttgtattttcagtagagatggggtttcaccatgttggctaggcaggtctcgaactcctgaccttaagtgatccacccgcctcagcctcccaaagtgctgggatgacaggtgtgagccgccgcacccagcccggctaatttttgtattttttgtagagatgggttttcaccatgttgcttaggctggtctcaaactcctgagctcaatcaatccacccaccctggcctcccagagtgctgggattatgggtgtgagccaccactcctgacctaagactgcttttcctgacaattctcttgaaacccagatactggtcaacactgatatgggtttttaaagcaagctccaataactgcctaagtccctatgattttttttccgattctgacattttctatatattttgaaaatatatgtacatgttaaataaataacaataacataattcactgtaatatggtttgggatgcccaggtaatccccaacactcatgaatctagtgtgcagatggacatccaagaatagtgcctccctgtcaaatagctggtacctaccccagtctcttgcagagaagaaaattcttttctcctgactttccccttcctgctacaggtcacaccactccctgaaactgctattgtatatgcccctgaagcaactttccaacaggcaacagtaaaggcaggcaatgcttctgttaacagaagtggtatcttcatcaccttcaacatcatcctcactcccatcatgaccattacacatcacagcagcccccattatataaagtgcttacaggagtccaagcactgttctaggcctcacaacaaccctttaaaataggcattgttatctttgctttgcaaatgaaaaaaaactgagtctctgagaaactgacaagggagtgagaggaaataaaacacaaagctcactgactattcttatgtgctccctactactaccctggacaagtaaatttctttaattgagtcctatgtctatattttatcttattctctctttttggaaactcacttctggtcctcatttgttcccatcacaagaaaaatttcttaggagaattgatatgacctcaagtgttcctttgaacaaatcaggtgtttcggcttactgcgtattatgcatgcggccactgtctttccttttgtactacaactataaaaaagagaatagcacataagaaaagagaagaaaaaaatgtcagaataacttaatgaactgttcacctaatttaagaataggtttaaaaaaatgttttaatactacttaatcctcgtgtgattctcaccacaacctacaaagcaggtatcattagccccattccatagaagcagctcaaaaaggttagacaaccagtgcaagcacagccaataagcaatagaatcaaaatttaaaacccagttttttctacaaatcagaaagcaaatgacaatccgattaaaaagacaaacggggaccgggtggagtggctcatgcctgcaatcccagcactttgggagggtgagacaggcggatcacctgaggtcaggagtttgagaccaacctggctaacatggtgaaacccagtctgtactaaaaatacaaaattagccaggcatggtggcaggtgcctgtaatcccagctactagggaggctaaggcaggagaatcagccaggaggcaaaggttgcagtaagccgagattgcgccattgcactccagcctgggcaacaagagtgaaactccatctcaaaaaaaaacaaaaacaaaaaacggacaaatggaaaaagacttgaataaaaacttcatgaaagaggatatccaaatagacaatgagcatttgaaaaagtgttcagtatcattctacatcagaaaaatgcaaattaagatcacaatgagataccactgcacatccaccaagatatgcaaaaatttaaaagactcataataccaaatgttggtgaggatgagaagcaactggaactcttacacggtgtaggtgtgagtgcaaattggtataactactttggaaactatttggcaatatttattacagcagaacatatgacgacactgtaatccagcaattctactcctagaattgtgcacatatgtccattgtataagaatgctcacaacagtagctaaaaactggaaacaaatcaacagaagaatgggtaagcagatcatggtatattcatacaatcaaagactacacagcaattaaaaaaatcaaactactgctacattcaaactacatggatgaatctcagagagtaatgttagcaaacaaagttacagcagaagaatacatactttatcattccatttatatgaaattcaaagacaggcaaaaataatccagggtgatagcatcagaatcgtggttacttttgggaaggaagggaagcgttcaataagaggagacacaagggagctgctgaaaacctcagtgttcaaaatattgacctgggaaatggttatatggatgagtgtgcgtggtgcatgtgtgtgcgtaaaaatttaccaaaccatgcagttaagatttttataacttgctatatttatttcatctctatctctctctctctcttttttttgttttttttttgagatggagtcttgctctgtcacccacgctggaatgcagtggcctgatgttgactcactgcaacctctgcctcccaggttcaagcagttctcctgcctcagcctcccaactagctgggactacaggtacgtgccaccatgcccaattaattttttgtatttttaggagagatggggttttaccatgttggtcaggcttgtcttgaactcccgacctcaagcaatccacctgcctcagcctcccaaagtgctaggattacaggtacgagccaccgggttttttttgttttttgtttttgtttttttttgagaaaaggtctggctctgttgcccaccctgaagtgcagtggcatgctcatagttcactgcagcctcgacctcctagactcaggtgatcctcccacctcagcctattgaattgctagaactgcaggtgtgcaccaccatacctgggtaattttttgtagagatggggtctcccaatgttgcccaggctggtctcaaactcctgggctcaaatgatctgctcatcttggcttcccaaagtgttgggattataggcttgagccatcacgccctgcttccttcagtttttttaaagggtctctgttagaacccgcatatgactagcacaagcaattgttcacaatcgttgcattctactgccagaatctggaataagagaaagaaactttgatgtgcccggacaggccagacccttaagtatataatacaaattcagaacaaaacagcaattattatatcaacaacattttttttttacctactccatgttccttagatatctaactgtttcttgatttataaatgatccactcaacagtaagctaagaagttacaaaattcccctacagcatccttgactcaagtggattggaatggggtatctaattctgaagcaatgcaagacactgaatgcccacctttcaatagctcgcctctgggagaactagaattgaacatcaaacaaaaaagttaatgaaacctgtattagccacaaacttctatccactggggaaaaagccatctagattcccagaattagctagggtcaggcaggcaacactgatagaattcgaacagaatttcagtccacctgatgatttcacatgatgtcttatttccaagtcatattatacatttaaagaacactttacctacaactcaggcagctattttttttcaaaattccactgaaacagatatatctttttttttcccaagtcactaattaagtgaacttgagactgtgtaaagccatttcgagatggaaataaggaatatgtatccctcaagtcaattgatgaaatctaagaatacagaaactgcaactccaataattctataaggtctgtttgtaatcttatcctatgagacgggaaaggagaaaaacgtcaggttcatttaggtacaaatatagtatatagtatatatacagtatatatatagcatatatatatactgtatatagtatatatagtatatataggtatatatagtatatagtatatatacagtagatagtatatactatatagtacatatacactatatagtagatagtaatatagtagatagtatatactatatagtatatagacactatatagtagatagtatatatagtagatagtatatactatatagtatatagacactatatagtagatagtatatatactatatacatatatacatacatatagtgtgtatatagtatatatactatatacatatatacatacatatagtgtatagtatatgtactatatacatatataatatatagtatattatatacgtatataatatatagtataaatagtatatagtatatatacagtattccatctatgctgtatatacacatatggtatatatgtgtgtatacacacgtgtagtactatatactatagtatatactatatatactatatacatatatagtatatatactataaatagtatagtatactatgtgtatatactatatgtacatatatgtacactatatactatacatatactatatagagtatactatatacagtatatatacatatatacagaacactgtatactgtatatacatatatagtatgtatgtatactgtatatacagtatatatagtatactgtttatactgtatatatactatacatacacacatgtatacacacacatatactatatatgtacatacagcagatagaatactctatatatactatatactgtatatacacatatatgacactatatatactatactagtatatacagtatatatatactatactagtatatacagtatatatatatactagtattatatatactatactattatagtatactatatatagtgtcatacatgtgtatatacagtatatagtatatgtttatatactgtatgtgtatacatacatagtatatatacacatatatagtcggaggaaagaaacagtggtggttattagtgggggttcttgtaaccaacctgactgagctgcagtcctattcgataattgtaagccaagccacttaactttattagcctcagtttcctcatcagtgaagatactaatagtaattacttcctttataagatttctacaagtattcaataggaaactataatgaaaacacttagcataaacttggtattctgtaagtgctagattcttgttttaatatgtgcacaatatctttcaggctagtctctctatactttaatgaacacgatctatcaacatagtaacaaaatctcaattctagactaaaaacactgatataagtaagggggaagagagacaaaaacataacattcacatataatcccctttctcccaaactataattgtttgattattttttattttttggtataggttgattttccttttatagaaaatatcaaatttacagaacagtgcaagaataagaatagtacaaataacaccatacacactttactcaggcttgctggttactaacgttttaacctaccagcttgtcatttgtcctctctctccctcctcccacacataatatatttgtaaccatttttaatgttttgtagccatttgagcataagttgcatcattcaccatggccatttacccctaaatacattagcatgtatttcctaaaaataatgatgtgttattggttaattttaaatgcaataaaaaaatatgtcattgatcattttaaaagtctactttattcatattgtagtgaaaataacacaattgacgttttcttgtttaaattttgggcagctcattccccaacacaaactaggtagggcaatcagaacacaattggtgaaatttccttacttggaccacagaagaaatacacacaatccactatagaagccagaaattttacttacgtttattgaacacatttgatacaaggaaattttttaaaatatattatttctcattctcttgactcaaatgattcttgggaaactaaaatatcctttcctcaaaataaataatacatggtaaggatactgtgaaaactttcatgtgccttcataaatcgtcatggaaattgctttataattgcaacaaatcttgatggaaaatgtcagctaaaattataaagcaattaaataaattaacatgactgccaaatagatatattagtatcctacactcagccaaatactaatccatatgttattaggaggagactcttttttaaaatttaatatgttaatttttaaaaatggtctttaaggtgattgcaggcagaaaaataaaccaagagcttggactgtggaggtggttagaactaggtttgaatctgagttccatcattatttaactgtgcctccctggagatgccactacctaagctctccacacctcaaatgctgcactcatactacagaatacagaatacaggactgataacactatgccctacagggttcagagatggctaacacagcttgtaaatcacttagcacagtgcctggtgcatacagtaagtgctcaattaatgacagatgttattattaagtggtgaggtctgatctaacatgttttcacaagaagattataaattaccacaactctaattaaatttaatctaaaactcccatggctttcccttttctacatccctgagaaccttacaataaagaacaccagccaaaccatgtttatttgaatctattaacagacacatataaatcaagtccagtgttatgagcttttacgtttgtaatttttttcccattttttctccaataggactctatccactcagcaactatacaatggcaattagggttaacaacgtataataagaaatacaaagaaacagaacattggggaattagctgatgctgggaaaaggcaaaaaatgtgctgtttcaagcatgcctattattggctaaatcatccaattattaatcttcactatattcttgcctggcatctagtgttgggttgttactcaacaaatgccggaaagtcagttttttaaaacttagcttgtttaaagaaaaaaaagaatcttcatataaataaggcctcaaagcctaaagagaaactgaaaagagtgtttgggaagtcatgctagaaagggaagggaaaggggtaaggaagaaggatcagtcttaacagagggcctacaaagtatcaagctcatggctgggtgcgtccatacttcttctaaacatcagtaaagataatgaggaaactgagtcacaggaagcatgagtaacctgcccaagccaacaaaactggtaagtggtagaacctgccagcctctcaggtccaccacacctgaaagcccatcacatctgaatgttctagactcaacaagacaagcgctaatgacacacaggggcagggcatgagtccaagtgtactatgctgaatgggccctgaaaggtggcctgaaggtgctggaagggcctttccagtggttctcttttccattacatacgccattgtgctaaagtaaactaatagtacaaatggctgtaaaatgcagtggtttaagataataactttggggtctatcagactgaaatcaaactcagctctgtaagtgtatgcacttgagcctctataaatctaattttcttcattggaaaatggatataataatagcttatacttcaaaagattaagaggataaaaggaaataatgtaagtaatgtgtttaacagagttcctgacacattgggcatactcaataaacacaacttggtttttttaaaaaaaggtatcaatttttaaattagaaagcatggtatcagataagttactcagcctctctgctccccctttacctcatatgtaatgacagtaataactaccactagcatcatggtacaactaaccaaacaatatttgtaaagtacgtaggctctttactgacaaagagtgatgaatgccagctgccctgtctagtgcagaatttagaatttcagagccgatctaaaagctttaaaaaaaatggctctagataagctgtaaggagaaggactgataaaatacataagatcaaaaacagaaataaaaaagacccaggcatggtggcatgtgtctgtagtcccagctactctggaggctgaggtgggaggatcacttgagcccaggagttggatgctgcactgagctatgatcatgccactgtaccccagcctgggagacagagtgagactgtgtctccaaaaaaaaaaaaagaaagaaagaaagaaggaaagagaaaaaccaagcaagaaaaaggtaagtaaggtggagtatcaatagaagtaactgacatggactagcataaacaaagccttgtaataaatggcataatccacccatcacaatgtcagttttattgctgacaaaagctacaatggagaaaatggctttagatctttgttaacaaggggactgttaataaatcacccccaaaattacacttaccaaacccattccccagcaaatctcaaaaccactgtcttccccgtgagacccacccaaagatttccagcagggatggacagtgaatgcacgcttccctgggatcagacagagtccccaagagaagaggaattgtcacggtcaggaatgtccaggtccttctcataaactcactaacaggaaaactcacttctcccctagcaagaggtaaatatagattccacacttcaatgctcctgaaggggcactgtagaaatgcaaagtggttttctgctgagttgtcacaaatatgggggatgctgctggcatttatgaggagggttccagggatgctccaagttcctcaatgaataaaactccagaataacaaagaaccttcccgcttccctcaccaccttccagtgctccatcggagagtcccatggataaaaatgtgtttacacttatctgagcccatactctaagctccaaatcacatctaaacaaaaagtattgttatctaatcccatgattttttaatttggcacaaaactccttgcctggactattaccttacttcgcgaaacataaatcatagctcaccttatacatggtgaaataggaaaccacgtacaagcagtgcagtgatatccttgacacagtaacgcccttgacatgggcaatcttgtgtttaaagtgatttctatgtacacagtttgtgctaaacattatgaggagtacaaaaacaaatcaaaagcctaagaattcgttgctagccatgaaagtcctctgttggaacatcctcttacacaggataatttggacagaaccacatttaaagtcacaaatatatgatggacaagggaacctcataccacaataagaaacattcacttctttgttctaatgcttgtcttcttaaaggaagcccactagcaaaccgatgcatagcaaatacgtttcaatggagaaggacaggtgtaagcaggcaaggggtgggtcagtaggtgggaggagtccccgtatcacagacaagccaagggcacatgggaaaatacagtcatgatgggtagaagagaaggggagaaaaagagtagaaagctgatcaagataaatgttgtttacattatacgcaacaaacatctgtggttaaatagaaaagagatagagtcgaagcgttcagatccttaagagttgtactttagatgaagccaaagttagagatgacatgatagagaaagagaaagggatagagagagatatcatgacagaggatccggtacacagtaggtacccaaaagctggagagctattgctattgttactagtcatagttttgccacaggctaggctttgtaaaggctaaagcaatccttttagacagcccttagtttagatagaggacaagggcagagaaacagcaatagagagaaagtttccagtgacctttatctctttatctgatcagtcctatgatgcttgcagaactctcaagttcatgagttatgaccggaagcattccaccagtgtccaacacaacctgaacacaggtatgcacattccaggagacaaactattttccaacatccagttctttatcctggacacttgctgacaaataggtctagttcatgttatcagctctaattgtcaaagatcacaggaaaagtggttgattttaggcaagccatcctggaaacaactatgtttaagagaaaactgtaagttcaaatagaactaatggtaatttatggtcccatttaaaataataggcaatgatagcagatgctaaaatgcccttttgaatatggctatcttataaagaccagtatcacctatgtttaccacatcaaatttaaattgccttgtagatcaaacacatgtaatccctccgtaaagtcctttaagtcaatgatcaatacctcttagactggttacaatggtctcagtattgggaagagccttgatgaacaaagtgttaagctgcagaacaaaactgacttatcctttcctcttttaggtgacctttgcttgaaaagaaagatgacagttgagtccagaaaagtgaggaggaatgggaggggcattgtacagcattccagagaaccagaactactggatgagttgtatctcgttttgacagcagcagtatagtaaatgacaagccctgtcaggtaatgcatttatcttcatgggaaaagcggccattccaaagcaagaatctcagatgttgtcacatcagctaggacaagaagtcataaaacaagaaggctatcaatgcaggaggtacggtgatatctagactacaattaagaggagctgtgaacgggcactccagctccaagctcatgggagctttgacatttttcttgtgtgcttcgagtaccagccaagtaattagtgaagtccttatcagtcatctatgaccctttttggggctcaagactctgaccttccttatattctgaaagcgttatggtcaaagcaattctgctgtttttctcaaatgttaagtaaggaagaaaaaaataaaagaagaaaaagaaagaatatctttttccatttcttcatttgttcatgcgttcaacaaatacttatcctatagtccaggcactaagctaggagtggcctggtcactcagttagatacgctgcctgactcatgaaagttagaatctaattaggacaggcaggcatgcagcaggcactacaatcaggcacaaaacaggcatgaaggaggtcacggagtgcagcttggggagtagggggagagggcaacaggcccaatctgcagaagcaacggaggacttcgtggaggaagtggcatctggctaaaacttaaaaagaagactgtgaactggtcagatagataggcagcgaaataggaaaaaataatatgtactcatttataagaagacacaaagtgtgtttggaatatgaagtttgtagggttgaagcgcagagtgggaggggttgggaatgtgaccaaaactggaggaggagaaagagaaatattagccagatggttctgaggaatgagagaagtaggcatgtttacaagcattgcaaaggttttccataggtacacaaagaaaagatctaatggaaaataagataaacttagatatgctaagaaaatcatgtaatgatttttttgaatctgaataatcattattaaaattatattgtacaaccagtgaattacttgaacatcagagagaatatacttatttttaaggtattgtgccttccattgcttccaaacccaccagataaaacgtcattattttaagcaactagagctctaaattcagccatcagaaacttttttttttcttttactctcaatagtctgtttgtatattactctaatcaggctattactaataacacccaacttgagagttacaaagaattggtttaaccctgacaatgctacttgctgtgtgaccttaagcaaactattaacctctcttgagcctctgtttcctttaataagactcaccttataggattgctatgtgtatctgataagacagtggttgagtcagtactactatttccattttactgaagggtcaacgagattcagagaggttatgtgacttgtgccaggccacacagccagcagagtagccctcagacttcacaacaggcccctgaactcattctgcatctgcatctcttttctgttggggtttttctagtggtattttgaatggtaaatataattaaatttcaactaacatgccctttcttcttactgtagaaataataaaagttcttgaataaagggaagataaaaggggagtggagaataataataactgtaacaaaaatagcactggatgaacactttaaacaggtaagttgtatggtatgtgaattatatttcaacaacgccgttacaaattttaaaaagtaaaatagcagcagatgaggaatgagtaatatggcatttcaaatggtacaattttgagaaagttcaattttgttgcttcatcttttggccagtaaaacaggggtgctattacctgcatttcctttgccagagaattaagataaactgagccgtaagtggtaaagtgtgctatgatgcacatacagctccactacattatggcaatgctaaaaataacctgagaatgaaggagctttatttcttcatttccaatgacccatgagcctcctaaaatgcacagggaaagatgtctacccccaccacaagcacctgttcatgaggtcacctctgttcaaaataccgaagtcaatgaaatgtcagtggcaggaagttctggaatatacagattacacgagcccatttccctgcagcacagttacatcatcatcaagagaatgcattccccaaatccacggcttcctaatccattagcacaacaggctggtggagagcttggctttctcagtcacatgggccatagaatcaaaataaacacaaatgtggccagagtaacataagtcgaaagaatcccaagtaagccccagtctactcatgttcaaaggcacacacgctccaccagactccaaaacagacctcttctgaatttccttcccattttatgaagaaagtgtaaaatgaattgttacctgttttctcttttagtaggaacaccatttctgctttccaaattcctgatttactggtttcacagccataaaacatcaatgccaaggggctttataccagcaaaaacaaacatgatttttccactgtttttaaaagacagagttcgtttttgccccaattcctacatagtggtaagcttaaaatcaagccatttagctcacagtcaggtccaataaatcagtggaaaaaataaatgggagagcatgccaaaatgtaaccatggtaacaccacagatgcatcaagaaatggtgtgctcatttgcttcatccccatttcttaaattggaatctaagtaggggaaaaattacacagagaacaatcatgattctgcaattactgatttctgcaaaattgtattcaacctgctgtactataacttcagaggcagctacagggcacctatgaaaacagccctagatgacataagagtgaaaaagaccagatctgccacttactgaccctccccgtgactttgtttcttcatccgtaaaatgggtgttaaagacccccaacttcaaagggttactataggaggaatgcctgacagtgcagaagaagcagggcaatggtgaactcaggagactcgaagccctgatcacctatggctttaattttattggcttcctcattgcctcagtttcttgatttgtaaaaatagaatgataatccctgccctacctatgtgattagcattaggaattaattattattaagccaaaatataagaaattactacgaggttattactaggactacagtttataacttcaatgctaaaagactaaaagaactgaggaccacaagttcacattaacacatcatcacaacctcctctccgtcaaatgcagcttagccactccatggacagaggcaaccttggggccctgtcccaagttacttgcagcaaacctcttctcctctcatagcctctgttttattaatgagtaaaatggaaagccaggggctattctagaatctgatctgtggaggttatcatctagaactatagtctaagtcctttaaaatctacagaatgcctgagattagttctgcttattcttttacagaaagaattagctaatgtttatcagaaaacattagcactctagcatatcatttgcaagttttttttttaaaagaaaaccatttatagcaaacaaatcatagaaataaacacgatacctggaacattaaattattcttcctttcttttgctggttcaaaaaatggtatgtctaggaaaataaaggactgggtgatagagaggagaaaggaaaattctaagtaataaattctaagtaataaaaccagaatcattcttcccttgtattttaaaagaaattaaacaaccaggaacacagtgtgccacagtacagtgatacttcactacaacggagctgcgaatttatccaaccatagacagacaggctgcctttctttaaagacactctgctttcagcattcctatgttctgtgtcttgttttttcagatttggtgtaatctaatggtttgggggtttggattttttatctgtggaaatcatttctttgaacaaaattatacataaaatcctgacttatgaatctgatgaagttggccaaaaggagaaccctgggaaggaagacagagcccactggggtattcccttcactgggggtctccacaaaggtcagtccgaaggccgctggccaggtctactccattaataacagcaaatgttaacatttatggaggctcacagcacaccattaccttagaaaatgccttctgtgcctgatctcattgactcctcatagcagttccatgaagctagtattactaacacgtcctttccactaatgtgaaaagtgggccttacaaagggtagataatttgccccacattgcagagccatgactgaaacccaggcacaccacgacactgttattgaattatgatttgcttgagttaaggagtcactcagtaggccaaccaccaggtgttccagaaccagttgttgagatctcctttctcccctggacttttcacacacacacacacacacacacagcagtgagatgccaaagtccaactacttacaaggcacagcatggcggtaaaggttatcccttatggtctgctggagctcatgatcaggagaccccttctggaatcgctgattgagaaaatgtcgcaggtccttgttcagccttcctcctgcaggaaatacataaaatagacataccacatcaacacagggcctcctagaaaagaagtagccaagaactgattgcaagaaagccacaggatgcagttctagcctgccacccctagtcattaggaggatgtactttaggttttcctctgcaggggtaaagtcaagccagaatgtcataaagataaaacagcactggcaatgcattaatttagagatcctatctcacataatactagaaggccaaaatatcaaagtgtttaatgtaggctattacatttaaatatgtgccatagacacttgcagacactattactagaagcataaattactgaaaccttaaagaagacaatccagcaataactgtcaaatcataaaatgttctttgaccagggattcgaatggtaggaatttactctacaggtatacttgtaatctcttcaaatttccatgaatttactacagctttttttatttttttaatttttattttttgaaacggagtcttattctgtcacccaggctggagtgcgatggcgcgatctcagctcacggtaacctccgcctcacagattcaagcgattctcctgcctcagcttcccgagtagctgcggttacaggcacccaccactacacctagctaatttatatatttttagtaaagacagggcttcagaaccatgtagaacaggctggtctcaaactcccggcctcaagtgatccgcccgcctcggcctcccaaagtgttgggattacaggtgtgagccactgcatctggccctactatagctttttttatgacggtaaataaataaaaacaaagacctggaaacaaccaaaagggagcaattaaagcacaattcatccatataacaactactttgcataagctagattttcatgggttgacattgggagaaaatgtgtggaactgtgcataatgtctgattccttttctgtaaaaatgaatttggaaaaggagagactgggtaatacgaggaatcatatgaaagttttaacaacagtttcatgtacaaaaaaggacttgagctggggataaataagtagacttcactcttcatcacacagacagagagagagacatagacatagacatctccctatcctgtgttgcttttcaaacactaaatgtatgttgctttttggttgttgttgttgttgttattgttaagcatagttatctaagtgagtctgtgtttatttctttgcaattctctacacttaagagaacaaaagaaaagctaaaaatattatattatcacaaaaatgtgtcatagaaaagagatacatttgaaaaaatcataatcacaaattacagtctacaggatcaacagaaggcttgtagatcaacctaactagcattcactcttaatggagaaagatgcttcaatgacagctaaaaataactaggctgagactgtctttccatttttagacaagatacaaattaggtaagagcatttttagccttagagaaacaatgcagcaacccaggagtcacgtgagctacaaaactcatgccttcaaatggtaacttccctatggtcaaaaagagtaaatcatgaggatgacagtgatggttaagatgatggtatttcctacctagggcaggaaactactgatctttactttaatatcacattcaatataagattccagctacagctgctcattttgaaatagataataaaacccaatttgagctattttatttggtattctatctactgtttcaagtcaccgaaaggaaaaatacatatattcaaaccaatcttaggtcattcaatcattcatcaagtatttactgaatgaagacacccacatgccacatgaagccaccccccaaaaaaatcagcacaaggtttgaacagacagttcacaatggaatatatgtgactattaagcatataaaaagatgttagacatcattagtcattagaggaaaaataataaaatcacaatgagatcccactaagtaactacttgaataacaaaaagtaaaaagactgaaagtatcaagtgttggcaaggttgtagagaaacaggaactcaaatatactgtttagcaggcataatggttcgtcctcttaggaaaacaatttgtcaatatcttagaaagtcataccttcaatagccaagtgacccaacaattccacccttatttacatgacagaaatgaaaacaagtccacaaaaaaaaaaatctcgtagatgaatcttcacagcaactttacttacaaatagccaaaaattggaaacaacccaaatgtccatcgaaaggtgaatgaataagcaaactgtggtataatcaagcactggggtgttacatagaaattaaaagaaactactaatgcatgcattaatactgatgaatctcaaacacagaatgttgagcaaaagaagtcagacacaaaagataaaatattgcatgatttcattcatatagaaagttttgggatggactaaaaaattttggaacggactaatttatagtgagagaaaacagttcagttgttacagagagcggaaggtaggcaaaaactgactgcaaagggcataagggaataaaatctatggatctatgggtcttccccattggaaattgagaaaacagggtgaaggacttctacatgacttctatacatggaggattctatacacggggcctctatattattttttataatatcctgtgaatatataatatttttaacatcagtttttaaaatggggaacacaagggaagattctggaggagatgccaatataatattttctttttttaagatggagtctcattctgttgcccaggcttgtgtgcagtggcacagtctcagctcactgcaacctctgcctcccagactcaagcgattttcatgcctcagccttccgagtagcagggattacaggcatcttccaccacgcgcagcgagttttcatatttatagtagagatggcgttttaccatgttggccaggctggtctcgaactcctgccctcaagtgatctgcccacctcggcgtcccaaagtgctgggattacaggtgtgagccaccactcctggccccaatataatattcttgattgagattaataacattggtttatatatttgtcaaaattcacagaactgtatacataaaacaagtatgttttattatatgtaagctataccaataaaatcgatttcaaaagtttaaaatatatacagtgattggatgattggatgagtactatgtgtgagtcaatgttcaggttgcgtagttctctctttagagagttgaagtaaaggaaaaagaaagtaaatctaggtagttaagccagacgtgcctacttctgaatcctggctcaactgtttattagctggtgagtctgagaacagggcttaatctctgaaccttgctttcctcaactgtaaaaatagaacactgatgtaatattagctctgtcacaagattgttgtgaggattaaatgggatgatacattcagacagtgcctggcaaaaagaaaacactcagtgaaagatggaaattataattatgatgttgttgaatggacgattattgaggtgagggggcaaagaaagaaaatcagttcaaacatgaactcttactcttttttaaaaaaatccatgcaaaccaaatttattctattggcttagaaatagccagaaacaaaatatagacctaaggagatctggatgaaaggatatttctagtgtttctagaagtgaataaaaatctacctgtgctaaaatagtgtggacctatgtaaactcattaataaacatttagtgtgtggttaatgtattccaggcattgtgctggggctgaagttcaggaaatgaaatcaactagtaagtcactgatatgtgatctctctacctgctaactccagcttgaggtataaggcactctagaaattgagtaaaaaaataatgtttaccagcaaaattcccattgcctgcaatgtagggttttaaatttctcttaggtgacaagagttcttgacattaaaaagacactaacatttatcatttgagccacggcaaagacgtctatgatatccaaaatgcttaaatcaaaagcaacattccaaaggagttttcagatacagtaactttttatcacatatataacaaagatttgtacatccttatggatcatatgtggtaactatcaagataaaccagggacatatagattggaaaccattttactttttttatttttttggagacagagtcttaccctatcacccaggctggagtgcattggtgtgatcatggctcacagtagccttgaccttttaggctcaagcagtcctccagcctcagcctgccaagtagctgggactacaggcatgcaccattatgttcagctattttttaaatttttgtagatacaggttctcactatgttgcctaggctggtcttgaactcctgggttcaagcaatcctcctgtctcagcctaccaaagtgctgggattacaagtgtgagccaccatgccccacctggaaggcattcttaagtataagctcttggtttacacctaagcttatattcaaactagccaaggtagctagggtttatggtcatcaaactaaaactcccctctactgcagatgtgcaaaaagacagagtttactatgctgccagttaacatttactctgagttccatgacatttggacatgaaaagtctcaaccttcacattctattaaaaatactgtacattttggcatctaatctcaaattaattgccaattattcaagagacatgtctataaattgtctactaattgtcaagggcagtgagccaataaaataagttggaagacagtttgtcatagcatcttcactttctttgaaattcaagatttattttgtaaatagaaaagagaacataggtcagaaacacagtcatacactgtatagcaaagttccggtcaaagccatacttaccatgggtccaaaattacaacgccgtattttttctgtaccttctctatgtttgcatatgtttagatacacaaatacttaccattgtgttacaaatgcctacagtattcaggaaagtaacatactgtgcagattgtagcccaagagcaacgggctataccatacagcctaggtgtttagtaggccataccaactaggtttatgtaagtgcactctatgatgtgtgcatgactaaatcacctaaggccacatttcttagaatgtattccagtcattatgcaacaaccatgactatatatagaactttttccaagaaaggggttcagagtttattctaagacaattttatattttaactgaggaaaatggggcttagatgctctcttgatttgccgttattttatatttctgtatcttttttttttttttttttttttttttttttttttttttttgagatggagtcttgctctgtcctccaggctggagttcagtgacgcgatcttggctcactgcaagttccgcctcccgggttcacgccatcctcctgcctcagcctcccgagcagctgggactacaggtgaccaccaccatgcccagctaatttttgtatttttagtagagatggggtttcaccgtgctagccaggttggtctcgatctcctgaccttgtgatctgcccaccttggcctcctgaagtgctaggattacaggcttgagccactgagcccagctatatttctgtatcttatctatatatctggaattctgtgtcttctaaatttacagcaatgtaactctgcttttctcacccacatgagtttacagaatgttaagcatgtttgatggatgtagtttttcttattttaaatgttgtataatattcaatattaaaataaaccacaatttatttatccttcatagaaaattaagctatttccaatataaacaatgctgctataaatgtcattgtaatgcctccctcccctaatttttttttagcaaatgtgtggggtttttccctctagattatctaaacctgaaaatggacatagatatctttgatttatcttaacatttctgaattcatccccaaaatggtggtaccaatttgcctttccataaatagttttggtggtcctgttttcccacacttaggccaacattggctattgtcactatttttcaggtccccaagaccactcctgattggatgattcactaggaagattcggaggactcgttatatagttgtactcatggctatggtttattccagcaaaaagatacaaagtaaaatcagcaaaggaaaaagtctcacagaacaaagtccagagaaaatcgggtgtaagtttccaagtgtcatctccaaatggcattacacaggacacacacacattccccaaagaacccatatgaaaagctgcccaccggagaagctccttagacacccagggcccgggagttggtcatgtaagcagcctttgcctggcacaaaataaatctccagactctcggggaaaaaaagcataaatgatagcatttgggcatgcagtctagacatagtgagccactcttaccagttatcagaatagaagaaattccctgaaatgcaagttcccagatgccagccaagggccaccttagcattccatccagctgccactaactcttttctgcacattccaactttataaatgtttcccaatctactaaagataaaatgatatcttggtgttatattaatttataattactgattacaactgagagtgagcattctattatagtttttaaattgtcttttatgttttcctttctgtgacttgcctgttcacatttcttatacgttttcctattaggttatctagttattcttgataaaaagatattcttatatattctagatagggttcctttagcacttatttatggtataaatttttcttgccattatttaaacatgaaatgatcccctaatataactaagttgtgtcgtgtctctttttctgttacataccaactcttaccagaagcatcttttcaaggtgatggatgatgaggggaccctgcttggactgatctctatctcctaggatagagatctgaaaaggaatgttgctcagtagaaagaatctttgtggtcaagaaaccaggtttcccaagagaacacttttgagtcttcttaatgtatccatctgtgaccgagagggcagaatacaattccctgtgtgtattccatgtgctccacagctacatccacatccagaaggtcaaagaatggtatttcattacaattagaattgacactttaatacagttcaaattttcaatgctaaggagaacctgcataaggattttgaactaatcacactttcaggtgattctgctttagcacacaatttcttcaaaaaaatgattatagttgtaggaaaagtccatttattaggacaacaacaaatggtatgtactgcagtggtgctattacagcaaaaaaaaaaaaaatccatcagttcagcacttcagttttataaagaataggattttttaaacacaaaattataaattgaaaaacaaattagcttgttttatagtcactcaaacttacaatccaaaattcatttaagtgagctttatctgaaaaggatgtttgctacttgctttttctaatatatttttctatatttttttcttattgtaaaagcaatataaatcactggagagttaccctttaatgggtgcggagtttcacttgtggatgctgaaaaagttctagaaatggatggcggtgacggatgcacaacaatataaatgtacttaatgctacagaaccacatacttaagaaagggaaaaatggtcaactttatgttatatatatttaaccacaatgaaaaagcaatatgaattaatcacaagattttaaaaatacacaaacgtacaacaaacaaagttaaaatcacctgtgacttcatttacagcacaattaatattttggtacagtgtcctctgtatgcctatgtacctataaacatacatgcacacttataatacacttaaacatttggggagtttcattcactaattcaacatgtatttattaagtgcctagagctaaacaccctgtgagccctgaggatgcaacaaggacaatacagagcccctgagcagcagggtatatgcctgctttaggaaggacgaacagacatgacctccaggcagagacaattgttaaggtgagaactaaaggaggatgagaggctagctaggtctgcaaagtgttggggaaagactattccaggcagagtgaatggcatatgcaaaagtttcgaaggaggaaagaggttggtatgctagagaaacagcatgaagctcagacagagggtggctcaggttgaggttaaaaagagaagcactagtggataatgaaaaatgtgatatctatacaccatggaatactactcagccataaaaaggaacaaaataatgtcttttgcagcaacctagatgaagctggaggccattattctaagtgaagcaatggaaaaccaaataccatatgttctcacttataagtggaagctaagctatgaggacaaaaagacatacagagtgatttaatggactttggggatgtaggaggggagattgagaggtgggtgagggataaaagactacacactgggtgccgtgtgcactgctcagtgacatgtgcactcaaatctcagaattcaccactaaagaactcatccatgtaaccaaaagccacctgtaccccaaacactactgaaatttttaaaaagagagagagagaagcagtcgccagacaattctgtgccttgcaggccatgataaagagcttgcattttattctacgtgtgtaacaatgcactgagaggatttgagccatggaggtagaggacgtggtctaaatatcaacgtttcttttgcagttgtgtagtgtgtatgcacacgcagggtcatgtgtagaggtggaagtcagaagaagccagtagagctgatgatcacacaagtcctgaagtagcctagactaagggagtgtctaggaagaaggacaggaaggggcagagaagagatgtaatttaaaactagaactgatacagtttggtgacatgatggaggaagacaccacatgcaatggagtcaaaaaggaatccaatgtttgtgcttaactggtaatgaacagctttgagtggaatacagagatctattaggtatcttttaagtgtaggatgtgtaggatcatgccacatatatggatttatatctatgttttctaacaaataattcatgagcatttgcaatattagtgtacaaaaatatagttttaagggctacgtagtattttatctcatcaattcatcacaacctatttaacctattaccaattagtaggcataaaaattgtttctactttgattatcctccttgaacaaaatctatctgtgtacttctgattatcttcttgagatctttggagatattgaaacaaaaagcacaaaaaatgtttaaggcccttgatacaaattccctccagaaagatcatattagctttccttcttccagctttattttaaatagctccaaagtaggtacgtaaactcatggcaatattatgagtttcatgttaatagacatttgtggccagatgcggtggctcatgcctgtaaccccagcactttgggaggctgaggcaggtggatcacatgaggtcacatgaggtcagcagttcgagaccatcctggccaacatggtgaaaccccacctctaccaaaaacacaaaaaattagacgggcgtggtggcaggcacctgtaatcccagctacttgggagactaaggcaggagaattgcttgaacccaggaggcagaggttgcagtgagccaagatcacaccactgcactccagccggggcaacagaatgagactccgtctcaaaaaaaaaaaaacagatatttgcatgtctttctttaaaacaactattatacataatgctgtaataaaaaactttaaacataaaatttgctgaaatttcctagaattactagattgatgagtatgaatattattttaaaggttcttgataaatactcacaaaatgcattacctaaaggttatggcagtttctaccaaatctggaagaaattcagcatcactcaactgacaattacagtgtcaaaatgagactaatttttcccattttaattatggtttttaagaattttccaccaataatttgaacagatgtcaacaatgtattaaagagaccacatgatggtaaaactgtcccctttcattttgagaaactgcttgttctagtaagaaaattaatttggagtatggcttagtgagaaataatgaatgactgccatgatcatatttattcaactaaaaaaacaaaaactctcacatctaaaaaatacacaaataaagaacattcagtggatgtgttctttacacaattacttccaacctcccttctctaaacattcaagcattggtctaggtcaggggtcagcaaaatatttccataaaaagctaagataactattttccagccttgagagtgcacatgaactctatccaactgctcaattctgcttctgtagtgtgaaagcagccattgacaagatgtacatgaagttgtttttcagtgaaagtttatttacagaaagaggcagatttgtcccttgggccatagtttctaaatcctggtctagatgttggtcatgcctcttcaggtaaggaattctccttaagtaattgttggggtagagttcaagtaatacttggtgtggaggtggagggtgttccttgtctcccaggttagtctatgccagtggttctcaaagtatggtcccatgagactggcagcagcagcaatacccagaaacttacatgaaataaaaatgactggtctctaccccaggacttgatagaattagaaattctaggggtggaggttcagcaatctgtgttttaacaagccttccagatgattctaatacctgctaaagtttgtggaccaatggtctcagccacatcaaaacgtcctaatgaaatatggggagctaggctctatttctcacagcaggtcctcatctcttgctaatctcaagtgctgccaccccactgtgcggctgacaataacaggcacacaccacacatgactccagacacggggtacctcaacacacatgcagagatggaagctattccccgagtggtacaaagactattgttcttttagtcatgtttctgtaaaagttaaaaaatacaaacaaaaaagaaacgtgtggtgagtgtgatgtgagagagaggctgcgagacagatttatgtatgctgatgaagctcaagaagctactatttacatttaactccccacatgagcaagcatgaaacattttgctagcacttcaggaaatccactttattattattttctgcctgccttctctgttcttttctcttggtgaatctttttattataaatttcatcccgcagtgagaaaaaatttgaattaagcatggaaagaaaagcaagcttaggtttaaatgccatcatcttgattttttcattatttacagcctttggtgcttcttgtatttattccagttacactaagatagtggaataacatctgttcagaaaaaaaataacaaaggatttatatacagaaagcagaaagacaatgttcccctattggtaaagtaatatagctgatgtgagcttatggcatgccctcgtaaacagctgcatagcctcaccaaaagctgaaatcaagtgtctctacattcagaatgctgagtggaatctaaagatacgggtgtctgtgccctttgagaatattctaaattcttgaaaagatactctattagaattctaactggaccaattggactcgagatgacagtgaacactgattaagtactttcaatgagccagatagcaatatgaagcaataactttataatccttactcccacccaatgagattactagtctcattttacagaagtataaactgaggctcagaagttgccccatcacccaggtagcaagcaacagaggagacgggactcaaatccgggggagtatgactgtctgtgttcttgaccagagaggtctaggaaatgttcacaatcagaatgataataaagacaaaccaggaagcaccagtatagaaaataaaagcaaaaaaccaacacatattctttctaaattcaagttcttgtacttgcaaaggtttttaagccagtgcctgattctgggaagtctcccaaaagcatagctggtgctgtagaaatttgttgatatgatcagtgtccccacagagtgtgtttctttcagtagtatatggttaagagtgctgaacttcaagcgaggcttgattagttcagatcgaggccccaaattcaccagcttgccttgggcatgttgctgaacttctctgagcctcagttccctaatctatcaggtggggataataatagtatctgctcaaaagggctgtgcagcttcatgagatcatgcactaacgcaatatccagtataacacatagtaagtgtgcagtaaattgttacttttaccaaggctcataacaatgcagtgtgtaagcttgattagatctggaatttaaaaaaataagaacaacagagacgtttatggctcagctaagggaatgttgactatgaactcaaagttcgatgatgttactgaacgaatgctgataagtgacaactgcatcatggcttgtaggaaaatgtcatcattttgtggtaatttttggttatttggggatgagttatcatgatatctgtaccctaaactcagataacctagcaaaatggaaataggtgtaaatatggacagatggcatgggtgtagcaagatgttaacagctggtgaatcctggtgatgggagtacatgttttgttgttttttcaacactagcgtgggtttggaaactttcaaagtaaaaaagtaaaataaaatatatatatatatttctgagacaggctggagtacaatggtgtggtcgtggctctctgcaacctccacctcccaggtccaggtgattctcccacctcagcctcccgagtagctggaactacaggtgtgtgccaccacatccagctaatttttgtatttttagtagagatgggatttcaccatgtcagccagggaggtctcaaactcctcacctcatgatcctcctgcctcggcctcccaaagtgctgggattacaggtgtgagccaccatactcagccaataattatttttaaaagcagttacagtcataaggacactgtaaaacatctatgtgaatctcaatataaaaaccaaagactgactttccttctaacctgccacatcataaagttgtccaaatggccctctcaatgcctaccatatgaagaaaccaagagagtgacatctgaatggcacagacttccagagaacactcagccaaggcataagagcaaggtttgtttccatgagccagcacccaggggtaaacccttgtaatccagggttttaggaatctgctgacaggtaagatgttttaaatgtttttatgcaaatacaactgagatcccattggtattccacagccttgaacatccatagtaattaacacaaatgttctcctaccctcccagcctcaccccaatttattcacagactggaatagataatctggattgcaaactgtattctaatatgatctgacgtcattcatgcaacagttggctggggccagagttctaggtgctctgacctacattgggaaatctcattctgactgcattacagtatagcatgccacttcaatttctactggactgtgagagcagaaaccactgtgatacacacatcatttgatgggtctgaaaaaagtgacacaatttcccatcaacagagcatccttgagtctattctctacacagcgcctctctttaaatagtttcaaattcagaaacaaaagagagagtcacaagtaatcgccatggtcccggggcagagggaggaagagggatacgggaggagaggggcacctattttatgtaaatgtggttgtgtacaaaacaagttctagacttatttcatatgttgccaacccactaagttaaacattctcaaaccattaagattcatctctctgattgaccacagctctcatttttcaagaatgtggtacatagtgctcttatttaaaaaatatttaggggagagagttctaggctgattatcagatatttctaatctccataattccataaacgattataatttgcacactccactattttcattccacctcactgtagtcttccagctgctattcaaaagtgattataaataatggggctataaaagccattcagtaattaggacactcactggccatatgccaatcttgacaatggaaggtgatttatgtaagacaaccctatcacatctgccatcctggtttcccctctgacaggctcactggtcacgtattaacattgcccttaatgatcatttttttcttgactaaagagcaaacgggcaacccaaagttctacagctttttttttaaactatgtttataagggaaaacacatacacacacacacacacacacatacacacacacacacattaagccatttattttctgtcttgtcatttaacatatccagagaaaggagagaaggcatagaatgaagtaaactggatcaggtaaaaatcctggcacttgccatcaaataggaaagacctcaatgaattccaagtacaaaaacaaaaaacttcagacccagccgaccaaatcttatcccctcagcacaaaggcttcaatatacacaaggttaagcccattgcaggctttgcctagtgtttctcaaaaggagtgccactgccatcttgggcaggacaattctttgtcactgtgaatttgttccatgaaactctggacattcagcctccctgttcttggcagctccaaactaaatgcatggtgtattccctagttactgtgacaaacctagtgtgacagtcccacccaggggttgggtaaacatatagaaattgggaacagttatacttaagtgcccctttacacatatgtggaatcttctttcttatttttcttttagagcaaagagcatattagaaaaaaaaatattgcaagctgggcatggtggctcctgcctgtaatctcagcacttcgggaggccaaggcagacagatcacttgaccccaggagttcaagaccagccttggcaacatggcacaaccctgtctctaaaaaaaatgtaaaaaattagccaggtatggtggtgcatgcctgtagtcccagctacttgggaggctgagttgggagaatcacctgggcctgggaaatcaaggctgcagtgagacatgatggcatcactgcatttcagcctaggtgacattgagaccctgtctccaaaaaaagaaagaaagaaagaaagaaagaaagaaagaaagaaagaaagaaagaaagaaagaaagaaaattgcaaaagggcttatattggtgatgattccaaattgttgagatttgatatgcacatgcatatatttccatacatttcttctagcacagggctgttgtgcgaaaggcagcacggtttagggctgggaacacaggtacgaaaggctttctctgaaaactgtatctaaaagacactgctccatcagtgtctgttctattgctctggtttattgcattcatagcagttatgattctttgaaattcttatttatatatttatcttgtttattgtctgtcatccccaccccccaaaccatgagagtttcctatgaagactgagatcctcttagcctagaatagagtctcttggactacaggaggagctggcatagactatgtgactgaacaagtgagtgaataaaggatgatactgctaattaaaatgacacaggcagtggctaaagcagaactaggcagacctaagttcccatcctgactttgccatctgctgcctctgtgtgttcttgggcaacttacttaatcactctgggtctccatttcctcatcagaaaaatggggataagaatagcatctacctgacagggctgtcatgaggactaaatgagaatatacaacgtaatgctcactaatgtgagctaccctttccttcatcatctgacttgaaagtgacatgattcaaatatacctttcatgaaattctattctccaagaaggtaacagaaaagaattttttttaagattcatgattatgacaatgtacaaaacaaatgagttaaacaagccagcctttccatatctccagactgcaaactaattaaaactggtgtgttatcaccagattgctttcacacgcccgcttctgtttgtactacactgtatggccgaaggtgtgcaagcagagacagaatttccttccttcctcccacctcaggcctcaagtagctgggactacaggagtgcgccaccatgctctcctgattttttttttttttttttttttttttttttcagacagagtctcgctctttcacccaggctggagtgcagtggtgcgatctcagctcactgcaacctcctcccaggttcaagtgattctcctgcctcaaccacccaagtagctgggactacaggcatgtgccactgcacccagctaacttttatatttttagtagagacggggtttcaccatgttggccaggctggtcttgaactcctgacatgaggtgatccgcccacctcagcctcccaaagtgctgggattacaagcgtgagccaccaggcgtggccgtggcttatttttttgacttttagtagagacaaggttgtgctatgttgcccaggctggtctcaaaatcctgagctcaagcgattctcccgccttggcctccccaagtgctgggtttacaggcatgagccactgcatgctgcccattattttcatttgcattgccctgatgactgacaatgttagtcttgtcaagtactaacagaagtgtcttttcatttgttaagtttctattcaaattgttcatcagtgtatattggttgtcttcttaatgttgacttgtaaaggccccttatatatccctcatatcagtcccttgcagaaaaacatttttcaagtattctctcccagtctgtggttaccaattcattttcttaatgatgccttttgatgagtggaaatgttctatgttgaaatgaagtctaatttatcaatttttatggttattttttctctattattaatttactacagatgagtcagaaaacaaaataacgaaatagaagaactctgggcaaggagtcagggggcctggatttgagacttaaatctgcacaggtatttgagtttcgggaagtcatctgggagggttgattttatgtgttaacttgactgggccacagcatgtccacgtatctggtcaaacagaattctgggtgtttctgtgatggggttttgagataaggttaacatttgtatcaacggactgagtaagccagattgccctccttagtgtgggtgggccccatccaatcagttgaaggactgaatagaacaaaattactgtccttcctccaaataaaagaattactttccagccaggtgcggtggctcaggcctgtaatcccagcactttgggaggccgaggtgggcagatcacctgaggtctggagttcaagaccagcctgaccaacatggaaaaaccccgtctctactaaaaatacaaaattagccaggcgtggtggtgcatgcctgtaatcccagctactcaggaggctgaggcaggagaatcgcttgaacccaggaagcagaggttgcagtgagccaagatcgtagcctgggcaacaagcgcaaaactccgtctcaaaaaaaaaaaaaaaattacttccgtctgactgctttgagctgggaatcagtttttcctgtgttcagactagaactgaaacatgggctcttcttgggttcaggtccaccagccttcaaactgggagtaccatcagctcctctgggtcttcagcttgtcatgtgcaggtcttgggatgtgccagtctctataactgtgtgagccaattccttaaatgaaatctccttctctctatatatacatcctactggttctgtttctctagggaacactgactaatacatcatctgcctcctttagctccaacatagcatgaagcattctactcaattcttaatgaatattgctggaatgtctaatacatcggctctaattcacatatgtataaatgaataagttggattcgacaaccccagaggcctctcctgttctaagagcctctgatacttatcttgctctcacctttccattccaatgactccttttccctcaggtgtcctccaccaaaattaattcggctgtgcttctcagaaaaagcgacaaagctccctcccagctaatcagcttagaagtaattctaacaggctccagctacatagaaacctgttctggtttgattgtcctcacctttttggaaggaagctgaagagttcacaaaaattcaacattgttgtatgtttattcacaacaagggttgcagcagttgaattctcttaacttcctctccgaatatattgcttatatactgacgtatttacccgaatcctaaaataacattttaaaactgcaaggaagataccaaatgcaccaataaatccaactaacgagtgttcctattagggaagaaagtccctgacacattatagttcccaaaacacagaaggagatcaaacgtttgtcactgaaacaaactgaaataggtccacacttcagcctttgggaactgtgacaccctcttttttgttgcttgattccaaaccagtccttatgagaaagaaaattatctttacccattcatgtgactttaaataaattttgcaatgccctttgagaccaaaccacacccttggagataccaaaccacaattgagaatttttgctttctaataagcctatattaaaaaaaaaaaagtaggtgatggtgactgagagctatagtaagaacctgaagggattcagttcactaagcttccccacatggctctaacagcaaaagcacagagctgctctctcttggggtcctggaatgttctaacgacaaggcatcagccaggcttactcagagtggaagtggcaaccgaatgttgttacctctaagacagggaagtaaacttcaatgaacactgaaatcacctggggcatgtctataatagcaccagcgcctaggcccccacttcagaccaattcagaatctatagggaaggactaggcatcggtattttttttctaatctccactagtaattccaaagtgtagccagggttctaagcctagcctacttctcagactgtgaattcacggtagattcactaattgtcaaaatatacacacagaatcttctgttgatagagcatcctgtataatctcctaagatgaagtgcccttagcttcaaagaagaaatataagactctgaaccaggtgcagagagtggtacgggagtgaagaacatcaatgagataaggaagtggaaaaattctaacaccctcttagagtcacagccctgggaatttaaatcgtgtttctgcctgccctgactaaggaagaaaactgaaattagctgggtagaaatttcatctaaaagaatcaggagactccaagtgacctgtactttgatgtctctcactgtggctcagccacgcttttctctttcacaccaattcctgagaaaagtcatcagtaactgatatgtagtttgaagaacagacatcaaatacaaaggatgggttaggggcccaaggtttctgccaggctgtgatcgatgacaaggaacaaggtgagaaagggcctgctgggatcacaaatgcagggctttcccacactgaaatcataataatgatgtcttaaaagttgcacaggctgacttctgaaggtgcacaaagcaccaacacatttagaaagcactggaaaagatgaaagaacaaatagaaggctccccaaaattaaacacaactcaacatgactgctgtgagctgggtaattatctcgttgatggattctacactccagctaacactgaaccatgtgctacctcaaaaggtttcttcaagcaccagcaccaatgaatgcttgcagccactcccatatcttgatcaagcccttcagtgctcacaagaacaatcaattttctttaatgagacattattctgccactggtcaaacatgctatgaccatcaaaccttctatccggaagactcgaagggaatgaaaagcctttgagaattttacatcagcaaaccaaaaatacttaaggctagcagaaaaccatcttcttcaaccagataccaaaattttgaataaagtgtttttataatgacttagctagacagtccgccctatctataaccttgatatgtaagctctgtttatacatactgaagtcatactggcatctcaaaagttcaagcaaaatcaaatcatgaaagtaaatcggttacattttctatcctttttcttgataaaaagaaggctagcttaacatttgcttttctccccataattagaaagattctggaaagagaaaatgtagtcaaacaggcttgagcagaaaatagcttttttaaaaagtgccttatataaaagaataacaattaaggaataaagctccatctctcatttgataggtattacctgcctggaaattaaatcatacttagtgctttctctagagaagacttctgttccaaaatgagggtctaatgttttgagtggtgcaagccaaatcagcttgaagaaacagaaggctctgctaagctttagcagaacaagccctaacataatatgccagagaacacgtttgacaaaacagaagtagaaaaatattttcaaaatcagttcttggcttaaatatagcatttggcacctccagtaaacacagaggagaagatctaacttggtagcaccatgtgactttctgaactgcagcagaccagatggtggggtgagttattcatttctcagctcctcacccacttttcccttccattagtgacttctcagttcagggtcccttagaagagctggaaataaaagaactggataaatacatagaactagttttcttagtacttattattctactttaaaaccatgttactagcaaacacctcatgccaactcaacagctcttgttagtaagtgttctggattatatagtcaagtcaatgtctcatttgctatctacgaaaaataaagagggtgacacttccccttctgtaaagatagggcagacatacctttccctattcctcccactaagtacaactataggccttggatctaggaaattaagaagatgtctgaaatgtaaagagaaaaaggcagaccaactaggaaccttgggacaaacctcaacatggtgatgagtttcatgggttttctttatgtctcatatatcccagaatcagagctgaagaacccaggaatgggtaaaaaccaagtgggatgaaggaaaacaacaacaacaacaacaacaaagcctgttctctctagctaaagaattagggaagaaggagggaaactggcaataaggaaaactgttacacaataacggctctacttcagccaaataccacaggaaaagactatacttccaccaccacccacgccagcaatgattgaatggggagcttagaattccgcccttttcagactgtattggggtcacctaatctctgctcctcattctggggtactgtcaaagaagactgagtaaagacagaatcttcgaccccatgggtggaatctcttcttctccccacatcccctcttccttatccgctcttcatcatctttggagaccccagaggaattcagcacttctgccccacatagcagtaatatgaagtcattcctcccactgaatgtcaaaggaagaagaggagtgggaaacctagacttctacccccactggactgtaacaaggtctcatatctccttcccctaacaaagtggtgtcagataaaaccatctaaaacagaaggtttaagtaagtttcagtctcataacataatatgcaaaatgtccagattttaattgaaaatcactcatcatatgaagaataaaaaaaactcaacctgaatgaaaaaggcaagatgacaaaaatgttacaattatctgacaaggattttcaaacagtcatcctaaaaatgattcaaggaacaattatgaacacacttgaaacaaacaaagaagtataaaacctcagcccaaaaaaaaaaaaaaaaacccagaagacatagcagggcaggaagctaagacgagcagatttcttgagctcaggaggttgaggctacagtaagcagtgatcgtaccactgcactcagcctgagtgacagagtaagccctgtttcaaagaaaagaagaggaagaaataaagataaatagaaattttagaactataaattataaccaatgaaataaaaagctcagttgataggctcgacaagaaaatggaggagacagtagaaaaacattagtcaatttgaaggtaggatattaaaaattaaaggccacgcacagtggctcacgcctgtaatcccagcactttgggaggctgaggcagatggatcactgaggtcaggagttcaagaccagcctggccaacttggcaaaactctatctctaccataaatacaaaaattaggctggcatggtgacgcacacctataatcccagttatttgggaggctgaggtaggagaatcacttgaacctgggaagcggaggttgcagtgagccgagattacaccagtacactccagcctgggtgacaaagtaagactccatctcaaaaaaaaaaataaaaagaaagaaaaaaaaaacagtgaaaatgaatggaaaaaagaaacagagcctcagggatctttgggactctaacaacagacctaaaatttatgtcactggaggcccaaaagaaagaaagagttaaacatttacttaaagaaataatgacaaaacatttcttaaagttagcaaaatatataaaaatagaggttcaagaaggtcagcaaacccaaaatagaatgttttaaaaatccacaccaaaatatactcaaatttttgagaactgaaagaaaaaaaatattgaaagcagtgagagaaatactaccttacatagaaaaaatagagtgacagtaaatttttcatcagaaaccatggaaacctaatagaaaagggtacaacatttttcaagtcctagaagaaacgaactgtcagcccagaattctacatccagtaaaaatattcttcaggaatgtaggtgaaatcaagagattctcaggtaacaaaaaattaatagacttcattgacagtaaacctatcctaaaaagatgactagagaagttctctgaaatgtggttataaaagtaagaattttaggacaaaaagagggaagaaaaacaatgaaaagagtaaaagtacaagcaaatacatttctcttctcctactgagttttctaaattaggtttgaagctcaactatctcatgtggctctaagagtacatggaggaaatatttcagacaatgatattataaaccaggatgtaaagagacgtaaggtttcagcaattcagccaaactggtaaaatgaccattctacatatagttattttatatacttttgagtatatctatttttacagcccttttagtattatatataatgtaacacataaagcaatactaaaaaggctaaaaagagatatgctcaaaaacattatagataaatcaaaatagaatgctaataaatgctcaacccacaggaagaataaaaaagaaaataaaagaataagacagaataaatgaaaaataaaaaataaaaagacataatttttaaggcttaacatgtccataattacatgaagtgtaaatcacctaaacacaccaattaaaagacagaggttagcagaataaatttaaaaacataacccaactatattatgttaacaagaaacttgcttcaaatataacactataggcatggtgaaagtgaaaggatagaaaaaaatatgcaaacattaatgaaaataaaatagaaatgctatgttaatatcagacaatgtgggctttacagcaaagaaacttaacatagacaggaagagacattatgtaatgataaaggggtcaacccaccaagaaaacatagcaatcctaaatgtgtgtgcactaaacaagagagctgcaaaatacataatgcaataactgatagaacagaaaagagaaaggaacaaatcaacaatcgttgttagagactttaacatctctctctctttctctctctcaataattggtagaattagaaaatttccaagatgtagaaaaactcaacaccttcaaacaacaggatccaaaagacatttacagaacaattgaccaagcaacagcaaaatgcacatttttttcaagtgcccacagaacatataccaagattgaccgtgttgtgtatgataaaacaaatctcaacaaatgttaagcgtcgaaagtatacagaatgtgttctctaaatagaagagaaccaaactagaaataaataaaagaaaaataggagtaaacctctaaatgcttagaaatcacacttgttaaaacaaaactcatggatcaaagggaaaatctcaagagaaattttaaatacacatcgacataaataaaaaaacaacgtgtcaaaattgtacaattacacgtaaagcagtgctaaagggaaaatttacagggatcacattagaaaagaagattcaaatcaataaactctcttatcacctcaagaacccacaaaaacaagaacaaaataaacccaaacaaggagaaaaggggaaataataaggaaaagagaacaaatcaatgaaagtaaaaacagaaaacaataaaacaaagagatgattctttgaaaagaccaaacaattgataaacttctagcaagactgacaacagggaaaaaccaacttaagacacaaactgccaacaatatgaagcaaacaaaggatatcactaaagaccttgcatacatcaaaggataaaggaatattatgaacaaatctacaaacatacatttgacaactgagatgaaatggagtttgaaaaacacaaactaccactactcatcccatataaaatatataatttggacagtctgaaagctgttaggcaaattgaagagaaaacaagatttcccaatttattttatgaacctagtattactctgataccaaaaccaaagacagtaccaacaacaacaacaaacagtggaccagtatctcccacaaacctacatgtaagcattctaaaaaacaaacaaacaaacaaaaaacatctcacaaactgaatccagcaatatatgaaaacaatatacactatgaccaagtggggtgattattccagggatgcaaggttggttcaatacctgaaaatcaattattataatctacaatattaatatgttaacgaagagaaaccacatgatcatatcaactgatttaaaagtatttgataagattcaacattcttttatgacaaaaactttaagaaaactacaaatatgcaagttccattctttatgtgaaattaaaaaagaaaagaaagaaaactacaaatagaggtatcttgctggtaaagaatacccaaaaccctacatctgacgtaataattcatggtgaaaaatggaatacttttccccctcagattgggacagcacaaggctctcaccactgttgttcaacaaggagctagaagttctggccaaagtgttggcaaaaaagagccagaaaagtaaataaaaggcatataaatcagaaaggaggaaattaaactgtcttgttattcctcaaatatcatgattatctacatagaaaatcccaaggaatctgttttaaaaacaaaaagcctcctagtactaataagtgaatgcagaaaagtcacaagataccagatatacatctgaaaatgaatgtatttcttttttttttttcttttttgaaacactgtcacctaggctgaagtgcagtggcactatcacagctcactgaagcctcaaccttttgagctcaagcaatcctcccacctcagcttccagagaagctagtactacaggccgtgtgtgtgtgtgtgtgtgtgtgtgtgcgcgtgcgcgtgcacacagacagggtctcattatgttgcccaagctgttcactaactcctggactcaagggatcttcctgcctcagcctcccaaagtggtgtgagccactgcacctggccttaatgaatgtatgcctatatattagcaatgaacacaatgaaatcaaaataaaaagaacatttaggtataaatctaacaaattcagtacttgtttactgaaaactagaaaacagtgatgaaattaagatcccctaaataaatagtgatgatacaccacaatcaagaattcaaagagtcgacacagtaaatatagtataattctcttcaaactgctaggtttaacgtaattcctatcaaaatcccatgaatgttttttgtagatatagacaaaattattctaaaattcatatgaaaggcaaacaaactggaatagtaaaaaattttgaaactgaagaataaagatcagcttacttgattttacaacttaatatatagctacaatatttaagactacgtggtattgatggggatgcagacacacagattaatgggtcagaatccagaactcagaaacagattcattcaaatatgcccaactgatttttcatgaagatacaaaagcaattcagtggagaaaggacacccttttcaacaaatgatactgaaacaattggacattcacagccaaaagaggacaaatgttaacttaaacctcatatcttacacaaaaattaacccaaaatgcatggtagacttaaatataaaactataaagtgtgtgaaaaatgaagtacacctgtaatcccagcaacttgggatgctgaggcagaaggatcacttcaggctaggagtacaagaccagcctgggcaacacagtgagacaccccaccccaatctctaaaaaaatacaaaaaattagccaggtggagtggtgtgcacctgtagttcctgcttcttgggaggctgaggcaggagggttgcctgagcccgggattacaaggttacagtgagctgactgcatcactgcactccagcctgggtgacagagaccctatctctaaaaattaagcaaataaaataaagtaaaatgtgtgaagtctttggtatctggatctaggcaaagttttctcacaccatgacaacaaaaccataatccataaacggaaaaaataatgaactgggcattatgaaaattaacaactttttttcctgcaataggctctgttaagaggatgaaaagactgggagaaaatatttgcaaactatatatctaacaaaggattagtgtctatctggaacatataaataactctgaatattcaatagtaaaacaacaataacaaataacccaagaagaaaatagataaaagatatgaacagactccaaatatgaacttttcactaaagaagatagtgatggcaaataagcatatgaaaagatgtctaacatcattagtgattagagaaatgcaaattaaaaccacaattagctattactacacacctatcagaatggcaaaaatattgacaacgcctaatgctggctaggatacagaaagctggatcactcatacgctgcctgtggggatgttaaaatgatataggcactctggaaaatagattggtagtttcttaaatacctaaacacaactaccatttgacccagtgctatagtttaagtgtatcttgccaaaaatcatgttttggaaacttaatccccaatgcaacaatgttgagaggtgtgacctttaagaggtgatcatgactggattactgctattatttcaagaacaggctggttcctcataaaaggatgagtctgcattgcacctcatgctcttgcataaatgctctggtgctcttccaccctgtgccagatgaaggcctcttgaccctggacttctcagcctctggaactatgataaataaaattcttgtctttataaattgcctagtctgtgacattctgttatatcaatgcaaaatggaccaagacacccagcaacagtactccttgacattaattccacaacaatgaaaaatcatgcccacacaaaaacctgtgcacacgtgtttttaggatagatggttaaacaaactgtggcacatccatatcatggaatactactcagcaataaaaaggaaggaactattgatacatgcaacagcctagaggaatctccagggaattatactgaatgagaaatgccaaatgggggccttctgtgtaggcaagggacagagtctcctgtggagggagcacatccctgtgttaacaccttgatttccaacgtctggcctccagaactgtgagagaataaatatctgtgtttttaagccaacaagtttgtggtaatttcttacagcaaccacaggaaatgagtataccagccacatcagtgacctgggaacctattaggagtccagattttcaggtcctgatccagactttgtgaatcagaatttggatttaagcagtgctcccaggtgataagaatgcaattaaagtatgagaggcattgacataaactactatacgattcttacaatttacagcaatgacttttgtaccaatgtagaaagtatttagttatcaacgtgtaaaataagtaaggtgcatatctgaaaaatgcatatttttagtttttcttggtgtgtatatagtcaaagtctgaatgaaaataagcaagaccaaaaaaattgtttctttaaggtgaagggattgtaactcccccaaccccacctagtcctcattttattctctataattctgctaatttattttatgataacttttttaaggccagcagacttacatgaagatcggcatttgccttttttgcccactgctcttctaggatcacgcgtcacacagtagaatgaaatcccacattatggacttatccaggctcattaacaaccaggtgtacaaggaacctgcctggttttagccaattcaacctcatataagaagaacaaaacaaaacattgctccagataattatcttttgaagaaacacccaaagcagttcaaacacaccctggagctaaggcaaagtagccagtagagccatactccatgcaagtccaaatctttgggtctacatttattccaggatgcagatctggcagctagaaccccaggaaacactcagtgccttgatggtcatggtggttagctgtgcacatggagacctttccctgtatattgcggcatgtggacctgcacattaagcccactttgccagtcatgtggaatcagcatccaccagacaatgaagtcaattaactgttcatcagtgagtcaattgtcaaattatttgtctccttctttttctcactgcagacagacatcccaggcatgccatccttgcatatgacaccaagaaaacaccaccagatatccagaggatccaagagagaatccttttttgcatatttgaaagcaacaatgtgccccattcacctccaaagttaatttttctaatgatttggcctataagtcaaccttctccccactcatctcaaagtgactacatttcagacaaacttttcagctcatctttggagaatgtatctctccagttcaaacatgctctaggaatatttatatgtaaacatctaaaaacgtatcttctctagctattatgctgaagggaaaaaaccccactctaattaaagcactaatgctaagttggatgaacaaaacaatatctacttccaaacttcaacaattatttatatacatgcaatccaaaatgaaaaccaaatgagaaatggttaaaatgagttttattatcgtgtctagactagtcacgcctgtgcagtggagccattatttaaatatttttaaactctgattatcaaagggggtagataaataattcaacactgtaaaaatttttgttttcacttctagatatgttgccattgccattatttaaatgtttcaagaagaaaataggattcatagtcattcaaagtgactaacggggagagataacctacaaaaataaattatcactttaaatcagggctctcaatcttagtactattgacacgtgggaccagataattctttgttgttgggagaagggggtcttgctcagcatgtaggatatgttagcggcacccctggtctctgtccacaagacaccacatgccagtacttattccctaccagctggtgacaaccaaaaccatctccagacattgtcaaatgtctcctggaaaataaaatcaccctcagttgagagctactgctttaacttagggactagggcaacctagttgaattctcaaatgtaactcaactctcctttagccctctagggatttcgtggtttgcaaacccaatagaatgactgtcaccatttagcttcctatgaccacattttaggaatcacctgagttttagtaggttttcatgtaatgcaaggccatggcgaggctttacagggactgaaataatggcaatattaactggccactggttttcaagagactaaagatgtaattcggaaggctgacaccaatgaccggaattattatggggcatacctgagaaagccatgatgcccaaaacttcggacaagaaagctatagtcctggcctaagttactatcaaaaatatgaccacctattagcctaaattgctggagtccaggacatgtgagtcatcagaagtctaccaggagagcttatccagcaagaatccgggtcacttgtagtttcagaataatctcaatgagatgagaaaacttgtatacttttttttcttccccagcggaaatatgcattaatatcacaacttgagtaggaataaagagcaccttcttggaccacaaagtcacctttgactccctccatcttccatatctttcacaacatatcaactgcccagttcttctaattccacctcctgtacagctcttgaatgagcccactcttttccaacacacctttcactactagaccattacagaagcctcctaatcagtcgcttaccttccactttggccccttccaccagacataaagcaatctttctaaaagacgaatctgattgcctttctccagtttgcattctttcatgggctttccgatgtgcttagaataaattacagacacctgcaagcttccgtgttatcaggaccatgacttaatataaggtgtcatggatgtggggcacagaacacaatgtcatgtgcaatgaaatcacacttatgcaggattttgtactacaggagtttataaaacccgaatcattgatagcacaaattgcatttaacaattccctaaacttccagaatctggacttttgggagctcaaaagccaagaatcaacccctctaagtttctctttgcatttctattgtacccttcctaaggcagtgaaagggagttaggccaaggttattttaaatctagcagggttgtgagttggggaagaagaggcataattaacaaaatttcactctctctttctttttataaagagtttttgttacactggtggagtctcactgcacttaccatgtgactccagtatataaaacacaactccaactatgttcaaaatatgcatacacataggcgttatatttccatggtgaggaggaggggattgctacacacagtgaaatatgcaaggcaaatgaactagaaagaaatacagccatatgtgaacaggaatatctctggatggtgagattagagatgattaatttgattctcaatactttcatgtatgttccactatcaataatggaatttttttaaactctaaatggttactttaagtctttatattaatatatggacctagatatagaatacatggcaaaggtaacattaaattgttttagaatgaaaagatttatcacctgccctgattcttctcagtttgcagatctttatgcccagataacagccccagaatggaaactgttgtcatttgatgctttcacacgtcatccccaaaatcaatcatctctaaggtttttaacgtacacacggagatatacaaaactgagggcgtaaaaatgtccagtgaatctgttaagtgttgcagttgaatattagtgcctgtgtgccgttttgtggaatggtgacctatcatgactgtaaacaaagagagaaaaacagttatgaagtatggcagccttataataatcagtgaaaagctttctctgccagcactttcaaatagaagattccatgaatattaaaagcttcaaattcaaatctccattcaacacacaccattgagtctctttctgtgtgctagtgacatatgagtaatgactttttttttttacattgaagaatatccttttcattatgggtataacatgatgagtgtgattagatacccatgtgctaaatgttacatactctctcctctactcacccagaagctgcagtatgggtcttggtcagggcatgaagtgaacatctgtgtggggcccaccaattgctctgtcaactgcccactgcatttctttttctaaatttctgagtgctgggctcaaatgtaagaatacaagctacattgactttattgcccagttgttataaaaatgtaaaagtttaagcatagattgcctatggagcgattatatgtgttttataattgtcaaatcatttaagttcaaatgaaaatgcatcttgccattacccaatttattttatatcaatttcaaaaggtgaatactggctccagccttggaatagcaagcccagttgcaaacattataggagtctttataagctccctttattacacacagtgtgtcttcctaccagtgtaaagcagggtagagtggagcggggatgtctcattcaacttcccggccttctagcattatgacaatatgatgactgtgaggacagacagagacgtagagcggagaaaaaacagtgtctcaccacctgtagtcccagatggcattggaagatactttactgtaaacccataaaggctcaaaaaacacataaagcaatgcactaattaaaaggaaaaaaatctacatccaaccatacatagttatggtacagattattacatacacagtcaactgtgacttctgaaatataactgagtcaaactccagcaaaacacagatgacaaaataaagagctcttctgttcctccttccactgatggtacaatggaatgcatacagatctattaattcaaagagttttcccattttcctcaacttgacatgcagaggagaatttttgagttgtcatcatccatcaccatgataagtacaatttattgccggacagtgctaagtgctcgcatacattatttaattcagtcctcaccactctttgatatgggaactatcattacctcagtcagacagaatagaaatggaagcacagacgagctgagaaagttgcccaagttcacacagcttagtaagaggtagaaattggatttgaacttgaatgcaactgaattccagttgaattccaatgttgaattccaatgtccagttgaattccaattccaatgcccaggtaaattccaactccagttcagttcccaagtcgaagctcttccacactttgtgtgagaagtcatgttatttaacagaaataatcttttcaggttttatttctgtctctcttcaaatcttggctacatcttgaattcactgataacccagaaagctcttgtgtcagacattagtgctgtctatgtatgcatgaaggtgtgggcctcctcactaaccattctggatttcagtttcctaataaaaatataatctcctaatgtcatcaagtctgcaatggggacagaaaaattaagtttcagaagtgttaaatttgaaaaaaaaaaattccctcgatatcaccaaggaaattctggaccatatattgagaaaattttgttctccttagtcagaagttagaaaacttgcatccatctcaaagcccctttgcctctgatgcagtttactgtctcttaagctgcctgtgacactgaactggcaagggtctgttccatttggcctcccgaagggcttaatattggaaatgaggtgaagtctggtgtccgttttcaaagtgtctcagattaaaagagaaccaaattttatatgccaaaccatcattaaacacaaaacagtacacatgttttaggtgcttttcaattctaaacattatgcaagtaaaatgttatggaatataagaggttaatggaataagacaacatcaaaggaaaaagaacacttgaaaatcttttagagcaaacttcttactccgagtgggggtgggaggcggatttgaagaaaggccacctaacaaagatgggaataaaggatatttattgtactccacatcaaacatagaatatatcaagaggtatcaaaaaagagacacagggccagacctagcggctcatgcctgtaatcccagcactttgagaggccaagtgggcagatcatttgaggtcatgagttcgagaccagcttggccaacatggtgaaaccccgtctctaccaaaaatacaaaaatcagccaggcatggtggcatgcatctgtaatcccagctactcgggaggctgaggcagcagaattacttgaacagtgagccaagatcactccactgcactccagcctgggtgacacaggaggacaccatctcaaaaaaaaaaaaaaaaaaaaaaagacacaatagcaaaaaagatgataatgaagataaggataacaatatcattggctaatatttatggaatgtctactacatgccaagtattgggctaaaaactttacatacatcccctacctggaatccacgcaacatccctaggaagtaggtactattcttatccccaacttaaagataaggaaatggaggtaaaggcaggctaagtaagtgtcttacccaaggagatacaataagtgtggcactgggattcaaactcagagccagtggtaatactgcctcccaggtaagcaaatagaaaattgcctttgaggccaggggtggtggctcacacctgtagtccaagcacattgggaggctgaggtgggaggatcacttgagcccaggagtccgagaccagcctgggcaaaacagtgagacccccatctctatcaaaaaaaaaaaaaaaacacataaatttgtctttgaattaagaggagtgggggaagtgtcctctattctgtgcacacaacagagagcaacatggaaagctgtaggaagctacttatttagggagccagttgtacttattgcccaaatgaacaccactctctgttaaaggagtcagtaagttgaatccctagcaactggggaatgacaacatcacgaaagtttaaaagaaattttttttgtttgtttcctttaaaatctttacttggctgcattctaagctgagctttgtctggtaacaatgaaatttgctcctaagtttggagccaagtccaataaaaatcaaaccaccttgcatgatgacccccagtgaagtgatagcatgaaaactttggtttaaatcttgagtctgctactgaatagccagatgatactgggaaggtcacttacattataggactgaaattttctcatctgtcaaactagcataacaataccttctttagaaggtcactgttaattgaaataatgtgtgtgaaatggtttgcacaatgtctggtataattaccaatgaatcactaagtgtgcacacagaaaataatttgaggtttaatgttaatttaatatgctaggactttaaaatgatgtggaagtcacacgaaggaaaatcacgaactttatcatgtgttccctgggggaatgagccttaatgctgaaaagaacaatttatattgagaaggtagaatgaggtgatgattataattaactgattttggctcaaaatcactttaaaacccttccttttgggttctagagaatgttacagttctctttataaatatcactgttgacttttaataaggacgcgatggaccaaatagcaatacatcagtacaggaacaaaacttcctgcatttgctattcagagaaaaccaaatgatctggtaaaatgttgctattttaacagtccagtttgactgtttaaaatgtttagttgctctgttctccaacacagtgtataagcactgagattccagttactggtaaccaaattgtaacactgactgaacaactgaattcttcagaccagttcttctgaaatgttaatacgcatctcaattatctagggatttggttaaaatgctcattctgattcagtaggactgggatgagtccttacattctgcatgtctaaaaagctcccaggtgatgctaatgctgttggtccctggaccacagctgggaggagcaaggctatggaacacaagttctctccctctctctctctttttaatccagctttgacttgttcatccgttcacaagccatcttctgccctcccatctcagaggaagtttctgtccaatgtcaaaacgaagtgaaataagtgcaaagcacaatattgtgtccagtctaaatctgagggttttcttgccctgtattttgacatatccacatgagcatgcaataatgcacaataaatactagaaatcaactagaacttatatccacaccttctttacttgtggattaatgacagttgcttcctttttatgcacttcttgccggctcctcttgtacgataaatgccaacaacagccaggtaagtcctatttttattcctattttatagaagaaaaggggagattcagtcagactaaataatttcaccaaggtcacccagataggaagtacagagccagtctgactctcaagtccatgttcttaaccactgtgttatgaagtacagttacccgagaacttccagttctgtttctggaggaaaaaaaaatgacatgaaaatgaggcaggaataaaacagggtgatcacaggagaatggaaaattccagggagtaatttcacataactagcaaaaaagagactactgaaatagctacaaaagctatgagttgataagaccctgaaaaacaggcatggaccaagctggctaataccaactggacccaacatggtgctgcatttgacctaggtttcacctagaacctcattatatgctcattaacatactaaaccacacactcaccagtgccaggacggttccaaaaacactcatatttggtgtaaaactggaaggcaacatagttcagagaaatctccacctttttccaggagttttcatgaatatcccaccccttggttaaagaaacccataaagatggaaaccgcaaaccccacggcatgactttctcctgagtaaacccgtactcccctttcttaagtatgtatttttcactttgcaataaatcttgctacttgaactattttctgcctcatccttgaattccttcttgcaatggggccaagagcctggatatcagctggaactgaagtcccaccggcgtttggggacctcctccaaaccaaaaccactctctgtgtcacagtgatgttggcctgggttctacatttctcaacccccaatctccaaatgagtggatggcaaaggtttccagagtttggttacaatctctctgtgctaaatcaagatcatagtttatgacccacccagaaccatactgacaagacacaaattacaagttggccacatagaaagcactcaaccatttaatctacctggtatttacaaaatgatttcgttatgccaattgttacatgttgtggggcaaatacaaaaaaagagaaggcataatttcagcttcaaagaaagtccaactttcttagaggtaaaggtaaagttcattgtggtgaacttttaccatagtgaggtaaaagttcattgacttgttgattcattcattccacaaatattcactaagtgagtgtctcatgtcatgcactctctaaggcactaacgccatgaaggtgaacatggtaaacgggcttcgccctctctgagtttatagtcaaaaaggacagatagacattaaatgcataattatacaaataatcacaatagtggtgaacactacaagggtgaagtacaagatgttctgtgaaacttgaccttgtctaggggcacagacaatacatcctaggaaactcagacaagtttaagataaacaaacatggacattgattagtcttctacagggaggtctagttacacaaagtgatggtcctctgacaactctgaaatcaacgcattcaatgcaaacaaagattattattgtcttctggaaaagtttccagatctcattagggaaaaatgaacccaatatttgttcttaacatataattacttcaaactatggttaaactcacagaaagctggaaagtcagaaagttttctgacatctgtcttctaatgatgcttttcactttcagattaaacaaattctgctataatgaaagaagatgaagagggaccatcatctctatgggaggccaccatgtctcgccttccataataagctattacaatactttggacccatatccataatgccaaaggaccaattattactagaatcttaattctgggaacaagataggtaaagaaaaatgcatcacgttcaagcaaaaatacactcatcaaactgacacctcacaggcacatcaaacaaaacactaaactacaccccaggattccaagatgaatactaattttctaaagtaaattaggtaaccttcaggacacagaaccatctttcctgacatcagtttagagctctaaaaaataaaaaacaaattgaaaagcccccaatgtatattcttacacatatttgctcacaggatggtgtataactagattaattgtgagtatatgtcccctgggggtagaattagcctttttggatccctagtctaaaatctagaactagtggggagaaaagcaaatgtcaggcaaaacccccattatcatatgtaaattacagaatgagtgatttcctgtcaacaaaatgaattctgtatgttgttttggaagtggcaccttattaaacacacaagtcattttcataattaaacaagggcaaatgcagaggaaagaagccatttaaaatggcatcttggttttcagagggaaaaaagtgggtccaaataaaccacagcaacatatgaataaccatcaagccctgctgtatggttaaagtctgagactatcgtcaagatgtttgcattggaatcctggctttgcttcttctaaaccagacaccttgagcaagccacttcttgtttctaagcctcagtttcctcatttgaaaacagaggataaacttactgtgatgggaagcatatgaaattcatagcatgacacctggcactagtgttacctgtttttagtattcttaaaatcatctttgtatttctttttttgttgttttgtttttttctgttttttttttttttttttttgagatggagtctcgctctgttgcccagactggagtgcagtggcgagatcatggctcactgcaagctctgcctcctgggttcatgccattctcctgcctcagcctcccgagtagctgggatgacaggtgcccgccaccatgcccggctaaatttttgtatttttagtagagacggggtttcaccatgttagccaggatggtctcgatctcctgacctcgtgatccacctgcctcagcctcccaaagtgctgggattacaggcatgagccaccatgcccagcctcatctttgtatttctttattattgctgccaagaaaaaaacagaggaattaccaagaactttcacaagttcaggatggaggctgaagtggaataaaccacaaggtgaatgaaaggagaaaaaaataaaaataatcagaacactgggtacactctgtgccctctctctccttcaattaacaagtaagccatactcagtccatgcagaagccaaattgtttacatatgacattcaaatgagcagcctggcctgggtttaaatgaaaatgtactcatctaaattagggagcagcaaactttccataaaatgccagacagtaattattttaggctttgcagaccatacggtctctgtagcaactacttgattctgccactttgtgtgaatgcagctatggacaatatgcaaccaaatggccatggccgcgttccagtaaaactgtattgggacaggtgtggtttaccaatcactgatctaaatagaagtttgagaggtcagtatgacagatatgtttgtttgtttgtatgttctaatgatgtttctcttttttattgtatcaatttaagttgtgcaatatgatgttttgatatgcatataagtactgattattatagtcaaacaaattaacatagccatcatctcacatagtcacctctttttttgtgtcaacagtacctaaaatcccctcttagcaaatttccagtatacgatattattaactatagtcctcatactatacattagatttctagacttatttaccacacataactacaactttacacattatgacctacatctctattctgccccaactccctgcccctggtaatcactattctgctggtagacaggttttgttcattgttttcctaaccaatgtttctgtccacttcctgaagttccaccttcagttgtgagcagggcatggatggtagaccagagacgggtgctggaggagccaagaagaccctgtttcaaaggaggtacacctacccatgcctagcacatactgggaattcaatacatatgtccacgatgttttatttcttgaaaagggaactaaagggtaacaaagtgagattgaaaataatatacaaatataaatttaacatagtaaaatgtcaacatgtgtgaagcctgggaagtggaaacgcaaatgttggttatctgtgcttctgagactaccagggtttttaatttccatattgctacagaaggatatttatgtatatttagcagaaacatcacagcattggtcaattgctacaaaaacgtctaaagttttactctcattttctgttcttgccttcctctggactgataatggttttaccgtggtaccagtccacagaccacactttgggcactgcttatattattttttccttatgtttgaaatatagcacaattaacatcttaaaaataaaatcagaacggagaagaggagtcaaatgtggaatcctaaaattcaaaggtcatgaaaccaactgcagaaacgccaaactaaagggctttgtgtctttacagattacttcattcaagaggtatctattgagggcccactgggtatccattcctgtgccagggttcaggacagtgagcaagccacagtggcagcccttggggagccttcagttagtggggaacttttcagccttgacactaccgacatttggggctgccttgttcttccttgtcaaggttccttgtgcactgtaagatgttcagcagtatctttgacctaaacccactaggtcagtagtcagtagtagtacctccccgagttgtgatggccaaaaatgtctccagacattgccagatgtcccctagggatcaaaagcaaccccactgtgaaccactgacctatagcaaaggaatgatagttacagttaataacaactataatatgtcaagtcgtgttgacagatagggctttaacccaaaaatgttaaatcctcatgaagaaataatatgttcattatgaaacatatatctcaactaagtgatacttatgatcattacaaatggtaggctacattcatactgctccatgccattgcaacagttcccaactactattgcaatgggcttcagtgctgaacaaattgtcacctaggatatttcacagaatgctcataacaggttcgccaagaaattattacagtatgtatttcatgaaaaacaaaacaagagatccagaaaaaataagccacttgcataacgtggcccaggtagacactatactcaggtttactgtctctgagtctagtaacatcattactaccaccaataacaataaaggctaatagcgcttattcagagaatatgtatatgtataagctattgttctcagatcataatctcatttaatgctcgtaacaaccctacaaggtagcttctgatattgccacattttacagacgaaaaaactctggccaagataaattaaataacttatccaagtggcaaaggggaggaatttgaactcgaccacaccagtggtttctcattccagtttctgtggagaaaaatagtcaatcttcactattaacagattccatatttgcatatttgcctactcactgaattttatttgaaacctcaaaatcaatactcacagcactttcacgacattttatgggcatgtacagagcagtgaaaaattgtagttgcccaatgagtatgtttccagtggagatcaaacaagaccatggcctgtccttctgtttcaggtctcacactgtgaacaaatgtgctttttacagtctatttagtgccattctttcacatttttgtgctttttgatggtaatttctctgtttaaaatgacctccaattgtagtgctgaagtctatatagtgtttctaagtgcaagaaggctgtatatggcctatatttttgcttccaagcaacaactgccctaaaccattaaaaaaattcaaacatcttccatgtggtcttgaaaaagtaaccccacccaaaattctagccagaagtctacctgctgaggcagaagagcctttgagtactaatcatagatacactgactcatgctatcaatctaaagcaagtgttcacccttgactccctgtcacactcagcaaatttcctacctctttaaaacttaccagccttacagagaaaatggtgtgctggatatgcttcattcaggcatgagttacagggctcttagctgtgaattcggtgttaatgaatccacaataatatatgtccagaaaaagaaaacggaaattggctgatctgaggccaagccacagattgccaaggtaacatctatagtgcatgatgaggctatggaaaagatggaaaacaggctaaatttgtggatttgtgagaagaaaaatttgaaaaaacatagtgaacagcattgctgtaaaggatcaggaaagtgttcaacccttctcagtgacatcttattataaagaaatactgcatatgtgatttgaaagaaatgaacattaaagtgtcattaaacagaaatacaagtaagatacaattatgtattgatcagttgatgaaaatgtgaccagaagttcacaggaacctaatcctgtatttcccttagcagatcagtatttgctaattaagtgttcatggtgaccttatacaacataactacacacagacacaaaaacaagaactgacagtatgtggatcactcttggaacatttcctgggctttcccctcaaagttcctaaatttcaacagcggggcccagaaatctaaatgttttaaaggctcctcatccacagacccatgtttatgaaccactgtgatacatcatgctaacaaaaccaacaaaaatctttaaaaaaactattcttcctacttttgataaatctgtataccatagagcgccttacagttacagagggctcatgctgtgaaattgtttggcttatatccttgcttccaggccacaacttttttaaaccattaaggaaaaaaaaattcaaacactttccatatggtcactgaaaaagtaactccacccagaactctagccagaagtctacctgctgagttaggagcccttcagtactaatcacagatacactgactcatgttgatcagtccagagcagggattcaccatcaactccctgttactctcggcaaatttcccacctctttaaaactttccatgtgtgtgtgtgcattcacaatgtactattatcttagtagccagggcactgtacaaagagcattaaaagataatcagagatactataaatagtgatttggaaatatacttccttaagagaatgatgacaagactcatgctcaggatagatttttatggccatccccagatgtccaacaatctttctctccagtatagaattctccaaaggctattccactgaacacaagtcagagagaatgctttgagactaaaaaattccaaggcaggtgagtttggaaaatgctgcttattataaaaccttatagacattcaatcacatattagcatagtaaaagctctgagaagccctgaagggaagataggaatgacacatgtctaaactatgtttcagtgagcaattcccaaactgatttgaccatgcgtttcctttacaaacctataagttccaggaaacaatgctgagaagtgttattttattatcctgctggtggaggccatagaaaaagatgaaacaacctccccctcatggccatctccacattctgatgaaaattccttacccttatttctccagtgcaaggattcatcacagatcaatcacggagacagctttggactcttccagaaattccacagctgcaccctttgctcatgaccacaggcaaggtccaccattagggggagatgagcgctgcgcttcaataccctttcctccatgaaaacatccatcccaaactagatgaagccttcagacatacctacaattatcccactgggaaagatgagcatgagaaaaacaatggtctcctgcaagataaacagcagtgtcctatttgttcgcagtgagtgaaaatggcattccttctgcccggaatgagaacagaggaaaaaaggtgttcaaattatagacactttcattttcaaaaatcatttatctaaattatttgatgccatgaggaaggctcccatgaagaaggggcaatgggctaggccttcagggacaattcaaaattgggaaagtaggactacagtatgtgggtatcagagatgggtggaccagcatgggaggggaggtttcaaaatgatttaaatagcatgaacgaatataatacagaacacagtttggttcatcagaattccacggtggccgattcctgggagaaaagcagccagaaggtaaaacttaattatactttccaaggccatcagagatgctaccgcatgagaagtgtgatgtgtgttttgcacagactggggaaggaatgcctgcgtgtgtgggacaagtgagagcaccaggaggaatgactgtgttctcaggatgaattctatactcttaaagaagaaaccaattgaattttattttattattttatgagacaggatctcattttttcacccgggctggtgcacagtggtgcaatcatggctccgtgcagcctcaacctcctgggctcaagtgatcctccctcctcagcctcctgagtagctaggactacaccaacacactcagctaatatttgcattttttgtagcaatggtgttctgccatgttgcccaggctggtctcgaactcctgggcacaagtaatccacccaccttggcctcccaaagtgctgggattacaggcatgacccaccgcacccagccaagaagaaaccaattttttttaacactcccacctgcagctggacatgtgtatggcacagtgcaagggattttcatcaagtatagctacgtactaagagtttgctccctgtgtaatgtttctgttaatttaatgaaaacgtaaattagtaacatcaggtttttctgagagataatagtataatgttgagattcagaccatgaactccaaacccaggctgcttaggttctcatcctaactctgtcactaacaggccatgtgaccttgggctaggcatttaaactctttgtgcctcagtttttccatctgcaagatggggatgacaataataccactacaccagaagggttgacgtgaggtttaaatgaacgaatacacttaataaggcacttagcatagtacctggcacacaagtgctattaaatagttgtgcactggagtaagcttatactggctcatgagagtcaaatgttagcacctcttcctaccttcgtactcagagacatcagtcatcccctgccagagccaggtgttaaacatttatcagcataccacataaacatcatattttcaaaaagtttgtgtaaaaatggaattaaaagataaaaattaaaaatataaactttatttctcaacgcaagctccaaccagttcaaaactctcttgtgagtgatgaaccagccatttagtccttttttttcttttttttttttttttttttttgacacggagtctcactctgtcgcccaggctggagtgcagtggtgcaatctcagctcactgcaacctctgccccctaggttcaattgattctgctgcctcagcctcctaagtagctggggttacaggcgtgctgtaatttttgtacttttagtagagacggggtttcaccatcttggccaggttggtcttgaactcctgaccttgtgatccacctgcctcgacctcccaaagagctgggattacaggtgtgagccactgtgcccagccgccatttagtccattcttaaagaactgaaggtcctgggaatttaaccatgtcaatgttgtctttttttacattatctttatttatttgtttattttcttgagatggagtctcgctctgttgcccaggctggagtgcagtgcaggggcacaatctcggctcactgcaacctccacctcccaggttcaagcaattctctacctcagcctcctgagtagctgggattacaggtgcctgccaccaagcctggctaatttttgtatttttagtagagacagggtttcaccatcttggccaggctggacttgaaatcctgaccctgtgagccattgcacccagccttttttacatttttaactgaagaaaaaaatgggtgtcccttacagactttttaagattagaaaacaaaaagaagtcacaaggagccaaatcaggactgtaaagttgactcatgatttcccattgaaactcttgcaaaattgctcttgtttgatgagaggaatgagcaggaaggaacactgtcatggtggagaaggactctttggtcaagttttccctggcatttttctgttaaagctttgattaactttctcaaagcactctcataataagcagatgttatcatcctttggtcctccagaaagtcgacaagcagaatgtcttgaagagtccaaataactgttgtcaagacctttgctctcgaccagtctgcttttgctttgactaaaccacttccaccgcttagtagccattgctttgattgtgttttgtcttcgggattctactgataaagccatgtttcatttcctgttacaattcttcaaagaaatgcttcaggatcttgatcccacttgtttaaaattgcagttgaaagctctgctcttgtctgcagctgatctaggtgcaatggttttggcacctatccagtggaaagtttgctcaactttagtttttcagccagaattgtgtaagctgaaccaattgagatgcctatggtgttggttattatttgtgctgttgtcggtccctttcaattagagcacaaacaagatcaatttttttccttgcaaattgatgtggatggtctgccactgtgggcttcatcttcaacatcatctcatcttttcttaaaatgaattatccatttgtaaactgtggatttctctgagccattgcccccataaacttttggtaaagcatcagtgatttcaccacaaatttgatatttgttcttgtttcgattttagcagaattcatgttgctcgattagaagttcttttcaaactgatgtctcatcattcttagtacctgaaactagatcctgttcagctactttataacaagttagtatgagtttcttgtggggaaaaaacattgaaatccatgtatagttgtatcctattgtgtactttccaggaactttttgaagactcctcatatatatgcatatacatacatatgtatacatacacacatatataacacatatgccatgtgtgtatatatatatatacacataagtgcttggcttcattattgccaacattgaagttttttttaatatggctcaagcagaatctgagttatttgaattcctggcttttatgtaggtttcatgaaaatttagaggttgctctcaaatcctcaaccccaaaataattatttatagagtaccatcaatatgtctgacatagccatagacattatggactacagaagaattataacaaaggtctttacctgcaatgagtttacaatcttgctaagattttttgcaaagctaatgaaccacatagttggtacgtgtttctttctctgggatcatgtttggtacccatggagcttatccactgttcatctcttccccgggaacctcagtggtctccatagttaatgcagataaatatagcccttgccctgaaactgggcaaatttgctacttatcactcttactagatataaacagaaaaatagccaaggtaaacaggcacatatacaaccacattcatattctttaattaagtaaaaaccaacaagcatgtattaagcctctagaatgtaccaaagtgctttatgtaactttctcctgttgggagctattcattcactgtttttagctgttttatgatgtaaaataactgaaactcatgaattgtaatgatgttaatatttatcataatacctaatgcttattgagaatgtagaatcagccatgcaattcttctaagcactttacattactcctcaccacaaccctgtgaagtaaaactgttaatatccccattttacagatgagacaactgagcttcaagagactgattatgttgcctagtactacagagctggtaagagctaaaatttgaaccgggatttggcactctagagccaatgctatgaatcactgtaaagcaggtgtttctcaatcttggcactactggcatttggggctggataaatctttgctctgcattgctatgcactgtaggatgtgcagcagtatcctcggctcttactgactagataccaggagcaatcgacatttgtgacaattaaaaatgtctcccataggaaccaactcacccaaatgagctggccaaatgccccctgcaattcaaaactgccaccggttgaaaaccactgctataaattaaaagaaagaaagtagggaattcctaaacctggctacatattagaaatgcctagggtatatttttaatgggttaaaaatgcagatagcaagtcttatcactgattcagagaatcagagtgtcaaggggtcccatagaatagtccatcatttgtcaccaattagttatgtcatcttgagaaagttacttgccctctctgtgcctcaatttctttatctagctactgagtgggcaaagctagactgtgtgtcaaacctttccatggctaacaatccagtctgtgaaatcactcagatacccatcacttccctccttgacaggcttctattcacactgcacagagagggtgtaatgaccaaaaaaagttcctacaactccaatcctcataaggaaatcctcataaggaaatctggccaaaagctgacccgtgatagacttacaatcagttcaccatagatacaaaattgggcacaattatcactacaaaaaggttagtttccacttcacacacctgaggtaggtaaaaactgaatcccaaattggagatgcaattttcccattatgcaaagtggttgctgcattcctgggtggaaaaaaaaatccccaaaccagtattgccaaaactgaatttactagaaaccttgactccaaatgacactggggagtgtgctcctcttttcagattcatgaaatgctttcatgtcatttaagaagcaaaatgcaaaagaaaaaagtgggcattgtctacacttcagacatggaggctttagtctgacaatcccagatcctatctccaactcaaaacaaatctgttccatggcaagaaagtactttagagaattagtctttgctgtatttgtatatgctaattaagctccaaaggagaaactgctgatgataaatcgctgacaaagaagccatttttaaaaaattttactaatttatagatatatcagattatatcggtttaggtcacacttactttatatacccatgtgtaaaaataggatgaaaatgattacatttgaaagtgcctggggttgttaaagtaaaaataggaacaatcttcattgaagagggggaaaaacatccttaaaaggatactgaatagaagggtgtctgtaaggcacggagaagaaggagaaaatgtcctggattatgaaaccacaatagaattctgctcagaaattgcatgttatcaattcagttgatcagataccaataaatccatttactagaaactgatttcggaggaaacagacttgtaactataattcaaattcattcctttaaagcacgtactaccagtgcactctatcaagggtgggccctaaccactattaaagtgttaaaagaaattatttcaattctttatgagtataaaattatagtagaagggaatcaattaatcttaggtgatatgccaccaggccataatcaagtatgataaattgctttcttctatcctagtttctcaatgtatgtgttatgacaggttctgcgaaggtgagtattaaaaaatatttgttcccaactcaaaagggcatcacataaatgaccgccagcgccatctgtcggtggtacacagagctgttgcacttgtgcctgggcttgcgagtttttgttcacctaaattaagattcgatgactgaagttttacatgagggacagcatccgtacactactctaagtggtgtagtgcagaagctcttaaacatttctcctaatgtttatacccttttacatggccagacactgaatgaatttcttctaatgatctggaggtgaagcctaaaataactgcctcaaatttcctgatgtcttagtttatcttaaacttttatatgaatcttgtgctgtataccagagtaacctgtgtctgtttttttacgtaaaaacatgtataaaatatttatagttcaactacttaacttgtatgaccaaatattcgggttaaatagataatttgttgaggtgtaccatatttagcccctggggcatattaccttggatacctacatcctccagagatactcctactccaatttgagaaaaagtaggaactcagctctgccacagcctgctgtgtgcccacactgagcctcagtttcgttatctgtgaggtaaggaccatggacaggatctctaagggtgcttccagctctgacattctctgaaacaacagtcatttggatcttcagacacaaacacctcactcatctcactactggtgagccctgcgtgcacattcctataacatgtgggcacagagatttgtaaattatattattgtatgtctagttcaataaatattataaataggcgtttcctatttcacctatagtcctaaaagcttatctactcaagttggcaaaacaaaagcattttctccctcattcttctcattagctaaatggaggaatgccttctattagagtcacctcgtatttaagcatacacagctgggcgtgtggcatgtgcctgtagtcccagctactccggaggctgaggttggagactctcttgggcccaggggttcaggaccagcctggggaacacagcgagactccatctcaaaaaatactaataatttaagcttatacgacagctcaataaggttaggtctagtgttcaagaatgcaacaggagatgacattaaagatataagcaatgaccataacaaaagagctcttaaaaatgatgttaagtagctaagatttctgcatgttatggcctgtggattttggatgttggacaagcccaacaagacaatacacaagcacagagaagccgatctcagccctatcagcatgagacctttggttaagattcttgccaaagctgaagaattcaagccctcaaatgtattttcaagaaccagtcattttatttctcccctaggatcacagaccttcccaagcccatgaggtgcctgtgaaactccacatatgggaactatatttttaggaaaggggccaaggtgtcagaggctatgcatcacaagaacaaccccttctttctcttttactaactaacacagtttggctttccctcgtttctagcagcagttaattccaaggctttatgttctcagacagtttcaacactgcctttcccttcagagtcatcaccaaaataaattttaaaaaattccagtgcgcccttcactttttcagtattcccactcctgctggccccaggtgttctctggtttgaaggttgcccactatgcaacccgctgtataattcagaacctggtgcacttcccaggcacatcagtagtctaaatttgtactacagcaaaagcttcaagggcttaatcaattacagatcaaatatttaaaaatgaggattaatctcatcactgcagcccaacagatgcattttgtgttaataaatacacttcaaacttcctgtagacactgaaaaatgcattcccaatttgcctttgctcctggttcccaacagacaggagagagggctccattgatattccagagctgcactttccaagtgttcatggggctggctctgctgtatctcgtaagataaaggaatcagaaattagaggaggagaaacattctgaccagatgctctctgatctccccaacaaaacttcaaccacactgtcagtctcaatcacaatgtgtgggcactgagattcatgaggccaaatgaaaataaaattatgatattcatttacgtgggtgatggaagggtggatgaaaagctccatatgttcggagtttcaagtataatttgaaacagcaacatatcagccttaaaaacagaacctccatggcctccaaatttcaagaatagtagaagatgcttgcctagaataaatcaatttggaaagctgcagtcatcaatctcaaagtaatttctgccaaagtataaatggtgatttaaaaacgggggaaatgccagaaaaataccacttgaaagttttattaatagtacattacagaacacagaaaaaattatttattagagaacttgtgaagaatacacagagaaaaactcacatgaattcacaaaacggggcagcacaatgaattcaccagtgtattaaaagcagaacaaaaaaataaacccatcacagaccaagtaggtcttaattcaaaaattcaaggagccatctaatgaggtggctcattacagtgtcacagcggcacatgtacctctagtttatgaatttcaacgatgtaagctaaaaacaagacaaaatcaaacaacaacaataacaaaactgataacaattgtctttgataatagatggctctagaacacaagccaaccacttcatatgggttcaaccaaagaaacaacattctgttccaatactggaaaaaaacaattgggctgagctgctcttactgagaaatgctagagcacaaacagggatgatttaatggattttcaaagataattatggcaggactcaattttcaccttgtttgacgactttaagctaccctatatatgtcaatagtttggaggagaaaaaccacatggttatctcagcaaagaatgtaaagaaagcatgtgataaattgagttcatatttttgacaagcttgtagtaaaagcacaaaggctatttgtagcattatgtttaacagtaaattttggaaaaacccaaatatacatctatatgggcacaattacaaaattatggtgtttctctatacagagaaactctacataaccattaaaaagaaatgagacttacgcactcacacatgacaatgatgaggatagatgcaaactgaaggacaggatgaaaaccttaatcacattttcaaaaaagccatgacatgtacacacacgtgtctctatttaaacagcatgaaaatacatagagcaaataatcatgactgcaataatcacggttagttccaagaaaagtaattggagcagaggcttttggtttataaatttctgaatcctcagattttttttaaaaaacgtacttcttttgttaatttaaaaaataaatctggagaataaggaagaaaaacactccaattaaaaatgcagaattggaccaggccagaaaggtcatctaggaaaagctgtgtccagcatctccatcaaaggagaaactactcctttttattcatactcaggaaggaggtggcagagttcctggctaatccggtcaattgttacacaagctaagcagtgcaaaaaattctacattttatctacccccttcttctcattctcaactccaagcccaatccttttgttcttttctcaggagctttagaaaacagatggttacaccatcctttgaatctgtcaatgaatcacacaaaatcaacagtgtttttctggagggacactattgtgttcaacaatacagaacgacatatcccagtttgctccccacatacaaacataccagattccattaccaatgagctattcaaagggattttaccagatgtacttaatttaattcaacaattattaattcaatgactcccgtgctcttggtattttattatgagctgtgcaggacccttcggaaatttaaaattttatggtggagagggacatacacgatgagaaagagataaacaattcagggtagtttaagattaggagaacgtgcagacattatagtttttgaagcactaggaaaatctttagagttcagactaggctaaataaggtgaggagataaacatttaggattttttttaacttttcattttctatttttaaacgttattttgtattgtttgtttgtttacttaaaaatattttgggaggggatttttactattggccagctagggtcaaggcaggggtatagagcaaggtggagatgggaagactaagaggcttctgcagtcactaaggcacaaacgccaaaggctgggttgagggtaggagcacagtcatatcgaagacttgacctggctcaatgacacaccggcaaggtttggatctcagtgaccaaaggggattttcatgtaactgacagatgcaatgaagaaaaacactgagcagagtgcttaaggtatcagagaagaatctcagcatgtggaaacaggaaggtagttaaaagtcaacactggacccagacttatgatttaagagagagaatcatcactttgtgttccttcactctccacacctcacagctttctgcagttagtatgggagtttggtgggaacctctgcactttctcccactctttcgtatccacgtcaaaggtcaaactcttcatatgccaaaagaggcaccttggccgaaccccaatccacaaaggaatgcactaaatcactggaagtgctgcacatgaagacaaaaatccaacaccatattaatcattggcaggttgtatttcctgtcccttgaaaagttagccacttcactgttcacaaaagcaaagacttggaaccaacccaaatgcccatcagtgatagactggataaagacaatgtggcacatatacaccatggaatgctatgcagccatacaaaaggatgagttcatgtcctttgcagggacatggatgaagctggaagccatcattttcagctaattaacacaggaacagaaaaccaaacaccgcatgttctcgctcataagtgggagttgaacaatgagaacacatggatacaggtggggaacatcacacaccagggaccgtcagaggatggggagctaggggagggatagcattaggagaaatacctaatgtagatgacgggttgatgggtacagcaaaccaccatggcatatgtatacctatgtaacaaacctgtatgttctgcacatggatcccataacttaaagtataatgataaaaaaagaaaacctttaaaaaataaaataaaaaggtaaaaaaaaaattagctgcttatacagcaaagtgagagtagttttgcatttttcttaagtatctactctgcaaaccaagaaattaaatcaagctttgttgctaacaaaacaaaagagctacttggtatcaagtaaaaacataatgggattaagggaaacgtacatacagatgtccactggccctgagtggagggaacagatcatgtcagggaataggtaactggcacttcctcaagtccatgccacactcctggaagcatactcatatctggttaactgacactaacccacagcttgcctcactgagagcaggaagcccagagccgtcctttcttctctttccttttgctcatcagcactgctcttttcaaattttgtcagcctgttgtgttcacgctccttgaacaagaaaactgtcatttggcgtgacatctctctcctaccctggaactcaacaggctcctgaaaacctgcaaaattccagacatacttattctgtgaattttgaaaatctcttactcattttaatgtatccttctatgatggtgattttctatccgcattgacacccaaataaataattaagaatcatcccatcttccaacttgaataatgggcgtaaatagtgacagaatccttttttacttccgtgttccacttattcaggttttcctcctcaatcatgttgtttaatttctcgtcagctaagcatatctttggacagacaaagcaattttcccctacagtgtgtcaattctgcagtgaaggttttctgtttacctgcctacttccttagctcaaaaaaaaacaaaataaaataaaagtctcatactcaactgtcacacatacgcttcattttcattgtgtttgatatatgaattccatacagtgagacaggtcttaaaatccagcactcagcgactacttcatctcaggaccacccttttacagacagccatggtgataagagctatagctgacatttcctaaggattctttgataaatttcatcacttccttaactgcattcctattgcttaatcaagatgcccctggggccgggcacggtggctcacatctgtaatcccagcactttgggaggctgaggcacaagaattcattgaacccagaaggcagaagttgcagtgagccaagatcatgccactgcactccagcctaggtgacagagcaagactctgtctccggaaaaaaaaaataaaaaagcccatggaaagaaaggctatcaagaagaaaggagaacggcagtccagggcacagaaacacagaaccagatacagggagcatcctcaggaggttctgcacgctgcctgtgactcaaggcccacgactcttggtcggcggttttcaaacccactgttttccaacaggggtggggggaaatgtcaccaaaaattgtgttaataattgttgctggtttgcaaattatttttatttttcctataaactagaataaatccagggcatgtttatttaaaacagtactctcggtcttgcatgccaatatggcctagtttccatgaagctggcttgggtggtagcaaagactaggactactgtaggaccaggatatggccaaataactcgtatttcaggcttacttcttaagtgggatgaaggcatacagggtccttgcttagagggtagaaagattagttctctctctctttgatcccaaagctttttcccttctaagtatggggacaagaaagctcagacagcatcctatagacaaaggccttaccgctctcactttttcctttgtacattttctattcttccatgacattaggtagtatgggtctagcatctcccttggattccagtgccctacccatcctcacctcagcctagacccatcaagggacagcagccctcagcaggtcttcgacaagctatacggcaccatctctggcaggtcattcatttcttccttttgatctgtctctgatttgaatatgataagactatggtgaccataccatttatcattcaaacaggagagctcttgtgaaggagagcttattgactgatcaattgattgatgtattaatttaaagacagtctcttgctctgttgcccaggctggggagcagtggtgcatcacagctcacagaatctcaacctcctgggctcaagtgatcctcctgcctcagtctcctgaggagctgggactacaagcacacaccaccgcacctggttaatttttcttttctaatttttagtagagacaaggtcttgctatgttgtccaggctggtcttgaactcctgaactcaagtgatcttccggcctcagacttccaaagtgctaggattgcaggagtgagcctcaacacccggcctgagccaccacacccagccagcacttcaaataatataataatgatatgatatgatatgatatgatatgatatgatatactttaataattattaaaatcataataatgatagcaattatgggacaaccaggcacacatactagaattatcctcccaggcaagtcgagaaaatatagtgtgagtttttcttgtaatgggacggaaagattcagtattttagtttcggagttgggaagatgaagaattgattttggcctactttagattttaagccattctggcaaaggagttctccataggtccacagatccagacctatttaatcaatatctatagtggggcttagggacaaagcacctacattcttgtattttgatttatcatctgtgcattagtgtctcagggactttgaaaacagggcttaggtactattttgtctattggctaaaatgccattatatttacttaagcgcaaccacttcattatttataacaccaagaataattctaaatcctttctccctgaatttattccctctctcttccaaagacctgggtctcatttatagaccacaatctacaaacatctgccccaaataagctacgcccataattccatttctcacgagagtccctggaaagtaacaaagcacctaaatgacactgaaagataaaatccttattttatcctatcattattttagaacgtgagttatatcatttttttactctaaatgaaccacccaaacatttttaagaaaaaagcacttcatatgtttatatatccaaccgggacagacattacaatttacactatcattttgctgtcacactgtttagaaacattttccatagaagataacccctgaaaactttctgtataaataaatactagcagaccctctgcacttctatttatgttcaagtttactgagactcagtgcaaagctatcttgcttttaaacaaagcactcatagataacaagtactttccatatcttcatccccattctcaatcatacagctaaatttgaacaaaatgaaaagaacttaagaattagatgcccaagtgagtagatgataccaaagcagaacaagttcacagcaagatgtttaataagagttttggctttttttgtttttttgttgtttttttattaattaaaagatgaggtctcgataggttgcccaggctggtcttgaacttgtgacttcaagctatcctcccacctcagcctcctgcatagctaggattacacacacatgctactttgtccagctgagtttggcaggtttaagggggcaaaaataacatcattcacatccacaattttaacttctagggttagcttttagcgtactcagaggaaaaaagaaaaaattccctggaaaaggggaatttatttcctttagtaaaacaaaaacccctctggagagaaacctagaaaatgaatccaagattcaaaagtagcatcaagggtgggcatgcaaagccagaaaaggagacccagtgacaacaagcagcccagcccttgactagcaaaaatactccctacaaagaaggaagtgggaggaatcactctgcccaattttaaggctcatcatttaaccatagtaatcaagactgtggtactggcaaagggaaagagacctagatcaagggaagaagaatgtagaacccagaaatgtagacctaaagtatgcctgattcttgataaaagttcaaaaagcattcagcaaagtaaggatataatctttaaacaaatggagctacagcaagtggccattcacaggccaagaaaggagcattgacctgcctctcacactttacactaagtcagttgtgacctttatctcttacaccaaatttacttggcatggctcatgcacctaaatgtaaaatgtaaaactatacaacttttaagaagaaacttaagaaaaaaatctttaggatatagggccagagaaaaagttactaggcatgacaccaaaagcttgatccactcaaggaaaattgaatctaatcaaaatttaaaactttcactctgtgaaagcccatgtgaagagaatgaaaaagaacagtaacaggcagaacacagaggattttcagggcagtgaaaatactgtgtatgacagcggtccccaaactttttggcaccagggaccggtttcatggaagataatttttccaacggatggggacggggaaggggatggtttcgggatgaaactgttccacctcagatcattaggcattagattctcataaagagtgcacatcctagatcccccacatgcacagttcacaataaggttcacacttttatgagaatctaatgccaatgctgatctgacagaaggcagagctcagggagtaatgcttgcttgctgctgctcacctccagctgtgcagcccagttcctaacaggccacagaccagtaccactgtgtggcctgggggatggggacccctggtatacaatggtggatacatgtcattataaatttatctaaacccatagagctatgtcgtttatgtcatcaagaggtaaccctaatgtacccaatggattttgggtgataatgatgtgtcagtgtatgttctccaactgtaatgaaagcatcaccctcatgggggatgttgataatgtgggaggctgtgcacgtacaggggtagggagtatatgggatacctccagacatgtctctgaattttgctgtgaacttaaaactgctctaaaaaaataaagccttattaaaaaaaagaaaagaaaaaaaagacaagctataggctgagagaaaatacatgcaaatcacacaggtgacaaagaacaagtatctagaacatataaagaattctccaaagtcaatattgaaaacacagataatccaattagaaaatgggcaaaagacctgaaaagacatctgactgaataggatatatatatatatatatatgtatggcaagcacatgaaaagatgctcaacatcattcggcattaggaaagtgcaaatttaaaccacaatgagagcacttcacacctatcagaatggatgaaatgaaaatattgacgccaccaaatgctggcaaggatgtgaaaaatctggattacactcatactgctggtgagatgtaaaatagtatagccactctggcaagtacttttataagaaaactcacactcatgtaactgcagcactttgggaggccaagaaaggtggatcacttgagcccaggagtttgataccagcctgggcaacctagagagagcccatgtctacaaaaaaaaaaaaaaaaaatttaattatccaggatggatggcatacagctatagtcccagctacctgggaggctggggcaggaggattgcttgagcccagaaatctgaggctacagtgagctatgatcatgccgctggattccagcctgagcaacagagactgtctcaaaaaaaaaaaaaaaaaaagaaaagaaaagaaaaactaaatattcaacctgcaactgtactcttggacatttatcccagaaaaaggaaaatttaaattaaaaaaaacaactgcaacaaccaccagtatgccagcattcataacagctttatgtgtaatagctaaaaactagaatcagccaagatgccaagatgtccttcaacaggtaagtggttaaactgtggtatacacatatcatgaaatactactcagcaataaaaattatatattccattaatataaaatttctgatatgaccaactttcagaaattgaagacggattagtggttgtcaggaatttgaagggagccaggggagagatgggtgtggctatagaagggattttggtggtattagcactgttcaatatcttgactgtggttgtagatacatgaacctacatgggtgaaaaaattgtgtataaatctaaatacacacatacgcacaaaaaagtataagtaaaactggggaaatctgactacacttggtaggatttttttggttttgttttttgagacagagtcctcctctgtcaccctggcaagagtgcagtgccatgatctcagctcactgtagcctcaacctcccaggctcaagcaatccactaacctcagcttctcaagcatttgagaccacaggtgcaagccaccacacctggctaatttttttttttttttttttttttttttttggtagagatgagattttgctatgttgctcaggctggtctcgaactcctgggctcaagtgatccaccagcctcagccttccaaactgctaggattacaggcatgagccatcatgtttggcctggtagactgtattaatgtcaatatcctgattgcaatattatactatagttttcggaaattataccactggaggaaaccaaactaagtgtagaagggctctcactgtattattttgtaaaactgcctatgaatccacaattatctcaaaattttccattaataaaaaagtgctgaaaattagtatcattaagatgcatactgcataacagaagtgaaaataccagcatacaaaagtagtgaaactattctaattttgttaaaatgtaagcacatgcttgtatatttcttcatttaaaaaaaaaaaaaagattaggagaaaattccagttaatacttgtcatttctgggtggtagaattacacatacctttatttgcattttaactttttcctcaaattttaaacttagttttcaaacagtctctaatgaatatatcgttttcatattccagtgttataaaaactgcttgatatcaaaagcagaaaaatccatctcatatatattttgtattacacacaatgtcaaagaacgtagcttgtctggggactaaaatattttcagttaagaaactatctgaggtggtcatgttaatttagaagtagcaaataaatacatcttttgattcaatcaataaaactcaccctacatattgctattttcatttgatcatttccatcagtttctattttagtaaaaataaggctttcaggaaaactgaacttcagaggagtatgttgctctgaataactgctctcttgcctttccagtcctggaagaatgccagtggtctctgacactcaaggactactgagagagacagaaattaagctggaaaaacacaattcagtctgtggttactaggaagttagacacgttttcttcccctgaaaattatctccatttgcttcagattcttcacaggcctccacttaacaccctctcgcagcacggtgcaaaacaaatctgtcagctgcaaatatggccatagaaactttttccccaattgctagggaaacaaagtgaacagcagagaaaacacctccggcaagactgtacggctctgctgtcatgttctgtgcaataactgtgactctctacttgattttctttggcccctggctctggggacaatttgcttcaacaaactagaagcagtcatatcacacctatgagtcatcttatggcctgttcccattcattggcctttggatttgggggttctccatagatggtatctctcctctgggcattttggaaatctgtaggggtgtttttttgtttgtttgtttgtttttttggcagagactcggtgtcaccaggctggagtgcagtggcacgatctcggctcactgcaacttccgcctcctggattcaagcgattctcctgcctcagcctcctgagtagctgagactgcaggcgcacaccaccaagcccagctaattttttttatttttagtagagacaggttttcaccgtgttagccaggatggtctcgatctcctgacctcatgatactcccgccttggcctcccaaagtgctgggattacaggcatgagccatcgcacccagccctgtagggttgttttctaaatgcagagaggaaggggattgttgcagcaactggacaccaaaactgggatttaacaggcagaatctcttaatgaattatgctatggcatgcatgacttaggactgtctcagtggacaggaagtgaaacgccaagcatctgaaccaagaatcttccttcatttcacataaaaacaaatgcacagtatgttttttatagttttaatacacatcacacactaaaccatgtaaatttagaggaaactgctactttttctttgtaactttactaagagttatcattttggaatattgaatctccaacagcaaggtctttctggtttacggtagcccattcgatgaatctgtagcaggtgcttttatagctgaaacattcacagtgattctatgtataggtgcaagcatctcactacttcattaagtcctaaaaagtcttgctactcaaaacgtggtcacggaagagcagtactgacatcacttgggagttaattagaaatgaagaatctccaggcctggtggcatgcacctgaaatccaagctatcttgagaggctgaggcaggaggatcgcatgagcccaggagtttaagaccagcctgaataacacagcaagatcctgtctcaagattttaaaagagaggggggcaggggaggaaggggtgattgatgcggcttccatttggaatttaaggcaccacgaagagtgacaaaggtcatggttgtggtggacacttgggctccaaaagaggctcaggaggagagttcaggccctttgtaccacatatcccgtttgatttctatttgtgtgaaatggccctcccctgggtcaagccaacacctgatgcaacttccttcagtgaggccttcctgaagagcaatcaggacccagctcctgattctgctgagcaggcctcttacttttccctggtgacaaaaataaacaatgtgattgacaatctgtggctccagggacatctgaagtgcaaattgaagaagttggataggtgggatcctataaaaagagaatggtcactacaggccacagtgcagctgccccgctggtaatacacaagattctgccaaggctggaagctgttgctgccctgggaaacaaagtcgggggaagcctgagagcacaggatccttctgaagttttgaccatgcctaccatgctgacgaaactggcttggaaatcagttcttctgatgctacagtgaagactgtcattacaacagtgccacccagtcttccaaaactggacccagaactccgtttggatatcaaggtattgcagggtgccttagcagccattcggcatgcccgctggttcaaggaaaatggctctcagttcacagttaaagttatcatcagactactgaaggacttgagggtttcgttttcctggctttgagcccctcacaccctggatcctaggcctactaagtcattatgctgtgataaccccaacagacagcctttggccctgaacactgcacataggtgttgcttgcagattctaggtgcaggactgttcctgccagggtccatgggtatcactgacccccgtgagagcggcaacttcagagtacacacagtcatgaccctagaacagcaggacatagtctgctacacagcccagactctggtctgaatcctctcacatggtggctttaggaagatccttggccaggagggtgatgccagacatcttacttctgaaatatctacctgggatggagtgatagtaacaccttcagaaaaggcttacagtagtcattagagaaaaaggaaagggaggaagaagagaagacagaagaaccacctcaaggagaggaagaagaaagcatggaaactcaaaagtgaccttcccttcactccctttcctacccaagggggaagactgaggcttaaggtaggtgctactggtaggtgctactgtgctttatatggtgacagacatttccgtggggtagggaagatagcaggaagggaaataaactctacagaagtgtcattccactgggttttgacattggcttagcagccaatatcaaatgttggtatccttcttcattatagatgaatggcattatgacctatgacattcatctacaatgaaggaggataccaacatattttcctaatattctagaatccccacctcctgaaaacccctctcttaactaatacttagcaggatgaattatctattcatcttatattaggataataaagggaacacattgaaaatatttattccaaatcagagaggcactgacttgagaactactgagtaagaaactattgacgctggcagctctgtttgtacctttatttttctacactatccctactctggaaaaacagactgcaagagaagcaaatgtaaattttcctcgactatgatttttgtgccccaaattgtcctcactgaggcaatgagatgttaagtcactaaaatgtggcatctaatgcaacttgacactcacaaatggaaacatctggaaacacatagtccctctgaaacccagacatcagtctcttcaagggaaaacaaaagctctaggagcacttcccttgaacaatctttttacttgataaagcattccaccttactgcttctcacaaggaaatatgccttagcttttatcaaagtaagttctgttttgaaccaaaataaagacaagattggattttcccaggatacaataaaacagacctgagttccatgttcctaactgctcaattctaccaaagtgtcccaccagcagctcaaatacacttcaccttcaaatttgcactcagtatcttctttcctaaacctacattttgtcctttgctccctatttcagttaatgacccaaagtaaataaaaataaaaaaccactccaatctcctagttctacaataataaaatatccttcggaattaactacgtgccaggtcacagtgacaccaaggcaaaagacacatcatccccctagtggagaagcccacagacaaggaaaactcctgggctggttacagttacatcgtctggaatattcaaagtcatcttggaatcctccctctcaactgcttcccacagtgaaatgtcaggacctgttaactttatttttgtgccaagtgctcattgatttactccatcagcaactagtaatctaactaacctaattagctgcaacttaactaactagaaggtcaattaactgaaatctttttaattcaattcacaggaaaaaaggtttttcacaagccagcaagctaagggcaagtatacgggatacctgtcatttttaccctccaggcatacgtgtctgctgcttctggccgcaccacctctattttcttctggggatctgtatcccgtgccccttccccggctcagcacatgttgtttcaatgaggttgaccctactccttggcacaagagctgcacacaatccagctctgcctaccacagcaataggagtggctgcaaggaaaggactcactgggcccaaatcagccaatgagatttaaatcagggactttgttggaaggataggaaataaaggtttaatttccactgcaaatagagtagactacatggagtctatttgattacacaggcaaatatattccttgagaatcaaatgaatacagaggaagagaaaaaccaagggacagagaagggttgagtcctggtgacacactcttttagcttaaaaaccccactcctgatacactgtcacactgttattgctgtagacagttggagttggctttctgacacttttaaagaaagtcttagcagaaatgttttaaaatgcttttttaaaaactgctgaatttttttagtcaaaaacagcactaaatatacaactcttttttctttctttttttctttgagacacagtcttgctatgtcactcaggctggagtgcagtgtcacaatctcgattcactacaacctccacctcctgggttgaagtgattctcgtacctcagcctctcaaatagctgccaccatgcccggctcatttgtatttttaattttttttttttttttttaagtagagacagggtttcaccatgttgcccaggctggttatgaactcctgacctcaagtgatccacctcccaatgtgctgggattacagcctcccaatgtgctgggattacaggcatgagccaccacatccagcctagatctacattttaaccactattatagtctatgttaaaaattgatattttgaatgatgcctatgaaataccatgatataatactatgatattctgagcaaaagaaattctgaccaatatgccccacttaccaaactagcaaaatgtgcacctaattttagactgtccagagtgaccatcctgagagtatttcttaggacactggtgccttaagaaaaaagaggttcagcctgggtgtggtggctcaggcctgtaatccaacattttgggaggccggggcaggcggatcacaaggtcaggagattgagaccatcttggctaacacggggaaaccccgtctctactaaaaatacaaaaaaattagccgggcgtggtggcgggcgcctgtagtcccagctacatgggaggctgaggcaggagaatggtgtgaacccgggaggaggaggttgcagtgagccgagatcgcgtcactgcactccagcctgggcgacagagcaagactccgtctcaaaaaaaaaaaaagaaaagaaaaagaaaaaaggggtttcagagcaaatgtatgtggcaaagtctgcataccacagccccctcttgggaagtcaaaatgtatgaaatagcaaaaaccacaattacttttgcaccaacctaaatacattgacacattatgggctctgtaatattctacactgagaaatctgttttccttctttgaccacataacttccttttataattattatttttatttatttttagcaagtgtaaacttttagcagaacattatgttcaggaaaacactgaactcaaaggcccaccagctccaccttaaacaaattcctattctagtctactgctgtattgagaaaaatgaaaaaaccttgaatttccaaatctaacagaatttaaatctcactacctcagcgtgaatcaaaataatatagttccagaagttatactgtcagcattatagtacatttatcaattctgtatttgagactgctgtggtgtgtttacatctgagcaagaagaaaaaggcatggctaactggactgaaatcgttccaggaaaataagtgcttaaaccagttccaacctaattagcttctcacaaaacctaaaatcctgcttgatgcaaccaaatagccattattaaatcaaaatccaaagtgctacatttcagaacagaataaaattcaagttgtagctaattactccaaagtcaaaatttaaatattctgtatttgtgattgaattacatgactctaacactacttgagctaaatcaagtagacaagtataggtatataagacctttttttaaaaaaaaaatgtgatctggacattcctagatcagatgttctaacttagcacagtgagacacagaactcaaggaataagcatcattgagaactctcaatgttagaacatgcgatacaaaatccatgttttaaatgtttcaatggtcaacaaagacagatatcgtttattcattgattcattcttgcttgtcagcacacatgaattcatttagcagatatttgctgatggcatactctgggttaagaactatactaggtgatggggacagagcctcccctcatgttatgggtgaaactgtgcctccctgccaaccaaactcatatgttgaagtcctagccctgagtccctcacaaaaagcctacagtggccttgacttaccctacatagacttacacaattcatatatccctgagagatagccagtgtcatcaccaacatcatcatcatcaccatccccattttgtagataaggaggctgctatggtttgaatgtatcccaaaaattcatgtactggaatcttgtcccacagtgcaactgtgttgaaaggtgggacctttggcaagtgattgggtcatgagggctctgtcctcatgaatgaatgaatgcatgggttatcgagggagtgggtgagttgtcatgagactgagtctgttacaaaaaccagtttggctgtctcttgtgagcccccttgccatgttatgtcccgagccaccttgggactgcagacagtcctcacaaacaagaaggtattcatcaaatggggtcctagaccttggccttcccaacttccacaattgtaagaaatattgcttttttgagacagggtctcaacagagcagacagggtcttgctctgttgcccagactggattacaatggcacaatcatggctcactgcagccttgacttcctgggctcaagtgatcctcccacctcagccacttgagtagctaggacctaccataggcatgagatactatgcctggctatttttattttttaaaaaaatttttatacagatggggtctccctgtgttgcccaggcttgtctggaactcccatgttcaaccaatcctcccgcctcagcctcccaaagtgctgggattatgggtgtgaatcactgcgcctggccacataataaatgtcttttctttataaattacccagtctcagggattcagttacagcaacagaaaacagactaagacagaggctaaaacttgaaaaggttgaaaactttcctaagatcatgtaacctttaaatgcagagcaaggacttggacccttgtccacagtgcccccatacaaccgggttccaaggcacctggaccataaaatatagcacaagaattgcccacgtttctaagaaggccaagtgagattctaaagacactggaaacttgaaaaagtgagggaaatgcccacaatcataatttcctggaggagctttaatgccttatttgaaatgtctactgtcctctcaccaaagaggaatccaggttagcctctttggagagaccaaaggcggcctgatccaagaagaccagcagatgttgaattctgacagggtatccatattcagaacagtttttttttgtttttgttttttgttgttgttgttttgttttggagatggagtcttgttctgtcacccaggctggagtgcagtggcacgatcttgactcactgcaacttctacatcccggattcaaacgactctcctgcctcagcccccgagcagctgggattacaggcgtggaccatcatgcctggctaatttttgattttagtagagagggggtttcaccatgtcggccaggctgatctcaaactcctgacctcaggtgatccacccacctcgacctcccgaagtgctgggattacaggcatgagccaccgtgcccagcccagaacactttcttaacggaggaccaaaaaaatgagtaaaatatacagacaggttattttttaatcagcagaaaatcaataaagatgaaaactggtgatgtaaaatagagccagataactaaccaaacaaacagaaaacaagaggcattgagaatcagacttcctacattctgtaatacactcaaactcctttaaaaaaggttatatctaagccatagcagctgtggttattattttcatataaatacttaagaagtgtcatacactgcactaagcagtgtgccttgagcaaatcacttaatgtttccatgccatggtttaatctatagggccagcatctaccccacctgtctgttgtggggattaattgaaatggtatacataatgtgctttggaatatgcctggcgggtagtaagtgctaaaaaaaatatgaagtgttctcatcaccaccacccggggttcaaccttctaaggaggatttcttcaactccatttttcagatgagtaaactgaaccttgataagccatcctcaggggtcagagaacaaaagggacttaatcaggacagtttcggcaacaccaaaagttgattctggctaagccttcggctcattcccagcaatacctggaaacagctacaatgtgctgcaaatagtagtgcccaggtatttccacctaacttgtactcctgtgactaacccctgagctgcactactcaaagcaaggtcctctaatgcataataaaacaaatttactaaaaggcagaaatctattaattacaaccaaagacttccataacaaaatactgcaatcactactcactacctggctggctgtctctttgaacaggctgagataattggttttctttacattttatttttcctactgaattactttttttgtgtgtatgtattagccactaccacattcaggtacaaagtgtgaaatttcttttgcatataaggctgctcgtgctcaagggaatatttagtaaattagatgggcatttattaccaaaaattacgcaggaaggaaagggaagaaggtccccaaattaataatcttattaatacacaaatgccatgtgaaatccattctcttctactcccctgaacaattctcttcaacagagataaccgataaggtagaaaaaagagggtcagagagaactgaattcaaggaagaaagacaaaaatgggaaaatgaatacaggataaaagatgtattttaggtgggagactgttgggacaaagttcggcctgattcaggcatcacccccattaaataatagatgtggccaatcttgtcccagggaggtaagacttgcagagttcaccttatggaagcagatcataaggatacatgtgaaccaaaggaaaacagaaggaggtcctggatatcctccgcttcagtcctcctagctccagggaccttggaacttgtacttgctccctctgcttagactgcccattccctgttcttgaaagggccaactccttatgttccaggtctcagtcacatcctttttcttcccaggacatatgatctgaaattatgaagttcatccatttatagacttgctttttttatgctcagtaggtattgctgggggatgaatgaatctacagtagacgcctagacctcttttaaggagagataaggcactggaaagccatttgatatttgaattgttggaaaagaaataaaaagacttcatttgctgtgcagattccaagggctctcagttccagctgcaggccatgtcgggaagttgtcccagtcaacatccaggacactgggaaaggcctctgtggttgatttgtgatgtctgccatgagtgtagccaccaatatttgtgctttactcactctttactcatcctacatcacctaagatactttccttgttgctaccctccacaagcagccagaatgaccctcccaaaggtaaggcagatgctatcacaacacttctcaaaccctccaacagctcctcttctcactcaagataaaatccaatggccagtcaccgtccatctcccttcccaccaaatgggttccagcttcactggcgtctttactattctacaaatacagtgagctcactcctgcctccctatcttagaagcattttcctccatcagaaacatcccccttccctaactttctgcaggtacctattcaactcaccttatcaaggaggccttccctgctcaccctatgtaaagaaaccctctgtctccatcactttctgccatttcattcagctttagtcttctttataacacctaccacttgagatacatttttttaattatctgttttcttcattcaccctttgtagcctccccatccaatacctttatattggattttatccaatataaatataaaggaattttatcctttacattcatggggcatctctaacacttagaacagtagttgatacataaggagtccccattaaatatttgttgaatgaataaataaatgtattccccacttataattaaaataattaaaatgattaaggccattttcatctaaagaatagcttaactgcccatgaaaatacatgtccatgagcttcatgttttttttccctcctgctagataccaaaaacagaatttcctaacatttgtggcaatacaataaaataaaataaaatatacatttggattctcaacaaaaattaatgtatcacaccacagcatacatataataaagaaacaagaataggggaaaagccaaacccttacaaattttccctaaaggagtggttctcataatgtgatccctggactcagcatcagaagcccagaacacttgctagaaatgcaaattagagaagaactgaaggaaatagagacacaaaaaacccttcaaaaaaaggtaatgaatcgaggagctggttttttgaaaggatcaacaaaattgatagaccgctagcaagactaataaagaagaaaagagagaagaatcaaatagacacaatgaaaaatgataaaggggatatcaccaccaatcccacagaaatacaaactaccatcagagaatactacaaacacctctacacaaataaactagaaaatctagaagaaatggataaattcctcaacacatacactctcccaagactaaaccaggaagaagttgaatctctgaatagaccaataacaggagctgaaattgtggcaataatcaatagtttatcaaccaaaaagagtccaggaccagatggattcacagctgaattctatcagaggtacaaggaggaactggtaccatttcttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaataacccttcatgctaaaaactctcaataaattaggtattgatgggacatatctcaaaataataagagctatctatgacaaacccacagccaatatcatactgaatgggcaaaaactggaagcattccctttgaaaacgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaactgctgctcaaggaaataaaagaggatacaaacaaatggaagaacattccatgctcatgggtaggaagaatcaatatcgtgaaaatggccatactgcccaaggtaacttacagattcaatgccatccccatcaagctaccaatgactttcttcacagaattggaaaaaaccactttaaagttcatatggaaccaaaaaagagcccgcatcaccaaggcaatcctaagccaaaagaacaaagctggaggcatcacactacctgacttcaaactatactacaaggctacagtaaccaaaacagcatggtactggtaccaaaacagagatgtagatcaatggaacagaacagagccctcagaaataacgctgcatatctacaactatctgatctttgacaaacctgagaaaaacaagcaattgggaaaggattccctatttaataaatggcgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcgtgggcaaggacttcatgtccaaaacaccaaaagcaatggcaacaaaagacaaaactgacaaatgggatctaattaaactaaagagcttctgcacagcaaaagaaactaccatcagagtgaacaggcaacctacaaaatgggagaaaattttcgcaacctactcatctgacaaaaggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattgctggttatatacccaaaggactataaatcatgctgctgtaaagacacacgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaacaacaaaaaaccaaacacctcatatgctcactcataggtgggaattgaacaatgagatcacatggacacaggaaggggaatatcacactctggggactgtggtggggtggggggaggggggagggatagcattgggagatatacctaatgctagatgacgagttagtgggtgcaacacaccagcatggcacatgtatacatatgtaactaacctgcacaatgtgcacatgtaccctaaaacttaaagtataataaaaaaataaaaattaaaaaaataaaaaaaaaaagaaatgcaaattcttaggccttgccccagacctactgaatcaaaaactctgaaggtagggccccagaaatctgtactttcacaaaccctccaaagcacactcaagtttgaaaactactcccctaaagaaaaatgtgagattttagaaactgatttttaactacatacaattttgacatttttggtttgtacattaaaaatatgacattccttataagatggttgagatagcctctaaagaatcaatagcaggctgggcgcggtgactcacgtctgtaattccagcattttgggaggccgaggcgggcagatcacgaggtcaggagttcaagaccagcctggccaacatagtgaaatccggcctctactaaaaacacaaaaattagttgggcatggtggtgcattcctgtaatcccagctactcaggaggctgaggcaggagaactgcttgaaccgggacccaggaggcggaggtcacaatgagtggagatcacaccactgggcactccagcctgggctacagagcgagactccatctcaaaataaataaataaataaataataataataacaatagcaaatttcattctaccatttgaccaaattataattttgaatagtaatcatacatgaattgatctaatgttttaaatattttcctaaaatcaagctttgtattccatggctgccctggatctacttataaataaaactgaacaaccacatctgatttcatcctaatgttgtgatttttttgggtagcagttctgataattagtagggatcaaccaattaaaaaatgactgtaacacgtcgtataagaaaccctcaaaggatagaaaatgtgaatctctaacagcctcacatccaaaaatttcaccaaacatctttacctgaagctgtttctttaattgcttctaatgaagttgatgcatgtgttaattaaatattaagtgcaaatgtgagtacttctaagaggaagtacagctcttcaggtcaccaacatactccttacacccaccaatcctttagaacatgaaggctgggacccccaaatcacttattcaaccgcccctttttaacacaatgcggccaccatcagggggctcattaccaacttggaaacacaaaaattatgtccacaatatagcttaagggcagtttctaaaaacaggtttaccaatattaattgctggccttgcactaagtgttattcacatattatttaattttcacaatagctctgtaaggttttcatgtatccccagtttactaatgaaaaaaactgatgtaccaatagattatctaaaattctcataaaagaaaagctctaacttgattccaagtagcttttttcttgagacagagtcttgctcttgtcgcccaggctggagtgcaatggcgtgatcttgccttactgcaacctccacctcccggggtcaagcgattctcctgtttcagcctcccaagtagctaggattacaagcatgcaccaccacacccagctaatttttgtatttttagtagagacggggtttcgccatgttggccaggctggtctcgaactcctgacctcaagtgatccgcctgcctcgacctcccaaaatgctaggattacagccgtgagtcaccgcgcccagtcccaagtagcttttaatgcaaggttcacttttcttttttttttcctgtcacacacatggctcccttgagcttccaagacagaccccaaataaaggcacttttattataggactgaaaaagatgtgactaggaagagcttgaataagaacttcatttgccaagaaatggtctctggtggactcagatttttcccttttttcttccttgatgctcagaatcacagctgtacatttctaacaaaaagatatatgaatcagagacagccaatatgagcaaaagaataaaatagaggagaaaatagtaagaaatggctgcactggtagccgtgataaaattttaatttgaacattttctgagaacagattttagcttatcaagcgctatgcaaattatatgcaaatcccacacaatgcctgcatatattccccgacgcttgttattttatttatttattttttttgctctccctaggatgtggcccttaggaaatctacccccttggctcagcactctagatggaacatttgctatactgaagatgacaaatctgaaggtttctgatcagtattcagtacctgtgtttacgagcgagcccactggtcccccataatagcagcattaaatccaaatatcaagtggaatttatatacatatattttttaagtgtcagcttataaggcctcaccctagttacaggcaatctttagccaccctgcttctttaaaaatcaacgcacaaacacaacaaaccacctcttggatgtagtcattaggcagaaagagtttccacagtggaacccaatactgccataacctttaaggtcaatgttgtaatttatcatgggaccatgtgcaggctaccccaggagacatctctcacatggcagaggtgacacacacgacagtaaggtgtcaattttacaatatatatgcagaatccaggccagaagctattaactagtcttgctagcctcttctcactttctagaattaattaccaagccctctcctaccctggtctttttgcttgttctttaaatgctcttgactcttctacacgcctttgcatccttcagggcacagccttaaagctcccttctctgagaggccttccttagctaaagaagataacccaattattttctgttaggccacctgtatgtactacaaccactggtacttattttgtttgttttacttacttatctccttcaggatctgaactccttgaaagcagggaccctgtccatcttgacaaccaggatattcctaaagccttaatgcacacttatcacataaataaataaataagcagctcctcctttttatttccactcccaaaagcttgggctcagcatatggtggtgagaaaccgtcttccttagatctctgagatgcaggactaccccctgctgagaatgatggaaggtacccaccttcatagaatacttgcaagcagaatctggagcagagacactgagaggacgggcttggagaggcagcccaccctccacgttcaggagcaccatgctgcacctgacaatctgcctcatttggccttcaaggcatgatgcgcatctctctactgttttggcagggggtggctggctttcagtctttgctgctatacgtgcttcctgactactgaaccagaagatgagcaaatctgacaactgctccaatgcccagtgagtttaactagagtaatgaacaccacaagggcatctgctggacgcaggagtagggtgtaagtgaggacccatgactggccagtcaattgtctattcaaatgctagcaagattgccctggacaagttttctccctgattagaataaagacccaataaaaaaaaattgtctaagaatatttaaatatactccaggtgccctttctcatttcattagatgaactgcccttaggcaattctacccaagcccaaggcttcaattgctctttctctgctgatggatcttccagccaggacctttcttcctgagctcctcccagaaatccagctgcctcttggacactgctacttggatatcttgcagtcatctcagactcaaaatgtgcaaaactcacctaaggtcacactaatagaaagtggcaggctaatttatagtttagatgacaccaaagaatatacacaggcttcccagtgtgcccagatgcctccacctcattgacggggatgcctgcgggagagaaggagggagagtgccattgtaccaacttgcttgggtaaatgaacctcaggaaaatgagttctagattagtaatagcaatgaggatgtcaataaaattctacctgacctcccattaaccctgggaactgttaacttcagtgttagctagggatttcttagacatgcatgggcttaaagttgtttcaagaaattcacttgcttagaattcagtgagtttttttgggaagctggtacaatctgaacaaccctttttattgcttactttgcgttttaagggtctcagttaatgaagtatctcctagcacaggggatgagaagaggggaaagaaggcagggcatcaccaatccactattcccttttactaatcctcacaggaaaagaccatcctacaacatcctccaagtccagctggctatctgttctgcctcatttcttctatgttttattccaccaacacgaacaggcttagttttccccagccctgaacagagctctgtcctccttaggagacacctcatttgcagtttgtttccaagcttcaactcattccaatgttcttagacacagttgttaccaaatgagcaccagccccaagtgtcaactcaactgccatgtgaggagggagcatctaccctttccagtgggaagctcaaatcaggctggctgtcctagattgcctcctttccccaggcttcctacggggtttctagacattaccacttgccaggtttctcctgccctcgatcttctctgttccttattatctctgtccagagagattattttgaattgaaacttttcttcctcatctgacttggcaccaagaacttgcacatttgacaaaagagtcaatggggcttatgtggtttttaaaatttaggaatgctatggtagtcacttcaattttctttttcaacaatcattttaatcagtttctgaaaatttgtgtgcattcaagtgcatgacgacataaaaattcatttaaaaaaaaaaggcacaagtagctaacactttgtagaaatgcgcctctatggtgagctaaatctctctccttcttttcagttatcctctagaccccgtctcatcacagtctgcagtagatgtgcacttctcatatttacctacccttcccaataatccctattttccttctagacccaagacacggctttctactactgcacagactcctccgcggtttcctcaaatccccaaccaattaaaaatggctctgcctggctgaatttctagagacctttgctgaggttaaggatcagtcacaattcatcttatattactttcatacaaatactagataggacagaaatgcagagaatttcagaagattttgcaaaaactctcattgtcatggttttaagtcaaactaagttcttatcaaggcctatttgaagaaaaaaaaatttctaagcttacatttggataataaagtgctattttaagtactttaatgttttcagagtatgttagcttaactgagtattttctctgccctagaaaatttcacaaagtggttaacattcagtggcacaccaaggccagctatgatgtgctttttgaatttactgaaattctaattaaatacagagtatcttagtaagccctcaagaggagcaataccaacaatacattatcccttaaaaaagcaactgtgagcattcactgaattgtatactttaaaatggttaagtttgtgttatgtgaattttaccctgatttgtacaaaaagaaattgtacaaggtgcaagtcagtctaaacaacctctgatggtaatgcttctttattcacatggggagcagccatgagtatcacattcaattgcagaaaccctaatttatggctttgaataattctcaaaagctaagtcataacagatcttgaacattttcacatacccctagataattagacattaatgtgtcccattccaaagattacttgagtttggaaaaggaatttcaaaatcaaatggctacaaaagtttgagctcactaatatgaaacgaacttttaagtctcttgttcagacagggttaatgtataggtttggggctaatccttcctctcaacagagaatctaatggagtgttagcattaatgttcttattgattggcaaaataaattcttatggtgaagatatatttccttatctgcagtatatttctgtagatgaaatgtggtatcatacaaacccagctctgagtccatgagtaacaaatccttctgtaaagtacaaactgactgtatttgtgagaatatgcctttcagcattttctattcaacagctcagcaaactaagttctccaattaatttttttttctaatcaatgtaatgaaaacattagcacttttgctacattttgtcaggaaaaccactagtagatggtacacgggctagtttaaatttcattttgctttgcaaatgggatttaaaacaaaataatctttaccaaattgatgcttctgtctgaaaggaccaaaatttatgttttaaaaaatgctctgaaatagcaaaccatggcaactgttgacatgaatgagctaaatctgagcggaactcttaaaagcctcactgggatatttagcaactattccagaaagactaaggcgccataccatagcctctgccttccctgaaattacccagcctccattcactgacttaacaaatgtgcgcccagcacctcctgggtgccaagcacagtggtctgaatgggaaactgtcgaaaatgagccaaagtcctctctctcaatgagctggcaaacagcatcacaacagactgtgccaaataaggacagaagaaggcttgaggtggttaggagtccagaatatcctggagaggagtgaaagataaggaggatccagacaggggatgagaagggaaagagatgtggaggggaaatggaaatgcaaaggtccagagacaaagcaaatctgacagcattactgacttcatgttgactacagcgtaatggatgggtgggtggggggaacagtatgggatggaaatgaaaacgcaagcaggagccagagaccacaggactctctcagccatggtaataagttccagcatgttattttaattgcaacaggaagacactgaaagactttattcaggatgctcaatttgctttaaatcctagtcctataattccatctcacaagacataaacaaaaaatgtccataccaaaaccacctgtggatttcatttatcatttcaagtgaaccaccgtctcggcatggcagtcggataaactaaagacttggcaaaagatttcagggaatgacagctcattgatcaaacacgaatgtgtttgccgtagttactgtagatgttgtataaacttctattcccaaagtctgaccaaaccttagatgtaggcaactttccttcagtgctgattggcagggctctaatgtgtaatctaaaaagtgaacctgccatttcacacttccaaattaaatatttaatgactgatatgtttcagggttgatgctatgccacatagaagcactttgtcaagaatcaaaccatgcaattgagatggcaaaagagcacagtggctcacacctgtaatcccagcactttggacgtgcagcctcgcctccccgagtgccagggcaaccggcctgagccacagcggctccctatcccagcactttgggaggccgagccaggtgattgtttgagcccaggagtttgagaccatcctgggcaacacagtgagacactgtctctctaacaaaaaaaattttttaaatagtcaggcatggttgtgcgtgcctgtaggcccagctacttgggaggctgaggtgggaggactgcttaaacctgagaggttgaagctacagtgaaccatgatggggtcactgcacggcaaactgggtgacagagtgataccctatctcaaaaaaaaaaaaaaaaaaaaagttggcaaaagaatccctggagaaaagataattattaagccacaaagataaaaagatatttcaccaactatggattttacacaccctctcaagcttctttctcagtaaaacctttaaactatattgatagctgaaccagagaggaaagcaagccaataaaattaggaggtcgctaaaaatccaaagtcatggccatgccaatccaacctgcggctgtaactgtgtgaagaatataaaactggcacatagaaagaatgaggtaatattggataaggtatcaatgtctacacactttaaaagcatctcaccatcaaaaagtatggaattggacatagttctacatatgtcctatttaccaaaataatcacccctataaatgtaacccacttcctggagttgaaaaataatctttagaatcaacctgacaaagccaatgcctctcttacctgaggttcaagacaggacaatgatttacagataggacccaacctggcttttccccccttttaaagaaatcaatggcatttaaatatggaaatgaattgttaaaagaataaagagatggtagtaaacgccaaaagaagaggaaggttagctttcattgggataagtatcctctgtcctcttgtaattaccagtgagaagctcttctgtgcctgaggaagagagacagaacaggctcagaggagcagccaggtgcttgcttcactgatagaggtgacagacccctcagagacgaagaagcagagacggactgggagatgccactgcctcacttaactcagaacatctctttcttttgaaacttgaatttggggagaaagtgctcaattatttcttctagttaaggcttgggggcagtcaggtgggcaaatcggtcattggtggtggggaggaaagaaaaaaggaaggatgaaaaagtgagaaaaaaggaagggagggaagaagaggagaatgatggcaagagagtaaaaagcaaaagaagaaagaagagagaaagaaaacgggggaaggacagagaaagaacagacaagagctagcattatatctcttctggtggcttccagacagactgccattcttctcaatcaacccttcccttctttcttctttttcttcttcaccaaattccaggatacctgggtaggtgatgaacatgaggagaaaggagaaacggtaaatccacccaagcaggaaggagtaatttccaactctatcacccatctcccaatgcctcacaaattctgtggccttagaggggcaaactgaggttttataaaggttaacagaggttttataagggttctaatttacctggacctcagaagagggacaagcctgcacatctgggctttggcataacagaaattatgcttaaagttagccagtgattttcaagtaaacatgaatatgtatatacactacatggccgttctcttttggtgacagaaatgtgctcagcattcacatcattctcgcttggttttttccaagtaatgaaaaggggcaacgagaaaatatgcagctcaacacatttcttataccaatctccaaagcaagggcagtcagtggcatgccagaaatgaaaacctgctatctcttttttttccagtccaatgcttagcacactggattacagagccttcaaaagttttaagaacaggtatctttgaagctgtcttttgtcaagtctctgtcattaaaagtgagttgactcacctacctctattaatacatctgaggtctctcttcatctttaagagccactgaatagagcaagattggaggataaaatatttaaacctcttttaggaacatcatgggtgagttttgggaaagcaaagataccaaattagagacaacaggaaacgtcagtagtcttacggcttttctttgccaacatgagcttctagcaagaccagatgcacttcggatcagcctttccataacttatccattagagatgtctttaagcacattgacacccaattttgccaccttcatctgaatatgagaagagtgctcatttcacgttttcacgttgcatttgacagattaaaacttgaagatatgtttttgtcaagcaatttgaaaagaattttagtagctctaattgacgtacagaactagcctctacattaattgaaacataaaccataactggtgtaaatcaaatcatgattgatactctcttgcctagaagtatctggtgtgaattaagttatgagaaacactgcatcccaaaccagtgaccttacaatcaaagcttctccaaaaagctgacttggtgagcaaatagtgaaatgtgccacataaagcccaagcttttgacttctgaaagttgtcttttgtagactaccttgttgttagagaaagtatgttaagaggttactccccaagatttcacaagcctttttttaaaggaatggttttaaaaagcaaaatactataataaggcaaaatagaaggcagacaagcgatcagtgaaaaggcaagcttaaactaggtaagtttagaagatgtctttacttggtgaatcacttattaaccttacatttcttttttttttttttttttttttttttttgagacagagttttgcccttgttgcccaggctggagtgcaatggcgcgaccttggctcaccacaacctccgcctcccaggttcaagcaattctcctgcctcagcctcctgagtagctgggattacaggcatgcaccaccatgcccggctaattttgtatttttagtagagatggggtttctccatattgaggctggtctcgaactcctgacctcaggtgatccacccacctcggcctcccaaagtgctgggattacaggcgtgagccaccgtgcccagccttaaccttacatttctaaagcactaagaagtttctagatttgagttaacactattatctcttgaagctcatataccctacgaggtagacaatgcagatagatacagtgattctcattccacacgtgaagaaactgattttcagagactaatttgcccaaggtcacacaacaaatcaaggtagaagcaaaacttgaaccaatgtcttccagtgtccagttcagcacttttcaaccatgcccttcttgactaaggagtccgttttaaatatatgctttcccaatgcccattgatacagactttctcccactttcctaccatttctccaactgttccttttttctctctgcttaccgtccttgttctgtcccctaaatatagaccttcaactgtttgccttttctttttgtaactcatcccactagatgggtctcatccattttcatagcctctatgaagacaatgaagacaattcccaaacctactggttccagtctacaccttaaactccaatgccacatgtccattcaacaactagtcaccaaacaccaagtgtgttctaggtacagtgttagattttttgtggatgatgctatgaacaagagaataaaagtttctgccttcatgaagcttgcagtctagaagggttgaaataattactagtaagaaacaattactatgaactgtattataccaaggtcaaatagagaaggacattcagaggaaatgaggttgaagtttggaagccagatttctttgaacaggcttcagattttactttggaaccacataaacgttttattcaaatgtaaaaaggttttagataaacaatctctaaaaacagataattcaaaactccaaaatttgagtttatatccataacaagaaatacctacagacaaaaaaaacacaaaaaaatctttaggcaattccctgctatgagcttagttttgtccccccaaaattcatctgctaaaatcctaatcctcagtacctcagaatgtgaatgtatttacataggccctttaaagaggttattaaggcaaaatgaggtcatatgggtgcgcctaatccaatacaattggtgtcctgagaaaaagaggaggttaggacaagaatgagcatgtatccagcagaaagaccaggtgaggacacagagggataacagcaggagtctggcagccaaggagcaaggtctcagaagaaaccaaacctactaacaccttgatctgggacttctagcctccagaactgagagaaaacaaagtccatcgttcaagccacctggtctgtgataccttgttatggcagcctcggcaaattaatacaatccccatattgtagactctctgatcatatctccttcagaacccttaccatattgcaatttatcttttattcttgtgattttggattgatatctatctcccaggctataaacttcatgaggacagaaagagagggtgtttctccaaagtgcctagcaaatggttggctcttgtgatggtttaaaaacacaacctaaaaattctgttacactcctcccattgaaaggtagggtccatgtgcccttctctttaatttgggctcttagacttgacccacagaatatgacagaagtgatttttgacagtttccaggtcaaagggttaagagaattccagttcctctctcttagatactcagtcttggcgcccacccaccatgctctgaggaaactgagccgcacagggaggccatgtgtaggttctggctgatggtcctcactgtcagtcccaaacaatgccagcaacaactgccagacatgtgagtcaggaatccttccagatgaatccagctgcagctaccatctggctgcaaccacgagagaccccaagcaagaaaaaaaaaaaaaaaaagccatgcgcgataataaaattgtgttttgtttttgtttttgttgttgttgttgttgttgagacagagtttcactccgtcactcaggttggagtgcagcagcgtgatctcagctcactacaacctctgcccccaagttgaaacaagtctcatgcctcagtctcctgagtggccgggactacaggcacacaccaccacacctagctaatttttgtatttttagtagagacgaggtttcaccatgttggccaggctggtctcaaactcctggcctcaagtaatccacccacctcggtctcccaaagaaattgtttcaagtcactatgttttggggtgatttgctatgcagcaacaaatgacctaaatagcattctataaatagttgctcaataaaacactttctaggaattttctacaaatgctgcccctaaatgctttgggatgtctctgcaaatctcagcaagtgaccatcactctacctttattctctcactggtaggctctccaattaaatattcattcaggaagctcatagctaggaaaggaatcttactgttcagttttgaccctaaatacagcctaagctttcaaaatgcagtaaagacagaaagtcctagagagagaatagctttccaggccccattccttctactcctgagccagtttctgttcattggcatttgcagcaggccctgctgtttgtgggcataaaacattctggttgcttgagtgatgcaacatcaccctgtcttctgcttcctctccctgccataccagccttagcaaagctgcagccatcaccatggaaactagcccgggaagaaactcaacattcttggtcaaaccctccatgctgtcacccacagggagctctggaaagagagccttgtatttgagtaaaaatggttctttcagattctgggaggtaaccattgttttccccctatcaagctgcaagagagattttttaaaaaaagaaaaaaaagaaagaaactcttttattacaaagtcccttccaatataatactggctgtctaccctgtgggaactactaaaacaagtcagacagaagcctaagccccaacaatttttgagaactgagctgattctaccactaaccgagaagggcagagatacataatagttaagcacaaggcttaagagccaaagagacctcagttcaagtcctggctccattactcaggacctggtaagttcattcattcatttatgtattcattcagtaagtattttgtgtgtgcctactacgtcacaggtagttttgtcaaacactgagaaaaccctggggtacaaaacagacatggttcctaaacatttactgcatgcctgcttcctaccaccaggcactaatttagctgctgggaaaacaaaggtgaacaaaataaagtccttgaatttaaagagctttcactccaatgctggaaaaagaggaaaaaaagttaaaataaaataacattattataagaaccacgaaggggacatacgaaaagctcaaacaaaaaaatcataaaaagcacctgactttggaactgcggtcagagcaggcaatgttgcttgaactctttaagtcttggctgctctatctgtaaaacaggcatgccaccgcactgggttgacgtaagggttaaaattaacccatgtaaagcgtgttcacagtgcttgcatacacagacgttccgtaactggcagttattatcaatatgacacatgaaagtgccttgagtgactcttgtagggagaggcattcctccaatggccctgacccctgaatgttcctgcaaagaacactaaggcctgaacaccctctgcctggaccactgcttggggttatgttcgcagtgaacaatcttgagagatgaggtaatgtctccatccaggaaagagcaggcttgcagtacaagaggcagattcccccagctcagggtttctcagtggcaaagcaaactcagtgtgtacaatctccacctgggccccttcgaatcaccctcctcaggacttggggagcatgggagcctacgtaaacatgatgctcatgccacttgttgtgctgtgagcaataacagcctttatctctgacccaagagtctcatgttggttgccagcatgcatgaaactgtataataggctaaattattagcttgtaagtagggttaaaaaaaaccgaagcctgatactgtctcttaagaatcatcagtgagcctcaatttagctttctacaggtaaatcaagtcctcaatcatttcttctctgacatcacagtctcttttaaggacaactcttaagtgccattatcataaaatgaacacacacacaccccccacaacaccaatttaaatcatctgaaatttctgtttaccactgtgaccaagcctggcagtttcttctgttcctcactacaggaaaaatagtatagatattaatgatggtgtcttgctctccccgaaactcagaaggagcagggaccacagacacaggtttagaatctggacaaaggatggtgacaaagatataagatgggtgggatggggagaggggtagagatggtggggggtgggatggccaaagaatcatacaaaaaaagaaggtgggaaatctaaatgtggtgtagtatacagatttgctttcaaagtgaagacttacctaggaagaaaaacgacctcagacattttaatcagcaatgctttgcaaaaaggcattttctcaagggtatatcactctcatcagatgctaaattggtgtaacaattttctgcatcccaaattaaagtaaaaaatgcacaaacaacaattatagtttttgcaggtcataaacattttcttggtccccttatagcattttcatccttctctccaggtcaggattttgattttttgttttggttttagtaatacaggtgtaagttcaatttgctatttcttgctatatatgccaaaagctcagaatttgaaatgcatttttaattaagcatactgctgggagtttggaaattccagttggaccagcatttgtctatttcatcttgactgcagaaatcaacattgctttcctctctgattaccacttactcctaggggtcacgtgcacaatccagggaaggaaatggcaggtacaaaaagacacgtacacacaagcaccaccgtttcagacacacattttgtttgtttaaaaaagaaatcacttggggaaaggaagcagatttatcacttctctcaggcactcgccatgctgtggaattatttcatgtgaaagataattgcatcaatgaaatatttatgtgcactcattataggaaaacacttcattttataaccaaaaatttgtgctgcttaagtaaaaaagcaggaagagtttaggttgtagaattccttccgttttggatttgtaaatttgtaaatttagtaaaccaaagccaagacagctgcacatctcagttgagatgttccttggagcaacagaggtgttggaagtggtttgttgaagtagagctttcaaaaagtttgtgttacaatcaaaggtatccgagactcagttctgtattctaaggcctgtgaaaacaaacaattatattccaaaaaaatcgtttacaaaattaaaccattcgagccccctcaaattgttttaaaggcatcctcttgtcctcaacttaggaactgatgtattagacaccatcttcttaggactgagacactgtatcagattcaggactagcctaaggatctgggatagtttcacacagagaatgatacagggactgttgtgtatgctacaggccagctgattgtaatcccaaagggatttgtgtaatctgttagaaaacacacagacctcagaatacatgaggctgtgaacataaatatatttcatcctgagaaactgctctgagaaggaaaataaaaataataaattcttctccatctaggatagatttatcagtcacttacctcgatgtgcagtgcacaaaaatgaggggaagggaagagcagcaattaggccgacacaaaggcagactatcttatttcacagagtggtaggaacagtggggaacagcaattcctttcttgctacctgactctgaaattcccagctctttaaaatcacttaattgcttatctttgcagggaatgtttacttcctttctcagtattctctctcccaaagctctgcctaacaattcttgtggtagtttctaataactcttcttcatgggacccaagataaaacgaaagaataaactctgcattcaatgagtacacatggaggacccatcactgaccaggctttgtgttaggtgctaggggttttaaaaaatcagcctatgaactgcagcatgatttaaaaagtggttttccaaactatgtcacagtttatcacaaaatcttagttgcagcaactggaagtcaaatcaacttgctaaagccaaaaagaaaaatattggtgaatgttgtaggcagaataatggctccccaaatacgtcctcatcctgctctgcaggatctgtgaatatgttcccttacatggcaaaagtgactttgccgatatgattaagtaaaggaccttgagatggagagacaatcctggattatctggatgggcaaatcacatgaatcttttaaaagaggaggccttttcctggctttagtcagagaaatatatatgataacagaagcaggctcatctaaaagacagtgaaagaaagttaatataggacaaacaaccgaaaagtcaaagagttgtcttcaaacccagttagactcaaccagtggttctcaactgggaacagttttgtcccttaggaaacatgtggcaatacctgaaaacatgtctgatgatcacaactagggttgggggaatgtgttactggcacccagtaggtagaggcaattcctttcacagaacatgtttccagcacgagatggagatgaagcaatctttgaacaggcatatcaatatacactttagttacatactagtaatgcatcttgcctttaagttatttcacattttcatgactctggtataaacagtcgaagtagcctgtgatgaaagatgacaaagatttcagagcacgttctcagatcaaattattacaggattcacgtacaaatatatgtgcctagaaactgatataacactgaggacaacataaaaacggagatgaaaacatcttgcaatatctagacattcccctatagcttcaagctcaaaactttccattccaggaatcacttcttagataggtctggcaaaagcccttgagttgattctgattggtccagcttagaccaccctctgaatcctgaactaatcacagtggccatgaggatggagcactaccctaagtgcccaagcttggtcatctgccctcccctagggccaaaagtgctgaatcagctccagctccacataaacctactgtaatagcagagtgtggtcaccaagagcaaacaacataagaaagatttttttcccccaagcttctactaccatggtagattctgtctaaccaagtgggcagagttactgtggaaggtttttatgaacattctataacatcttccatgcagaaatccctgtacctacactcgggaccttgaattgattggtctgtgactctaactcctgataaggtgttctacaaggtcacagtgacatacaactgataggctatgtcgtctgtggttaatgtgacatcatactggtcaacacaaacttttttttttagagaaagccatgaccgggcattctaacagcagaagcaagttacccagtattgccagaaacattttggctggacctaagagatagcttcctaagatgatgaaaaaaaggataacggtgagaactttttgcaattcctttcacagaacgtgtttccagcacgagatggagatgaaccaatctttgaacagccatatcaatatacatttgagaacagaaatgacctcgtgccccagtgcaaatcctacaatgttgtacctttgctctatcttttccaatctacttctatcacacttctattctctgcaaatcacaggcggttcactttagttacatactagtaatgcatcttgcctttaagttatttcacattttcatgactctggtataaacagccgaagtagcctgtgatgaaagatgacaaagatttcagagcacgttctcagatcaaattattacaggattcacgtacaaatatgtgtgcctagaaactgatataacactgaggacaacataaaaacggagatgaaaaaaaatcctttttcatatgaatctcccagaaacaacatatttgtcacatttgtatttaaatttcccaaggcaggtatcatgaggcatcctttacagatttccatctggtctttccaattgggctgaggtatttttccttcttttgtttccttcctcccttcctttcaaaaagcactaaaagaaaaggtcaattcccttttcctgccctctctctgctcctcaccacagcctatatgttgtttttcagaacttctacccagtagcacataaccctaccaaaaaaaaaaaaaaaaaaagacacaaagcaaacgccctaaattgttgaatactaaaaacaataaaaaaacatttgaaaaataactttttaaaccaaaacattgtgtattaataacaaaagcatcagaagacagataaatacaaagagatccacaaacagcagtctaactacataaatgtaaccaagacactgctatagatttatttgaattgggcttatatggatatatattacatacaatacacacatacatatatatacacatatatgtgtgtgtgtgtgtgtgtatatacatatatatatatctgggcttaccatatatacatttttgtagaatgtggatattatacaatgtttaatgtatatatattttaaattaaaaatattatgtatgatttttttaacttgctttctacaatttacatcatacattgtgaacactgttatatataaataaatattcatctataacatcattgttaatgcatagtattttattagagaagtaccataacttatctactcaacctctttttttttttttttgaaacagggtctcactctgtagcccaggctggagtacagtggcataatcacagctcactgcagcctcaacctctcaggatcaagtgatcctcccacctcagcctcccaagtacctgggaccacaggcacacaccaccatgccaggctaatttttgtatttttttgtagagaaggagttttgccatgttggccaggctggtctcaaactcctgggctcaagagatccatctgccttgctctcccaaagtgctgggattacaggcatgagtcactgcacctggcccatctactcaacttcctatcttgcacagttatgacagcagtgtcaaacttaaaaatgttacaattcagatgcacaaaacaaatgcaacttcttaattgtctatagtttatttaaccttccttaagagctcttaccctgacaggtagcggagtagtgctaagttattgttgacagtatctcaatttcttgtgttttaaatggagtctttgggtgaagtcactggaatgtaagttccacgaaggcaaggatttttttcagtttcatttcctgctgtattcccagtatctacagtagtgccaggcatagggtaagtgttggattaatatattttaaatgaacaaatccatctcttttttttaatgttaatgcaaatcctccctacaatgacatccaggtatctgggaggctcacacaatcttgtggcagtaggaagaggggtcctgtgctggtcaccgagtcctctgctctctctgctgtgaagtaccttacctgccaggttacccagtgtatgccccatgggcatctgacactgaagcctaccctggaagacttggctctgttctccaggcttggactgagtgctacgttctctcttaccaattccatcctaatttaaccccctcaaattctgatgaacctctgggcctcagtcccatcccctaaccaatccttgacttagcccatcttagcctgtacttctagaatgttagctcaccatcactaaagcatcacccacggtaagctcacaggctctctcctcaggaccttatacatcccccaagaaacacgtaaagcttccctttcataccaagtgggagatgaggaagttcaggatagatagatctctcaggccttcgctctgcctgagcctgatatgctcttattctttttttgtttgttttatttttttgttttgttttagagaccgggtctccctctgttgcccaggctggagtgtagtggtacaatctcagctcactgcaacctccacctcccaggttcaagagaacctcccacctcagcctctccagtagctaggactacaggtgcacaacaccacgcctggctaattttttgtagagacggggtttcaccatgttgcccaggctagtctcaaactcctaggctcaagcaatctgcccacctcagtctcccaaagggttgggatttcaggtgtgaaatcccacctgaaatccctggccattctcctaaacttaccgagctgctgttaacctgtcttggtatgggatggccctgcagtgtagccttcctagagttccagaggtagtgagaccaacgccctattgcttttaactaatatgtttgccaccactcccagcatacactggaattctgactccagggtataacataacacacacacatacatattttgttacttccctccctttccatcttccttgatccccacactccactaggcccgaagggctgggctccatgtcactctacctcttctgaggcagggacttcccttacttataattcatcatccaaaccaggatgcatttgagagtaaaaggggtgctactgataattaggtcaggataaggtgcatgaattagagctgtcctaagcaagctagtaagtgtggtcaccctagttacattaaacttgacattcaagttcaccactgggccttgttcttgatatgctaatgtaggcttaagggatttagaaaatcttattttggtagacaaaacttaagcactgactccttcctgccttcctgctttaagaatcataatcccttgaggcaaatggatgcctctgggtgttgggaaagaaggtcatttacacagaaatgtaaaagagaaaaacatattaatgtactcgaaaatactactcctcttatttatgctactccaaagaatgtgacaatgaacacttatggaattaaatcattgcacactgcctcagttggtttccttaaaatggctgtttctgtttgtatgttttgttttgttttttgttttttttttcaagtaagcttacatagacttgatttctaattctggaggtcgactaaggaatctgtaattccctactttcccagtgtgtctcaactctgggctctcgactatccagtttcttcttcctggaatgtcctcccacattctcactctgcccttacaagtcttgctttccactatgagttccctgttgctgacctccttccctcctccaatcctactactcagggtcagttgctctttccacagtgctctcacagtagagcaagttccatggcttaagaactgagtcaaccaattcgtgcagcagtcttgagaggtaggtggaatatttctactttgaatatcaggaaactaaacttagtatgtcgtgatacaagtactcaccacagttgatttgtcactatccaccttacctagatttgtttaagaattaaatgacctagtgaatgggaaaactctgggaaacagatgagaagccggacaataaaaaaattactttggggaccaggcacagtggctcgcacctataatcccagtactctgagaggcggaagcagggatggacagatcacttaagcccaggagtccgagatcagccttggcaacatggcaaaaccttgtctctgccaaaaaaaaaaaattagctagacacagtggcatgtacctgtagtcccagctacttaggaggctgagatgggaggattgcttgagcccaagagctggaggctgcagcgagccatgatcacaccgctgcgctccagcctgggccatagagcgagaccctgtctcaaaaacaaaaaaattactttggactcatcttctttctacatggttgttaaactctgtgataacaaagactaaattttatctaaatcataaaatattagtgtgacatgaaagcctcaagaaattatgaacaacgttagcagaagtttcacatgagcaaatttagccctccataggcccacatttctgtaaaggaacaaaagaaacaccatgtgagtttccagccacttctgtttctaacggtgaatacttgtgggggtaggggaggggtggaggggctggagggaacttgaatactacctttgatttttatagatacaagatgtagatatctgttgtagtaaaaaaaaaaaaaagtcacaaatgagaatttggagctcaaagatcactgagaaggagcaatgatattaggacatccctcatggacttaggttgcccggactgtcatcatacaggtcagaaaaagatgtcaggaaggcgcaatggagaacctgccttagagtctgaactagtggccagtgctcaacaaaacctagatgaactaagaagagacacagttcaggtcagagtgcagctaggagtgaaaccccttgtggcactgtgggtacacctcggaggaagtgtgtgtgtttataagcatcttgtgtctacaagagcatcttgtgtccataagcttattgaagaaaagagctacatcaccaagatgcttcaatcctggacttttcatgcagaacatccagtatctggaaggtgttaagagtttccccaccccaaagtagctccaaaagaaagctgacaatctctaggggcagaaataatagcaagagccatctcttggcacctctggctgtagaatctcctcaagcagcagttttcaaagtttcaggactcatttatactcctcaaaattattcctttccaagtcctttccctgctcatggtgtttgtcacaaaggggactgagttctatagatgttatatgtgtaacatatctagcaacatcagtcgacacagataataaactgggatctgtgtttcctctacacatatgctcctcttaaacagtacattctcattaacttcagaaagttaacaacaacaaatggcaaaattagtacttttgacatgtaaaaatgcacatcataatcacagttttggtggagaacttatgctaaagtgagagtgatcatcttaattatataggagggtctcattagagcctcaagtatttaatctttagtgagattcagcatgagtgcaagagaactttgtgtggaaattagcatgtttggggattggaaaaagtaaaaatctactaggtgtacctgtgaacacacacatttcaaaaatcccatcaattgcagacacatacatcatcacttcaaagaaagcaacttaatactctgagcaaagcattgacaatgatatgcctgaacagacaggtttaattagcccaaacactgtgtgtcttaaaaaaggcaacacatgtcctcgagctttcttccacctcaacaaggctttataaaagcacatgtgtttgtttgtatataaactcacactgtcctgtgaaaattataatgtagtcatggagagggatgctaacagaaatggttaccacagcaacaaaaatcaccaccacactaaagatgtctgattctgtttcatctctcaggtttttgtcagaatggcttgctcaagttatccttcagcagtctagaagacagccctttcagcatgggactaccattattctcaatcacctgagcatagccataacttcacctgagtatagtcataactacaaagtctttgggtaggaaattttactggatacctggatcagataaatctatactgcccattagaatggatgctatctgaaaagagggcttttcccgttttgttcattggtgagccactgttatctaggataatgcccgacacatactaggtgctcaacatttgttaaatatataaatgatcactgtattagtctgttctcatgctgctctaagggcatacctgagactgggtaatttacaaaggaaagaggtttaattggctcacagttaagcaagacttgggaggcctcaggaaacttacaattatggcggaaggggaagcaaacatgtccttcttcacatggtggcagaagagagaagtgcagagcaaagaggggaagagcacctcataaaaccatcatatctcatgagaactcactcactatcatgagaaccacatggccaaaattgcccccatgattcaattacctcccactgggtccctcccacaacactcgggggttatgggcactacaattcaagacgaaatctgggtggggatacaaagcctaaccatatcaatcaccatgaaaaacacagcataaattaaaatcccagctgaaatctctctatttcatttttaaatcacaacacccaggatttgagtcaaaaaaactcaatatttcaatatgcttagaaggaaacaactccaaatgagattcctttgcaacacagtttgattctttatccctttcagttataattaagtcattcaattgaagtaggacagtacaatggttaagtgcatggactctggaacaataatgtcaggatgtgaaaccaggctctatctccttatagccttgaagggaccacttgacttctgtgtaccccagtgtctccatctgaaaaacagggagagtaatgggacctatctcaaacatcagctattaccatttgagcacacactatagctacaaagatgaataaaacatccttgagttcttattataccaccccccacagggtatcacagatcttgttacatgtctaacaagacagcaggaggacagaggtacaattatcagacagtcttccattgtctcaactctgccaaaccctggtggctggggctcgacaacttggtcactgagaaactaaggctggcaagtaggcatgtggactcaccttttgacattctctggcatagcatggaaaagaagaaatgcaagggacttgagtgtcaccaagctaacaatgctgaaagacaggaattagtacatctccttcttcactctgccagatcctggaataagtagcagcacattccattccagcctacttaaaatgggagcagcacagtcttagccgatgatcaaagacaaaagatctagaagttagaatttcaagactctccaagctggttgctccaacgttagaaaagtctatgcataacaggaaaaaggttggaactcaaattctgaaaaaaacttgattccaggtaagttaattcgtcataaaaataaaggaaagaaagggaaaagagaaactattatttaaagggttaacagtctagttgcctctcaagtattttctgaagccagtttagcagggttaaagtaatatatatgaacatattcttggcagagtatagtaaagaaatatgaaattatgcaaagacttgttgagattaaatgaattactgctgcatatgaatcagtcttttttaaagaagctatacagtataaaatagacacagtcttgtcattgattagatttacatttccatcttatttaagctatgccacctggagaataagataattcaatgcttttttatataaaacaccttggcttaatatttcacaatgagaaactttgattttgaattaaattatgacaaaatggaagtctaggagaatagaatattcagcatacaggatgctaaccattcaatctggtaaagatattgagtctctgacagtgaataactattgcaatgtacattttcctacaaatgagaagtagattcagaaactctaccaaacctttgaaaatcacacagcaaggcaggcatatattgccctatttttgtggttatgttgaggtatcaagtttctgcagcattcacgaagcccagaaatctctaaataatgccaccctcagttcattggtgatatctcaaaaatggctagagagaattattgtcttttatacatactgatccaaaagaaagctgtaatttctctaggacaccatccacaagtgtgctataaagcacaacttcaccagggttcctagaaacactgacgccctcagctcttgggggcctgggtagggtttcaggcacctagggacctcagaatggtctcttatcctacgagcatcttgatagggcttcaaatccccaggcaagtatcaccattatccgttatagccatggcatgcaaaagacgagaggcagaatggaacagataaagggagatggataaacaggttgagtatccctaatccaaaaatctgaaatccaatatgctccaaaatccaaaaaaaaaaaaaaaaaaatccaaaatctaaaacacttctggtcccaagcattccagatgaggaatattcaacctgtaattccacacaatgttaacaggaatttggaagaaaacaaaatatatgggatggagaaaattctgtggccaaatatgtgtaggaagtagtgagacaaagtaatagaaatttcttcactgtaggatttacaaaaattctttaacatgctgatagaacatgttaaaagaatatgatactgttgtaattcaacaacttatctgacagcacacttatttaaatggaattttaccagagttaggaattcacagaacacagtttgaaaaccactgctttacacatttgtgttacctgataaaaggacttcaataaacatttgagttacaatcgaattattatatatataaagaaacagggagttattccatttatttatttgtttttgaggtggggtcttgctatattgctcaggctggccttgaacttctgtgttcgagcaatcctccagcctcagcctcctgagtagttgggactacaggtgtgtgccattgcccctggctctatgggagttactccaaatgaagcttccaatgaggaagatattttatgataaactgaatgtaacctgggagatgtgagtaatatatgtgaatggcctaaattaattctgttattttacttctaaaatattccagatgcattcacacattgcttgtttccctttcttttgtttcaatcaatgagtaactatgagtgtctcctatatgctctaggcactgggacacccagtctccctcagagagacagacaagatggatcaacaaggtaggcaagacggagcttctattttcacagaggcagacagatgataggaaagcagatatatattattcagaagtgaaaattatgttatacttttaaggatgatatatcaatccgggtgatgtcagggagagtgactataggtggaaatttgggtgggagtactatttgagaagaaagtcaattagtacccccacccaaaatagaccaggaaacatttgtaaagggatatagtctgtttcctaatacaggtgcaggcaacttcaatgtaagctaacataatgtattgtcagaatagcattttccacactcaggaagggtctggaagtctggaaggctattctaaggaggtggcataggaactgtgtctgggaccatgagaaggcatcagtcaagaaagatctagggaaggagattcccatatgaggcaaatgacaggagcaaatgctttgagatggaaatgagcttggggaaaactcagaacaggatgattggagctggagcaccctgtgaggcgcagaaggtggcctaagatgagctggagatgcaaagagagacagaccacgtgggatcatagagcccatggtatggaatttggatctttgtctgcaggaagctgctcagcagttttcagcaggaaagtgctatgacatgatttctgttgttaaaaacagctgctgctgtgtgggaaacagcaagaagaaaagctgaaaagatgaagagaagtaattcacccctaaacatggtaagttacttcctcaaaccccagggcctaaaattccaaatcctggagaaataagtcaaactagatagtcattcagctaagcaaagagcaggtgttctgtggcacagctgaacttttacccttcaaacagtattgtcagaagagaaacaactgtcccaaagaaatgatgcaaagaaaaaaccgtattttttaaaaaattattttgtctaggacaccactattcttaacactttttttaaaaaatcttaaaggaacttggggataaaacttttttaactgcataagcactattcctctagtagaacttgagtgtgtaatgaagccaattgttttttaaaatagtaaggctttactgtgattcctaatcaatactcatatgacatctcctcacaaaatgatcatttactgtgtttaataactcttgagattaaataggaatgacatgcagtaaaacctgactaattttgatctgattaaatcaagttttgcaaaaatttggacctggcatggtctgaatctgtgttctgcattatccaataaaaacaaatctgtcctacaaattagcagttaacaaaaaatggaacggggggggggggggggatgatattcactctgaagaaaacaagccatctacaagtatattcatataggaccaacacactaattataaactgcttatctattcctgacagcaggtcactccaaaatctctattacattatgtaagcatacgttgaggttgcctgcacctacattggtaaacaaactatattcatttaaaaatatttcctggctgaaagttctcaatgacttcagctaacaatacagttaggatcaaagtttgaggttggctaaaatcacatgaaatcactatgtatgagcattttgggtataatactatgcacagtagacaatataaaacataaaacatatatattttatacagtcatttaagatttggttttatctgaatgtctaagtggactaacttccagccaaaggtttagaaacaacactgaatctaactcagggaagagccactgccaatcctgctttactaaacattacaaccactacccagcaaggccaaattccttgagcaaatgtgtgtttgctgaccctggaacccatctttgaagctccccatcgctaatgaaaagtgaactctacttcctgaccttttcagctgttctgggaatccagccataaccagagtctcccaagagaatctctgaatttgtctactgcaaatacagcactgcaatctaagcaggaaactgaactagattttaaaacaagccgttagcaacaaaaggcagaacattaaaatcaccatgtaatacaatcctgctaccactgacctttggttatataagtagttcagaatgacttgattgaataagagatgctgtattactttctttctgtgactaaacattttggggcctcatgttcaattagaaattaaaatttggccacacataccaagagtctaattacatttctcagcatctgtctttctttccaggccaaaagaaaatatttatgaagagcagattgagacaaaatatactgctgtggaattggtgaatatctccattacatcatttgccttttaggtggtttatcagttaggaatgcttttggctgcaaataagagaatctttgcattaagagtagcttaaacagttagtggcttatttatctcacaaaatctggaagtgatccctggggttgcttcagctcttcaacaatgctataaaaaaaaatggcttccaccattctcagcatgtgaattttcttccccaagcctgtcacctcattttcacaagatgctactacctttccaagcaacatatcctcatttaaagcaggaagcaggagacaggggcgaaatgactatcttcatgagtatccatcatctttactaaggaagggaatctcttctacttcccctcacgtctcattggccagagctgggtcgcatatacaactctagaccagtcactggtgtggcagaatggactgacgagactggcttagaccaactgtgattcacgacgtatgacctgggacaggcctgctttgcctgagatcaagtaattgtgctgactagacacaaaatcaggggtcagttagcgggaacagggagagatgctactgaggagataaggacagcactgtaacccacaaatgtttcctagaatggaaagatctacggataaacaaatgaataaatggtcactaaaagaaaaaagtaatagttcatttttgttttctctacagcaaaatattgtgagaggctgaagtgttgtcagagctgtagaacagaatctgttattgtctaactctccccacccccccggggtttttgtttttttttttctttttaataagtgaaatggttacctccattgtagttttgccaaattcaatgaaaagaatcacaatgaatcaagttacctctagaggcatcttctagcccccaaatttagttactggataactcaaaaggtaaccaccgtgcaacagggcatttcttccagtttccctgaagggtgatcaaaatgtccatttaaaacatataacccataccccatgatttaatgactggtatataagtaaaaggctgaacttacaaatactctcaagagagaaaccctgtcttcagaatgtaatagctttggagcaaatatgggaatgtttgtttgccatgtcagacatacataaaaggaattttcgtgctatggctaaaaacaccatcacacagtccaccttaaaacttggctccagtcgggttaaatagaattctaacagcatttaaggaaatctatgaccaggcatgatggctcacacctataattccagcactttgggaggctgaggtgggtggattacttgagtccagaagttcaagaccagcctgggcaacacagtgaagccctatctcttaaaaaaaaaaaaaaaaattagctgagcatggtggtgcatgcctgtagtcccagctactggggcggctgaggtgggagattcacttgagcctgggaagtcgaggctgcagtgagctgtgattgtaccactgcactccagcctgggtgacagagtgagactctgtctcaaaaaatttaaaaaaaaaaaaaaaaagaaagaaagaaatttacattatcatgcataaatcaggcatttttagtgctttaaataataaatggcgctctgaaaattcagcctaaaagcaagctgtgcttatttatccccaggattcgaagactgatactaagaagaatgttaaatgtggatagtagccagaattggaatataaggtgtaatctccattcttgctaagtttacaagcacaggaaagaatgagggtctaaattttagaaactgttgtgtacaatattgtcagagttgattacttgtggttctgatataatactgggatactgaaatgtcgcaattaaacaattctattttaagtattatgaatatttttcccctttaaattatatagcttcttggtagaaaacattcacgtatcaatttagcaaattagcccctgctgaactgttcagaaataaaacgaattcagtctctgcataaagaagagggcaccaacctcagagagataacagaatctagagaagaaaagttcctgcctcttttcaatgtctgtgtgctaggattgcagtccaggtgctctgcacttaggtaaaacacacagacaagccagatttggctactctcatttacaagacatgaaaacttgcaaagactttgtacacaaacccacttctcattagactgatccttggggatactgataagcagtaactagtgaagagtacaacctcatccttcctgccacactttccaagagctcccaggattagctgtgcgagaaagggaaagaaacggtttctgaatcatttcaaaccaccagcatccttccccagactctctaacatcaagctgctctctgctaccctctagaggatatcagcattacaacagtaaagaagaaagactgctaatcacagcgcggcacttacctagaaaacaagaatgtgaagttgaatagaatgaggattccttcaatataatatacaaaactcttttgagacttctgtttttagtatcaactatcataacaaaattatgcaaaaatcctgctacagattatacatcacaattaagcaaaagttatgcatatcttccctcattccccaagtctgatccacttcctggagtttgtactaactcaaagcattaaactatatgctaagaagtatctttaaggtctggcaaaaaaactatgactctgattcttgaattcattgatgagaaactcaaatgagaaaaatgaactaggtgtaaaatatcagggaatgatgaggactgtggcaaactggggaatctcctgccccattaatggggtaagaatctattaagttcttgctgattgtctggactcagggttccaagatcacttgttttttctgtcattgttgtgggttttttgtttttgtttgttttttttgagatggagttttgctcccaagctggagtgcaatgagtgcaatggcgcgatcttggctcactgcaacctccgcctcctgggttcaagcaattctcctgcctcagcctcccgagtagctgggatcacaggcacctgccaccacgccccgctaattttttgtatttttagtagaaatgggatttcaccatgttagccaggctagtctcgaactcctgacctcaggtgatccgcccacctcagcctcccaaagtgctgggattacaggcgtgagccaccgtgcccagctgtgttttgtgtttttaaatgaaaagccagaaaattaattgtatgtaaaaatctctatattttagaatgtttgacctcaaaacactgtaataagaaaaacaaataatgaaatatcttgaagatttagcccatcagagcagacatttctgctctaagattatctgtcagtggcaactgcaatccaagagaaaaaccagagaaggaaacctcatccatctctcacacaatgagagtcatcctatcaaaaaaccatctggtttatagggacagatgtagcagatgtggtaatttgaagaccgtttaaatcttcagccagtcccttccttggatgtttgatcttaatcttgaaacaaagtggctatattatatggcatattaaggcataaataaatcactgcaaccatctaggatatttcttccttgcctgctcagtccagaagcacagaagatagtcagatggacacttccaagaagggaatggaagcaatgaaaccaccttcacatgtttgtaggaggccatgtcactacagctgttgttaatccactcccagggaagggcaatgcaggtttgctgtttaacaccgaaattcctgctctaattctgagtgttacttttctccatcttgggtctgatttaaaatccaatctactcctcctatcactataatgtccctttctgaggtccatttatctttctcaaaaagaagaacatcgtctcagtcgatttttcccatggctgacagggtttggagaacagatatagcagatgaggatgccaactcatttttcatttgcaggttaaaaacattatcttgactgggtgcagtgactcacacctgtaatctcagcaccttgggaggctgaggcaggaggtgggaggaaggcttgatcccaggagttcgagcaccctgagcaacacagggagaccctgcctctacaaaaatttaaagacttggccaggtatggtggcacttgcctgtagccctagctactttggagactgaggcaggaggatctcttgagcccaggaggtcgaggcagcagtgagccgtgatcatgccacagcactttagcctgggcaacagagtgagaccctgtcaagaaaaaaaaaaaaagaaagaagagaaagaaagagagaaagaggaagagagagaaagaaagagagaaagagagagggggagagagagaaagagagaaagaaagagagagagggagagagagagagagagggagagagagaaactgtcttgtctacataaccttcattatcattagtcaaatctctatttcaacagcattgaaaactctttagtgactgtttccaacacaaatatatgactgctgaagattcctgaaggaagcagagttgttaaaatctaacaataagcgagtcctcttgaatgtgtgtatggatttattataaatttccagggaagctaaatccagtgtcacatctagataaacagcaggaggggaggacagagaaggaaatggtggggggaggggaggtgaagagatgggaggtgaggggaggagaagggaggaagagagcggaggggaggggagggggaaggaagacaaatcctaaaattatcctatagatcattacaattcacataaaagcttctctctattaaaaaagaaagtatatacctatgcatacaattgagttacttgagaatctggcaaaagacccttattatttaataataaattactcctgaaacacaaagctaaatttaaatatctatgaatgtcatttaacctctgaagatgtttcatcaaatacatattggaatcatgctgtattcctagcatttaatttttttcttgaaaatgaatgaataagagccatgtagactgctttaaaatttcactttatagattgctgtctgcaagtgttctaataatagacaaatggaaacagaagttaaggatttttgggggggttctcattttaaaagtggataaagcctgtttttaaaagtgtgtctgcacgtgtgtgtgtgtgtgtgtgtgtacaggagatcaacagaaaatataaatattggaggtgattcctaaggttatgcaagatggtgagacctacataagaaccaataagatgagtgagatcagcgagattccattaagttgatctatcatgtaatattgtcaacagatccagggcaatctgaagcctccacagatggtcagacagcactgaatttggtattcacggctcttgctagggatccgtccaacccagtgaatgatccttgagctagtataaaaatgcaacccccaggccccacagcagcacctcagttatcattattatcaacaacctactgaagacaaaaagaaaagcaacatgtgctgaccaaggaggctccacagttaaagattctccctctgctaagtttcacttacaacaaaaaaaatttgacttgccaatacacatatattaacattgatgtccgctgccgctcattaaatgcttagaatgtgccaggttatcaagcactttacaggcaccatgtcaataactgaagcctctgtgaggaccattcttacctccacagtcagatttcatagaggcccatggagattagatagcctgatcaaagttctactcccagtgagtgcccgagcagcaatctgaacccacatcttcatctctaaagacactgctcttgcctgagacactccaacaattaaatctcccagacgcagaattttcagaagtaacactgatatttttgaaagtgaattcagagagccgaaggttcattctctgttaccatcattcaattctcttatggttttctatgggtcttgccaaaagagcactttgatttctatcattctatttccaacctgtaagaaaagttcccagcaaaagtagcagcttcatctatgtgggatcttccagtggtgacttttagatcaatggagttccaggtgacaagaacagagactccttttaaaagaatgctatttgtattagtcagggctctccagagaaacagaaccaataggacatatatatacagatatataagaagaagtttatttataggaattggctcacatgactggctcatgtgaattggccaaggagtcccacaatatgctgtctgcaagctaaagaaccaagaaaactggtggtatatttcaatccatgatggtataaactcccaatccaagccagaaggcttgagaacctggggtgggtaagggcagcactggtataaatcctccagagaccgaagacccagaaaccaagagctccaatgtccaagggcaggagaagatgggtgtcccagctcaagaagagagaacaagttcgcccttcctccatatttgtgttctatccaggccagcaaaggactggatgatgcccatccacattggtgatggcagatcttctttactcagtttattgattcaaatgcaaacctcttccagaaacactcttacagatacacccagaaataatgttttaccagctacctgggaatctcttaacccagtcaagatgacacacaaaattaaccatctcactattaatttcaaaggcaacttcattcctagaataccacaaacacctttgtgcccaccagccagaactgattgttaatactgtcacacttgcatcaagacttttttttttttttctttttgagacggagtctcgctctgtccctaggctggagtgcagtggcgcgatctcggctcactacaagctccacctcctgggttcacaccattctcctgcctcagcctcctgagtagctgggactacaggcaccgccaccacgcctggctaattttttgtatttttagtagagacggggtttcaccgtgttatagccaggatggtctcaatctcctgacctcgtgatccacctgcctcagcctcccaaagtgctgggattacaggcgtaagccactgcgcccagcgcatcaagacttttaaaatgaatggatggatggacagatggacggacgggtggatggatggacagatggatggatgaataaatcagccttaaatttaatgaataaaagcaacttcttccagtaaagaacaagtcaatgtttggaactaattaatttattcaccaggtatgccctgagttagaatccagcaatgtgctaaatactggggatacaacaggaaataagacaataatgtaacattgttccaatacaggaaaggagagagcattgtgggagcatggcaggtggtagctcactcacaatcactggctgccatatggtgcccggttttccaatacttccaagaggcagaaaataaagattttacatgggtaggtggctggggtcaaaccacaaaggtccaggctaatcacgtcaaattacaaccaatgaaagattttaaatgaggaagtgagatcactaaattctactttatcaacattactctacccacatatggcaaatgggttggaaggggtgaagatggaagcctgaagtttcacttaaccaattaccgaaaacaacacacacacacctctctccacacacacacacgccattagcgcattaaacctgcctcattaggactcctaaaatcagattccacattcccttacaatattctaacttgaaaataaaaactcactgtaggcaactagtgctttcaaagccctccagttttccttcctctttgtgctaatggctttaggccacatctcactgcaggagcaaagtgtttaaatcacaacaggtttgcactgacagtggcactcatcccatcaatatcctcagagaatacttatacaggcatagctcacagatactgtgggttcggttcctgatgaccgccataaagtgaatattgcaataaagcaggtcacataaattttttggttttccagcacatataaaagttatatttaaacttttgccatcctcctgcctcagcctcctgagttgctaggactataggcatgggccaccaccccaagccaatttaaaaaaaaaatttttttgtggagatgtggtctcattgtattgccaggctgcactgaaactcctggcctcaagtgatcctccaaccttagcctccccaagcactgggattataagcttgagccatcacacccagccacaaatgttcttaatggcctctagaatggtaaattgtttccagaagattttcaacttactttgaccagatccatagaagaatcactatctacggcagctatagctttacaaaatgtatttcttaaataataagacttgaaagtttaagtgactccttgatccatgggctgcagaagggatgctgtgttaacaggcacgaaaacaacattcatctccatgtacatctccatcagagctcttgggtgaccaggtgccttgtcgatgagtagcagtaacaatacattgaaaggaatcttttttcttctgaggaagtaggtctcaacaagggcttaaaatattcagtaaaacatgctataagcagatgtgctatcattcaggctttgttattccatatatagagcacaggcagagtagatttagcaccctctttaaggccctagaatcttcagaatagtcaatgagcattggcttcaacttcaagtcaccagctacgttaccacctaacaagagactgagtctgtcctttgaagttttgaagccaggcattgacttctcctctctagctaggaaagtcctggacaacatattcttccaatagaaggctgtttcatccgcactgaaaatctgttgtttagtatagccacattcatcaattatcttagcttgatctcctgcataccttgctgtagcttctacaatagtacttgctgctgcatcttgcacttttatgttataaaaacagcttctttccttaaacttcatgaaccaacttataggccagcttcaaacttttcttctgcagcttcctcacctctcagccttcattcacagaactggggagttagggccttgctctggatcaggctttggcttaaggaaatgttgtacctggtttaatcttctatccagaccaactttctccacattagcaataaggatgttgcactttcttgccattcgtgtgcttactggaatagcccttttaatttgccgccagaactcttccctttgcattcacaacttagttaactgtttggttcaagaggcctagctttcagccgctctcagctttccacatgccttcctcattcagcttaatcatctctagcttttgatttaaagtgagagatgtgtgactcttcctttctctcaaacacttaaagagtccattgcagggtattaattgacttaatttcaatactgttgtggctcacggaatagggaggccccaggagagggagagagacatgggaaagggggatccgtggagcagtcagaacacacacaacacttattaagtttgccatcttatatgggtatagtttgtggcaccctgaaattacaacagtaacatcagagataaatgatcacagatcaccaagacagacagaacaaggaaaaagtttaaatattgtgagaattaccaaaacgtgactcaaagacacaaggtgaccacatgctgttggaaaaatggcaccaatagacttgggcaatgcaaagttgccacaaaccttcaagttgtaaaaaaaaaaatgcagtatctgcaaagtgcaatagagggacacaatcaaaaggatgtgcctggaatggctttcaagcactagtttatctgaagcctctgataggaatgtgcattcagtatgcatgcgtactcccacacaccctcaaacacacagaaacataacaacccatattcatttttctgccaggaaacaccacaaatcaatttccactagtgtctttttggtttttaaaacaatttactggactgataatgatgctaataatattttctgggcactggtcatcgtgtgagggacattactacattatcttaatttaatgctcccacaaatcctaggaggttagtataattactatccccattgtaccactgcaaaaaccagtgcttggaattgttaatgagcttgcaaaggtcatacacccagtaaactgagatattgggatctgaacctggaaagcccaaatctgaaccctttgtttctaacagccatgcctacttgcctcttccagggaaggtgaacagggcagtgataagggtgtctggctgtagggccacacattattttcacatttactgttaaggtctcaggaaaatcccagtgatagtggggagaaacgatggaaaacttaattactgttcattattttgcatcggttaagaaataatctactctcaactgttatcaatagacattctgaaaacttcaggaaacctctatctctataaaaccactgctttcagccactaaggtcaggtcgtgaaaaaatacatattaagatttaaaaatttaaggcacatagtgctaagtaaataaaaatccacttgtaaatatgtgaccccatttttgtatgcacacatccacaaacactagaaaatataaacaaaaatgttcagccattaactttgagatcactatttttccttctttatgcttttctatctttcctaagtatttcagatttactgtttttgtaatgggggaaatatgattcaatgacagctttgggtgaatagtgagaagagtttaatgccttttgggctgcttctgaaatgcacattttgaagctccttctataatcatgtaaacaacatcaaagactatggttatgaccagagagaacttgatcaactgtggaaactgcagttccatcaaaataaaagaggttgctattattgatttttttttttttttaaatggagtctcactctgtcccccaggctggagtgcagtggcgcgatctcggctcactgcaacctccgcctcccaggttcacgccattctcccacctcagcgtcccaagtagctgggactacagatgcccgccaccacgcttggctaattttttgtatttttagtagagacagggtttcaccgtgttagccaggatggactcagtctcctgacctcctgatccgcccgcctcggcctcccaaagtgctgggattacaggcctgagccgccacgcctggcctattgctttatttattaagctacaacatttgatgagcacatttgatgaaataaaaagttcttgttgttggctcctgcagttgtgtcaatctttaaaatttacaaaagaacttaaaaacctaacagggagtaattctatcttccttgagctacaatttgcagagtttttaaagaagccacgttgagaagactcattttaaaccatgcttctgtactgggataagttaatggctttaatgctgaggaatataccctaggatcacaacatgtcatagacatcaaaggatgtgtttcatttgtgaataaaatttattatacatcagcagaaagctttcaacaaggagatccacactctagaaaatccacgaacatggagacccaatccaggctgcagacagttaatccccacgaccaattttaatcacccattcattcaacaaataactaataagtgtcatgcccggaactaggtacagcctaatgaggacagcatagaggaggtgccaccttgacagagtaggatgtttggaatccactggaatgcagtctacaaaatgaatactacgtggctttcattgcccttgttcactcgcatggggatatgatatttaaatatatttatatcaaaatgcttagaattctacaatatttaacactgtatcaagtccaagaagaacaaaggctgttcttcaaagtttcctgttgttgcatatcaataacaaaaacaacagcaacagcaggccttactttggagcactttcaatgaatcaggttccctgccaaatattttacatcattatttcattaattttaagaaaaaaattcttagaactcctgcgcccatgttttgagacaatgaatgcatctttttccccattatgaaaatccaatatacccagagcctgcttctcattttaatgaatacttttttatgtagagcaagtaagggcttcagagccagacacatcagaatgtgacttggggctccaccatgaatgttcatatgggctttggggcaagctctgtggtctctgagcctctctgtcctcatcgctgaaataaagaccccagtcgcttttcccagaattcttcagacgattaaaggagatattgtgtgtgagtgaatgtgtctgtgcattccccagtgtctgctggggtgcatgcacaacagctgactttattcaagacgccacctacaaccacactacttcatgcgctctcaaccttttactgaattccatttccaatgaactgtcctaagactcatatctgatttccacaggattctgctgagctggtaaccttctctttccctgcatctgtgaaaacctacagcatttgtcatacagtcaatcagaatgtaggaaacaggcttaagaagatgctgttaattgcagaaacctgctgatcaacaatatgtctgggaaatgtttgcaaacaaaccctgaaacatctgtccacataaaagtctgaaaacagatatgaaaattagcttttgaagaaaggagtaaatgggagacagggttaaataaacttcattctatcaattgcttaaaaaaaaagaaagagaccctacatgacttctctctacaaagacatctgcatattttcctggatgctagatacgtctaggcatacaaagatgattcataccacatcatctcattatcactcttgagatcacttgttaaaataaataatgtatcttttttcccatggtgataatattcatattctaatgttaaaagttcagtcctttcaaaatccattcatttgctcaactttataccaagcttttactatgtgcctgatactataaaatcaggatatagtctagaagattcctaagtgtttgtccaccaagttctttatattccaccatcttccttctaaatcacccaagaaaaatatctctgaagcagtcctcatctctgccagtatttaaaatatctaggccgggcgtggtggctcatgtctgtaatcccagaactctgggaggccaaggtgggcagatcacctgaggtcagtagttcgagaccagcctggccaacatggtgaaatctcatctctaataaaaatacaaaaaattagccgggcgtggtggcataggcctgtaatcccagcttactcgggaggctgaggcaggagaattgcttgaacctgggaggcagaggctgcagtgagctgagattgtgccactgcactccagcctgggtgacagagcaagactccatctcaaaaaaaaaaaaagtctaaaagaaaagtctattcgtgtcactaagggttttgttaaagtaattatttattttttctgtctctagggtatatttaacacatattcattttttgtgttggttctcaagtcttgagtggaacacattttaatataataaaataaagtctggggaaaattaatttacacataaagataatatatactcaccaagacaccatgattatgtgtgggctttgttattctaaaactttaaaataaaaaaaaaaagtgagacttaacattccttcattagactcctaataaggggatgtatttgggtgttttgttttgttcttgggaatgaaaatttcaaattgttcattacatttcaaatcagtttttaggaaaggccaaaagcttcatgggtatctccctaatagagaaaaacagtgaaagctaacttttaaaatgtgcttctaacagtttgttcatggccaggtttcttctagctagttttcaggtttcagaactaaatgccccatatcagagaattttaggaccagatgaatagtatagaatctatagatcacccaatgtctctcaaaatatatcacagagaactggtttgcataggttagacgatgtgactccagattttgaaccccattactggcttctacctccctccgagggcccaaagtataactggcacatagcaaatgctcagtaaatgtttgctgaataaatgaaatggggaagtcagcataacaagaataggctgagaaagattatagtggcactgttttaaatgaatgagtctggttagaatgaaatcttaagtagctgaccaggctgatgcaaaggttccaatcgtatggaaacatgcttaagaaagaagactgaattaaagaagatatagactgattttatagaagatatagactatattatactctaggatcctaatttcaatgataagaaagactgtcaggaaatgtttttgttttctgttttttttaataaaggtaagaaaaagatgcgaaagtattaacagtgaaatctccgaggggtgggattatggacaactttgttttccctttttaaaaattacattaacatatataaaacgaaatttgccatcttaaccattcttaagtatgtaattcagtggcattagtaacatttacaacattatacaattatcactactatctatctttttcatcacctggaagagaaattctttaactataaggcaataaattccccattctgtccctccctccagccctttggcaacctctagtctccatcctgtctctctgaatttgcccattctagatcttccatacaagcagaatcatacagtgttggtccttttgcatctggcatatttaacttagcataatgttttcaaggtttttccacaagtgattttttggaaaactattttcgcatattaaattattttttacaatggaaatgttatatacagggaaccagaatgctttgtgtctcaaataaggtgtaagctacagagaaacagaagcaggaaagagaaggtatctcaagcaggaggaatgagacaggcaaaggggcacagggcagaggacagacagtgcccccagaatggcacagggagtggtgtcaaggattagtggtcagtaagtcagactgcacctctgaaatcagcctagcagataaccaagatcatcttgcacagttcttaccacaagatccaatccactgacaaaaatacagagcgtattacttacaattggaagccctaacttcgcaggcaagcatattttgcatgaattggcaggttacaaatgaacataagaagacagcatctgtcaagtcccttaggaaaccaggcagaaccaaatgtaattccttacctgaaaaacataaacacataacacacattaaaattcaataggcaaattttatgcctttcttagtaatttaagacatatgtttaatcaattatttctttttctcattgcaaggtgcctacggcaagtggatattgaattctcttttgtttttccccccttgaggtagagtctcgctctgtggcccaggctggagtacaatggcacaatcttggctcactgcaacctcagactcccaggctcatgcagtcctcccactttggcctcccagtagctgggattacacgtgtgcactatcatgcccagctaattttttgtattttttatagagacagggatttgccatgttgcccaggctggtctcgaactcctggcctaaagtgatctacccacctcagcttcccaaagtgctgggattgcaggcatgagccactgcacctggccagatactgaattcttttctttttttagatggagtcttgctctgtcacccaggctgcagtacagtggcacaatctcagctcactgcaacctctgcctcccaggttcaagcgattctccttcctcagcctcccaactagctgggactacaggcacctgccaccacgcctggctaatttttgtatttttagtagagacagggttttaatatgttggccaggctggtctcaaactcctgaccttgtgatctgcctgccttggccttccaaagtgctgggattacaggtgtgagccaccacgtccagccctgaattcttaattcaatgcatatttttccctgattcaagactaatttgatgtaaatgtttctatataggatgataaattctcctatataggatgataaatgtttctgatgcaagtatatggagtcactatatcaaacataactcagaaataactatatcattgacagtataattagtcatttccaggacataacaatcacataatcaaatggaccctaaagtcctacttgacatctcatccaacccctgaattcacccgtcctcttcttgggtatctatccattcactcggcacatctagtgagcacaaactacccttgctgatgacatggaggggaaaagcatgattccagccatcaagggcattaaaatataatatagaaataaactatattcaagcctcttccctcttcactggtgaatatctggaaaataattatattactttgtactgcttctgcctagtcaatcactgactcagtaagtatattcagagcatttctctgggctaggaatacataatacagcagcaaacagagccccatctctggccttggggaacttacagtctagtagcaaatacacatattttagtacaagcacatgtaatgggaaggccaaacagggtgatctagtctgggctaatggaagacgccttgatgaggcacatttagagtgagatctaagccaggcgtggtggccaatgtctgacattccagctattcaggaggctgaggcaggacgaatgtgtgaggccaggaagtcaaagccagcctgagcaacaaagtaagaccgtgtctcagtcacctaaaggatgaataagagttaaaggaaagcatcatttaggtgtatgaaagtggttctcaaactgtgtttaggggaccctctgaggagtcttaacactttttcaggagatacataagctcaaaaccattacttaatcatgcaaagatgtacatgcccttttcactctcatcttacagttatgttttccagaggctacaggcctgaaggcagaagcagcaatgagaacccagctgccctacattaaaccagactgcccagagatggccaaacatctaacaaaattccactcttctcactaaatatttagttctagaaactatttctttaaaaaatattacttatgttaatacataatagggatattattgtaatttttttaaatgaattaatacacatttgtaatttctcaatttccatttctaaaaaggtaaatatgcagggaataaaagctctttggtgtcctcgagtatatttaagagtccagaggggtgaactgtggacttcagttaagtgatgtgttgatatagattcatcaatggtaacaaatgtcccacaataatgcaagatgttaagaagagaaactgcgggagaggaggagaaggcgtccatggagactctactttctgcgccatcttcctgctaaacctaaaactgctctaaaaaataaggtctatttaagggggaaaaaaagagtctaaaagaatgtcaagaccaaaaagtttgagaaccactggcctacagaaaggcagaagcaaagccagcgggcgaggcaggggtggtgggcagagaagccagtgagccaaatgctgggaaaccaagactcggggtgccagtaattaggaccagaatgtggctctaaacacagtttttaaaaagatattgcttcacagcattcctgccagaaacaggactcctcctctctccgaaactgatgatagctaagagggacaaggaaaacctaagagtctcagaggcagtcaggctccaagcatgggccagggtgctccttagtagccaaatttagacatgaagatttttcaagtttgctcttattttattcctaaaggaattaaggtgtagttgttattttaatatctattaggtaacaaaaactgccctcaaagagttgctgagaacagtgacattaagcaggccccatgcccactttcttgtgtgtcaagtagaacactaaaactgtgagccacaggaatattctgattctcaagttcaagtcttttggggatgattaatgcaaagcccagggtaggatatgggcctttagatgttctggctctgctctaagttaagattttctaaaactgagcaggaacccccagagagtccagaatagaaggaaagttatgtatctattcaaaggataagaatttgcagctgccgctttgtattgcaacacagtgaggggcaggctaggttcacctgtccttccattgtttcagctgatacttattaaacacctactgtgtgccacatctgatgtcaaggagctggtgaccaagttgtaggaagagatttaaaaaacaggccacatttatacagcttgacacatgtaataagagagataaagaaaggatgctatgggcccccaaaaagaaggacatgagaggcatgacctcctgggggagttattgtcaaaatcaaggcctggtgggggattgatgtttggccaggttagtaaacagtggggtatacagcacttaagactggtgaaatgacacggacaaaagggcagaaacaacacaggatcccaaagcagccctgggaagggggataacattggaggcaggagagtaataggggtggcaatggtgatccagatggtatcctcaaacaggccagcggcagtaggggtggacagtagatgtgttaaaactgacagagctcaggcactactataaatggaggtataggaggaataagaggaacacagcacagccatccaattctctacagtgggagagttgatgggcttccaagacttcatcatgttaagatgcaaggcactcagtggtagccagcaaacctcagagatcatgatagtgaaggttaaatgaagagagtgcccaatgtctgtaagtgcatgatgcaattcataagagctgttgttactgttaccatagctatccttataactgagcatccatcaaataaggtgaaggtgatgtgattctatgtaaaacatgaccaaaatcagttgcaaaactgttctgtggcaacctggatgagatgggaggctattattctaagtgaagtgactcaggaatggaaaaccaaacatcatacgttctcactcataagtgggagctaagctatgaggatgcaaaggtataagaatgacacaatggactttggggactcaaggggaaaggatgggaagcggatgagggataaaagactacaaactgggtccagtgtatactgcttgcatgatgggtgcaccaaaatctcagaaatcaccactaaaaaacctactcatgtaaccaaataccatctgttcccccaaaaacctatgggaataaaataaatatataaaaccaggtctagtctgagttaaaaaaaaaaaaaaaaaactgctgtgggccaatcattcgttatgcaaatgaggttgagggttatagccagtagaaatgatacgctgaatcaaatgctgaccaagcaaacaaaagtggaggcctcaagatatgttctggaatccttatttttaaaaagaggttttgtttggccttcccaagcaagatccagatgatacagagcttactttttccacctactccataatgcagggggaagcatttaaactcaaaatgatggtgcaatgagagatggggtcaggaaggctgcagcacaacaaacgaggaaaacccaaactcctggtggccaaggctctggttaagggcaggcagagcagaaaggggttcctgagggtgctgaggctgggacacattctgcaaattaaaaccaaatggcataaatccactggcaaacaccaaaacaagatggtcccgtaattggcaaaataatagtttgggaccccaaagcaaccatcctataattctggtcactgtgctgatggagggcaggaacagaaatctggagaacctaaaaggagttacatatgtgatgaggaggttgggaaaacgggctttttaaaaagggaacaagtaccagggatttatacgtacagtggtgagaaagggatctttaatgatgcttctcaagtagaaatgcatctccctctaagaaaaaatctaccattacaatcaaattaacaagctagatgaactgtagaatgagttcacaaagtttacaaaatacctaacaatatagttactctaaatagtgatttgatttgtttaacaaatactggttcacacacattttagaaacatatgcaatgtaattagtgactatgggaatcaaaactctgagaagtcaaattttgctgtgtaaatcagaagttctccaaagcagtcaacgaatagcctacatttccctcacctgaggtaaaatgcttactttggagtccaatcccaaatctataacattagaatctcgggtttcatgaatgtgtattttttacaagttccccgcaaggtattttacatacgctgaaagttgaaagccaccaagggagagcaagtagaccttgtaggaagggctcttacatattaactcttctcaatcaacatacgaaacatagtactacttgaaatttttgcaggaaaagaaagaatattacagtgctaggtgtcatgagacattaaagtaagttaccaaagtggcttgaaacctttctttatataagatgcaccaggcaagtgattcaacttctctgaacctgtttcctcatctttaaaatggggattaaaaacagtttcagaaatttgtgatgagggttgacccagctaatgtgtttattgtgtgcacacgtgcctggcactgggaaacagcttggtgagtataagctataattatttgggggaaacatctgattaaaaccctaaaactagtcctgcattcaaaagatgagaaaggtatcgatcccatttctgcccttactctagctcagagacctgaaataaatgtaaagatccttcagctggaggcttctcatgaagaaagaaattgtcctgccccctgctgggcaatggtgcactgacagaaagagcctgagaaatgttcccggcatcacagccaggctggagcattcccattgtgtggcagggtcagcttcaaagagcacacagtgtctctccctttgtctacttttgatgtctcttttcaatctaacattatgatgttgcattgaccttcggagaaaagggcactgttctacacggttctgataagccgctttctaaaaaacacttcctggatgctagcagtatggacttcttaccaagaggacaagacaataatcttgtcatttaatagaggccttaggaaagagagagatgacaaaggcagtttccaaatgtcactgaagaatggtctttgcaagtatcactgagtcaaatgtgggcagtgtgtatgtaaggatgtatgtgtgcagatttacatatgcatgtgcattccatatatatgtgctctctctgaagaaaatatattaaaactctacattcaattttatagtttaaaagatatacaatatttagagtcaaaagacttgatctccatccaattttaaaaaatttccttctttattctattcttttacaaacagaatttcttatggaagaactttttaaaaagctacttatccttaaagatatcgtctgattttttcgtttgtttgttttttggaaacggggtcttgctatggcacccacgctggagtgcagtggcacaatctcagctcactgcagccttgacttcccaggctcaagccatcatcccgcctcagcccctccaagtagctgggactacaggcgcaactcacaaggcctggctaaatttttttttgtattttttgtacaaacagggtttcaccatgttgtccaggctggttgcaaactcctgcactcaagcaacgtgccctccttggcctcccaaagtgctgggattacaagagtgacccactgcaaagatacttagaagtagctttaagatcagattcaaaactcagcctctgttgtttactttaatatggtgttaggtaagtaacttagcctctctaaggtttaattttcttctataagatgaggaaatgcctacttaggtttggtgtgaggaataaataaaataatgcatgggaaagtgctttataattggtaaccaatcaaatcaatgtaatttaatgtcaaaattaatgacataattaatccaaaatggttgttctccacaaaacgttaaaaataatcttgtaaaattacatctataatctcagaggtataatttctaagcatacagaagcaagctactaaggttatggtgtcatgcaggcatgtatttttggttgaggacaaggccttgatgtgtgttcacaaagactctctacttgatcaaactttagtctggttcctatgagccctctttttggactaggcctcaaccttaacccctgtcctgtctttggctggccagcccagtcttagcaaagaatcctactcagtcatatcccaccccgacttcaatccttgacatcttatcatcttggcctgctttcagcaagaatcctgttaggtcagtgcagccaaaatctttctacctctgatatctcctcttagtcattttccacccactgacctcccctcacaccctcccttgctcattagctataaatcccacttgtcctggctgtattcaaagttgagcctgatctccctcctctactgtaatacccctattacagcagtcctcagtaaagtcttcctgaccattttgacaagtgtcagaatgatttttttcctcaacaatgtctaaaagagaaatagggaaagaaggaggaacttacgtcatagtgcaacaccaaagatggcagagaccgagatgagaaaatctgggaagatctgtatatcctgaactgaaactgagtgcccgagaaccacagggatgcattgcaaatacacacactcagctcactttgtgagacctaaactgtccaggctcgtcagaatttgtggtattatagacactctgccatcatcaacccaatgagaaagctgagaaaaacaccaatacgaagcactctcctgcatattatctcactgaatcttcaccaaaaacacctatgaactgagtatggttattatctccattttattggtaaagaaactaagagttaaaaaagcaatctgtcacgcctgtaatcccagcattttgggaggccgaggcgggaggatcacctgaggttcaggagttcgagaccagcctgaccaacacagtgaaaccccatctctactaaaaatacaaaatcagccagtcgtggtggcacatgcctgtaatcccagctactcgggaggctgaggcagcagaatcacttgagctcgggaggcagaggttccagtgagccaagatcgcaccaccacaaactccatctcaaaaaaaaaaaaaaaaaagtaatctgtacccatgttatgtagctggcaagtgaaagagtctagactcaaccccaggcaagttgattccaaagcccattcttttaatcaccacacaaaactgcctcccaggaagtaatatccaggagaaagaaaagtaaagttgaaattctaggaaaagcagaagggcccagaaggagcgaaccacctaactttcggatcataggcatgggaaaggaccacacagctgcaggtatagactgtagagaatgtctgactgaacacagtgtgtaaagaatgaataacttattgtgccctctgcattagttataattatacaaaatctttctcattgatcttagggattcccaaagaactttcttcaattccccatcctcattttctgtttgcttgaaatctatcacatgatagatattgctaaaatatagtgactttttaccaatgattttaaaggataaaagcaaaatccacaattccttcttatcactgagagacagaattttgattaccgcaacaaagaatcaagcaaatatgccacgatctgatgtaaaaacaatggcacatttacgattaatttccatcctcattcaagtgatgtaggaaaaaaataatgagctaattactgaagaaaggaaaaaataactatctaaaacatctatcaaggacttatagggcacaggaaaattcattcctgtgctcattttatgctcactcacttgttttggtccccagatttctgtgtgtaatatcacttttcaagatcaagaaagttattccataagcctttgaaacaagtatcttattagatgtatttcatgattcactttctgatgttgagcctgcctttttatcactgccactttcaaaggcaatgtcttaaggaaaatagtttcgtgtacactgggttttccccttaaaggcagtgctagttttaggcagctaaaagaaccaaagctttggagaaggcccactgggttttcaaatagtttattctcactatttcaaaccaaatatgccaagttacaaatgaacatatggcaacatcttagccaaccagtttggattactgtccaaatcggagactaaatcttggagattaaacttaatttggagtaagtatcagctagttttctatgtttaaaaggaagttatctttcatacaaagagaggtgaggaaggggctggccaattaaataactgttacaccacaaatagtatatttatttatttattattttttaaatttttttttttttgagatggaatctcactctgtcaccaaggctggagtgcagtggtgtgatcttggctcactgcaacctccatgtcctgggttccagcaattctcctatctccctagtagctgggattacaggcgcgtgccacgaggcccagctaatttttgtacttttagtagagatagggttttaccatgttggccaggctggtctcaaactgctgacctcaggtgatctgcccgccccagcctcccaaagtgctgggattacaggtgtgagccaccgcgctcggccacaaatagtacatttgcattatatcagctaatgtttacaattcacccaaggaggtagttatttctgacaatcaaagagaaaaagcttagaaagcttaagtcattcagacatgttcagggtcatatctgatatgatccaacccatactctttgctctatacctttggtctctgatatcagaatattcactcaagcatgtgaaagtgtatctgaattaaaaatcactattttgtatagagtacttcgggggcaagggaacagtgggggtggtaattagaattcatttcttctagacagtctgtgataggattcagcatcaagtggtaggaatttacacataggcatataaaatgaataagtcttctaagaaaatgtaaatgagacccaaggttacaactatatatgtttatggccttcaggaaggttagcataatgctgtagtattttctcatgtgaataatgaaactaacttacccacaattgagtaagcctaaaaaaaattcaggcaacagctattctgcaaagttaccattattattaaaataaaatcttattaacctcatgccaactcatttcagatagttctaatttaagaaaactgttaccctgcaggcaaccttatgcattatcatgctgcaatataaacactgaataatctaaacctagataaatcaaaatctgtcatttctgatcacttacatttcaaattcatagtcttaaccatttcttacttctagataagctctccccttaagtctttaaaataatttcaactttcacaatgaaagattccaaagattttctataactgggaacaactacacaatgttcgtgaagttaaaaattatcgtgtcggggcttatagacttctctcttttccaacttagttcgctctgtaattgatcccctcttacagagaagaaaagggacaatttgatgtagttttccacttagtggatccctgagaaaaaaataaagagttagagactaaactcttctaaagatggccagtggggaaaaaaattgtgtgcatttttacacagcataaataagttaaatggtggtgcatgtcggtgtggatgagaacaatgttctcacaagtgatggggatctaaagaaaagagaagctgcaagatttcggtaaaagttgcatgtactagtaaatttagaacactttaaatagctcataaaaacatgagcaaaggtcatacttctcatggggaccctgcttatttaaataaaaccctgccctaagacagaacaggagcatggctttataaatgatatatgttcatcccagcgtctggctcctggtgtcagcagaggtctctactgtaacaagtctttcataagcatctctgtacatcctgagatatgtcctttgccaactgtacacactctgaagtgcattatggtgccacagtctcttcctgtaaactacctttatgaaaaattacagtcatatttccagatgacatattcggaagtcatcaggagacagtcttaccttcaatacagagtgttcagagaatagagttaaaatgaaagctatacagcctcaactaaaacaacagaatacccacatacacaaacacaccatcatacaaggaagacactttattacctatccctgatgaaaaacagaattcctctggtaatgaacttacatctgaacccatacacggaatgccaaatttgaaagtattttagttaaagaaaataactcaaataccatactgaaataattcttttcagacacttaagaaaacatactgcagaatctcataatctatcacagctttgggttgctacctccttgccgggaggtttataaaatcactcaagagcccttctcaaattatgtagctttccatttgctactttttaacagtaacttggagagaaaaatatatttgattgtctatgttaactcttttaattttcactgagtttgagggcacaagaagcactgacttataaccattccagaggaccaaaactggaggccagggaccttctatagaaaagaggttttctgaaattttacaataaactccattgtagctatataaccagtggtcacatttttcaaaaatgtaccataaattaaatttctggccgggtatggtggctcacgcctgtaatcccaacacattgggaggctgaggcaagtggatcacctgatgttcaagaccagcctggccaacatggcgaaatcccatctctactaaaaatacaaaaattagctgggcacggtggtgcacacctgtaatcccagctacttgggaggctaaggcaggagaattgcttgaacccaggaggcagaggttgcagtgagccaagatcacaccattgcactccagcctgggcaacagagccagacttcatctcaataaattattaatttctataaatagaaccataccctcctaatgacttaaaccatcttctcagaagtgtttcagtttatgcaggaactattaactgcttcaacttttaggtttgtcagccacatgatttaaagaaagaaatcctaaaataaattatttgagaaattaagtactcatttctgctttctctggtttataaagttaagacattcattggtttagaaagcaagacaaacttcaattttaactaaatgtatcacccaatttcccttaaacaatagagacacataatcttctctagagagatactttagagcatttcttctctttccagaaacttccttcaggaaaaactggcttgagagacccatttctgtgatgtcacagcatcttacacacacagagctctaaggcacctcaaatcctagggtcaaattaactgggttctaaccaaaacaacaacaacactcgctgacttcaaaggtctgttgactcgaggagataaatctcccagtcctagttggttcttttcagagaggtgcagaaaagaccccctagaatggagctgttgagccaatcacctttccacagcaagacataaagcggagcatctggggagagaaataaagcttacaaacaaaactcggggaaaggagaaagagaaaggtcattcgtccttttcaaagatgcttacttacactgttgattttattatattcaaaactacccaaatatcagacatccagtctgactgctcttttcttttaatcacttggagctcatttctgaaaatagcactctggtcctcagtgagccagattttgcaaactgcccatacattcccgttatcacattttacccagtctgcagcatattcataatatgttaagtaaattaatttccaatatatattcccaaagcagcggttctcaactgggggggaatatcatgccccaggagacatctggcaacgtctggagacattattggttgtcacaaatggaggatgctactggcatctagtgggtagagaccagggatactgctaaataccctacaatgcacaggacagcccctacaacaagaagtattcggcctcaaatatggcaaggttgagaaactgtgagaaatcaattaataatatttttgttgccttcattcaatgagggcagtgtttctcaaaaacgtaaactttctgactccaaactctttactgactccaacaaacacctccaagaattctgaaaaataggcaaatgtttacttagtccccacattttaaaaataagatactcaaggaacatatatgctggtgaatgttagaattcaaatgttaaatccatctaatccttgcaagctttctcatatatgatctcatacatattttctttaccacagccccagaaaggagaactgttaggcccagtgcaaaaaaaaaaaaaaaaaaaaaaaaaaaaaatggaaagtgaaactgaaggaagtcaaaagcaacttatctagtgtctcccgatgggttagcaggagagcaaggaatcggatcaagtccctaattttagtgttgttcttctcaatacatgatgccctcctctaggacagtttttaaaatattgaactgagctgctaaaattgtaaccatctcatccaatgccatatattcatggatgtcatttaacccgcctaagtgccagtctccttatctataaaatggggatgtgttgtgaggaatagaggagataatgttccttacatctgtgcttagcacaaaagaagcactcaactagaaaaggcagctgctcttgttattcttattactgggatctcaggacaatgtgtgtcattataccagaacagtatttaagcaagcaaccaaaaggttgggatagaaaacccaacatacaaaaaaagcatctactgcaaaatactatctatctcagccagcagcagtgggtggggggtagaagaggctgatttcaagttatatggagcacaagaccgaacaaacagaagtcttgaacatttacttgcatttatttccttttctgttattaaaggcataaaagaaaggtcttcatttcaacgtcatggggcaatgctgggactaacaagtttgtgcttgaatgtgagatgtgttccagtaaaactgatagagtctatacctccttatttaaagaggtagtgaagaggtgagaaagattcaaaagggggcccatttttatttgagtgatatagcactgaaattaagattcggggctctagaattagcctggattcaaattttggctctagtgtgtaactagccctgactattagaaagctacacaacctttctaaccttcactttcctgagcaaaaattggagagcacgaaagtatttccttcatgtaatagaattgtgttggaagtcaaatggtataatgcaggtcaaactctcaacatagggtctggaatactgcacatggaaaataaatgctaaccactgttactatgattgttgtcatcattgtcttcaacttcctcctcctcctcctcctcctcctcctccccgtcctcctttataatgtccagctctatgtctagctcacaggaggttcacaataaatgtctgctgattaataattgtttatgacacactagatactgctctaagaggcagttactactattattctctttttaaaaggaagaaactggggaccagaaaggataagaaacttgcccaaggtcacacggcaaggaagtaacagagcggtaattttttttttttttttaagagatggggtcttgttctgtcacccaggctggagtgcagtggcacactcatagctcacagcatcctaaaactcctaggctcaagcgacaggaacacaggaatatagaagataggaatagatagcaacataagacaggaatacaggcacacaccactacgcccaactaattgttttatttgttgtaaagacggggtctccctatgttgcccagtctggtctcaaactcctagcctcaagtgatcctcttcctttggtcctcaaagaggtagggttacaggcacgagccactggcccagcctagagttataatttgagcccagatggtcaggccgcaaagcctctgtccctagctaccacacaacactgccttatgatagaagaagagtgaaaaacagggtttaaggaagttctcatcaacataaaatctcaacagatgagacccatctgagaaggagggaaagaaaccacactcctgagatggccagtcagagggaggcttcgtagaaacacttctttgaaacaaggggtagaggtaggcaggaaagagtctttgcatgcaatgagcttgtttgccattttaaacatatgtagcgcccatagacggataggtaccctgaagacagaatcagagatcccaaacactgaagttacgcagatatctgaggatgaaagaaggggacccttccacaggatagatgcagctgaacaacttatgtgatctggaatcttcaagtcctcttgactttcaccaggcacattcaatttccagagcgccctgggatgtactaggcaaaagatggtatgttttagggaaaacagctctcagacatcccaacttaacatccatacacatttgccacctgattgtgaactaaattacagggtaataattatcagatacgagattaaaatggaagattcttgtcctgcccaactaaagaggacaaatggagtcaaatgaagaatactgttagacatttttataaaggataaattatatttccaatagacctagtaccagtcttgtcaagtaaggactcttcagaactgcagcaaaatgctaaattccaacaacgttaagccatttcctacagtaattacatgaggtttcatttctaacctctccaaacgcttttatgtctgtctcttttctagtggcaaacgcagggaggttaagaggagcaagccattttgtttcaagccagccacaaaccaaatgcacaatgccacaaaagaagtctttattccatcagccagcgggttcctcattaaccagccgagaatgaacctagaatgcacaatttcgtgttaatcacagaaaacagatgcccatgatggctgcaggtaaaactgattgtttttgcctctcagtaccactcactagggaatgtgatctgtttcatctccaccctcccttcaaggattgctgagctcccaagtgcttgtgaaaacacgtcaggtgtggggatggtactgtgagaaatgaaaaatggtcctgacaagatgaaaagctgcattttccatcttgttcttaaatgggcttaaatagacacaaaatggggactgcttaacccttccatatccacacctcaatagagcagactggagtaagagcctaaaaagttttcaggaggtcagcagggtgggggtgggaactgcctcattttttctttatggtaactcactatccagggctcacaataccccagaatggctgcatttcactaggtataagccacttccagcacccagcgcctgccaggagggcagtctatgaacaatcacagctcaagtggttcctttccccctccaacgagaatcacaaatgcctcctgaagtgggtcccactaacagttcagctccttgaacacccatttcttccttctcagattttgaaagtctaaatagttggttagtgatgataaaggagatacatgtagcagaggcgacttgcaaggcattaattcattctccgaacaccagcctctcctacgaatctcattactgcacagcaggtggacaagtgaagtacaaagaatgggaaggcggaaaaaaaaaacaggaagaaaaaacacacagatctccaaaggatgccatcattattttacattataatgatcccaagaaaagggtgaactactcattgttcatttgttcattcactggagaatcataagcagggcccagggaaacaaaaatgctatcagtaacaataattactttgtttctatttgtttctttagttatataacatgggtgtgttattataggttaggcactctgctaagtcctctacatgattttctcattgaattcttacaccacccactgacataggtattactgtttttcctgttctacagatgaggaaactgaggtcctcagaaattgagtatctcaaaaggtcacacagctagtaagtggctcagataggactgaaactctggtctgcacagtaattcatacaagcgtcactctaccacttccagaatgtggtctaaatgcaggcacaactttatatacaaggatattcattgcaacataatctggaaccaataatggaaacaacacctgtttcccaaagtagggatggtacattttttgaaccatcactactactttggggaacagccattcaaggggatatctgcagtgcaagaggctctctgaccccactcttttccttcctgaaagcagtgataaaacccccatgtgcaagtatcctccctatactagtaggaaagtcacattcgtatcatcaaggatgggaagctgagaccaagagagttctgtataaacagaccttgttaaaataattcttaccttccttcattctccctacataattcagttacttttccagaattgcctctctgtgttcaaccaaatataaaagtatctaggttttgccacttccttagatctatatttccatataagggttcccatgtcacaaaagacttatattacataaatttgtaagcttttctcctgtgactctcacagtgctttaattctcaggcctggctgaaaaaaactaggaaggtgaaggtaaaagtttgcctatcctacaataacaacatttacatagcacacatcacttatcaagcactttttctatagtaactcatttaatcctcaaaacaaccccagaaaactgaggcataaagaaaaaaaataatgttcccaagtcacaaagctgctaagcacaagggctggattccaacccagactgtctgaatgggatatctgtgcgcataagcatttccctacactaatggtaacaaaatagcacagtcttctaggtggaagcataggcatatttcatatcgcacaagtgcttttaaaaaaaaaaaagaaataaataaaagaaaatcctgaggccaggcacagtggctcatatctgtaatcccagcactttgggaggctgaggcgggaggatcacttgagcacaggagttcaagaccagcctgggcaacatggagaaaccccatctctacaaataaataaaaaaattagccaggtgtggtcgctggcacctttagtgccagctactggggaggctgaggtgagaggatcactttaccctcggaggtggaggttgcagtgagccaagaccatacctctgcactccagcatggatgacagaacaagaccctgtctcaaaagaaaaaaagaaaaaaaaaaaaaaaaccttgttgttcaaaagaattatagtttgggtattaacatggtctatggtcttccgtttccttttatgatcaacatgaaatccttaaatacagtaataaaaatttctagttccacacccacccacccaccataaaaaagaatgtagacgtgaaaatggcatgatacttaatgatcaagagattctcaggtaaaaatgtaaagcaagccagcatgatattacttatggttgtgattcattctctatgcttctcccactcctgtccactcccctctcccccactattcaaaaaggaaaggaaaagctggatgtctagctctgacattgcaagggttgctgatattctattttactatgtttgctatgttttcaaaagaaccaacattttagaagaaaaggaacatcagtttatttaatttggttcttcactttttactctaaatcaaagttcaatttaccttaaagttttaaaaaaggctgacagctgaggccttttggaaagatcacctcactctacagaatgcttaggggaaaaattcatcaaaagcagacagcagacatctaccatccaccataaatcagcttcctttttctttttctttttttttctttaagcatcttctttagaatacagtgagaaagtcgtgtcatttaacttggctttttgaaaggaatttcagaaattattttagtttctggaataagcataggcgtaaacacacagattcagtatatgcctgaagcttgttgatttctcctagatatttaaaaacagaaccgcttgttttgtcctttttcacttggctcacaaagtgacatggcaacagactatgtactaattttctggggtttcagcactgaaccaagaagatggcagaaaaatggatacaatcattaaagaaattataggaactaaattaagtcaacctaacagtgaggctgattttcataaagggcctgtgtccccaaggtaaggaatgcatccttcccatcatggaagtcaatggatggcacctaacatggtgtcctcagtgctacagaatttatctaacattatctgacttgcctgttcccattaaaagtataacatatgtgatcaactgttgtagaataaaaacatttggcaaagacaatgaatcctacttataggtctggttttgggaatgaacctttaccaaaggaggggaaaggctactgatcccatgatcccataacaggattgccactaagcacttttttatttgaggtaaggccaagcatttggttgtggcactggcgggacaactataaagaaaccaatgttccactgcttattaagctccagagtctcattaatgccctttacaaacttaggagaggtgtactactctaccttacataataaagaaaattgaattttaaaacattgaagtcatttatccaaagtcgtttagctagagagttggaagagtcaggattcgggcccaggacaacctaataccagatacatgaggctgtggtgcctttcctctaaccttaagttgctttgagaagtttgagctcctgctctttagaaatattcaaccagaggctgtatggccttttggaattaattttgtaaagaacttaatcactggctggggaatgctagtgattccttccccatgaaatctactgatatttccattatatgagtcaatggacagtcttcaacatgggttgccattttcggatttctctgtctttctcaatcttgcttctaagcaaggcaatgattcttcctatacaaaagtcactttctgcaatatctgcctaaatttttaaaacatttgtgaaccctggtagtgtcaccaaaacatctgctgacctaactaaataatttcatctgatcatcccagcctcggtcccatctgtggctttcttctccctgcttattaagttgagatgagtaggcaggactaaagtatccctaacattttcctgcttgtttatttaacagctatggatatttacatttgccttcctaacatatttggtattaattaaaactcacagatttagcacagctctttctatatataaggcacaagtcaacaaactaatcttcaaaaaaacttcatttgggtaaagtgggggataccttcttcaactcagaaatcgggagtttaataagctaaggctacattcaatgtagtatgttatatagaacaagggagaaggagtcccaattcctggcctggtggacaacagctagaatatacccaagctattgtgattctttccgggtaccatattttaggaggaacataaactagattgtttccaaagaggatgtggataatagaaattcgaaactacgttgcaagggattgtacagctattctccatgttggtcaggctggtctcaaactcttgacctcaggtgatccgcttgcttaggcctccgaaagtgctgggattacaggcatgagccacggcccttggccgcaagaattatcttaatcacagtcattattataacagaataagaggctgggtgcggtggctcacgcctgtaatcccaacactttgggaggtcaaggcaggtagatcacttgaggtcatgagtttgagactagcctggccaatctggtgaaaccctgtctctactaaaaataaaaaattagccaggtgtgatggcaggcacctgtaatctcagctactcaggaggctgaggcaggagaatcgcttaaacctgggaggcagaggttgcagtgagccgagatcacaccaccgcactccagcctgggtgacagagcgagactccatctcaaatagtaataataacaacagaataagagaaagcacactagcctgaggataaaagatgcttgggttctagtccgaatttggttggtaacaaactaccgtcttgggcaggtcatattgccctctctgagtttccatttctctctcttttttcttacataagtgcatggtctagattaggtagcaggaatgacagaatcatgacacgcaaaatcaatctgcacacatgttctgtctggctagcatgaactctccagatcatcaagtctgcctctctatttatcaataatcacctattcacacatttaacttacctgcctgacccaagcaagagtgttatcccccaagttctattatatttcttacagatctaaaattatatatagtatctctttctgactcacccacagtttagttttttttttaataaagactttaggccagggcagtggctcatgcctgtaatcccagcactttgggaggccacattaggtagatcattagaggccaggagttcgagaccagcctggccaacatggtgaaatctcgtttctactaaaaacacagaaaagaaaaaagaaaaataaataaataaataaagactttactcaaagcattttcaaaattcctgtcatcctaaattggagaatagttttatagtatttagaaagctcaaagacattcatccttccctcaagaaagaacttcccctaaatgaagctctgacaattgttacatgaaatttacgttaggaggccattgttatggactgatctcctgcactaggccccaacagaacagaccaaaccaaaatggggttactcatgctaaggttccattcaccaaaacaaaatgaaagtgtctaagcttaggagaaatgacaaaaaagatgacagccaaatcctcaggcagttctagctggcatgaaagggaaatcacctctgctttaacccttacaggaaaagcaatctgatgtagcttaatgtaaaccaagccactttttgtattatgcaatttcattgttcctggcttaagctatcatataaaaactgaccattctgcatgcccaatggagtgccttttctaaatctttggatgtcatgctctccaattcatgaattgctactaaaagcaaataagatctttaaacttaatttgttgaaattttgtgttttaacacaaccaaaataggcaagcattctattcctactggcaaccctttacacaagttgcttaaaaaattacttaagcaggctgggtgtggtggctcatgcctgtaatcccagcactttgggaggctgaggcaggcagatcacttgaggttaggagttctagaccagcctggccaacttgacaaaacctcgtctctactaaaaatacaaaaattagccaggtatggtggtgcccacctgtagtcccaaatactcagggggctgaggcaggagaattacttgaacccggaaggcagaggttgcagtgagccaagatcacgccactggactccaacctacgtgacagagcaagattcaatctcaaaaaaaaaaagaaattacttaaggatactggtgccaccatattaaattcaagaagtggtaaagcaaaggttgcttgtctcagtcaagttttttcttcattgtttggcttcactaaagtaccaaaaataagactattgaaatcaaatagcagaaagttagaatgctttctaaaaaactaatcactcctgcaaggctcacataataacagccagctatgggtagaatgactttattcacatctattaataaatggcaaagatgaaatgcagcagtggaggctcagatttttccagttgtggtagaacacacaggagtcccagtttgaaccttcctacaatttaatttttaatatctctgctttagaaaatactacagtggcattactttaaagaaatcattatcttttagaaaatgtgaaaaatgtgtttaagaagataaaaactgctccgtacagagaataatattttcccctttaaactccagggacaaagcaaattttccagtgtcattttactgtagcccaccaggattttgacaaagcaaacctagtgctaagaaactccttgaaacttgaaaccagcaaagagcctcttggtaacttaaatagatgaatttcaattttaaagccactgggcctgaaaaaaaagaaatgcctttttaaaaaaattgcaaaatttgaactcaatattggctttcttactgaagaaaataataggaaaatattctttaaaagttgtcgatctgtttttttctgatgacaaaaataaataatgagtagacaaaaccaaatgattacttaggtatataatcctcatatatgcatataatggggtttttacttggttttcttttgatctttttataaaaatgagctcacattgcacatgcactttgaacttcctactgaaagttcataagcgtagtagagcatgatgttgtgtacctgtagtcccacctattcaggaggctgaggcaggaagatcatttgagaccaggagttttaggctgcagtaagctatgatcgcaccactgcactccagtctgggcaagagagcaagactctaagaaaaaaatataaaataaataaaaataaagttcatcaatatcacacaaagcctcctagaaataaacagtcccaggccccatccaggtacaagctgcaatttcacagcatttcaaggtgatggacatgcaattgaaaaatgaagaagccatagccgggaagatactttatggagcaccattccctatttgactttgatgataagatgtagatgttgataacacgtgtctctggacaccaaggaagataagtgtctacctgggtttaaaaatgtgcctactatctctatgtaacagtgcctgttaaaagcaaaaaaggtgagaaggcatcttcaagttcaggttttcggatagaaggtggctggaaagagctttcctttgttgcatcacttccccagtaaagtagcttgaataaccatcagtgagatagcctctcctgtcaaaacctccaactaaagtcacagtatccaacagggcccttgggcaaagatgttcactttcaaaattcaccatgaggagatttacgtgccatctgggaggattgctatcttgggcccatgatgctattactgctctcatgaaccttattactgagaggacaagaaaggtgagagaggcagaagaagacacatcactggcaaaaactgctctgtctgcttaccatgagtttattttagactcctgcctgcggaaatacaaccagtgtgtcaaggcctatgtggccattcagcatttcccagagactctatgacttctcctagttccaaagactgtctcatagaaaactaacatcagaattcccacttttttcatcaaaattggtcaagcactaattattaaaagtatgaaaaatgctaccatatgttcatcttttagttgccttctaggtaccgtagggcattggtgatttaagctcccatccatcctgccacgtgcaggaagaaactgacacgaggaaacccactggccagctcttgttctgataatgtccagcaacccttaataggggcaaggtactctacatgcctcagtttactcttgtgtaaatgatacctgtgtgcctcaagtgtttctcaaagtatgactcacaaaccatgagagctgagggacaggtatgaaagatgcttttaataggtaatgtgagcattagaaaaatattagatgtttgcatataggcgtatccttttttagtaaattattattcatttatttacttatttattttgaagtggagtctcgctctgtcaccaggctggagtgcagtggcacaatctcagctcactgcaacctctgactccctggttcaagctattctcctgcctcagcctcccaagtagctgggactacaggcatgtgccacaatgcctagctaatttgtttttctatttttagtagagacggggttttcccatgttggccaggatggtcttgatctcctaacctcgtgatccacccacctcggcctcccaaagtgctgggattacaaacgcaagccactacgcccagcaaattattttatttttaaagaagattactgggcagggtgtggtattacagattacacctgtaatcccagcgctttgggaggccaaggcgggcagatcacctgaggccaggagttcgagaccagcctggccaacatagcgaaaccccgtctctattaaaaacacaaaaattagccaggcatggtggcatgcacctgtagtcccagctactcaggaggctaaggcagaagaatcgcttgaacccaggaggcagaggttgcagtgagccgagattgcaccactgcactccagcctgggtgacagacagtgaatctgtctcaatgtctcaaaaaaaaaaaaagaagacgattactcagcaaatatcagctcagatagtaggtgaatatgaggtggaaagtcctaaaggtgtttcttaattatttcaggtagtatagcaccatgggcaagtgagtatctctttacagaacacagggaaacatagagatattttatttcatcataaataaagaaaattttataactgtgtaatataaaagcacaaccacagtttacatgtctgcaatttgtttaaaactagctatcaaaataaggtataaccagccttctccaaatgtgattaatagttatttgctatttagcttataatgttttatgttctgctagcattagaaagcaaataagctagtcagcacaaaaaattttgaaacctttaataaaaaacaaaatctaatggatttaattttattcaataagcctcatcattatttgactctccttcagcctaacccaggaatccccagtgctgtatggagcatgctatgagaagcagggactagttggagtctgaagtccattctatgaggctagatcatgtaagaccttaatttatggtttgactattttaaaagaatactgtggcatcttttataacctggccaggcgcggtggctcacgcctataatcccagcactttgggaggccgaggcgggtggatcacaaggtcaggagttcaagacaagcccggccaagatggtgaaaccctgtctctactaaaaatacaaaaatttgccagacttggtggtgggtgcctgtaatcccagggagagggtgaggcaggagaatcgtttgaacctgggaggcggaggttgcagtgaactgagatcatgccactgcactccagcttgagcgacagagcaagactccgtctcaagaaaaagaaaaagaaaaaaaagacaacaatataacctattaggcccaatcccttccttgtaggggccaatttcctctttcctcatcaaaacagagactttatgaacctgtgtctccctgttaacattgtcagaccatagagaaaagccattccttctttgtctcttctgcactgattcaggggggacttgagtacagctgtccatcatgagaccctggctttttcaccacaggagtgggcatgggacctgggatggccaatcaccaccaatgtaggcaaaagacctaactgagccaactgagttctctgcagagaatgatcatggtgctacaagggagggacacctctttccctgggatcagcagccataagaaggaagtaggccaggagctgccacatggagaacacttcgtgagagtgaagcaaacacagaggaagcaaacagggagcagagaaaaggaaaacgagacagcataaggataagcttcataaatcaggaagctaacaaacttcaggctcactgagggcagtattgcaggtaaatgagtctaagtttgggacaagacatgtttccagggacctggttttacgacccagttcctgattactgcacaggctgatgagaatttcttgcatttacaaatgacagaaaagatgcacagaaagcaattaacagcatgtgaatttaaggaggggaagcaatgggaggaggcaagaattgaaagactaccagatgaaagttaccaggaagcacagaggtcatgaggtctgcagaactgggtgaagatacagactccacctcacaccagcgtcctctttgatctaccacggaccagtttcctcatctggtaaatggcaaaaaaactctacctgcctggcaggactgttgtaagaaataaatgaaatcatatatgtaaagtattcataaaagtacctgacagagtagaaaaagagctctcaagttctcaccaaccctgaatcactatgatgtaggagtaatatattaaaacaacagccaacacccccaaaagattaacaaccttaagagtagggggtcgggcaccatggctcacacctgtaatccaagcactttggaaagctgaggcaggaagatcacttgagcccaggagttcaagactggtctagtcaacacagtgaaacctcatctccataaaaaattaaaaaattagtcaggcatggcagtgcatgcctgtagtcccagctactcaggtggctgaggcaggaagatcacttgagcctgggaggtggagtttgcagtgagctatgatggggccactgcactccagcctatgcaacagagcaagacactgtctcaaaaaaaagacaaaaaagagtgggggtgggatcactggtaggtaaactcagaatacactagcataaggtctatccatatcactcggattgtctggctgtgatgctaatgtatatgccttggaattctaagttacagtctccttgtttatcatctggaagttcacaagcctaccttctggagaacatggtgaattcagaaggaaaatgtaactgtactctaatttgctttctttgtgtctcagactgccttgattcgagtgtttatgccttaatcatacttgagtctttcattttaatgacttttttaattcgatataaagattaaaatttttatatctcattgtgttttccttttaatacaagttacttgtggttgctgaacaaggtacaaattagaacaatttcttcccgggaacgatatgaaggaaacttcacaggaagagaaaaaaattccaaaggataaacaggtttattacagaaattacacactacagattcccataatgctaaccatcccagtaactaagtggcacatgggcatctgtttccatagccccagatccactggctagttaaaaaaaaaaaaaaattaattgctaacaataaggttttgttctaacattgggtgaaacttttcctggttatgagtttctataactgacatataattccggctaaaccaaaattctgttttacacaagcaaagaagtcctgagcagggtgaaatggtagttatcatctttgatgttactgtcaaaggcgtggaagatacttatcttaataccactgttgtctccaccatcttcctgtgatgtttttcacccatgaatttattgaaaatgtatttgaaatgagcaaaaattgtgtcctgtatccctcttggataattagtttctgaagtccatgtttgttatatattcaaaatcttcctggggcaaaattctccttattttgaatgtccaggttttggtggaaaagaattcataataagtgctttcatactttccttataatcctgttggcttgtgtcccctaaaaactcagagtctaccaagcttttgttcacatagtttatggatatactgtgcacccattcttaaccctgacatttcacatctgcttgcctaagagaaatggcatacacaaaatgttttcctatttggtgatgaacaagtacatggaacatatagatcacaagtgatttttaagtaagaggaaaacaagaaattcaaccaaagagccaactagtactgggcctatgttctgtgcctaacaaggggttctaagatacactaactcgccttaggcaatagggagaagattttgatttctgtcttcactattgatagctacatgagtcaattacttagcctttctaagcttcagttataaagttaggataaaaatgttgtcaacatcatgggatagtagtgaaacaagacaatgtatatgaatttcatagtacccagcatacaataagagctcaataaatattggctatttttattatcatcatcattcttatcaacccaaagagccacatgaatgtaacctacagactgattgatctcaaatgcatttttttaattctaaaatttctgaaatcctatgaatataacaaagtattttcaggctgggcgtggtgactcccacctgtaatcccagcactttctgaggccaagacagatagattccttgagtccaggagtttcagaccagcctgggcaacatggcaaaaccccatctcaacaaaaaaatacaaaaaaatttgccaggcattgtcatacatgcctgtagtatcagctacttgggagactgaggcaggagtatcatttgagcctaggacttggaggttccagtaagcctagattgtgccattgcactccagcctgggcaacagagtgagaccttctctggaaaaaaaaaaaaaatttttttaagtgtttttttctcttctcacccactctgccaaaaaaaaaaaaaaaaaaaaaaaaaagcatcttaaagaaaacatagtccattatgtgaatggatatgcagacaaaaaatgtgcagttacatacaccaaagtattaactatgattatgaaaggtgatactatatagttctttttaacagtggtttctggtcaaacacagtagcccacacctgtaatcccagcattttcagaggcggaggtgggcgggttgcttgagccccaggagttcaagaccagcctgggaaacatggcaaaaccatgtctctaccaaaaatataaaaaattagctggacatggtggcacatgcctgtagtcccagctatgcaatggctgaagtgggaggatcacctgaacctgggaagctgaggctgcactgagccatgatcacatcactgcacttcagcctcagtcacagagtgagaccctgtctttaaaaaaaaaaaaaaaagtttctaattattctttgatgaatttaaattatttgcaaaacaaaaacattaaacaaacatttttgccataaatcccgtacttacttagtgtgccccaaatctagtcaaataaattactataagaattttttgttgtccttcctacttagtttgcaatttttgccactccttttgaaatagctcatcctcctgtcttctacataggtggtgcagaaagtattttaaaaatcaatgtagcattctttactacttgctatatgaaacactactggcatatagttgggtttctttttttttttttttatggcttctgaatgttttacattccattaattaaatcctactctcaattgtttttttaaaaaggccacacaaatattaatgtcaaaaaaaagtgattaggtaagagaatggaagatatatttccaaaaatttttcaaagcctctgagtcccaggaaacacaatttttaaaaatggtaacccttatttaaacacataataaaaagagatcttgtcaaatatattaaattataaattggacatcagttttgtacaggctgatttctaaactgtaatagaacacatctggggtgattttctggctctcctcgaatatctggttttccaggcagctgcaggaaatctctgggtagacataccactacaataattaatgccagctttcaggcatcccaatgaaaaagaattcatgacagcaacagaaaacggtactccccccgcaacacacacacagaataaccacgaatttaatgtaaaacatgaatccacaggcctccagcctggagcagctgaaagacatttgtgtgatttgtgtgattcatgaacaaagagtcattcgatctcttccatcagacttttctgcatctcagccacttttgtttctatccatcgctggctgcttcattcataccctggttatgtctgcactgaacagggctccctatttctattatactacaggttccaacaaggaaccttcttctaccctctccttgctttcatctttcatctccctgaagggcactggggcctagcacagcacctggaacatagcagatgcccaaccaaggctgtgggtagatggactgtagggtaagtgagcatgtgcaaggataaagaatgtatgaacaaaacgcaaacagtgaaaactcaaagactttctggattctaaaattatatttattaagggaaatattcgacttttgagaagcaaacatacagataatgtgctcactagctgtgtgacctcagagaagttccttagcctctctgggcttcagttttctcatctataaaattgagaccctaacagtgcctaatcaagtggttgctgtgagggttaaattagtcaccatttgtgatgtacttagacgaatgactggaaaatactatgtgtcaagaaaaaaagtaagtactgacaaataaatatcaggttcattatcaccattttactaaaataaagggactatatttggcataaataccaaatggacttgaaaaccgtgctcatggcaaagtgcggttgcttacacctgtaattccagcactttgggaggccaaggtgggaggatcacttgagcctgggaggttgaggctgcagtgagccatgattgttgtgccactgcactccagcctgggcaacagagtgagactcttatcacaaaaaaaaaaaaaaaagaaagaaagaaagaaaaagaaaagggaaaagaaaaatatgttcggtctcctaaaagatagaaaacaaatgtatatagctggtttcaaatcccacctatttgactgcagtgctgtgtaatttctggacctccgtgtgaacaatttgtaaatggaattatcatagttcccattgcatacgttttctgtgaaagattaaattaaattatataaaaaatttagcaagaaaactggcatgcagtaaacaatcaataatcctaactaacactactatagttctattagagagtgtggtaaatcatgattaaataggtatgcataataattcatatggtgggcatcatttattcagacatcaaatacttaatgagtacatacatcatattaggccattttagatactgtattctttaaagccccacaacagccatgtgatacacagtttacagcactaacttaatgaagaaaatattaatttaaaaagaaaagttcggccaggtgcagtgactcacgcctgtaatcccagcactttggggggccaaggctggcggatcacctgaggtaaggagttcaagatcaggctggccaacatggtgaaactttgtctctactgaaaatacaaaaattagctgggcatggtggcgggtgcctgtaatcccagcttcttgggaggctgaggcaggagaatcgcttgaacccaggaggcagaggttgcagtgggccaagatagtgccattgcattccagcctgggcaacaagagtgaaactctgtctcaaaaaaaaaaaaaataaataaataagtcttttgagaaatgcaggaagggttcaaagggaagataacatttgttgaatatccagcacattccaagccccatatagtgccctttacatatgcaatctgtgtcctcactccacacccagaagatggggaccatgacttcaattgcacaggtgaggaaacagcagttaagcaacttgccaggaccactcaggtcaaagagccacagttcaaacttagacctacctggcttttgactctagatttctgcccaacttcttaatatttgccaaacagaaaaatactaagatgactgaagccagtcaaaatgtgtcttcacttttaatgacttttaaaaagacaactcgcatcttggatcaagttcctattaataattttccaaagattccaatatactccagaggtcctcaaccagggacagttataccccccaggggacatttggggatgtccagagacattaatggttatcacaattaggaaggtgctagtgtcatctaggggtcgagaccagggatactgctaaataacttgcaacacacagaacagctgcctgctcccaaaccccagacaatgaattatccagtccaaaatgtcaccagtgcataggaaaagaaaccctgtagcaacccacaaaatgaaaattttttgactttccaaaagttgtactttgcttagtcatgctctagaattccacaggaataaccacttagcctcactcattttttttcttcactattaagtttacgcttcagtacacattactgccagtatgacctcttccatcacacccagggctctggcagcgttaatgtgagtggccctcttctccatgtaaatgtgcacaaatagaatattctggtctcaagagaacacaagcaagtcccaaatttgcttctggaagggctcagcccaaggtaagaagggccgggaggggactatatcagatgccatacactaaagcactcaacttttttccaaaaataattcatcttcaacccagcaatgcagttttctttgcctgtgtgttcttgcataaggaactgtgagatgatttaaaaagcaaactttagaaaggtaaagttgaatctcagaactttctaagaccaagaattgcacaatcgcttgacagatttatcccctaatttgatagcctctgccccttcccagaaaaactcaactaaagatttataagtctacttagatgaaaagttctcctgtggcaacacaaggcttcttttaaagtaacagtctaatagtctaatgaattttattcgcaccatggagagaaagatcttgattccttaaggtctccaaaaaagatctatctttggaaagtgacgagtatgctgttaagcaaaagcagtagcaagtaactctaacctttttcttaccagctagttcctgttatcgattacatgtgatgggaacatttactatcatgaaaataacagcactaacaaagaaaaaaaaatgacacttgtaacacagtccttagtttcctaacacatttgacaaacttgaaaagggggtggtcctgagatctgagaacatgctatcaattttttggggggggaagggcaggggggacatcatctcactctgtggcccaggctggagtggactggtgcaattacggctcactgcagcctggacattgtgggctcaggtgatcctcccacctcagccttctaagtagctgtggactacaagtatgcaccaccagccctggctaatttttgtactttttgtagtgactgtgttttgccatgttgcccaggctggtctcaaactcccaggctcaagtgatccccccgcttcaatctcccaaagtgctgggattacaggagtgacacatcacgcccagcctatgctgtcatcttaagatatactgattaatttcagtcaatgcttaattctgaaattaccaacttggcctaaatacttgcaaaagcactgaagaagatttaaagcaaaagttctataaccacagtactaaggagattcaaacgactaacaatgaggtccaaaactattgagagaagagccctggagagctaacttgcatatgtattcacagaaagtctcaatactcaaactcaatattacacagggtcagaaatggttaacagctgacttaaagtttcctctttgagtgaagaatccatttttgaaaaaaaattttaacattaaaaataaatcattactttgatccaacagatgaataagccccctatacagtttatgctcatttgcagacttgattataaaaaacgtaggaaaattaaggaaggatggccaccacattatcaaccatgggttacagaagggggttgatgagaaggaaaagaatctagcccacatggggcagaagaagggatttgcactgcttatggtatactatgtaagggccatgactacgggtgatttttctgttttatgtttcactactttgcatattgtattttttaaaagtttggatgggctgggcatggtggctcacgcctataatcctagcacattgggaggccaaggcaggcagaccagtctggccaacatagtgaaaccccatctctactaaaaatataaaacttagccaggcgttgtggctcatgcctgtaattccaactacccaggaggctgaggcaggagaattgctggaatctgggaggcggaggctgcagagagccaagatcatgccactgcactccagcctgagtgacagatcaagattctgtctcaaaaaaaaaaagaacaaaatttaaaagttaaaagttcggatggaaaacagaatagtacctgcacacagagccttcccaaacagatactgacacaatacaagatatctgacagcattcattgagtatacttacatgtgctaggcagtagttgctaatggctccatttgatcatctgaacatttgattgtttcatcttcgcaaatgcctatctaccttgatcaggaaatggatagatttttttttaagttccggagtacatgtgcaggatgtacaggtttgttatatataaacacgtacgtggtggtttgctgcatggaataggttttttaaaactaaatacagtagtggtttgtttcacagaaatagattcatttaaaaaattattatacaaattatatagcaactgccgcttttcaaagaccaaagatataatgaaattgacttgacattaaactcgtattatagataattcagttttcatctcatggctgagaggccattacaagatcctaaatagcttctggccaataatggcaacatctataataataacagctaccacggaagagatttgctaaaggtttctactgattctctcattaatctccatcaccctgactctgcaactacgcaaacacagagagtacaggcagctttcctgaagtcagtcagtggaagtctgaaccatctgactggggaaccccccctcactataaacctaagattgttctgtaaaaacagactcgctggtaaacagaggggtctcctgagcagattggtagatttcactttcccatatattctgggggatggcatgcatttcatgtccatttatcacatgtcccaagtctagagaccctaactatcaaagggaaacacttgtcaatcacagattgtagaaattatcattagtaagcataataggcagaataatcaccccaaagatatccccatcctgcttcccagaacctgtgactatgttacatgacaaaggggaattaaggtcactaattatggtgacctttaaataggattatctgggtgggcccaatataatcataagcatctgtaaaagataagactgtagatgaatggcacagaaggatacaacgttgctagcaggctttgaagatggaggaaaggaatgtccttaggttggaaaagtcaaggaaacagattctcccataaagccttaggaagggaacacagccctgtgacaacttggttttagcccagcatcaccagtcagaactgtaagataataagtacatgtgtgttaaggcactcactttgtgaaaaagtgttacagcagcaaataagaaactaatacaggaagtaactactgagttattgttcctaacccttctggaccaaaggagaataaaaactattttttaaagtatatggatttcttaagcaaaaaaaaaaaaaaaaaaaaaaaaaaagttagatgaaaggttcatttttcaacactgtagcttaggtataaacataatatactgaaggactctgtttagtcaagttgatttgttttcaggtgtaatacctacaacagttaacatctactgagcttttaatatgtttgcaatataagtgttatcttattaagtcctcacaacctttgagccagacactattagtactgggccatctgtgaaaagtcatttcacagatcagaagcctaaatgtaagagctaaattattaaactcttaaaaaaaaaaaaagagaaaaatcaatttcatgaccttgagttaagcaatggtttcttagatataatcccaaagcacctttaaaaacaaaacaacaacaacaaaaaaaagaagaaaaaagagaagttggatgacatcaaaatgaaaaactttggtgttgcaaacaacaccatcaagaaagtgaaaaggcaacctactgggggaaatatttacaaatcacatatctaataagtgtccagtgtgcagaatgtattaaaaaaaaacaactcttacaattcaacaacaaaaagaaagaataggacaaatattttaacagatatttctttaaagaaggcatacaagggaccaataagctcagaagcacatgctcagcatcattacacaatagtgaaatgtaaatcaaaaccacaagacaccgcttcacacccactaggatggctacaatcaaaaaggcaaaataaggcaaggcacaggggctcacgcctgtaatccgaacactttgagagggcaggtgggaggattgtttgaggccaggagatcaagacaagcctggacaacataatgagactctgtctccagaaagaaaaaaaaaaaatttgtcttgagacagggtctcactctgtcaccacccaggctggagtgcagtggcacgatcagagctcactgcagcctcaatctccttggctcaagcaatcctcccacctcagcctccccgagtggctgggacttcaggcgtgcatcaccatgcccagctaattttttttgtattttcagtagtgatggggttttgccacgttgcccaggctggcctcaaactccacggctcaagcaatctgcccacctcagcctctcaaagtgctgagattacaggtgtgagccaccacacccagcctgtaccaaaaaaaaaaaaaaaaattaattttaaaaaaagtgcaggccaggtgtggtggcccttgcctgtaatcccagcactttgggaggccgaggcagatggaccacctgaggtcaggagttcgagaccagcctgaccaacacagtgaaaccccatctctactaaaaatacaaaaattagctgagcatcgtggcaggcacctgtaatcccagctactcaggaggctgaggcaggagaatcccttgaacctgggaggtggaggttgcagtgacctgagattgtgccattgcactccagcctgggcaacagagtgagactccatctcaaaaaaaaaaggtgcaataacaaggagtaatgagcacacagagaaattggaaccctcatcattgctggtaggaatgcaaaatagtacagccactttggaaaacagtctgggagttcttcaaaaagctaaacatggagttaccacattcctaggagcaatcccactctaggtatgcatacaagagaaatgaaaacatatgtccacacagaaactagtacgtggatattcatagcagtattactcataagaggtcaaaaagtggaaacaacccagatgcctatcaactgatgactggataaaaaacatgtggtagggccaggagcgttggctcacgcctgtaatcccagcactttgggaggccgaggcaggcgaatcacgaggtcaggagatgaagatcacggtgaaaccctgtctctactaaaaatacaaaaaattagctgggcgcggtgacgggcgcctgtagtcccagctactcgggaggctgaggcaggagaatggcgtgaaccaagaaggcggagcttgcagtgagccgagatcgcgccactgcactccagcctgggcgacagagcgagactccgtctcaacaacaacaacaacaacaacaaaaagaaaagaaaaaaaaaaatgtggtatagtcaaaccacggaataatatttgggaagaagaaatgaagcactgatgcatgctacaacatggatgaatcctgaaacaagataaggtggagtagcacatcacaaaagaccacatactttacaatgccctttagatgaaatgtccagaataggcaaatctgtaagagatttgtggctacctagggcttgagagggtggcggtggagggcagagaaggaaatgactactaatggatataggattccttttggagagggcagaaatgttctaaaattagattatactgatagtcgcacacgctgtgtatctattaaaaatactaaattgtacatgttacatgaataaattgtatgacatattagttatatctcaataccgctatttaaaatgtgatttaacttctgtatcccatatgtattcatgagttacttactaagtaatttttatttaaggaagtaggtgttttaagaagtatttgtaggagaagcatatataaccacaagagggcgctttcctcacagctacagaaaaccgagtgtctaacatacaggggtcctatttaccaatttgatttcattcttcccccttttcttggacggaatgaggtattagtatgtttcatacaacacattaaagacaatagtgtcaccaaggttggtgacaggttgaaaaatcatgacttatacacagataaaaagtaaatgtttaaaattaaacttcagtaacagaaactacggataatgttgcactgcattcatttccttcacttcttgtcatacaagaggttatacaaacttatttgtttaggataaaattcagtgagataatataaatcatcacaggaaatgaaacatgttataaatacgtggtctctggttctctgttctatctctagcacctggaaccatgtctagcataattggcactccataaatatttattaaatgaatgagataaatgaatgaatgagtgaaatcaacatttcttaaatttcagaaaaaatttcacctaccttggagactacatcaaaatatttcttttcacccataccaaacatcacaatcatttcactgaataactatctctgaaacaagttcacagagacattgtgtgaaatcaagtgtaattttttaggccatgaatccttcccgacctcccccttattcctgctgtcatcttaactttttttttttttttcttgaaacggagtctcgctctgtcactcaggctggagtgcagtggtgcaatcagggctcactgcaacctctgctcactgctgcaacctctgcctcctggattcaagtgattctcctgcctcagcctcccgagtagctgggattatagacgcctaccatcacacccggctaatttttatatttttagtagagatgggatttcgccttgttggccaggctggtctcgaacttctaacctcaggtgatctggccaccttttcctcccaaagtgctgggattaccacgcccagccaatcataactttttttttttttttttttgccttgaaatcaacaactctgaattacttccagtttgcattctgtgtattgagacccacaccaaactgaagtgtcacccaggctggcatgcaatgacatgatcacagctcactgcagcctcaacctcctagtctcaagtgatcctcccacctcggcttcccaagcagctgggtctacaggcatgcgccaccacacccagctaacttactgtattttttgtagagacagggtttccccatgttgcctggtcttgaactcctgggcttaagcaatcctaccacctcagcctccaagagtgctgggattactagcatgagacaccacgcctggcccaagaatttttttttttttttttttcttaaacagagtcttgctttgtcacccaggctggagtgcagtggcacgatctccgctcactgcaagctctgcctcccgggttcacgccattctcctgcctcagcctccctagtagctgggactacaggcgcccgccaccacgcctggctaattttgtttttgtatttttagtagagacgggatttcaccgtgttagccaggatgttctcgatttcctgacctcgtgatccgcccgcctcggcctcccaaagtactgggattacaggtgtgagccaccgcgcaagaccccaagaatcttttaatgctgaccaacacatctctctcattgtgttaccttttgtattcctacttaatgtttttccatcaatgcacctcttactaagccacaagcacacaacatttcattagaggaaaccagattcttctcctatctcatgtttcaaggggtctgacatcagactaatttatggaacaacaataaaactgcccctatttcctccccagaagccacattcagttacaaaaacttttactctaagctcagtcacaacaaaagttaggcatggaaaggcaatctctgaaaggtttttcatttgggatgtgatgaatgggtgaaggatgagcttttacagacacagggcccggtcatctttaagacacctcgagtttataagccactggagcattttcatagcaacatagtataaaagaaaccggatcaccaaatgataaactcaacttgaaaagtcttcctctgccgtttttttagtgaacagtctactgtcaaaacaaagatgttatgtttagtcggttctaggcagcccagaaactttaaatagaatgccaaaacacattgtgtttgagtgacaagggaactaactctcacacatcattcactcatattcctcaaaattactccgtgtaactgagggctatactagatgctggaaatataacagcaagcagggcacattccctgccctctgggactgcaccgcctggtaggccagatggacaaataaatgagcaataataaaacagagtagactgtcagggacaagttcatggtgttatgggaacacaggggttgaacatctaattagccttgggtggttaaaaataactataaatggatatgataacaccgctgaatgttaggagccgttaaaatatggggagaaaggcatatttctcagaaaataatagcctgtgccaaggactgaagacatgatagctcagcaagttcaagaagtaagagagagctcaggatggttgaaaccaagcatggaaagtgacggggttaagaaagtaagcatgagccaatcaagaaaaaagtttatttagtcttgatccttagggagtcatccctgcaatggcctgcaaagttacaggttgcatttttcctcttcccccacttttactagacctttctaggtttccttgaggtcaaaccagaagtctcagaagtaattaacataaattgaaactcaactgtgcccaagtaaactcacataaaacaatgatgaaaaaatctccaaaagcccatgagggcaggactagcaagtcacacatatgttacaagtgcttgaaggtttttcgaatgtttttcaaatgcagtttgtcctgggaatcacacaatgatcccacacgctttctcatcccaatcttacaaataataatttttatttaaaggagaatggactagccaaggtcttgaactcaggaacagaactctggtctaattccaaacatcatttacttgccaccataacagctgcttccttctggaagccagtggctagtatgtacctacattatgaccactttcccctatgcattttagattattcatttcaagctattctagggaactgctcttgcagttctatgcccaagttcaatcctaacacaccccatcaccagctgcgttgcagaggtctgctcacagttcaaagtttggcttgcactcaagaccctctgtggcaataaaatcatctctacggtagctcactctaaattacttccagtttgcattctgtttattgtgacccacaccaaactgaagtgtctcagaaagcattaaataaatcagtgttcagagaaatgaggcagcctcaaaggaaaataatattagctcaatactagccataaatcaaccattatgtgtgggagttgctcagtgaaaacacaaggaaaatttagagaagtttatttattcccaaagccccaagctcacacaacaaacaaaaaattaaaaataaataatgaggccaggtatggtgacttttgcctataatcccagtgttttgggaggccaatccaggagaatccgttgcggccaggagttcaagaccagcctgagcaacatagtgagaccccatctctacaaaaaaaatgtaaaacattagccaggcttggcgacacccacccgtagtcccagttactgaggaggctaaggcgggaggattgctggggcctaggaggtggaggctatagtgagctatgatcgcaccactgcactccagcctgggtgggagtaaaactctatctctaaaaaaataacaaacaaatgataataaataaataatgaccaaaatgtccagtcagtggggaagaaaggaaagcaagtacataaagtagtaagatagtgccaccagtcctgtggtattcttcccacccccaccactcccaaaggatgcttaacgttccccagtcaagagctcctctaggctgtaataaaagcccttgaaaatcataccggggtggccaagagaatggcatagaccctgaaatctccccactacattctacagttccaggacaaggaacattttgcttggctataaggcccctcagttccaaacattactgagtatcatttaatcctttagccaattcccattttacacttgaggcagatgatcaccagagaagttaggtaagttaaagttaattggccagtctaaggaaaattcagaaataaaatccaagtctctgagcccaaacttactgagccactttaagtattaaaggacagaaccgaagcacgtaaagtggctgatttagccgggatctccctcgcccacggccctatggctgcaattagggacctaaaactgatgagcactaggtggggtttatggaggactccctagaaaaaaacaaaacaaaaacagaaacaaaaaaagtttccttttcaaaagtccttgagcaatatgcaatctcaataatttggacaaattttcctgtctttgttctgttttccacaaaaaggaagcattctgcacacaaacaaaaatctcatagtccatgagataaagctcttgcccagagtgctcaggatcagaaacattataagcagaatcagtaatgattattaacgtattaaatgtattgcatgtcttttacttcaaaacttacagacctaactaaagatgtctaacagaaagattttctttttaaaaagccaacaactacttgggaagaaaactagttgtatatgtgcttaacaggctaggcaagtttacgcttaccccgatttcacgaaataaacccaacgtttaaaagccaagatgcaatacttaaaattaaaaagaactataagaccactggcccatagtgagaaaaaaggaaaataaaagataaaacgatttgtttgaccttctgatcctattgccttcttaattacaacagttcacataattgggaaggaaagaacaaaaaagacatggaagtccactgaggcctccttgcaaaatagttgtccagcaaagctctgcctaaataaatcttttattaacctagactccacaagtttttaatccaacccctttgaagtccagtaatggtccttctccttttactaaaagccaaattagatggccattttaagggttaatgctcttgaatggttaggcagaagacaaaaagacggcctatttttcctacaacacagagttagatcttgataaggtagcattttataagtcctctggagtcagctgtagaggaaaaaagtgtcaagctcaagctaataaagtgggaaaggggtagcccagacccaaagcatcatgacatttcagctaacaacctcagcctcgcgggggaacatgcttgtgcttttcggttctatagttgtacaaggctggtacaacgaagattgtgcaggctggcacggtgactcatgcctgtaatcccagcactttgggaggccaaggcaggcagatcacttgaggtcaggagttcaagaccagcctggccaacatggtaaaatcccatttctactaaaaatacaaaaattacctgggtgtggtggcatgcgcctgtaatcccagctactggagaggttgagacaggagaatcacttgagcccaggaagcggaggttgcagtaagccaaggtcgcatcactgcactccagcctgggcaacaaagcaagactcctcaaaaaaaaaccttaaaataaaaataaagaatgtgcaaatcaacatgctttatacgtgcaattcttttaaaacagacaccccacacagcgcgtgctgtccatgcctccattactgccaacctctcttcgctccaagccaatgactggtgcagacccagcctgcgtgggaagaacacacactctcctccttcgaagctgaaaaacccaagaggggcgcatcagacaatgaagacacaaattctaggtacagtcagcccttcgtatccatgagttccacatctatgaattcaatcaaccttggttaagaatattcttaagcctacagcctgctgataccacgatagacattcaaaagcacactgctgaaaaaatactaatattagaaaatatttaagggacattacatggaagaaggctacaaatgagaatatttattatactggagggtatacagttacatattttaaacacagaaaagagaaagggagggaggagacaaagaaaatgaataaaagaatgggagagaaggcaggaagaggtggaggatggtcacagaaatgaaatcaataccatatgctatcctccatcccaaattaaattaatgaggaggtaaacgttcttattggtagcttatgggtagtgtttactctgttttgtgtgtgtgtgtgtttttccatttgccaaattttctacgttgaatatatattacttccatagcagaaaaacattcaaatatatagataaatgttctgggtgtttctttaaggctttttcaaaaggacagtctgagctgggaccacaggcaatgcaattgccttcaggtgccttttcaaaacacagatcttagccccatccaaatccttttacactagttctcccttatctgcccagaaaacattccaagaaccccagtgaatgcctgaaaccatgaataatacccaagtctacgtattttttttctatacatacatacatacatacttctgataaaaaaatcaatttataaattaggcacaacaagagattaataacaatagctaatcataatatagctattaataaaatagctattaatagaaaactaataaaatagccattaataattaatagcaagccagaagcagtggctcatgcctatcatcccagcactttgggaagctgaggcgagaggatcatttgaggtcaggagttcaaaaccagcctggccaacatggtgaaaccccgtctctactaaaaatacaaaaattagccgggtgtggtggtacacacctgtaatcccagctactcgggaggctgaggcaggagaattgcttgaaccaaggaggaggaggttgcagtgagcgaagatcatgcactccaccctgggtgacagagtaagactctctcaaacgatgataataatagtagttactaataactattttaaactaatacagttttttattaaaactaatagaatagctaataatatattgttatagctagctatatagctagctataacaatataataaaagtaaaataaggattccttgaacataagcactaggatactgtcccacctgatctgatcagctactaagtggctaacagggaagtggcgtatacagcatgggtccgatggacaatgggaggattcacgttccagggagaatctagtaaaatgactcaaggttcattacactactcagaaccacatgcagtttaaaacttatgaattgtttatttctgaaaatttccattggatattttcagaccacagttgaccgtgtataactgacaccacggaaagcaaaaccatggattggcgcgggggagggcaggcgctactataaatcacaacctccaaggtaagagcctggtttttgcattttaagtctctctcagggagtctcatgcacaccaaagtaggagaaatagggcatttgagtttggaaaactggttactcataaggctgaattctgaccctagagataagtctcatccaccagctaagttgaatgtatttcttttattgctaagaaactttttgagaactgtctctgaagaagtcatgcttgggaagacagggatgttggaaggcacaaggaatcaaggtggaaattgctggcagggcttcatcacattatcaggtgtgcaccatgctggcgctctcagggcttagccagtttagccaggatagatggaatacagaatgaatctatctgtgacaacttttcataagattattcaggccctggcaaaagatctacatgttggtcaactgtaaacaatgatagctagtgagatgaactctcattcacagagtctggggcaattaaaccaattactttccactgtgaatcccaggatctcagaaatgccaaaggagaacaggaacttagaaattatccaaacccttaccttttactgagaagaaaagcaatataactgaggcatggagctgggagctttaatcttcaaagtatttataagcagttgagagatactctggataaattaaagaattagaataaccattgagctcacttcaagggttgagcctaagaatctgagttgagatactgatgaaagcagctgcgaaaatgcctgcaactgctggcctgggtggagcagctgcaggtctgcatctgtctgggaggactgcatttccaggacagtctgtccactagtctctcctttcagtttaccttctcccaactctgaaggagaatccagttaaggaatagatcaagaaaatatattgcacagctatatctctgcaccaacatcatatagacaaaaacaactcaattttctgctatttgatgctggttctttgtagatacagatgctgcgtaaagtttctgttgtctaagaagttatacaacattctcaattgatgactaaccactgtaaacctgctgtctttatgtcaaacccactgccttcctttttcctcggagcaagacagccaccatatctgtgatttattgcgctaccacaatacagaacacgactcgacctggaccacaccctaaggctagaagacagcagtaacactaaaaggatgagacgcaagccattgccagaagatctggaatggccattttccttctcgtaaaaggaaaaactcaaaaattggacctaatcaaaactaaaacttgtgctctgtggaaagaggctaaaaatacaagccacaggcagggaggaaacatttgcaagccacagactcaacaaaagactgagacctagaatacataaggaactctcaaaactcaacagcaccttttcctcagttgctgctaaggcatttggtccttctgaggaagctcaggacctgttggggtatggccttctctttatccagtgactaagactgcgcccagcagccacttccccagcccccacccataacgcagcctcaatctctgagctcacctgcatccactcattctgcaggacagtgaggtgatagtcacagaatgaaaatcaaaaccctcattaaagcagctggtgtcaatggtgaacctttctggcctagccaatgtcagcctcaggagccccctctgctgtgtagagcctaggggacctgcctcacaaccagcgatgccccagcaggagaccctatccctccaccctgctgtcctcactcagaaaaaaagagggggcaaagaaaagagaatctgaggagccccacgatgacatgggccttggtctttttgactaaatcttttatgtaatatgttcaataaaaagctgaacaaaacacaacaaaacaaaccctcatcaggaaaaaaaaaaaaaaaacccacaaactatccgggtataagatgggcaaaatatataaacagacatttcaccacaaaggatatacagacagcaaataagcacatgaaaagatgtgtgcaacatcactatccaacgacgcaaatgactaatgctaatgagataccaccacgtacctatcaaaacaggtaaaatcaaaaacagtgacgacagcaaacactagtgaggtcacggaaaacagtttgacactttcttataaaactaaacaggtgactatcatgtgaccagcaattgctctcttgtgcttttaaatgagaaaaggacatttatgttcaaacacacaaaaacatttgcatatttcatacactatgaacatgtgcatatgaaatacacaaatgttcatagcaactttatcagtaatagccaaaactaccatcaacacagatcttcttcaatagctgagtggctaaaaaaaaagtatggctcatccataccatgtaacactactcagcaatttttaaaaatgaactgctgatacacacagtaacctggatgacgccctcaggtggctacgctgcatgaaaaccataatcctgggctacatactgtgtcattccatttgtataacattcttgaaatgataaaattgtagagatggggaacatattagtgactgagaggggttttgtaaaatattaccattggaagaaattatgcaaaggatacactggatggccctgtagtatttcttacaactacttgtaaatctccaattatctcagaataagaagtttaacttaaaatgaagcctgctctatttcggtctccaaagaaacagaaccataagatgataagatacacacacacacacacacacacacacacacggagagagagagagagatagagatttaagaaattggtcaggccgaggggtgtgatggctcatgtctgtaatcccagcactttgggaagcctaggcaggtggatcacctgaggtcaggagttcaagaccaggctggccaaaatggtgaaaccccgtctctactaaaaacacaaaaattagtcaggtgtggtagtgcacacctgtaatcccagctacttaggaggctgaggcgcaagaattgcttgaccacaggaggcggaaggtgcagtgagcagagatcgtgccactgcactccagcctgggtgacagactgagactctgtctcaaaaaaaaaaaaaaaaaaaagaaaagaaaagaaaagaaattggcttcacaggactgcggaggatggcgagtccaaaattgcagagctggcacaggccggggtcccagggaagaactgatgcaaagacactctccaggcagaattccttcttcctcccaggagctctattttctttgtcttttaaggctattttcttttaagtctattttcttttaaggctttcaactgatttgattgatgaggccaatccccattggaaagggtaatctgctttgctctgaatctattaataccaatgtaaacgttattcttatctaaagaataccttcccagcgacatccagactggtgtttcaccaaatacctgggtaccgtggcctagccaagtacaaacaaaattaaccattacagctgctgtttcatctcttttctgctgggcttttggtcactaagcagaaaatatgaggggaaacggacacactggctcccacagcggttggtctctgacatcagctatatctatgtggggcaagttagctattaataagttttgccatgaaataaaattaaaagtatttatattcatttactttaaatctttttaaatgcctaaaccttctgaataataatatgctattcctaatgctctaaccaaggggtcggcatatttcaactataataaggtgccgatagtaaatactgttggcattgcagaccatatgctctctaccctaacctctcaattctgttgctgtcatgggaaagcggccttgtactatacatgacaaatgggaatggctgtgaccactaaactttatttacagaaacaggctgtgggtcagatttggcctcagggccatagtttgaggatgcctcctctgttaccaacaaaatttcaggtacttttcattctttctctcatcttccaagggtgtgatcttggattgaaactaatcatctgtattttttttttccaacagcatttacttttcatccagaaaaccttagctatgccgcatgagttctgattatctattaaacatgaagctcaagtggttatttgctagtcacttttaagtgtttggaaaaaaatattaaagtcctcagtctctgagatacaaggcaagtccaattagtgcagacaatgtaagccattatccagctgcaatggtctcttacattttcaaaagaaagagtggaggcaggtaaacactagcccagtaaacattaaggatgcatctaaggaagctttaataggggcaggatacctgtaaagagtctatgactcactacattattctagaatagatttttaattactctgatctatgtatggcaactgctgcttctgattaaatagatttaaaatgagaagaaagaaaacagaaaccggccaggcacactggctcatacttgtaatcccagtactttgagcagtcgagccatgcagacggcttgagccccagagttcgagaccagcctgggcaacatggcaaaaccccatctctacaagaaaattagcctggtgtggtggcaaaggcctgtaatcccagctacctgggagactgaggtcaggtgatcacctgagccttggagttcgaagctgcagtaggccatgatcacaccactgcactccagcttgagcaacacagtgagacccagtctcaaaaaaaagaaaacagaaatctagtttctataaatactaatattttaaccaatattaatatttaagaactttgaagaatccagagcacggacaggaaaaataacacagatttctagtggagattattcaatgtatgttgggaagttttgtcatctaaggatacactcaaatctaagcgtaaccttggattggactgtgctgtactgtttatgggcattacagctatggagcaacagcccttgaaaggaatatagtttgtctcatttctaaaatgcatcttcaattcttcaccttaaaaacatagccttggcctggtgcagtggctcacacctgtcatcccagcactttgggaggccaaggcaggcagatcacgaggtcaagagatggagaccatcctggccaacatggtgaaaccctgtctctactaaaaatacaaaaattagctgggcatggtggggtgtgcctgtaatcccagctacttgggaggcttagaaaagagaatcacttgaacccgggagacggagcttgccgtgagccgagatcacaccactgcactccagcctgggcaacaaagcgagactccatctcaaaacaaacaaacaaacaaacaaacaaacaaacacagcctcagaagcactgaaaatgacaacccctcgcccattccatgcctttcttcctcccgggaaacataagtcatcaggacccatggagcagacatcattctgaaaggcacatcaaagacactctgaagttccaaaggaagccgccaactgtaggcctcgggccaagataggtgtaggggtgctgccctttaccatggctcttgcctctttaccatggcttaggaaggatgctctgggtttccttaaacttcgcagattcatgctgattgcagtcaaaataaatattcccaggagctttgtgaactgaaatttcctttcatgaaaagaatttctagaaatactacagctacagtagtccccccattatccacggcttcgctttctgcagtttcagttacctacggtcaaccacagtccaaaaatattaaatgaaaaatttcagaaataaacaattcataagttttaaatcatgcaccgtcctgagtgatgtgatgaaatctctcaccattccactgtgtccagctcaaaggggaaccggcctttaggacagcatttctaccccgtataccctcaccacccattaatcacatatcggccacctcagtgagcaggtcgactgtcaaagtatcacagtgcttgtgttcaagaaacctttattttacctaatgatgacccgagagtgcaagactagtgaggctagcaagtcaaacagccaaaagggaagctgtaatgtgcttctgttagtgaaaaaggtgaaaattctcgatttaataagcaaagaaaaaaatcatatgctgaggttgctgagctctatagtattctatctgtgaaactgtaatgaaggaaaaagaaattcgtgctacttttctgttgcacttcaaactacaaaagttatggccacagtgcattacaagtacttagttcaaaaggaaagaaaaatgtttgggtggaagacatcaacagaaatgggttccaactgactgaaacatgtggcaccaggaagcaccgagcctatacaaagacttcagcaagggatcccctaaaatgagtgacactaagttatttgttgcaagtagcgaatggttgtgcagattcaagataagcttgtaccgaaaaatacaaaaattactggagagtctctatctgctgatgaagaagcagctgtcacatttccagcagagttgaagaagctgttgatctcattactgtgcctagtttataaattaaattttatcatacatatgtatgtatggggaagagcaaagtatactatagaatttggtactattccatggtttgaggcatccactgggggtcttggaagatatctcctgcagataaaggaggactacacataataaaagagcagctgacatgtcagttaattgtagttttaaatgaatatgcaaacaaaactcatatttatgtgttttttaaaaaatatttatttgggctgatgtttccacaacttttgaaaactctgtagtgtattgcacattttcccctcacattaataattgtacccaacgctttacatttaaatattcttcagctgagaagatgtctggaagttgaaaaaaatagataaaacaagcaagcatattatttaaacacaaataatgtaccattttaaaataagttaatactacgtttcccaattattcagacttcctgaaggttccgactgcctaattccaagtctaccacttactttgctgaatggcgttgggcatgttactttcctcccaagtttcagtttcctcatccataaatggagagcctaataatacctgctccatatggggttctagtggcgaacaggtgacttaacacatgtaaagcattcagaataatgcctggcacgtggcaagcctttagtaagtgctaatcctgatcatcagcttctttttcttcttcatcattaatttgtggttcttacatttaaaggtgtcagggtagttcaatgtaggagcaagcaaagttttaggggtggcatgttaaatattaaatataatcaatccttccctccccttggagtattttctatacactgaagagtatcttttagtaattgtgaatttcttttttatccccacaaagagttagagggaaaccttagcaaaaccagacattgtgtatcagtgagtccaattgtccagtctcatagtctttataacccagcaaacaggcccagtgaacaggtgcttggaagggcagaacatggactgcttcaaacaatcagaaatgcatccaataagatatgaactcccaccatgggaaatacgttttttaattagattaaaaaaaaaactgatgtaagaaattggcaaaattgttgcttctgaaaaggagtgatagcaaaaactaaaactaaaaataaaataaaatttttaaatatgtatccattcctatggtttccaagtattttgatgttagcttctaccaggactgcctgatatttttctcatatattttcttcctttatcttagagtgaatctatttgtcacacagtttattgttcctgttaggttggtgcaaaattaattgtggttttcgccattaaaagtaatagtaaaaaccgcagtcacttctgcaccaatgtaatatttcccctgggataaaacagagttggatgaatcaggtgctcacaggcaaatctccctggaagttcctacttagttcttctcctctgtcactttatatttatttgcaaattgtcaagcaccattggtttatatttgagacacttatgaaaatgagagataaagaataatttcaggtaaaactcttcttgggcaacacagatctaatgtttccaatgaaataatcacttcctgaaatggaaaaataaaataggaagtcaagaaaaaatacagatttcaagaacagcatgggtttagcttcaagttaaacagaaacactgatgcagacaataccaatcatttgagtcttttgagatctaatacagagcatccaaaggaaaggtctgatgagggaaagaaaatccaaagctttgaaatggtcaaagtagctaggtcttgaagtcagatgcaaagttataacattctagaaaaatgtccggtcgcttaagtcttagattccatcaaagtgatgaccaaatttagagatgaataaccgtacttggatcacttagcagaaacagcattataggccaacttggctggaaaaaagctctccattatcaagatctgaggaagacctctgcaaatccaggtctccatctccctgacagcctccttcactttctaacagctcctcgaccaatcacttctcctacattctaacccaatggctctcaactctttaaaaaatgcagataggttttaaagtttagtggaacctaacatgacagtaattatattttaaatatctgttgggtaagaaaatgcatagaaacaaaaacttttcaattcactataagattttctactttattaacccctaaagcaggggtccccaaaccccgggccacagactgctaccagtccatggcctgctaggaacccagccacacagcaggatgggggcagtaaactagcattacctcctgagctgggcctcctgtgatatcagcagaggcattcaattcccagaggaccatgaaacctattttgaactgcacatgttggggatctaggttggacactccttattagaatctaactaatgcttgatggtctgaggtggaacagtttcatcctgaaaccatgctccctgccccactcaacctcctggaaaatttgacttccatgaaaccggtccctggtgccaaaaaggttggggaccactgccctaaaacatcttcattcagttaaaatttttctgagagcctactatgtgcaacgcattattcttagcatttgaggtacaattctgcccttaaaattctcctccttccctccctcctttccatatcctatcagaaaaggtctgaacaaaatggttattctgataggagaattctaaattctatttgatgggagggatgggggagacaaggaagatggaggcaactctccattcctccttggggttgtaatttttcaccatgtgaacgcattcatgagttactcgtgtaattaaaaataaaagatggtaaacagagcatctgtgtaagaaatgtctagaaaaataaaaagtcctttagaattacttcaaggccctctaaaaatgtgcccaaatccacattgcaccctggggttcagaaagcagtggctcttgcaaattgttcatatcaattcagttcaattatctggtagcaacactcaggcaagtaccatctttcttttgttcattcctgtaacatctatcaagtacacaatacctggcataaaacaaacactgaattaggtaaatattaaatggctgactgaatggatgactgaagaatgcctagtttcctgcctcaagtaccgaatgcctaaccattttccttccatggtgacttcaacacactctccaaaactccactcaaaagatcatctcatctgtgtgtgtgtgtgtgtgtgtgtgtgtgtgtgtgtgtgtgtgtcttttgttggcatctaactcatctatggtgaaaaacacaaatttcatctctataacctcaacattttctactgataaagacatccatgtaaccaacatgcagatgaagagagagagaggacattaccagtactcccaccacactgcttcaatatggccttattttaataacatccttgcccatttttttgtttctttgttttctgctacttgcaaaatcaaagtatttcactttgaataagataacagctaaatgagctgattttttttaactagagttagcaaacatctctaatccagtaaagtgatgtcaattaaaaatagtattaggaatcctgcgatattataacagcaggtgacaatttaacactgtttggactaaaatattgtaggtgaaatttactgtaatagagattgtacatatgaaaaaatatcaaaggtttctaattttaatacattttccctcaatgctcaatgcttaaataattttcctttacatgcttactgactataaataaaagatagacttaaaatttcctaaaaggaaattttagatgtgatattacatgacctctctacattctcatctttaaattattccctgtgaaatcttgttcaatccatcatttgagcatgtcagcaggaaaaataatttcttttttgttttaattttaggttcaggggtacatatgcaggtttgttatataggtaaactcgtgtcatgggagtttgttgaacagattatttcatcactcaggtactaagcctagtatccaacagctatttttccagattctctctctcctgtcaccctctaccttccagtaggccccagtgtctgttgttcccctctctgtgtccacgtgttctcatcatttagctcccacttacaagtgagaacatgcagtattggtgctggaggccattatgcttagcaaactcatacaagaagagaaaaccaagtactgaaaaataatttcttaaatgaattttgcatatgacaaaagatctcacacctcctctaactcagaaacaataacacgagtgcttcaacaaaaattgtaaccaagattcaggaagactccttaaacctttaagacaatcatgatagattaacaagaacctagcacaaactgaggcatccctaaattccactctgcatctttccaagagaaaactctaagaacattcaagtcccctttataacactgaagaaattcgaaaaacaaacattcatcttactgatgtagaagaacagaaaagcatcacactattagctcctccaatggcctggcagagaccctgcgtggcacaagccacaaataagaacattctaaagaattaaccattttgcaaaacagaacatttctcagatggcttagtaaaaaaaaaaaaaaacacacacagtgacatcagaacattaagagaggggagagattttcagataacatcactgactggtataagcaatgtatttatatcaataaattgatataaatttattggtataaactgatatatataaatattgatatgaattgatataaattacattgatatttatatcaatatgttatactgatataaattatattgatattatattaatacatgttatatactgatataaattgatatttacgttattaaatcaagtttagcctaaagctgcctctttacatattttaaatttggtctaaaggtttttctgtacacatcatgaactatagcaagtggcaatgtaaacggaccgtagcctacacttgtgccaatcaccaagtttttcccaatcaaatgtacccaactgtacagtaatcaaaacggcatggcactggtaccaaaacaggcacaaagaccaatggaacagaatagagatctcagaaataaggccacacatctacaaccatctgatctttgacaaaccggacaaaaacaatcaatggagaatggattccctatttaataaatggtgctggtagaactggctagccatatgcagaaaattgaaactggaacccttccttacaccttatacaaaaattaactcaagatggattcaagacttaaatgtaaaacccaaaactataaaaaccctagaagaaaatctaggcaatatgattcaggatataggcatgggaaaagatttcatgacaaaaacatcaaaaacaattgtgaacaaaaccaaaaattgacaaatgggacctaactaaactaaagagttaatgtacaacaaaagaaactatcatcagagcaaacagacaacctgtggaatgggagaaaatttttgaaatctatctatctgacaaaggtctaatatccagaatctataaggaacttaaacaaatttacaagaaaaaacaaacaaccccattaaaaagtgggcaaaagacaagaacagacacttctcaaaagaagtcatttatgcagccaacaaacgtatgaaaaaaagctcaacatcactgatcattagagaaatgcaaatcaaaaccacaatgaaataccatcttatgccagtcagaatggcaattattaaaaagtcaagaaacaagagacgctggcgaggctgtggagaaacaggaatgcttttacagtgttggtgggaacacaaattagttcaaccattgtggaagacagtgtggcgattcctcaaggatctagaaccagaaataccatttgacccggcaatcccattactgggtatatacccagaggaatataaatcattctattacaaaggtacatgcacgtgtatgttcactgaagcacattcacaatagcaaagacatggaatcaacctaaatgcccatcagcaataggctggataaagaaaatgtggcacatatacaccgtggaatactatgcagccataaaaaggaacaagatcatgtcctttggagggacatagatggagctggaagccatcatcctcagcaaagtaacacaggaacagaaaactaaacaccgcatgttctcactcataattgggagctgaacaatgagaacacatggacacagggaggggaataacacacactggggcctgtcaggtgggggacaggggaaaggagagcatcaggataaatagctaatagatgcagggcttaatacctatgtgataggttcataagtgcagcaaaccaccatagcaaatgtttacctaggtaacaaatctgcacatcctacacatgtatcctggaacttaaaataaaatataaagaaattttttaaaaattaaaaatttttttcaaaaatatagctggccaggcacggtggctcatgcctgtaatcccagcactttgggaggctgaggcaggtggatcacaaggtcgggagatcaagaccatcctggccaacatgatgaaaccccatctctaccaaaaatacaaaaattagccgggcatggtagtgtgcgcctgtggtcccagctactcgggaggctgaggcaagagaatcctttgaacatgggaggcagaggttgcagtgagctgagatcatgccacttcactccagactggcaacagagggaaactccatttcaaaaaaaaaaaatgtagccaactgtttgaactgtgttttaatagggcaaacgccgagctgtaaccaattcaactgttactgtacctcacttccgttttctgtacgtcactttccattttttgcccgtaagtctcccaccacataactgcgttggaatctcggaaacttctctggctcagatggctgtccagttccccaatcattcattgctcagttaaactcctttaaatttaattctgctggagtttttatcaatatcaatttactgatacaaatgaattgtgcacaccaatcagtgatgtcatctgaaaattagtttatatcaaactgatctaaatataccatgcctggaccctgtccactagatgccagtagcacaccccatagtttgtgactataaaaactgttccagacattccaaatgtcccccttgaagaggggagggaggagacagtgcaataaccatccatcatttgagaactactgatttatactgatgacatagttgatgatgataacgatggaaacatcatcatagcaataaaataataaaaacaatttcctcctattcagtactctactcagatgctatgccaagtactttatatacactttcttctgtaagaccaccctatgagacaggtattctaattttccacattttatagtaaagaaactgaggctcaggaaagttaaatgccctatttaaggtcacacagtaagatgctgtcctaatctgttcctgttgctataacagaacgccttagactgggtaatttgtaaataacagaaattcacttctcccagttctggaggctgggaagatcaagatcaacattccagcagatgtggtgtctggcaaggacttcatctctgctttcaaaacagagctttcttactgtacattgacatataggaaggacaaaaagggaccggctttctcttcaacctctgtttataaggacactaattccactcatgagagctccaccctcgtgacttaatcacagcctaaaggccacacctcttaacactatcacattggcaattaagtttcaacacgattccggggcaggagagggacactttcacaccatagcagagggtgaccaggggttcgcaaacaagcctaacttacaagttcataattttaactaacatgctatatattgccatctccaccacacagagaattatgagagtgctctgggaacccagcaaccggctattccaaacagaagtaaatggagaacacagtacccaaaagatacaacagataatgtctggtagtgagtgaagtaggccgccaccagactgcaaatgctcatcttccctattaataacatgtgctttaaacacaacgtgataatcctcagagcaacctctcaagatagataccagtatctccatgttacggatgagaaaactgagtacagagcgattgagtaaattatccaagatcacagggctgttttttctgatggagccaagatttaaaatgagacccagccaggtgtggtggctcacgcctgtaatccagcactttgagaggctaagttcggcggatcacttgaggtcaggacttttttttttttttggctcttgttgcccaggctggagtgatcttggctcactgcaacctctgcctcccagattcaagcaattctccagcctccgcctcccgagtagctgggattacaggcattcgccaccacgcccagctaattttgtatttttagtagagacacggtttctccttgttggtcaggctggtctcaaactcccaacctcaggtgatccacccgccttggcctcccaaattgctgggattacaggcatgagacatggcgcccagctgaggtcaggacttcttgaccacccttgtcaacatggtgaaaccctgtctctattaaaaaatacaaaaaggcaggcatggtggcacactcctgtaatcccagctactcaggaggctgaggcaggagaatagcttgaagctgggaggcagaggttacagtcacccaaatcgtgccactgcaatccagcctggatgacagagcaagactctgtctcaaaaaaacaaataaataaaataaaagtaaataaataaaatgaaactggtctgactgctgagcctcatttacttccagcacaatgattttatgggtcaagggacaatattaatgtaagcagccagcacgctctcagcaggaactgacacaagttacatacccgtgggacccactgcatgatgagaccttcacgacaccaacagaactccaacatcattctccacccacctcacaaattggggaccattctgctcttccgtcactcaagaggacttgcaccgcacacaggacctacatgggtctcagctttttatatctcattttaagtaaaagcagatttttttaaagtgcattctcctcttacaagaacattaattaacttctcagctaaaactctgctgggaaatgtgaggtacagcaatgatgtgtctccatgggtaatctaaaagggaaaggaaataaggggagatttacgctgggaaaatgagagtaatactcagagtgtgaataatctaaagtacagacatttaatctgagagaaatatttggatattgggaattccaaaggagaactcagccaatgattatggtccacagggcccatgggtaggttattaagaaatgcatttacactgaaatactatgctacacacagacagcagagcagcgtaaaaaggtttcacacagcattcccagcacagacagtgacgatgtgctctaataactgggataactgcccacggtgggaccctaaacttgtttccggacacttcagcaggtcaagtgtagaagaaaaatttaagaccactaggacatggtaacagttgtcaccatttccaaggggaagctgaaaaagaaggtgagaaaactttatgtaaaactttatcaagatgacagaaattcagttctccaacgtcatccatttcaagttcctatagaaataatactgcttacccaagtcagaggactggagccaagaaaggtgacagagaagagaaatgaatggggtgggaaagaacaatttaaattacaggtcttccagaaataccttctacccagtcccaccatcctgcagaaatcctgaacaatcaaaaaactttcagctgtgatggaaaactcaactcaaactaaagatgggacgctctcatttactggcctagtgacatggccagccctggagccctgaggccagggagaaggtcagttgcccagataaaaagtggcgcccagttaccaaaggaagggaaatggatattatgcaggcaaaacagatacactggacattccattccgttttgtcttgcacagaaattaatgactcctgtccagttcctctttctacaggagctcacaatctgtcttcaaaattcacctaggctcctttcctctctagtgccctgctatacacccccattctgaattccccaccccaactcttctcccactgctgctcctacacacacaacctcacatatatcctctctctctctctctccctctctctcacacacacacacagacacacacttctctatcattttcttttatttcaggacttatttaccaaagtatcatggtttcaagtatgacagaactatgagccagtacatgaatttatccatcaaaaagtgctatcaaaatctttacctataatttcacatattaggtaaagccattttaactcaaagaaatgcatgctaatggtggaattttagatactttggcacattgggcaagcccaagaggacccttctcccaaagacattcaattcatgccacagagagaggctgcctatgaagtctaactagcagaaggcctctctcttttatccagtctctatcccatacacccaaacggctcatgaatgtggcagtaatgcctctacccagaaaagtaattcagtacttccaaaaggttattttaagacagactgttaaatgaaacatgagtaattccattacagtgttgattaggaacacaagtcagaaactgctccagacaagaaactcgtaaccacaacaacaaatggaaaacgaactccagcgtggctccctggagagaatcgaatgaactgatgggtgttttccttctcttatttccaaggatctaataaaggtttcatctctgtcaggaatggtgggagtctatcgccggggaagatgatggcagctctcccttggagctcttgcatttctgcaatcagccagcgagggaaagcccgcactccacaaaatgcaaggagtagaatccctccccaggtctactgactttcaactccagcaacctatttaggtcccttcatggtgcacacacacctcgtaattgactttgttttgttatttgtggacacatttagctctttcctctttctcttccatgagattacatatttcaggagggctccaggcagtaccttcattaccttgcaagtacatggcatatagtaggtacttaatacatgtttgttgggataattaatctgctgatttctaaacaaaagattgataaacaattgaatgaatggtcacacatggacaaacgaaagcacacttgccttctcaatcaagtattgaatgttaggttctgaaaactaactatagaaaatacagtatcaaagtatgtatacagaaaagccaaaaactgccacacagccttcattattttcctacaggcaacttcataggataatccttgcatcttggctcttcaacatttgaagagcacctattgtgatagcaacgtcttatcacccagcctctactgacatgaacaaacaatgaaagactatattcactgacattccccggtaagaggctaggagactagtgtctaaatgttgggttgctttttttcttattccattagacatttttagattctcagccaagcccagaagccaaccctcttcttgggaagcttcctgccagatctccatggggagcccccaggcagccatatttggactgggaatccaacctccactcatcgaccaagagcagtcacctgactcatgcttggcaaagcagagtctctttctaaggaaatgtggagctatgactgagagccagctagtcagtctctgtgggttcctgaaactgcagaacgagctaagggttattcatgttttctttcacatgaaagctgggctgcagagaaagagataatgtagcaaaaataaataaataaatacacaaacaaaaaaaaaaacaagaaaagcagagccaagacagagaggtaaactgataaactttcaggtccattcctaagtaccagtccattcttgcccaagtggcatgagctaaccctgtagctttattataaagaatccccccttgttcttttacttaagctagtcattaccagctagttgattataaataacatgtataatctaatttcctgagaatttttaaatcttttgtatgtttacgtgtgtgtgtgtgtgtgtgtgtgtgtgtgtgtgagagagagagcgtgcactcgcagctataaacacaaaactatttctttttgcgcaaactcccacaaaaactcggcgggagaggaggtaatctcatgatctctgcattaagccagcctgaaattgatctgtgtctctccgtaactcaaagccaagctatttaaatagctctcaggaaatgctttttcccagacaccagacacataataaatactttttttaagtgtaggaagaaaagaataatataccaccaacctgactaatcttatcacattcctgactcagtacagatgcaacataaaggctggcacaaagcgggtattctaaaaatgttaattgttgctgttattgttattatttacctgttcctggcccagtgctccccagcagggctagcatgatgggggcacacactgctgtgaccctaaatacattacggttgaaaaaattacaggattttataattttataaaatctctctctctctttctctctctctctctctctctctcacacacacacacacacacacacttctctatcattttcttttatttcaggacttatttatccaagtatcttatggtttcaagtttggcagaactacaagccagtactgagcaaggaccgaataaaattataggatcattataagagttagcaatgatacattctatgttccaaagaaatgctagaccacattaaatcaatgatataaactgactggttaaagttagtttacttttttttttttttttttttttttttttgagacagagttttgctcttgttgcccaggctggagtgcaatggtgcaatctcagctcaccgcaacctccgcctcctgggttgaagcgattctcctgcctcagcctccaagtagctgggactacaggcatgcaccaccacacccagctaatttttgtattttttagcagagatggggtttctccatgttggtgaggctggtctcaaactcctgacctcaggtgatccgaccgcctcagcctcgcaaagtgctggaattacaggcttgagccaccgcgcccagcctagttcacattttctaaaagaaaaaaaaaaaagtcaatttcttttttattaaagagaagcaacataaaaatacacagtcacaacagcattcaaggaaacgaaaccatcttcattcttctgaaagaatccaaaaggagtgagaggtgaacatggcatttgcacatatacctgaactgacttccaagctatcctctttgtctcaccaagcgccacacccccatttctcccagcttgttcatgaatctagcatggattgggtgaggcctgtaacaactgaggctccttttattgttcactcctcaactggctgctccaggaaatcctacagcatggcaaaaccatccttaagcaaaagctaatggaaggcaatttgggggaaaaggaagaaaacaaggaaataggaaggagatgcgaattatgaaaaaaaatgaccattaagaaacaaatcaaatggacaaaatgagcttctatttagggcctatgaaattagcaactactcagaaaaaatatatactacatagtaatggtggggatatagaaaaagagcagtctcagagttgactatgggtaagtaacttgtttcaacctttctgggaggaattttagcaatgcacatctctttaacatatgtatcatctttgacccagccattccacttctagaaatttatcctacagaaataatgagaaatacgcagaatgcttagggtacacagatgtttagaacaattaaagtcataaaatggtatttataatagggagataatggtgccaatctaaatgttccatattaatggagtggttccctgaaatataacacacataattaagtccagggttcttcaaactttattctgaaaagctcaatgagtctctcggacatatctaaaggtaccttgcaggagtaatgaatgaatcccaatagacaggtcttgctcccattcatcccagacttagccatcctcataaaattatgggtacggaaatgatgctactgcttaagcagcaaacacaaaatggttagatgctaaggactattatgcagccattataaatcatgttacataaaaatatacacaaactaaaaagaacaagtggcaccccagtatctagtaagcttcagaggagatcgggtctttagtagctgctaaagatatagattactctgccagacacagggtgtctcatcactaataaactcctaatagtgggtatccttctttcatattcatctacataaaacagtcatgataaaattcattctctaaggtggtagtaaaaattagttgagatgatgcatgtaatggtgtttacctcaatgactggtacacaatactccatcatagaagttcttttaatgtatatcaatctaaggcttagaatttcacatttaccagtatttattcctcacctctcattcacacagcatttgaaatcatcatcagctcagacctcctgactttcatggaaggcatccatgaaatcaagtcttttaaaaagtcaaaaatgatttctttcgcccagaggattccagtctttgaactacataatttggattttttgttctgttttgttttgtttttcagctaagaaagcaagcacttcatttcttaagcaaccgcacctcagcactaacaaccccagcagactatctttccctcaaaatcacaggactgctcatagaatgctcagagcatcacagaatcttacagaactcttttataaagaaaaatatggctgtcatctttttatgtctctaagaaatgacaataattcagatttcaattctatagtgatttgatttgatcattttaaaacaaagacataaaatggttcatttatataaccagttgctaagagtgttggcattttaataggcagcttatgaaaacatactttttgaaagaaaatactaatatctacagagaggaaaaggatgaatgaagctcataaaatttaactgcattttagttttgatttgggaaagctgcaagatcatccacttgggaaacacagcagctgtatttctaagtcctgcctcgtacagttccccaccagttgctgccatgagagccccttctctagagggaggcggcagcattcgtatctgctctctccctgcaacctgtgctgctgagctagtggaaatctcaatgattcaagggactgaatagaagttcctttcgtcaaaaagtctgacaattctggggcccatgatctgggaatgaaatatctgtcctaatccagcctggggccaacacacggttgttgattgctttaaagaacgaagcactaccagccttagctgtttctcaagagaaaacacctgctaagggcattttcattcattccaactgagcagtttcaaggatctaaccaagaaagcagagcaagcaacttctggtagataagagcagactctatagatgccttcctacgccaaaatacctacccctcccccagctcacttgaaaggagtgcctaaattcccaccttaattcgtcattggatatattaaagaaaatatttaaaagttccctaacaggcagagcaaaatccatgaagtcaaatcatatagtattatcttagcaagaatgttattttaaaatagcatattctatactattaaacatgtaatattttaaaatatattttattacttgtcatatacatttgaaatattaaaattatatcataaaatatatttttattaagggcttatgtgccagagactgtcaccagtgattcatataccttatcttaattaatcctcacttgtttcaaggcaggtaccagtgtccacattttacacatgaagtaacaaaagcctggactggctaaataactaaccaaaagctactcagctagtaagaggcagaactgactccccaacgcagagatctaacatactccactgcctctctctaagcagaattcaaaggaggacaaaggaaaagaaaggtactaagttcaggagacactgatttgtatattaaaaaataaagtattattgtctacaatggtagttgtgaaagttggcagctgattggaatcactgagggcattttttcaaatagtggtgcctgggtccgagccccctccccctcccaattctgattctaattggcattttcaaacactccccaggtgattttaatgtagagtcatggttggaaatcaccatctagaaggatttggagtagaacttaaacgttcatagaggacgcttagtgaacaaacaaggttttagaaatctctagaacaggactatccaaaaaaaaaacactttcagtgatgaaaaatttccataatctgcactgtccaatgtggtcgccaatggcaacaatggctactgtgactaaggagatgaattttacatttcatttcatttcaatgaatttatatttaaatagccacatggggtagtgggaactgtactggacagcacagctgcagagatctgtcaatgtgcctctgctttattgatgaaatgtgtcaactgagatgttgaccgtaaacaaagtggcaagtacatgagctcctactgtccatatcaattatttgacatgaccgattgtccaaaatggagctttgttaacaagtcagatgctctgagtagctaacaggggaaaaaaaaaaaaaaagatcaatgccatggaaaatatgtcaaatatatttagctaaatactctttaaggacataattcttcaggtcagtgttaatttgctccctataatgcaagaaccagttgctagccatggccagtataaatgccaatatcatcaccgtaatgcagaggaaagaagagaatttagggatgtaaaatgttttgtcaacaacttctgctgttactgtgggtcaaaagaatctcttctttcatcttcatatctttggcacctactccagtacttcaaatatctattcaacggactaaaaaataatttaatgatagcggaataatggagcatttatgcattatcttgcatattgtagtcaatcatacatgcagaataaaagggtttggacataaattgcaattcataaaaattaccaatatgtctcacttttatttcaataaaaatttgtttcctacttaggtgcataacatgcctgtgtaccgagctattatacattccttaatttgaactacatgactacatatgtcaatggactaattctgaagatgtgcatattccccaaaattttgatatagaactatatgcttttttaaaggtctcagattatttgaattttgtatatcagatgttcacatatattatatctgaacttaatttaatttagaaatgctctgcagtaaattatacttagctaattgtacgtataaatccctccatagttaaaaataattttattatattctgaatggagcttgcaaaaaagaagacatcatttatggctctacatttgcctttatacgcagtaatactaaaacccaggcatggtaccaatctacatgaaaacaagagcttagcttcaaaaattaaactgcctggagaggaaaagctaaaaacatactgatatacttcttggtccaataatatactcgcatttcctcccatttttccaagatgaagccaggttaacaactgagtagtgttagaaaagaaagagggagagtgattaatgacactgaaaatgtgtaaaatgtgctcaattcatcagttgctttgaggacacaactcttttggaccattcctattctgctctatgtcatcaaagtaacaactactgctgtggcctcagtaaacaccacttttatcacagtaacaaaaaaggaggctttgcctgtgtttttaagctaatgacattgcaaatgtaatagaacaagacacaatggtctaataaaaaagaaaagctaatcgtaaaagaaatttggactacgataatggcttaaaacagtcaattccaaagcaagagaccatggtaactaattgttccattctagttacacagggaaagccaaaagacataatgcattaactgcagttagaaaacaactaagtaaaattatgagtgtgtgtgtgtgtgtgtgtgtgtgtctctctctttgactttcctttgttaaagagaattatttttaaatctgcagtccttaaaacacatacacacacaatattctatgttactcaaacactgtcccagtccagaaaacactgattaattagtcctccatgagttatcacatacatttttctaccaagcattcactgtgctattttggttagtttctatgtctgtctcaatttaattcaacaaatacttactgaggctccatttgccaagcaccataccaggtgctggagacctgataataaacatggtaagtttcctggtctgatggaacagcatctagatttacagctgaataaagggctgagtgttaaagagagtaagcacagcgtgcagtcagaacaaataggggggtccaacccagacgtgggagaaaggaaagacttcccagaagatgcagcccaaacagtgaatccacgttagccacagaagatgcagaggggcagagggtaaggagttgagagcactgctggcccaagaaatgccttgtacaacagcgcagcaatggacaaaacactgcatgaaggaggaacccaacgtttaataactcaaggggaaggcagggagttcaagatgaggccagagaataagcaggaagtagtcactgaagaactcatacatcttactgaggagtttcaacttttattctgagagcacgagggcaccagatttgagttttataggacaattgttacagcagccttgcacagagaagactggagcgtgcaggaagccagaatgcagaagactcctagaacactagctcccagaaagtagtttatcacggctcaacaaaagatcaataacgttgattgaattccattcatactagaaaacatatctatttaactgtaccctcagaaaaatttataattctatcatgctttattaacaaggcatatggtccaggaacagtggctcatgctttgtaatcccaacactttgggaggctgaggagggcggattacaaggtcaggagttcgagaccagcttggcctacatggtgaaaccccatctctattaaaaatacaaaattagcggggtgtgttggagcatgcctataatcccagctactcaggaggctgaagcaggagaatcacttgaacctgggaggcggaggttgcggtgagccaagatcgtgccactgcacagcctgggcaaaaagagtgaatgaaattccatctcaaaaaacaaacaaacaaacaacaacaacaaaataaacaaggcatatgatctcccagcaacagaatatgcgattttaactgttttatcattgcttaattcacttgacctaaattttatgcactgtaccccttccctccaccctcacattggtcatcctagtgaccaatgtatacaagtgaataacagcaggacagttagggctagagagatcttccttcaaaccaagttaactcatttatttacaaagttgattacatcaacttaaatgctgaaatccaccccagcattaaggcaaaaaaaagtaaggttgaggctgggcacagttgctcacacctgtactcccagcactttgggaggccaaggcgggtggatcatgaggtcaagagatcgagaccatcctgaccaacatagtgaaacctagtctttactaaaaatacaaaaattagctgggcgtggtggtgcatgtctgtagtcccagctgctcaggaggctgaggcaggagaatcgcttgaacccaggaggcagaggttgtagtgagccgagatcacaccactgcactccagcctagccacagagcaagactccatctcaaaaaaaaaaaaaaaaaaaaaaggaaggttgaggaataaaggctgcttaggtcaacagaaactatcaattcagaaattgctaagcagaattatgtatctttatattaagcaaatatactgcactggcatgtgtatataactcaagaatcatcccactggacaactgggatgttgtcccagcattttattaatcagttgattgacctttgaacagacttactagaatacctgacaatcagcaaccaaacagaaacaaatctttacttccacacaagcaaggtttcaaagtgagaaaaaaaaactgccacacttgtaggcagtgttatttactgtggcaatttttttcagcctttcagcttgcactgcatagaatttaccattatcagggagatcctcagagaggagaccctggtgcttttctgctacagttttagaagcttgttcattcattatcctctgagatttatccaggatttcttgctgtttacagcctatctgtggtgatcacatctcatctccagtcacatgggcagtgtgatcctccatgtcaaggggctgatggatacaaggggtagttatggcatagggatctcttttaagtcgaggagtactgcgtccaccctactttagaaacatacacattaggcgtccttaatctttcggggtcatgagcctatggtgtcacaactccctagaatcacaaaatattgaaagcaatttcttaagtctattcatgcacccctcaatgtaggtggattacctaggattcttcaggtcacaagaaaaaggaaatctaaatcaaactaactcaagttccctaacccccaggactctgttgtcttaagtaaataatgtgcttcaggcacattttgagtagtctgcatcatcaaggctctcttcacttggggctttatttttaggaaccctgtgttagtaccatagcaactaactgttccaggtcaatatcatcccagattcaaggccacaggaaagaaggtggtacccttctcctgacacaccaacaaaactcacagtaataattctaatttttctgactgggtcacatgcttgtccctgaatcaatcactgtaggcaaaacgatgttattctctatttgcccaatcttgggccacatgctgaccccaggagccgggggtcaaatctgcaaaggaaagggtggtggtagttaaagtaaatctaggaggctcttgggggaagacaggtgcatgggtgctagttacaaactcccaatctacagactgaatttaagtagactaaacctttgcattggaatcttagtatcacaggattgtagaactcaaggaaacaaagtgatcttaaccagcaactctcaaagtatgaacctggggtcctggaggtcctgagaccttctctggactccccaagattgaatcattcccctgccctgtttcaggccccgaggtctgccagagtttggtcatagcatatatgtttatgtgactggtatcctccccatgactacaagctccatataattaacgtccacgtctgccatgtctgctgcatgcctggcatgcttcctggaagtcaacagtgtctcctggatgagaaactgaatacattaaaatacagccataacacctggatatttccttggatctttatctgcaaatgctttcttaccaagtgaaccactaaagactttgtcaatccaatcttctcagaggtctaagatgttacaaaagtaaagacattggattcttacccaccagcatggctctagcagctattatgacaaagcacagaaatcactccgaacctacagccaatgtcaaaccaaaagaagcaacatcatcatcacaatacagtcatcaatttacctgggcaaaggggatgcttggttcccctaggacttcacatattcagatgtgggcaaaatttaagacaagcagctaagataccagagggcagagagtgagatgtcagtgatgataaggcaactcaaaccctaacaaggcatgatggcttagacacactaataaaccctgagacaaatatgatttttcagaagttcttttccacatttcaagatgaccatttcaacctgaccagatcactccttttattcattcatacaaagatggaaagcatcaagtgcctataacacctaccaacctaaaggaaatacaaagagcagaggaacatgtaaactaacaccacagggatgggatcaggtaatccacactatgggaaactacagggcaaacaacccagtttcttcaaatataaattccaggaagaaagagagatgaggaaggtcaggaaggaggggagaaatgaaaaaggaatttaatagataaaaagaaacataaaagaccaattgtattagactgtatattcagttttgtatattgctataaagaaatacctaaatccaaggcaggcagatgacttgaggtcagaagtttgagaccagcctggccaacatggtgcaaccccgtctctactaaaaatacaaaaattagccgagtgcggtggtgcatgcctgtaatcccagctactccggaggctgagccagaaaaatcacttgaacccaggaggcggaggtcgcagtgagttgagatggcaccactgcactccagcctgggcaacagagcgagactctgtctcaaaaaagtaaaaaataaataataaataaataaaaagaaatacctgaggctgggtaatttataaagaaaaggcgtttaactggctcacagttccacagggtgtacaggaagcatgatgctggcatctgctgggcttctggggaggcctcaggaagtttacaatcatggtagaaggtgaagggagagcaggtacatcttacaatggcaggagtatgaggaagatagagtgtgagggtagaggtgatactcacttttaaacaatcagagcttgcgagaactcactattgagaggacaggacctagtgggatggtgctgaaccatttgtgaaccattgctgaacctgcatgatccaatcactcccacaaggcccaaactccaacactggggattacaatttgacatgagatttggtggggacacagatccaaaccatatcaccaaccaaatacaatgtgtgcacctcacttagatccttattcaaacaaagagaaaaaatattttgcaacatttggcaattagtaatttgaatactggatatttgacaactaaggtattacagctaaattttttaactttaactgttttaatcacatatatttaaaatacccctcttagatgtaaatattgaaatatatatcatataaagtgatttgacatctaaaaattatttcataataaaataggaaggatgaagctagtgggcctggacagaattaagcagagtttgcaaaagtggatgacggtacaatggggtgtcttatgttattctgtctactctttctatggtccattatattttctagaggaaaaggaaaaaaacttcctcaaaagcagggatgttagctatcttgttctgttctatttccagtgcccagcacagttcctaatacatagtaggagctcaataaatatttgttaaatgaaagagagaacatttcttattcattccactagtccaaggctcatgggagcaatgtggtatgccatataaagctatataaagccttccacagcctgcttctcctgacacacacattgcatacactgttgtcaacaacctatctttattctctttctcactgtcattactgttacacctccaggtggcttctcctgcagtactgacagcttttatacctaatctctatttttatgagaaggcaataaaactgagaaaaatcctacccaaagcaatctacttttaaaaaataaaaaatatttattgagcctgtacaatgtgccagagctgacctataagcactgaggatgcttcgtataagcactgaggatgcttcgtgaaccttccatttttaacgatggacacacacctccttccccagtttcaccatatgagaggtcatagtgcacactggactccagaatttaagaaactgggtatgaatcttggttctgccacttaccagatggtaggacattgggtgaattatttaaactgtgcctctgtgtcctcactgataaaatgaagaatcttttaaaatctatttcctagagttcctaccacaatgccaagtacaaaacaatcaatcaggttactgattatttttaccacacaatttttttccttaggaaaattttaagaattgttttcattaaaaaaggaataaaagttattttgccacgtcacccatgcctagcctacgtccctgtgaatttggaacttgacataatttcaggaatccctgctctgccttttccctaagcccatgtgggatcttggaggacggatgtaaataatggccagagctgcagatgtgcaaatagtagggcttgctttcacatcacatctggcctgctttccaattcctaggtggccaagagtgattcacaagtccaaagcaacatgtcttcaatgaacatataccattacatgagtgggagaaaaacgaggggcccagcaggtatagaggccccaggtgaattcccaaactacagctgttagaaaacatgtgaacggtgctggagaccttaagaaagctgcatatacaagccaactaagttgtagaaagaatttgtgtgtctttatcttcaaaaataaatctgtcctctgctatcagctgacccaatctctttccaacattaatgaattcatgaattgaacaaagagacacagtagccctccattccctccttaagttgtctgcctaaataccttctacatctaatgcagcattcagagcttgggggttttacccagaaaggccatgttactacaagtcatggctattttcttgcctaccaataatttaacctcttagtaagttataagaaatatctctttactgaaaaatgtcatatttttttctgtcttaacctcttttgctaccagacaccaaagcatctgtgggaatattttaaaatgttgtaagagtacatggatactaaatacttcaaaattattccctgaaagaagcatgtctgtactccctgcccccaatgagcaaacacacacacaaatggcttacggtaaaacacccataaagtaaagaagagggaagagtaacttatcttcaaaagcgcagacacagaaaatgtatgaagcgctcttagaaagcatattggtctgagatgttttaaaagtttatctttgaaaatctaagcctgaggttacttttgggaaaactaatttaagcatgaaaagaagagagcttatagcttatcaattaaacattttggcccatggcacattctttttttccactaacaggcagggactcttctcatctttagaatctatctcccatttgaacaatacttcttttaaagaactatccttaaaatcaattatttaaatactttaacctaagcagtggttgtgctgaagctggcttgtattggctcacaaaagtagcacttctccccaacttcgcattcagtgacttcatattggtagtctgaaatcaaccatggtggatacattgacaccatggaaatcggcaagtgctataaatcagagctctttcttccctagagagtcagtagttaaatacttcctagctactagtgaggctaaaatgcccatcaaaagggaaatgttaaataaattatggcacagttatgcaatggacttctaaaacacctaaaaggtaacataaaactatatattcatcaatgaggaaaggtgtcaacagtatttttaagttaaaaatatagataattttcagccaggcgcagtggctcatgcctgtaatcccagcactttgggaggccaaggcaggcagatcacgacgtcaagaattcgggaccagcctggccagtatggtgaaaccccgtctccactaaaaatataaaaattagccaggcgtggtggtgcatgcctgtagtcccagctactcgggaggctgaggcaggagaattgcttgaacccgggaggcagaggttgcagtgagccaagatcgtgccacgcactccagcctgggcgacagagcaagattctgactcaaaaaataataataataaaatttttgaattttatatatatatatgcatatgtattttataggtataccactttagtagttgtatatatgtgtagatgtgtatgtgcacatatatacatgcatggtatacacatatacatgcatggaaaaaaatacaccaaatggtaaaaacacattatcaatgactggaaggattatgactgaattctgtttgcttaattttacttttctgaattttgcaaagtttttagaatgaacagctattatttcataacaggtaggagatcatactaaaacttaaataaaaagaaatcaatattattatactggcataagcatatgcatttcaatgccagtattatgagctacttatatttgggataagaagtagaagggaatattatttttaaacatgtgttgaaagagactggatatcagcattctgtgcaaattcttacctgttacttgtgcctaaatgagctttcatctgcctctgggctaattaagtatggctactcagtctgatgaaactttgaaaacaaaacatatacaattgagaagaatatttttcttactgaccttagttattattacatatgctggccttcatcattcaacaattggtacattttgtgcccaactcacaagaccagaccagcctgacatttatcagcatggattttaaaaaattgtctctaattacattaagggcactgtattgagacatcaacgcttttgcaattaggatatgctaaccatctcagatcctccataaaccctttgtagtgggttttaaagatggaaaacacgactaactttagatttcaaatagttctctttctaacaatttttaaacacattatcaataacattactgagaggaataaggaagcctttaaaaataaataaaaggaaattcatccattctaatagcactgctctcagcaatgttcttcagtttctcctcatattacctgacctgctctaatatgaatttgtgccaccatcccccggtctgctgctccaacaatgtttccttatttctcaaagaagttcagcatcaaccttggggttcactttctataatccaaagtaatcacctgattaaaggtttttaaagtaaggatttgctttatccagtcccaaggaaccaggggctggttataaatctaaactttcacaactatctgggtagctctccttttttttctttcctatattctgtgcttctccctgatacaggaacaaaacagcaacattcatgaccaagagcctaagagactttcagaatgtcgaaagttgatgccaaattgggaagtaagacagtaagtggggaagacgtaggagacaaaaacaactacttccatttattaatcactttacactatgctaggcacagcacaaagaatattacaaaaaaaaacattttaaagtctctttatgttcataaacctcttcaagaggcaatattatcacttggaacttagcaaaatgacataatgccaaagtcacacacagctagttaacaacacagccaaactgctcttgctccgaagcccactgccttaagctctatactctgctccctccacgcagtccagggtctaaactttgaaacgccttggacctaggatggctgaatcaaaagggtcaaacacagatgggtcagacgcacccttacttcaaggtctactcaactacattctcctacaataaagtcccaagctacaaacttttggcatggaagaagctgcataatgttattgtgataattattacagagagggatattttttctcttgtctcttgtcagtactcagaagtatatttatattcacatttatataacatttaagttattttcccattatattattctaattgcctgcagcaaaaaattttttaatgttatatgtaaaattaatagcatctttatgtctatcatgaaaacagtcaggctgaaatccatccaaaaagattccctgaacatttccttccagatgaaccaggaaccactcactcactcacacaaaatacatgttcaactagagttgattttataagatattaattaacatagcttcattctgcagtgacaagagcccatctgctttcttggcattggagaagtgatggacttcaaatcagcttaagggaggcttgagtctggaatgatttccatctgcaactagttcttatctagttctacttttcactgttaactcagcatatctcatcagacttcttcaactggccagaggaggaccatcaggttctgtccaaacctggtgaacatcaagcaccaacatcacaggctaactgtggagctgaacttttataggaggaaggagaaggtctatcccacaataagatttctcaccccccaaactcaaacacttttttatggctaaatccagtctctgcactgttgtagttctccagggtagtatatctcacatctatgtattctttaaacagccccttttttcagttagcagtaagatgggagactgaaagaaaaggaatgagccctattgatgtcactaagtggttaatgataatgctgtactttccaaaccccaagggcagaaatctaagcaaattaacacagtttcaagttttaaagtcaagtaacaggctgaataatggccccctaatgatgtccacgttctcatctgcacaactgcaaatgtgttaccttacattacaaaaggattttgcaatttatgataaagggtatggaccttgagatacggggattactctggattacctagtcgggcggatctaatcacatgagttattaaaaactgagaacttttcctgttctatcagagagatgggacagaaagagaaaagattccaaaaggaaaaggagctcaaccctgctgtggctggctctaaaagcagaggcagagggccatgagtcatggaatgtgggtggccgctagaggctgggaatggccctccgctgacagccagcaagaaaaaggggatcttggtaccacaaccacaatgagctgattttgccaacaacccaaaaaaccaaggaaaacgatctttaccccagaacttttaaaaaggaacacagccctttcaacaccttgattttagcccagtgacatccacgtcagccttctgaccttcacaaatataaaataataaattgtgttgttttagccattctgtttgtggtaattcactatagcagcaacagaaaattaatatataggctcaggcaaaatgaagagcatttctgaacaccttcttagcctcttggtctttaaaatcaaaaggaaccaactgcatagtgctatggtctgaatgtcagtgtcctcccaaaattcctatgttggaacctaatacccagtgtgatagtatcaagaagtggggcctctgggaagagatgaggtcatcagggctccgctctcacgaatatgattagtgctcttctaaagaggctcaaggttgctttcttctaccccttctggcatgtcaggaaggcacaatctatgacgaagaagacctccccagacatcatatctgctggtgccttgatcttggacttcccagctcccagaagtgtgagcaataaatttctcatgcttgtaaattacccagtctaaggtattttgttatagcagccctaatacactaagacacatggtatattgcttacaaatgttttttaataagcatgagagttgtacaaaaccccatttgcaacatctgcaatgccaaagacagctgtaggtgttggggaaagtctctgagccattactctcaaagatattaaatcattccagactattctgaaagccaaagataattaagcttgatcaggaatctcaagtttttttccagtgtaatatgtttgtataatggcaaaactatggcatggatccctacataaacagttgtgctttcagtaggtgttgactgactctccctccaattctactttggattcagcaatgcttacaaataaactgttttattagtcacaacggtatctacatacacgtgaaaaatgacattccagacacacgtgagatcattatttatgcagatgaagcctggtacacatacagaggcaaagatctttctgagttctgaccaccagcactgcccagatctttaatatgaaagccagtgtcgtggattgaaaactaccattaaggtcttggcacatactgtgtcagaggaaacatctgtttgaggcatcgcagttgttctaatttccaccttaaggataagtctgattttggaatcaaatcttcctgaggctttttgtgtaatgctaaaaccacacctggggaaaatcttataaaaggagagagagaaaaaaaaaaacacagagagagagaaagaaaacatataaagttcacttccaaataaagacatggggtagctatagctggcataatttagtttatcaccaaccaaccaatgattggttcaaccacggctccagtaacagctctcatgcaaaacacaaaatatgtttaaatcaatgctaagttaatgggctgccacaacacaacttctctcagtggacactatttcacaccagatttccatagccagattctgtatcagactccttatcaatagaggtgccttaaacaagactgacttatatttgctaacaattttccattgatttatgattcacagtattatattatgcaatctgttagacagattttaataatcagatgtgtccaagtgatgaaacatgggactgcttgcccaaactttaccaaggttgtaataccctccatgttttcagtaaggtaaatataaagaaacaatgggacctccattgtttaccaggagtcccacttgtgacatctgctaatacaaatgaaaagatttatagtattaaactgaagcaaacaagcatgcaaaactatggagagggtgacattgggtggttttagaaaggttacacagtatctttaaaatgtaaactcatttagactctgccagtaatcagctatatgtacttttagcaattggacctctctgagctccaattgctaaatgatattcccctttatttgtgaaatgaggagactggtctgcatttgattctgcattctaaattcatgaatgctaagtgaattggcagtgtccctaacaatgacctttttgtcctgttcctcacttctaacttcaagctagaaaccagcacattactctgcaacttgccactgacttaatggacaacttcaagcaagtgtcacttccccaacaagcttcagtttctccttcgctaagagcctcctccgctaattctgaggaagatgaacagggccacctggcaaaaattttttacagaatacaagtagcgttacctggatgttttgcatcaaaaactaaaacaagtacaggctgaaacccaaagctagtgagttcaaattcctccatgcttttaaggatggagcatgtgaagagcagaagtatagagataaagcatcttattgtataaccacatacacggttgaacttaaccactcttccaaagtacacaaaacagcacacttaatccataaaggagatttgaagactggcctctaactcttgaaagttggcatgctaccactataaaaatgccgtttttgaactaaaaagcaaagacctaaatgactcctggtcttacgattcaggcaggaaactcatgaggccaaaacaaaaaaattccacatagatttttgcaaatatttaaaaagcacctactggagagaatttacttgtgtgaatggaagttttagataaaatgcctctctgaaatacatttgctttaaagagaaaataaaaggtggcagtctttactacagatttgaaatttaaaaaggcaaatctgaaatgtgtcaccacatatgtgggccacaaggttacagcttgccaaagttgcaattcacatactttacccattcctggacttactgaatgttgagtaataattgtgggggccttgcctttcatattgcgccaataatctcgagagaccttacattaccatttatcaggaggtctttaacgttttgctgtcatcattcaagagtgccttttggtctctgatgtttccaaccagccctctttttcagagcacctttctcttgactgcccaaagattaatgtttaattgcagctggaaaggcaacaactgcacagccatcagcataaatcacagtgcagatccactaggcaccacatttaactggcagaaatgatgtctcccaatcagtgcctgcaaatgcagctggttctgtgcagtctttgtgccttataatttggttaagccctttacaaatgatgccaagggaggggctaagagagattcttcaaaacaataaagacttccagtgtggttttagcacatgtaatgaaactgaacacactgaaaagaaaactcctagggatggagaatcacaaaagaataaaaggcttacagcaattcctcataaccaaactgctagcatgtctctgaatacgacatggtcttccatgcctatctgcttggcaagtaacttctgttcattcatctttcaagactcctggatgaagctagatgctcccttctctgtgccacaaaagcactcagcccaaagcttctcttccaacaattaccatgtgttttggagccattcatttttctgaccatctctctcagaagacttgagcctcttatttctatacctccacatcctagggcagctccaggcatacaagagatatttaatgtttactgaaatgactacccatcaggcaaagcatctgccttcaatctaaccatcatggtctctatccactttgatgaaaatagcaaaccattatggatactattttgttttcaagtctggttattattactcaatgtgggggagcttgaatcctactcactgctttcacccagtatatgactgtatcaaggaagcagattaaatatgcattcttactacatttcactaaaattctcacaagaattctacaatggtgcaattatattcccatttgtatggatgaagtgaatgaatggagcttgggaaggtaaataaatgacttttccaacatctccaaacaggtcaatcagtaatagtgggctaggactggaatggaggtctactgaactttttttttttgggagacagaatctcactctgtcacccaggctggagtgcactgatgtgatcttggggtcactgcaacctccgtctcccggcttcaagagattctcctacctaaacctcccgagtagctgggatcacaggcgtgcaccactacgctcagctaatttttgtagttttagtagagagggggtttcaccatattggccaggctggtttcaaactcctgacctcaagtgatccgcccgcctcagcctcccaaagtgctgggattacaggtttgagccaccacgcctggcctaggtctactgaacttctaacacccatacaatacaatctctccggcttccccagtagcatcagagaccaacagcatagttacaactccaattcaaaacagaaagactgaagatgaactttcactgaatgtgcaagtatatgttcaaatatctatttactagtgtaatcatcgacgacttacctatttgtaagtctttactatgtcatataaaatagagaatattcatttttaaattccaggctttatgagatttttgttgtgttattacaaccaacttgaagcaagtgccagcttttttccacaagttaggtggcaggcttcagcatgcttttgagcatattcaacctactacaatctgagctcccagaaaagtttccttaattgagtaaacaattacatgaagccaaaagttggctgaagagagaggggctagatctcttagtttcatttgcatgcaggaaaaagtttatgaactttcacaagctccccagtggctttctgtagcagtgaaaatatctttagattactagtacacatgactagctatgtaacagaaatctacagtccatttgcaaattcttactcagcacctacttccctagacactggggatcctgtggtgaacacaacacatgtaattcccacttttctgcagctgaaattcttatgcctaacaccagctgatagataaacaacaaaggtaacttcagataataagtgctaagaagaaaataacaggacggtatgaaagtaagaggaggtaggaacatgaagatattagctaaaggaggttctgtaaaggctactttagattgggtaattacagaagtttctgaaatggcattgaatttaaagctcagaatgaatcatccaggagaaaaatctgagggaagagcattccacacagaaacctcaaacagtgtgaatgagcttaacatgttcaggaaatagctcaggaagtccaagtagctggagctatctttctcttattgatttctactttgattccactatggttggagaatatactctgtatgatttcagttcttaaatttcatgctttgtgttactgctcacgatatggtttttcttggtatacgatctgtaggtgcttgaaaataatatctattctacttttgttgggtggaaggtctataaatgccaattagattcagttagctgatggtgttgagttcttccacatttttgctgatttttctctctagttgttctatcaattattgagagaggggttttgatgtctacaactataattgtggatgtatctatttcttctttcatctctagcagtttttgcttcacatattttgcaggtcttttgtttgttgcataggcatttagaattgctatgtcgacatggtggaatgacccttttatttatcattataaaatgtccctctctgtctctggtaattttacttgctatgaagtctactttatctgacattaatacagccattactgctttcttttgattggtgtttgcattacacacctttttccatccttttactttgaacctgcctatattgtttcatttgaagtgagtttcttgaagacagcatatagctgggtcatgttttagtccacgctgccaatctcttgtctttcgactgatgttcttagagcatttgcttttaataaaattgttaatgtgttaggtcttaaggtttttattctattttttgttttctgtttcttctctgtttctcttttctccaatttactttttctacgttgttctgggttgcctaaacttttttaaaagctctattttggtttttctacaatatttttaagtgcccctctggtataatatttattttactgtcagggactaagtactatgtaactaccttattcacatcaaggaaacaagaaactacagttatatgataaggacgttaaaaaattcattatttcagacttgtctggcaggaagagaaaatagtgttaaaggggccacttaatagcaatgacaaatgtaccagcaagttaacttgtatcaagcaagtagagaaaatattcactttcaacccaaagccaatgaatttcctaatcccatgcatttgcatttcctgagtttctgattcttgccactttaacaaatagaactcatgagtatgataaaggccattcgtgataagccagtgtttgaaaacagatgactatatacaagaaatcaacgactctgtctggtgtatttactttcattgccagataatatttgcactaatattatatttttgtagtgaaaaacaagaaatctaaactatttaaatgtaaatgagaacattcttattttacactatttacagaccattatttggcagatttaagaatttatatttacaattttagcaccctctgcaccatatatagactctcccgccctgtgcttgaaaccagaatgcagcccttctgttcaatcgccctgtttctcccttgcagattacattaagcaccttgtttattcctgttttaattataaaaattggtatggtagataagagatgagagcagaactgaagtccacatcactgcaggcaagcaagctgggggttacctgctcaactgaggacccaatgtcaaggcacaagtttggtggcttgtggcatctcatccacatttcccaaggggcacactgctgtgctgtcatctaccaaccagacattgcattgagcaggttgtcagaccaaagatggaagggaggtacaaccattcccaagtaaggggtaaaaggtacagtgcataacattacaaagccaaagaaaaaatgatgtcatcattgcaaaatgtgaataatttgctccatgaacacatgcaagatctgagtcagaagaataaaccactctactcagtgatatgttggatggtaacaaagaaataaatctaactctgcaggcacagtataatgttcattcacctttctggtttcttaaagaatctctaaagtataaaatggctgaggactagtggcttagtgataaggatcgtgaataaaggacaaaaataaggaagcacaggacaaagacaggaccagataggtatgacgagaccaataggaaagatgatggttgtctaaagaaagggaaagaggccgggcgcggtggctcacgcctgtaatctcagcactttgggaggctgaggcgggtggatcacgaggtcaggagttcaagaccagcctggccaggatggtgaaaccccatctctactaaaactacaaaaattagctgggcgtggtggtgggcgcctataatcccagctactcgggtggctgaggcagagaactgcttgaacccaggaggcggaggttgcagcctgggcgacagagcaagactccatcagagaaaaagagaaagagagagagagacagagagaaagagaaagagagaaagagcgagctgtgctttttgtggagccatcacttttgtaaatatctggtgccaaaaacaccacacctgcaatcatctgccctggctcactgtctttgaaactgttaaattgtaatataaatgggaggtgttataataacaagaataatgccaccatcttacatacctgtgacctttcctcacagataggtcctaaatgtgacaccttttggaagaggttcctaagaagtaactactgacaccatcaagacagaaaaaatgaaggttttcttcaatgcaaaaaaaataaaaaaataaaaaacacagaacttgcttctccacgaagtattatggtacctcagctccaagaagacacaggtaaaatatgggaatcacctcctgctagaaataattccaggcaaaaaggcagatgtgtgcctgcctggcgctgcccacctccatcagggctgtcatttctacagcagctgtctgaacaaccccacagatgagtatcaacttcagctgccacacctgctgacggaagataaagcacaatatgaaaatagggatggttgatgccacgacctcccagagataggagagttcctggaattcttccagcaacattctccactgcccacacacctggaaagtcagatgaccattatatctgtccagctcacacaagggaaccataaccagtagatgccttcgtcctctgcttctataaaatatgccacgaccccacccagctgcttacccaaccatgggggccaacgtcctgatgcttggtaacagtgagcatcttctctaaggtataaacactaaatacgaatgcaaagcgcgaagtaactcaaatttgccattttctttctttacatttttctttttaaaatcacaggagtggtttcagtcagcatttaaatctatgttggtctgttttgctcatctctggtgtcctgtttgatatttttagctagttcctaaaaggcacaacctcaaatttcacacttccttattcgtctttaaaggtctaatacagggtttctcaaactcagtttgaccaacccatgaaggtcttatttttaaactttttattttgaaaagattttaggtttacagaaagtggtaaagatggaacagagaagttgtgcatacccttcacccagattcccccataggttccatcttacataaccgtagtacaacttcaaagccggaaaactggcattgcaatatttgtgtatgagttctatgttattttatcacataaaggtttgtgtaaccaccaccccaatcaagatacacaactggctgggcacagtattttactaaaaatacaaaaaaattagctgggtgtggtggcgcacgcctgccatcccaactactaggaaggctgaggcaggagaatcacttgcaccaaggagatggaggttgcagtgagccgagatcccgccactgcagtccagcctgggtgacagagtgagactcaaaacaaaacaaaacaaaacaaaaacaaaaaagatacacaaatatttcatcaccacaaacatctcccttgtgctactcctttagtgcatacacacctctccacaacatgcctggcaatattatgttttcatctctataatttgatcatttcaagaatattacataaatagaatcatacaatatatgacctttagagattgttttttcgtcactcagcataatgcctttgagatccatccaagttattgtgtatatcaatagtttgttcctctttattgttgaacagtattccatggcatggatgtaccacagtttgcttcaccattcagctgttgtagcacactttagttgttgaacattataaacaaagctgctatggacaatcatgtacaggtttttgtgtggacataagtttccatttctctagggtgaatgcctaggaatatgactggggtcctgttgtaaatgtatatttaattaattaagaaatggacatatcattttccagtgtgtttgtaccattttacattcccaccaacaatgtatgagagactcagcttctctgcatcctcaccaggatttggtgttgccactatcttttatttcagctgttctctgtgtagtaataacacatcatggtcttaatttgcatttccctaatggttagtaatgttgaacatctttttaagtgcttacttgccatctgtgttgtcttttgcccattttataattgaattgcttggtttttaatgttcagttctgagacatctttataaattctagatgagtcctttattaagtcatgcactgcataacatttcagtcaacaacagaccacatatacaatggtggtcccataaaattacaatggagctgaaaaattcctattgcctagtgatactgtagccatcataagattctagctattcatgtgtttgtggtgatactgatgtaaaaaaaacctactgtgctgccagacatagaaaagtacagcacacacaattatgtacagtgcatacctgataattacgataaatgttacagttaatgtatttattatattatactttatatcattattttataatgtattccttcgacttttttttttaattgactgtaaaacagcctcaagcaggtccttcaggaagcattccagaagaggacattgttacaggaaatgaccgctccatgagtgacaaaggcgcaaacacattcaatggaggaaggacagtcttcaacaaatagtggcaaaataagctgagcctaagctcatctttaaataaaaattaactcaaaatggatcagagatgtaaatgtaaaatataaactataaaactgtttagctaaaacacaggagaatactttcaggacatagggcgtggagaagaattcttagacacgacattgaaagcatgatccataaaaggaaaagactgacaaactggactttatcaaaattcaagacttttgctacacagaagacctgtgaagatgaaaaaataagttatgaactgagagacattacttgcaaaacaaatatagtcatgttgtaaagcatctttacgacgttgagtcttcaatatatgcaatgaggtatctctccattcatttaggtctcatttattgtctttaattagcactttatagttgtcaccatactaaatctggtatatattttgttagagttatacctaagtatacctttttgtggaattgtaagtggtatacattttaaactcagtatccatgtggtcattgccagtatatagaaatagcattgatttttgtaagcttatcttgtatcctgtgaccttgctgaactcctttattagttctaagattttttttttttttggtagatttcttaggcttttctctgtagacaaagatatcacctgcaaagatgtagtttatttcttcatctccagagtatgttttttatttccttgtcttgccttactaccctagctagaaattccagtactatattgaatagcagtggagaaaacggacatctatgctttgttcactgccttaggcagaaggcattcggtcttgcaccattaagtacaatgatagctccaggttttatgtagatactccatattgagtttaaagaagtttccttctattcatactttcctgagagattttatcatggataggcattacattttatcaaataatttttctgcatcaattgatataatcatgtgatttttctttcttagcctgtcaataaggtgaattaccttgattgatttctaaatactgaaccagctttatatccctacaatacacccttcttggtcatgttgtagtagaattctttcaaatagtgctggctttgatttggtaagatactgttaaggattttggtgtgggtggggggtggcctagattcatgagggatattgttctgtagctgtttgttttgtttttgtttttagtattatcttggtctagttttgatatcgggataaaactagcttcataaagtgagttagaattatttcctcttcttctattttctggaagaaattatatacagttgctattaattcttttttagacatttgctacaattcttcattgaaatcatttgggcctagagatgggggagagccaaattacaaattcaatttccttaaaaataatagagctattcaaattatccatttgatagtaagttgtggtagtttgtgcttttcaaaaaattggtccatctcatctcagtcatgaaattgatatgcgcagagttgttcagagtattattcccctagacgtttttggtatctgcatggtgacatcaacagtgacagcctccattttattttttatattaataatttgtatctttttttctatttgttagtcttgccagataaccgtctattttattgaacttttcaaagaactagctttttgtttcactgattttctctattgttttctgtttttaatttcattgatttctgttacctttatttcctttcttctgtttgccttgggtttattttgctcctcgtcttctagtttcttgatgtaggggctccaaactgttatttgaaattttcctcttttctttctttctttgtttttttgttttgttttgttttgctttttgtttttgtttttgtttttgttttttttttgagatgcaggatggagtacagtggtgcgatcttagctcaccacaacctccgcctcccgggttcaagccattctcctgcctcagcctcccaagtagctgggattacaggtgaccgccaccacacccagctaatttttgtattttgagtagagacgaggtttcaccatgttcgctaggctgatcttgaactcctgacctcatgatccacctggctcggcctcccaaaatgctgggattacaggcatgagccaccgtgctcggccaattttcctcttttctaatataagcatttagtgtcataaatttccctccaccagcctttttgaaccaacacagggttcacaggaacctaactgtatattcacattccttagcatcaggtcccgaaatttagagaataaaaaaccatattacaactggtttgaaatgagccaactcacaatgcctaaggcgcaactggggttcatttcaaaaaacaggatccttatctattttggtactatagacaagaaggaactcaatcttactaacaaaatatctaaataataagtaaataaatatcagtttgagcatttttctcagtctacctttccagttcctgctccagacctccactatatgaagagtattgactcaaatttttactgccatttctcaaacgtcaaaacagatgtcaatgctctgagttatggagccctttcctagagagcaagaagaaactgatcttctctcctgggtgtctaagagataacaaacaataccatctttttgtaacactaaaatttacaatccagttagggaggaggtgtaaaagattatttaatcaagtaaaggaattcacacctgttttctctttctttttcaatgttccatatcccctgaaattttataaatgtgtactttttttttttttttgacacggagtttcgctcttgttgcccaggctggagtgcaatggcgcaatctcgactcaccacaacctccgcctcccaggttcaagcgactctgctgcctcagccttcccgagtagctgggattataggcatgtgccaccacgctgggctaattttgtatttttagtagagacagggtttctccatgttggtcaggctggtcttgaactaccgacctcaggtgatccacccacctcggcctcccaaagtgcttggattacaagcatgagccactgcgcccagccataaatgtgtacttctaacataaaatttaatctggctgaaacaaatatttggaccatagtaaaatgcttctctataatttgttccttcctttcttttttctagcaagcttcagagccaacagggcgcttctcctggaaggtgaagtcatggtgacctactgctctttattcagtctgacatgtatgttaatcttctctacttactcttagactgtggaatatgatccttccaatgggagacagtggcttttctcttacacttttccctgtctcctcaccataaataaaatgaaaactgaaaaatgtctcccctaccaaaaaatctctgtcccttcttacacatccataatatgtagctcctacaatggtcttcaatgatccccacctcctggtattcataaccctgaatacttttctctccataaatgtagtactggcttattgactcaattctaataaaaagaattgatcaaaagtgatggatgtcacttctaagataatgttataaaaagattgtcttctgtcttaggtgatctctcattatctcctggatcctttttcctagaaggatccacatgccatattatgtggcagccctgtcaagaggtccacggaataagggagcaaggactgtcaaccaggagaatgatcctgggaggagattcccccaccatcccaggcaagttttcagatgagactgcagcccaactgacagtctgactgtatcttcataagaaacctgaagctcaggatcccaagttaagctgtgttcagttactgacccatagaaacaaggaaatgctcaatgtttgttgttttaagctaaaaacttgtggagtaaagtaaataaacgtcagtttgttacatagcactagataactaatgtaccttcccagctacagacttccacagccaagattaagacttatttacccaccagttaactcactcatttccaaagacccccagattctagaggaccccttcttcatttcgctctcctcatcaggttcctggtatagggaaataagtcatcaccatgacttaaacagtatggactgttttgttttgttttgacatcaaagcaaccaaaacagaatggaactaaaagaaagcaaggtttaaacttttagtccagtttcaactccagtctcagcaaagctctgagagaagagagttttatggtcaaaaatgtttggggctcttcccctaaatggcctgaggtgaaaatggttcaccattctcttgacccagaaacccccacaaaaagcatgcaaattgacaggttaaaattttcattttcactgcaagaacacctgtggaaccacccaggccatcgagggtatgcagatatgaaagccaccaagtatctaaaagatgtcacttgacagaagcaatgtgtgccattccaaagctacaacagtggagttggtaggtgtgtctgggccaaacagtggggctggacactgggtcggtggcccaaaaagagtgctaaatttttgctgcacatgtgtaaaaatgcagagagtcatgctgaacttaagagtttggatatagattctctggtcattgagcagatccgggtgaacaaagcacctaagatgtgctacaggacttgcagagctcacacggtcagattaactgatacacgagctctccctgccacatctagatgatcttgactgaaaaggtacaaattgttcctaaagcagaacagaaagttactcagaagaaaaggatatcccagaagaaactgaagaaacaaaaacgtatggcacaagaataaatttggcataaaataaatccaagtaaaacaattttaaatgtctcgagaacactacaagctatgtcctcttctcagagagccctgaagttttaacatattgaaagctctgatcttgccaaagaactccacttaacttcaaaacacaccctccacacacatcatgatcaactgagatcttactgaaccagaatcctaaatggcatacttcaggaacaggggtccagagaagcagttctcaaagtgcagcttaaaaagaaactgaaaacccaattcatgcaagacctagggcttattttagagcattttccagtgcagattggatccaatctaaacacatagaattaaattacgaaaaatgatacagactattacctaccaatcacccactaaaggacaccccagggatccctaactccactcttaaagtttaggaagacatcagcactctttgtggccatgcattaatttgctcaaccctttccttcatctgagtatttcctctgcccattgaaatccttgggcataggcggggcacggttgctcacactgtaatcccagcactttgggaggccgaggtgggagcatcaaaaggtcaggagttcgagacaagcctggccaatatggtgaaaccccgtctctattaaaaatacaaaacttagctgggtgtggtggtgcacgcctgtagtcccagctattcaggaaggtgaggcaggagaatcacttgaacccaggaggcggcggttgcagtgagctgagattgtgccactgcatttccagcctgggcaacagagggagactccatctcaaaaaaaaaaagagaagagaagagaagaaaaaagaaaagaaaagaaagcaatccttgggcacatagagtgtcgtggttaacatgatgggcccctggagtaacgctgaacttgctatctgaccatcacttactatacatgtcaactaatctcactaagtttcaccatctttatccaaaaatgagcataataataatatctaccacactggaatgcatgagataattctcgtttagctttggcacagtgtctggaacagagtaggcactcaaaaaatgccacctattgctacatttttcatcatccaatgcatcagatcttaaattaaccaattttagtttccagccgggtccaaacacctcaacatatttctaccacatcactcacaactgcaccaatttcatgtctttgctatgcctttgcactgccagactgaagaacttgatgtgttaagttcactcccatgtggcagctcttagctcttcctccccatctgttccagccacacctgtctcgaccttctctggttccaaatgacaacctgaattttagaagtttcacagtcttttacgaaaggtaagttttgctgttttgcttccagtatcattcaggatgccagccaatagtttgctggccttgtgatccgccagacaagttaacctgcaaagcctatcagattcttttgtccttttctggttcaaagatgaaaagcaggtagacagccgggctaaaaaagcttaaatctttcttttataaaatttgggaataaaagcctcaaaccagtagtaacaatgccacttgttacttggcaacaacacttcatttgccaaggtcagaagccatcgaaactgactttgtgcgtgggtagacatacacagagcaaaggaacagggaccaggcagctataaatccagcagccaccagcccctccaacagaaggcagtggctatgtgaaagtattattttcaagatcatcactagaatctatgaaaatgactcctaaagttggctagagtctgcctgaaaactagtcttattctaggatgcaagcccttatgtagtgcggtctcaagtgaatagcagctggaaagggaaacttcaccccaaactctgcaaaattgcaaatcaagggcaaagttgagacaatggatgcaggtttggcctttgagtgaccttagtaagttacttagctactctaaccacacttcatttgtaaaacaggggtcatgatctagatcttccagagtgttatagttaaatgatgctctgccaccagagtcataatagggccccacaaaggtccttatagtaagtctgagtagcaactgcctcaaagtaccagcagtcatgatcaccaatatgttttgagcacacactctgtaaaaatatgtgctttcgccttgtaacagttctgaagcaggttctgttattattgccaccacagatggcattaactgaaggtctgagaggtaaagtaacttacccaaggcaggtaggaaatggtacagctagaactcagatccaggcagtctaattccagggcctatggtcttagccattataccacattgcctctgtgaggaagcattaaatacatatttgaaaggatggatgggttgacaaatataattatctggtgctttcatcctctggggtcctactcccccaaacaaaggaaagaaacattgacttgtcctttcagattacaaagaatagcaatgtcttacaaaaaaaaaaaaaaaaaaaaccctaagcacatttgtttataccaattttaggacaattatttcctaaaccaaatttttactaccctgaagttcggtacttatgaaaacactgccaacataatgaaatgactgtgcaaaaagcaacagctgatcactagaggcaattttctttcttataaatacaaaaatcctatcagctaaaagaatgtagcatgacaaatcacaaatcagagacagagtcttctacatgaggatttaaagctcaagaatttcaatgtacttaataacataaaatctgaggcagatggctcaatgctttagaattcccaaattgttaagggtatcctggatggaaataccctagctaggtttctatttcttttctggccggcaccacctggtggttttttttcctctaaaatctaagtccacacaggccataaaattaagatctggacagcattcttgttgtcaaagtgatccacggaagaaatctttaatttcatattcatataattctaactaacatattaaacaaattttatttttatccatatggagatagtctcatctctagtgcattttcttaaatatatttatcaatgtgtatgataaatatcaaaatacatgaatttaaaatcccgagagtactcttgagcttacacatcatggggaacaaccaacacatcattcaactatcattcattcatcctctcaatcgtttatttattcttttatgctaaggatgcagagatgattttgtataagttaaatgtgcttttgatgatgaaattccactgggtactacgctcttcactattttacaagtgaggacactgaagctcagcctaactaaggaatttgtctcacgtcacagaaatagcagagctgggatttaaatgtagttttggaaccaagcatggtggctcacacctgtagtcccggcaacttgagagactggggttggggtataccttgagtccaggagtttgagtccagtttgggcaacacagtgagacttcaacattttggttgatcttggatagctcagaagtgatcaatacccttccccgatagaagaacaaaggagacaaccagagaataagagttacccaaaggacaggaaattcatttccccaatttattgccagaattaaaaagaagaagtcagaagcattccactttgtcagaccacgtgtctctgtttggtttactggaagaatggtgaacatggggaactgcatgttatcctaaatgaaacttcatataaaagaaaaccaaatgagaaacatatggaagaattaaagtggcgagctaagtgaagcaaagcgaagcaacttagaatgtttcgtatcctacgctggttctgagcaggcttaataagaagctgacatcgatatctgatggcctgagaatctacttcagcactgaagtacacttactcctggccccatggacctattattgttcaacttgcaataatgggacacttccaaagagctgacaggcaatctttaattaaaatacactgaaaataacttgaggcacagtttgcacaaagaaaacaactgctctcttaagttacccaacataagttgtattcttttttttttttttattttctttctaagctgagagttttcactgaagggaagaaactgattttacaattaattaagagatgaaaaacctatagcttagcagttaaacacctgggtcctagacccagataggcctgagtttgagcccagtcacctgcaagctgaatgttcttgatcgttatttaaactctcttagcctcaggtcccccatcttcaagtggagaagacttcctgccatagtacacaccacagcagatcaccaaatgtttccagctctctgctgctgtggacacttcctggcttactgatttgtgagtgagtggggccatgtgattggttctagccagtgagttgtatgcaaaatgaagcaaatcacttgcactccaaacacttaactggcagctcaagactattcagagcattctttttttttttttttttttttttttttttttttttttttgagatggagttttgctctttttgcccaagctggagtgaagtggcgcaatctcggctcactggaatctccatccccagggttcaagtgactctcctgcctcagcctcccgagtagctgggattacaggcatgtgccaccacgcctgactaagtttttgtatttttagtagagacggggtttcgccatgttggccaggctagttttgaactcctgacctcaggtgatccacccgcctcagtctcccaaagtgctaggattacaagcatgagtcactgcacctgacccagaccattcttttcccttctgcacaaacaccagcaatgttgggtagcctctttgtcagtctgaatgacagtgatgagcacagtccatctccctaccattgacctatttgctgcacaagtatcctaagctaaaagtaaactttcatatatatatatatatatcatcaaatatacatatatatatatcatcaaatatacatatatatcatcaaatatacatatatacacatatatatatctcactgggatttgagggttgctggtctgttattgttagatgtctaatactgactgataaactacttcataagctggttgtaacaactaaatgaaataaagaataaagcctggtaagatgtctgtaagtgcttaataaatgacattttgttgctgctgttaagaaacaagtatttcttctacacaatggttagactgtgtatttttcatcacatctaacgaaggaagaacattaactgagctaaaatactttctccttcctttttccaggttccactaaagatttgatgtcagtgtttgggaatctacagaaatttaaccccaaagaaaccagctctccctctctagattcaactttaaactgcacaatttctctgaaatgcagataaattagtcactttactaatttggttcaaagcaagaatatgtatctgaaattaatttatcaattatgtactatatcatttatatactattatgatctagggtcataccctatatttttttctaaatcactgatattagaagtgaaataaaacattaccagccaaacttgtttgaataccctatttctttatatatataaaaaaatagtgctaatttaaatgtatgttacagaacatactaagagtttgaacccatgtgtttgtgtcatgctgtaaattatggtaaatgcagtccccttcttttgcagtatacaaactagaatgaccaactgtcacaatttgcctaagtcttgaccacttttagtatggaaaaacctggaaaccatatgcaaacttaatcccagtttgcccggcgctttctgggttttaaaactgaaagtcttgcatcccaggaacactctcaatccagggtaaaccaggatggctagtcatcctaatgcaaagatatccttgaagtgtcaagataagcaagacacctcttcctggaatgtaaagatacaagggaggaacattacatcatctaaaagagttttccattaaaacaaagatatataatagaatacgatataaactctggatgaacttttagaatagaactcaagctgtcaaagtaatgttgggctttttgtcctctgtttttacaggggcacactggagaaaaagaccaataagcagtgctttagaagaaaagccaccgacacagaaacaaccaggatgcaacgttcactccctcccttactttctccacggctgagaacagtcattaaccttgctctaggccccagtcaggctacctttattttaaaaatatgcctcaagcacggcgtggtggctcacacctgtaattccagcactttgggaggccgaggcgggcggatcacctgaggtcaggagttcgagaccagcctggccaacatggtgaaaccctgtctctacttaaaatacaaaaattagccaggcagggtggcaggtgcctgtaatcctagctactcaggaggctgaagcaggagaattgcttcaaccggggaggcagaagttgcagtgagccgagatcacgccactgcacttcagctgggggacaagagcgagacttcatctggagaaaaaaaaaatgcctcattagaaggcagggacttagctttgttcactgctgtatgcctggtacctagaactatgcctggagtttgactaaatgagtaattaaatctctcagccagggataaaactaatatccacatcaggattgttgacgctatcaaagaagatcatatacataaaagtgctctgcatattaacaagaactgtacaaaagtgactattatcttgcagatctcttgattaccttattttctcccacacaatgacttatgagtattacattgttgccttatttggattttgatgggcactggtgatggagtgtaagcttgcaaactaaataaaaaaaaatctgttaggttgccaggcgcggtggctcacgcctctaatcctagcactttgggaggccgaggtgggcggatcacttgaggtcaggagtttcagaccagcccagctaaaatggcaaaacctcatctctactaaaaatacaaaaattagccaggcgtggtggcatacacctgtcatcccagctactcaggaggctgaggtaggagaatcgcttgaacccaggaggtagaggctgcagtgagccgagatggtgccactgcactccagcctgggcaacagagcaagtctctgtctcaaaaaaaaaatgtgttaggctaacatgtacatacacatacaagatggccacatatgtttggaaatattttcaaaaatatacaggcagaagtcgaatgtttatgttcagtaatataaaaaagtttaatcaaagaagttttagaacatatgcatcataaggaggaagatattgcatagttttgatctgcgaaagaggcaagaacgggggaagaatttgagaggaatgtggataaaggccaaaagttgaatcatatggggaaggtttttaagtaggaataaaagcgaatacattgagctggaagtgggaaggctcaaggaattgtgggcccaaggcaaacttgtcaaaccaggaagatatctggtagggctgtaaacagcctaaataccaagcaagttcatgcatcatcactacctatatctgtcctccttggtggccctatcataaggaagaaatccttgccaaggttatcctgctggtgtcttccacaaggtaacaaggtagctggcgatggaagtagcattgctgtctaggatgggctctctgcacctggccagcatcagttttgagcctccccagaaaggaagaggagggtagtgagcaaacatatcttgcttgttactattgctctcacgttgtgtttcagatggtggaacaacatgtaaaactctacccagtaggtaaacactagacagacgtgcgtatatacacacacctccattaccataaaaatgtttgaagacacacttgacaccaattttttttttttttttttgagacagagtttcactcttattgcccaggctggagcacaactgcatgatctcagctcaccgcaacctctgcctcccgggttcaagtgattgtcctgcctcaacctcccaagtagctgggattgcagccatgcaccaccacgcctggctaattttgtatttttagtagagacagggtttctccacattggtcaggctggtctcgaactcccgacctcaggtgatctgcccgcctaggcctcccaaagtacttggattacaggcgtgagccactgcacctggccaacaacaaattttaagcaatcggcaaagtatcagaaaatatttgtggttttggctgggcgccatggctcacacctgtaatcccagcactttcggaagccgaggtgggcagatcatgaggtcaggagatcgagaccatcctggctaacacggtgaaaccccgtatctactaaaaatacaaaaaaaaaaaaaaaaaaaattagccgggcatggtggcacgtgcctgtagtcccaactactcgggaggctgaggcagggaaatcgcttgaacccaggaggtggaggttccctccgggaaccaagtgcattgagccgagatttgtgccactgcactccagccagggcgacagagcgagactccgtctcaagaaaaaaaaaaaaattaattgtggtttctactctgggacacatcagcagcatctttgttaattcataactcaagatttaaaaataagtcttcagattaatgatagcccaacccaacatgatgtggtaaacagctcaactgaaaccataaacatcaccttgcttgtgtgatataaatagttctataagtacatgtttaatgcattgataggtaaattcctagtagggcaaagataagatcttaattcattcacctatgcatactttgtgctgacgaaatttttaacacgagttccatccctcaaatgtttcaatatcaaaagtctaaaatgcataccatgcttttaccagctgctgggaagttggaatgtatcaaaacgtattcatttctcagttctgcccacactaacctccccattaacttaatattagggagacaagcaatgaatttctggatcagtaagtaaaacctgagacgtatccaaaaaagggcagctgaatgcaaggaaacaaaagcagtctctatcctcacaagaccatattttattaaatgatttcaaaatgcttctctctgtttgatgcattttgctgctgatactcaatatggaagccttccagggagaaagtggttatctcaatcaagaagtgccccgacaggccaggtgtggtggctcacatctataatcccagcactttgggaggccaaggctggtggatcacctgaggttgggagttggagactagcctggccaacatggtgaaacttcatccccactaaaaatacaaaaaaaattagccgggtgttgtggtgcacacctgtagccccagctactcagcaggctgaagcaggagaatcacttgaaccagggaggtggaggttgcagtgagccaagatcatgccattgcactccagcctgggcaacagagcgagactctgtctcaaaaaaaaaagttgccctgacaaaaacaggttagctgtgtaaaaattctaatcttttatttaaaggtttaaaaaaaaaaaaaaaagcatcggctactcaggaggctgagatgggaggatcccttgaggccaggcgtttcagaagagtctgggcaacaaagtgagaccctgtttcaaatttaagacaaaacacaacaaagaagtagcagaaagaaacaaggagacatgagtacatgcaatacactttctccttttcactcaaggattttgctgtcccagtaaatgtgacagtgctttgtacatacaactttgaaagaataggtgcatgaggcaataatgtgcctccatctctccatgaaaatcctgagttctcctcaaaagctcagaaattcccatgccagcgtcttcacaaccaccatttccatgtgattaaaataaacagccaccttttctgaaaaatggataactttgcaatatgttcatggaaaagctcaatgctgttcttacaaatactactcaaggaagttttgtttggaagaatttgaataaaatgtcccacgagagggttctgcaaatgaggcacaaacctaaaaacacagctagtctctgtcacctaaatgagctgctgtggcctggctcatctggtagcaccatgactcgcagttcctgcaaacctcccagggtgcaaagccatgacagatggtcacactactgaaaggggaatacctacaaccacaaccaaagggagaagtccacagaagtccacaaccaaagggagaagtatgacaccttggaaacgtaaacagcatcccctaatcaagggctgcaaagtcaaacgtctacagggacaaggaaggtaatataaataactacgtacaacatctgctgggtattatgcaagaggggatggatggtgctggctgcagctgcagagggtgtgccacacctgaagcataaaaattattatttaaactctgggctgataaaaacctgcccaaatccgtggggggcgggggtgagtttacagcctgaagcacttagcaccctaaccagcagacaggatgtgctcattaaaagatgccattataagcaggaagccttgtgagtccacaagagaaaaaaaggcctgtgaaatgtttgctttgagatccgcagaaagagataaacagtaccaaagaaatgggaggaaagggcttggtgcgatggctcacacctgtaatcccaacactttgggagacaaggcaggagaattgattgaggccaggagtctgagaccagcctgggcaagctaagacccccatctctacaaataaaataaagtaactttaaaaataaaataaaataaaatggcccagcatagtggcttgcaccagtaatcctaactactcagagactgaggcaggggggatcacttaagccccagagttataggctgcagtgagcaatgatgagaccactgcatccctgcctgggcaacagagtaagaccttggaggagacgggagatggggaggagagaggggaggggaagggagaaacagagagagagaaaggaaaaaaagagaaaagaaaggaaaagaaaagaaaacataattaaataaaatcagaaagtaggagatagcacatgtagatttgtaagaaccaacaccggatagcccattaacccccatagatacattggctctggtggggaaaagcaccatgccaattcaagcaaatgtgaaatgaagcccttcattcatgtgtatccactcactcattctttccctcacttacgcaacagctagtcactggaagcttctcgcatgccaggcacccctggctctggcctgaggacatggtgttagaccaacacaggactcttccagagcttactgtgtccagcactgaccagcagaattttcttgatgatggatgtattttagatctgctttgccctatatgattgctacatgtgtctactgagcatttgaaatatgactatggcaactgagggactgggtgggaggagtattttattatgtttaattttaactaacttatatttcgatttaaatagtcacatatggctaatggctaccatagtggatagtaaaggtctaggtagggtgtccaggcatcgccctcgggttggggagaagaaaaagcaaaagggaatagaagactccagaagagtagaatgcaggttttacctccctgtatactcataactttctctataccaatcaaatgcacagcttatccattcctgcctcccacaaccctgtaacataccctcccagatggcagaagttaaaaatgaatggcagatggtgacactcaatgtcctactcaataaagtgtgaccagagcaagactcgatgaactcaggtatctgatccaatttgacccaaactgcaatgctgcccaatgctgtgttctttcctcacagccctgcctggagaaggtcatcgggtgacacagatgctgcatgactatagaaaacaatgattctaagacaacacgccaggctttcctcccctccattctgacatatctcagatgaacaagtaaggacatcatcacgtgctacacctcaatgtcaatggcactttttcaagaggtcagtgtgtcccctccatactgatgcctgggacactgaagttgggagctgatggtcttaaccctctctgcaaaactacaacggtctcttggctccagccagccgcacaaactaacaggaccttgcctctccatgggagtttctgggcatgctcaagttcatgagacgcctaacggaaggggaactcaaatcgcccatggatccagacttccttttctcttaatccagtgacatattagaaactgtcaactaacctaccagaaacacaggaatcacatgaaaaccaatacaccctgacggccctgtttacttgacaggagttggccagctccaacagaggtaatggggcttattggggctcatggccactgcacacgcacaggctacacctggcagaaaggcagcccttctttctcaatagcagttggcctttgttcttaaggtcagttgccagagtcatggtcagaagcatttagaacaggaaacagagctaatctttacaaggactggcaagtagtttcctggagaaaagaaacatgagagagtacagcacaaaaatctagtactggttcagattttatgaaccatcaaaacacagaaatgctaccaagtaatgctgcagagatgtcctattcttcacatttgaagaagttaaaaattgataaacttttgttcattatcaccctatgattgtttgcaaatcagaagactttcttagctattctctaatttacaactgctaatctttgcattactccagccagggcagctatcatcagccccaaatcacacagaagaaaacaagagcagagggtcctgctgggtcacacggttcagggtccagagctaatcgctcaggctgccttggtagagatatttgccataccatatcgtagaaagctggtcagcaaagctgtgatttttagctcttccaagtatattgccccttggaagaccttataaaggtttataaactttagatgctgtctttggtgaaatttttaaaactgctatgtactaggaagctagtcaggtggtgctgtagtctgccacccacatagatgggacagacacagaagggcctgctttacctgtgtgacattcgtttcgtggggacacagtgaaaacatcccttagacatttaaaaagaggtaggaaggcaagaagggggggaacaaatgggtctaatcacacaacatttaggtgattaggcagggattcatgaaaacctagtgttttaaatagtattcattctagcctggtatggtgcttgtgcctatagtcccagctattccagaggctgaggtgggaggattgcttgagcccaggaggttgaggctgcagtgagccaacattgtgccactgcactccagcctgggtgacagagagacacattgtctcaaaaacaaacaaacaaacaaaaataatattaattctaaaatgatgttaacaaatataatattttaataatggcctaagcataaatgccatccttagcatcaaacaaaactcatgaccagcagaactttccagaagacttctgctccatgttgacataatatggtaagttgacaaagaactcactgctccatgttgacataatacgaagtgatgttgtgatttataaacataatgattaggaaaaggagctcagcctaccatctatgacacaagccagttgtggagacaacacatcaatgggtctctgctgcattcaactaattttttcatcttatagatctgtgactctgattggctgggtaatgctattaataaattggtaaaagataagaaccaagattttcaaagttcaaataaagaataactaaataattgcttcttcccagaaggaaatgaagattcttttccttttaaatctgttgtactctttatctcatcacaggatctaattatgaatatctatctttggagaagaggaaaggaggaggaagatagccttgtgaccagaaatctttgctttttaaaaccaccaatgacctggtctaattatctctgcaaaaaactcatctgtgatgacatggggtgaaaccacagtgcaattttcaagaaacattttatgcaaatatatctgctccaactgcatataaattaaaatagtaataaatcaaatcctattttctgattggcttgtattattatttcagttaattcctcttcctttctgaatgagctaacaccacgtttctctgtatccaccataagtataattggagctgtcaaacttaaagagcaagaaagggagggatgagaagaaggaatcatgtacacgttggcctgctgtgtgccagatattgtgctatgtgctttaaaaatgctaaaactggctaggcatggtggcttacgcttgtaatcccagcactgtgggaggctgaggtgtgcagatcacttgcggtcaggagttcgagacccgcttggccaacatggtgaaatcctgtctctactaaaaatacaaaaactagctgggcatggtggcgcatgcctgtaatcccagctactcaggtggctgaggtggaagaatcacttgaacccaggaggtacctgggtgacaaagtgagactccgtctacaaaaaaaaaagagctaaactttatgggaggccattgttttagctaagcacctgcattagacccctacaaatcagaaaaaactgaaactccatttagcatggagtcactcatgctaaatgccacataagcaacttaaaactttaaggaagcagggctgggcatggtggctcatgcctgtaatcccagcgctttaggaagctgaggtgggtggatcacctgaggccaggagtttgagaccagcctggccaatgcagtgaaaccccgcctctattaaaaatacaaaaaatacaaaaattagccaggtgaggtggcactactcaggaggctgaggcaggagaatcactcgaacctgggaggcagaggttgcagtgagctgagatcatgccactgcacgccagcctgggtgacagagcaagactccatctcaaaaaaacaaaaaaaaaaaactttaaggaagcagatagatcccccaaacagaccaggttttcttgaaaacaggagattccagtctacctgagtcagcaaaataagtaggtcccctctgctttaacccttaccaaaaagtaacctatgctaaccaatcaggtgtttttttgtttgtttttgtttttgtttttttttttttgagacacaattttgctattgttgcccagggcaatggcgcgatctcggctcactgcaacctctgcctccggggttcaagcgattctcctgcctcagcctcccgagtagctgggattacaggcacgcaccaccatgcctggctaattttgtattttttagtagagacagggtttcttcatgttggtcagactggtgtcgaactccccacctcaggtgatccacctgcctaggcctcccaaagtgttgggattacaggtgtcagccaccgcatccagcctaatcaggtattttttctattcttctatttccccattcccacctaacaaaactcactgttctactactgcccagagggagcccttattctatttcgaaggaggctgctcagatttatgaatcgcaaataaaagccaattagatctataactaagtttactgtaattttgtcttttgacaaatatgtgattgtatttaatccttatatcagaactgcagacaagggtattgacagagccatctttacagatagagacacggaggcagagttgatcaggggcatgtcagaagccaccgatccgggcagcccgcgcgttcccctccctccgcaccgattaaaaagaggaacaggtcctcggagtgtgctgcagggatctctaacaggagccatggggatctgccatggtaatggcatgctcagccaggtgccagagaaaggtcccctaggatggtgtcaagagtctgtcctccccgtggcagccagtgctgctgaacagattccatgggggagaaaggcaggatgcgtgcggtaggttcacggtgaggaatattccctcttccatttccccagcttctctgagaaggcagattgtccttcagagatttcagccaggtccaacacgacaaatacatttgtcaagccatttcaaagtaacaaacaataatcattattttacccattacttctagggtaacatagagaattcgaattcaaattcaaattcaaataccatttcaaagtaacaaacaataatcattattttacccattacttctagggtaacagagaattcaaataagaagggcataggttgttctttaaggaaggttcttattttcagcagcatctccatggatgtgagagggacagccaaagcacagccacaacgcggcctttgatcatggggccagggacacactcaaaaggatgagtgacagaaagcaagcccccctcgctctagttttccagctgcagggaggcaaggagccgtattccttaacagaagtcacaaagtggaaacgtggaggctgaagaaggctgttgcaaatatttgacgtgccaacaaaatgtttgtttgatttttaattaagttttgaatttcttataccaggtgagtactctctggtccagtcaccaccccacccaaagtttctgaccctctcagccaggccagtgtcactcttgagttaccctcttgactctaaagacttggagtttgcaatccctgttttatatagtcatggggagaaaagaactaaaccccttatctgcagaaaaagtattacccctcttactaacacctcttgtatataaaccactgaaactgggtatgttagtactgtaatagggaaaatagactccagaagagattattataaataaagatgggtaacagtgcagcatgaacagagaagagggaaatccatctctgtccaaggaggcaatgaaaagtttcagagtgaggagccacttgacctcagtcataatggtgagtgggagcttgcagagggaaggggcgccgtgaaaaaaaagacactcgtacaatgaagagcagagtgactcaatggctgaatcacagggactgggccttcattgtcccgtctaaaatgtggatctaacttttcttgaaaaaccaacacagagcagccaacaaaaacccttataaagcaacttgttgagatattagcaggcatgtgcagtccacagtgctaaatcacgtcacgcatcataagatggcagatctggaacaaccggtaagacctcttgcacaaaaagtcacaaagaccatgccctgtctctctaattggcaccaccaggctcccagaactgacatcttatttatcttcaattcttctctttgcactatgtctaatgaggctctgtccacctcatgtaagacatggttcttttgtttaccttctcttctttatgaatacccagaaaggtaacattgcctagcaagaggcattcattagaggttaagagctcacgcgctggactaagactagccagggtctgaaaatcctggttcttctctcagcaagctaccccataagctcagttttttcttctataaaatggggaaagagcagtacctattctcatatggttgatgtgtattaagtatttaacagcacctgccacagagttcatactcaataaatgttagacttcattaatctaattactcatgccttccccatgagccctcttccctttctgtctctgtgtttctctcctctagatcattctcaacaccagcatcatcacaattaatttgccataaacagcagcacagcaggatctaccactctgttcctcttcaccctgcatcacacacctagtttctattccacagcctcacatgtaacgtggtgggaccatgtaactgggttctatagctaacagaaatgtgaactcaagtgacatgagaccatttcaggcttggcttataaaaaacttcatgacagtccatgttctctcctcttccaccagctcatcacaagtgtgcatagtggcatggaaaccacatgctgcagatggcagagccacaaaatgcagagcctagagccctgaatcaccacttagaagagagtcacctgctaattagaaacacctcttttggaaattttgtgaagaaagtatagatttctcacagattaagtcacagaggttctggagtttctctgttatggcagctaacattacctttctccattcttaaacatttggtatgttcccactatctacagaatgaaacctgacctccctagcatggcattcaaggtctcccctaatccaggcccagctactctccaagcccctttctcaccatgaagccagtaatgtacctagtactttccataagtaccaggcattaataaaccttcccaatcctcaaaatctttgctctcagagttccttctatcagaaaggaccaaattccttaatagttgacaaaattcggatcaatcttcaaggaacagttcaaataccatctcctctgaggagctcatgtgatactggttaccatgtcttctggctaccagaatagacagaacagactatgctcactcctttactacaagactattacttatgatatatagccaagtgtctctctgtgttttcacactactgaggacttctggagagagaggctaagagcctttcaatttcatattcttaatccttaacacactagctggaatgagtaggaacttggtatgttgtatagggtaaatttaaaatcataaagaaataagggcacattccacgtatcattaagtagtatgcccagaaatgactacttggcctcaaatatcataaaagtgagaccacttccttgatgtaagttctttgcaggtcaattacctttgttgacagccctggttgagatatacaaatgtgggtcactggacataagaaagacaaatgagaacgttggcaaattcagacagatccactctactgctagactaagagttcaaagcctctaatccatccatcaaaatggataaaatagatgaaaaatcagcaataatctaaacgcaacccaaaatgacttgatacataaattatggcatatccataaattaaatattatacatctataaaaatcgacatagtcccctcttttcctaccccaattctacctccacatgctagtcttcagattctagctgaagtgtcatttccttagaaactggtcccctctgttaggcactcccagagtaactttccctcagagctccttcacattgatttggtataattaattgattattgtcttgctctctaactactactaaataaatgagagtggaaagaatatttctcttttttatttgtaaatagggtgagtgaatgaataaacattcaacagaatatgaaacaaaatgaaaaaaacgtaaaccaaaaaaaataaggttatataatagcatgtatagcatgatcctattttgtaaaaaggttatacccatctgtcaacctaaatacatacacagacacacacagacatagagaaacgtataaataaataacctgtataacctaaattttggaagattcttcaccaaaagctcaacactggatttttctagccaaggttgaaaggatctatgtggagtgatcatgacctcattcaggctcttctttctccctggtacaggccagggttaatttcctactaagtgatggatgaaatagctttcctaaacatgtggaggaagtggcctgctttcttgctttgctcaccaactacaaaaatggcagctgtgatggggaagcctggactgtcaaggccacccgtcagcgagacggcagactccatgtcacgtgccacacagctacactggccacatccagccctgcacagctgcatagcagaatcaggaaaaacagtacttttcattctggtttcccagattgaaccaggttactacagagaggagaaggtgaagaatggagtggggaacaagactctgcctccgtaactctgccacctgcctccaggctgtgggaggaacaccaggtggctcttcatggccattcgacagaaatattagactaatatggaagtcctgcctactcaacctgccactgtccaaatctaaactacagtcacaaaatgaagattctactgaggctacaaatattgggaaaatcaatatttttaaaggctggcagggataaagaaagatatgcaaatggtcatcattatcaaaatgataagacactaagcagcactcctcttcaatactgtagatatacacacctgtaattatgccatccacacacctacgtacatacagagagggttgatataacactcggatagacactaagcagcactcctcttcaatattgtagatatgtacatctgtaactatgccatacacacaactacatagacacacctacagagagggtctatataacatacgataatgtttactaaaaaaccagaaggaaaccaagtcagcataaactcacattctctgccctttgatggtataattttctcctagatttttaccaaataaatagtctaggatgtgagccaatataaaaaatcagaaaaatcctaaacggcacctgttaaacttcaaaaaaaaagcactgaccacgtgcagtggctcacacctgtaatcccagcacttagggaggacgaggcaatcgcttgagctgaagagatcaagacctgcctaggcaacatggtgagacatcatctctacaaacaatacaaaaattagccaggcgtggtggcacacacctgtactcccagctacttgggagactgagatgggaggatcacttgagcctggaggcagaggttgcactgagccaagatcacaccactgcaatccaggcctgggtgacagagtgagatcctgtctcaaaaaataaaaataaaaaataagcactttgcaagtgtttttttgttttgttttgttttgtttgcgatggagtttcactcttgttgcccaggctggagtgcaatggcgcaatctcggctcactgcaacctccacctcccaggttcaaacgattctcctgcctcagcctccagagtacctgggatcaccggcattcgccactacacccagctaattctgtatttttagtagagacacggtttcaccatgttggccaggctggtctcgaactcctgacctcaggtgatccacccacctcagcctcccaaagtgctgggattacaggcatgagccaccatgccaggccatactttgcaagcttttaaaaccacaatggcagcagctgacatggaatgatgttcataacatatgactgagagaaaaataggtttcaaaacattatgcactgttttgattcaatttttgtaatgtaaacatataatttacaattattaagtaaacatgcaatatataaatacattaaatatataaatataaaacatgtaaattatataaaatatatactacgtataaagaataactgtggctgggggaattgttggtatttgctgttttcaatttttttcttttttttttaacagacagagtcttgttttgttgctccagttggagtacagtggtgtgatcatggctcactgcatcctcaacctcctgggctcaagcggtcctcccacctcaacctcctgagtgcctacttctttttttttttttttaatgcaatgtgcatttaagaggggaaaaaaagcagtaacagaaaaaggaaacactaaaagaaaaaggaaaagaaaatcctaggctgggattcagaaaagcaggttgatctaagatctcagtaggccttgaacgactattcataatccctcccacccaaccgctacctgctcccaccagcacagaaagaccaggcaatgacagactaacctgtataacctgaactttggaacaaaagaactaaagagatgcagcatctcatttatatatatacatagggctgacatatgaattccactgtgggtactgcctactaaacctttcttacattctctgtcacctcccctcatcccagaggtctaaacttctgtcttctaagtttgattgtttcctaaggcactgccatgttcatcaaatcagctaggaaaaaagaacaaacaaacaaacataacttgtggtcccttaccaagagcaaaagaagtcagctactcggtgtaaacagggaagaagggaggcatcacacaagagtggatggtggagactgtggtcaatcagctggactgctgctggctgtcccggacaggatgtgaactcagcaacatccacctagcttcagatctttttaaagagaagctgaagacctagatgtctgggaaatctctctatttttcaagggtccatgagcatgcccttggggtgagttgcttagtttcctgatctggaaattggagaccattaagaacatgtctctcacaaggttgttgtgaagtttcaatgagttaatctatccagaatacctagaaagttaccaggcccagagtaagcatttggcactcatcatcttccaaccaccagcatccactggccaccagtttgcaacccctgggctgctactacctgagggccagggggtccctgagggacgaagatatgctatcgtcatttgtccaattcctggcacgctgttggcagcagcattttctgaacacatcaatcaactgtagaacaattcctaaaaagttaagctccacaacgcttttctggcatcatcaacccagttcccctaacttcaaagggtgtgagtgggaggccaggcatggtggctcacgcctgtaatcctagcactgtgggcggccgaagtgaaaagactgcttgaacctaggagttcgagactagcctaggcaacatatggagaccctgattctaccaaataattaaaaattagccaggtatagtggcccacgcctaaagtcccagttactgtgggggcgagaggaggtggtggtgctgaggtgggagaattacatgagcctagaagtgcaaggctgcagtgagccatgatctcaccactgcactccagccttagcaacagagcgagaccctgaatcaaaaaaggggtgggagtgggggtatgagtgggctgtacaacaagcacagtaagacagctccacaccctagcccccaagaagccctgccatttactgtgctttctgaattccactctgcactggagactcagggtccaggagtctgaggaggcgtcaggtctgaggaggatgggaacagatggcagtcccaaaagtgcctccttgtaaccactgatctatcaggaatccataagctgctcctccctgccctgtcatttgcttacaagtctgcctgctgagaaaaatccccatgaattcttagggtccatatgctgttctggaaagttggccctgtttcaggtagagaaagaaagacgctccagtgctttcctaccacagcctctcctctggcctaggttccagttacctttaagaaactaactgttatcacagccaccttgccagtgaggtttaccttgaggcaaaacctcaaatgatcctgcaaactgaggatggatgacagtgatcaccactgcacagtaaatactcaacatgtgtgagaccccaaactaaatgctctcagcaatccttacatcaacctttgggctaagtatgaatattcccatttcacagaggaggaaaacaaatctcaaagacgtgacacaacacaccaaatgttgacgggtagagcgcagattcaaaatgctgtttgactctgaacagagggcctgtcatgaattcaccacataaccttctagacagactccctgcaccctggaaaaatgccttagtgtctcattgtatcagttatggggtatcacaaatgcactcagcatatatctttgggagaatgcttacccacatccagtctttcctgctcttaatgccaatggaaatctgtcggcattattcccttgagcacctaattatatgttgggagctaactaatctccctcaaaaaaccacaggccattacagggcaagggtgacaagaaccattcctacatgacccagctcagcaaagacttgttaaatgagttcttaaacaattgtagctagattctaagacaaactagcttttttcaatactttgcatatttttctgaattcttgacttctcgacaaagtccaccctgatcaccccatgtaatactaccacctgctacctgcctggacattttcaaccctctgaccctgccctactttttcctttgcccatagcccctatcaacttctaacatacctcataattactgccgggcgcggtggctcacgcttgtaatcccagcactttgggaggccgaggcgggcggatcacgaggtcaggagatcgagaccacggcgaaaccctgtctctactaaaaatacaaaaaattagcagggcgtggtggcaggcgcctgtagtcccagctactcggagaggcagaggcaggagaatggcgtgaacccaggaggcggagcttgcagtgagccgagatcgcgccactgcactccagcctgggtgacagagcgagactccgtctcaaaaaaaaaaaaaaaacaacaactaattgattatgtttataatgtgtcatctatcctaccctacctgccatccccactagaatgtacagatcccaaaggcaagactggttttttgttgttgttgttgttgttgttgttgttgttgttgttgttgttgttgtttgagacagagtcttgctctctcacccaggttggagtgcagtggcgtgatctccactcactgcaagctccaccccccaggttcacaccattctcctgcctcagcctcccgagtagctgggactacaggcacccgccaccacacccggctaattttttgtatttttagtagagacagggtttcactgtgttagccaggatggtctcgatctcctgactttgtgatccgcccacctcggcctcccaaagtgctggaattacaggagtgagccaccgcgcccagccaagactgttttttaactgatgtattccaagggcctacaacagagcatggcacatagtaggtactccataaatatttctaatccaactgaaatgaaatgaggatcctggccgcttggtgtctcacattcctcacctgcaattaagcggttgtagtgctgcttatttcatgagaatgagaaggcaagagacacatgtgcagcacgtggcccagtgctggcacgcagtaagcgttcagtgcatctctcctattctttaccctagaaatcgaaatctgcattgcattctgtacctggcttcatagctcaggccattgattactaccctcaagttgtttctgaatctgggagagccattcttcattaaatgcatttcctcttagaaagagcgatttgttctacacggatgctgagcatttatttctatcatagacaggagcctataatgttgacaaatgtgcgtaatgatcagtaaacaaacacaggaagggcagggactgaacttaatttaataggctgcctgagcactgagatactttttttttttttaattcccaggatccaacgtcaattcaatactggaagcctgggcctccaacaacccttcagtttcattcattaagtgaaagagaaagactgtccaaatgatagggaaagcctgtgtagcaatgagctattcacattctgatctccccatgcaccctgatctcttctctaggacctagagggcaagggtgtgtcttaatgcatctttctatctatcccctggccccggctccatgaatggaccaaggcagtgactcactaaaatgagaaagagagcagggaaggaggggaagaagacagggaggcagaaaggaagacagtaagagagtcaaatcaagtagagaaggagggagggagaggagaagggaaggaagacagagaaagacaggagagaggcagggtggggggggtaggaaagagggtagagaagaaggaaaactaggactgttcatagtgggattttaccattttagtgaaaaaaaaaaaaaagaaagaatgaaaaggaaatgaagaaagactaagacttttatatgttcctacaagtgtgaaaagatattcaggccgggcatggtggctcatgcctgtaatcccagcactttgggaggccaaggtgggaggatcacttgagcccaggagttcaagtccaccctgggcaataaattgagatgagactccatctcatacacatataaatataagtacaaaatttttttttgagacacagtctcactccgtcatctagggcagagtgtagtagtgcgatcacagttcactgcaacctctgcctcccggattcaattgatccttccacctcagcctcctgagaagctggaactacaggcacacaccaccacgcccagctaattttgtattttttctagagatggtgtctcactatgttgcccaaactggtcttgaaccctggactcaagcaaaccaccctcctccacctcccaaagtgctgggattacagacatgagcccccatgcccagcctaatagttatatttttaaaacaaaaaatatatatattcaaccaggtaacactgaatgcctcaaggtgggagtgagggagagttgaaactggggttgggggttgtgggagagaagaatgcatgcactctttcttcatgcacctgtgtaattaatgtttgacttgctccaggattgggacagcgtgactgcagcacagccagccagctgaaagcacaacactgagaaaagcaaatttgggaattgctgaaggggaaagagaggaaaataactgtggaattctgggtgcttcccaggaggccagtattacagcttagaggccaaagcagtcagcagtcaagagctggcatgaggccagtacagctggaaacacagcaggtggagtgaggtggagggaaggaacacgcaggctcagggatccggcttaggaaaaatcaggctgggggacttaaagtaaggtgagcaggaatcataactacttaggtttacctctgtgcaaagttttctactgaatgctgggacagaaactcaaaaccttgcccttcagataaggctaaatattacaaaaagaaaatttccaactttcctttctccctaaccccacgcagtcattgtcccttattggagcagcccagaaagccctggatgaatcactggctgctattctattctgcctgggtcggtaacagttctccacctgttcctgtctataagcaaagacattctctttgtctgcctcccagtcttctgcagtcaatacactggtgtcaacttatcagagttctcgctctactaaccagttgtgtaacctggggactgaccctctcagacttccaaattcctaactgggaaaactgggaaaattaacagaacatagctcatggggttgttgtaaagatcaaattaaataattacattagcacaatgactagcaatggaaagcccttggtaaatgtgagctgttacttttaggcaatgcttcatatactgctcacagtccctataatataggtgcttgttagagttgacttaagttttctaacattaagtagctagtaaatggcagagctagaatttgaatccatattaaaaatttatgtacccaactaataattattttgtctccaactcttcctctccactgtcttccctttctttaatacatattagcctgtccccttctccattctaccttcatcaatttctctttctctttcctgtccctaacctgcacacactggaggccacaaacacacactctaagcataaagctgagtgtgagattaaaacagaagaggatacaaatcagaacctattggcagtgtcttctaaagccaaacaaatgaaagaaaggagtgtttatgtctaccaaaacactcagacaataaatagagcagctttattgaaaatagccccaaactacaagctacccagatgcatatgaatagaaaaataaatattttattgtatgtacatgcaagtgaatattatacaaccaataaaaatgaactactgacacacacaacacaagggtcatgtctcccaaacatactggacaaattaagccagacataaaagagtacataccatagtttttatttatttgaagttcatgagcaggcaaaacaaatatatggtaatagaagaaccggaacagtgctgacctctttaagaggagagcactgagtgggaaatagcacaaggagtctcccagggtacttatgatgttccatatattaatctggtgatggttacacagtaatacctcaattaaaaggtcacgaagttgcacttaatattaacacactttatgtattccagacttcaattctaaaaaaagaacaaaggtaataaaaataatcagaatccatttcactgcagaagtttccaaggttctggggcagcggccaagatggcgagctttggtgctgtccgtgggtaaagtgctgatttgtctcttggctgagacctcagataacctcatgtatgagaaggagaaggagtagatcaggacacatccagtgacgtcacagccaagtacatctgctgctctctggacccacggcaagctctcaggcctgcagaggtttgcagcaaaatctacagcaaagctcgtccacagctgagctgcttgtgcttactctacatagtgttcctgtgataaccctcaaagttaattcctactgcttattttctggcacatctgatgctttttacttggtacattatggcactttggttctctatcttctccttatctgagcaagggcttcatgcctctaagatgtttattccctctgatcacaaaggtttcagacaaagggggactgctgaaatccactcatttggttatcaggcacgttattgcattattacattattacactttgtgggagagaaggacagcatgtgtagagactggacagtaacagtgtgtcaagacctctgcatatttgatttcaacacaggtgccaagaaaatttaacagaaaaagaatcgccttttcaacaaatggtgctgggaaaacttcacatccacatgcaaaagaatgaagttgggaccctttcctatgcaatacacaaaaaaaatggaccatatacctaaatgtaaaacctaaaactatgaaactcttagaagatataaaagtaaatcttcaaaaccctgggtcaggtgaagcctatttaaatataaaccaaaaccacaaacaaaagaaaaaaaatagataaaagttttgtgctgcaaatgataccatcaagaaagtgaagatgcaggctaggtgtagcagctcacgcctgtagtcccagtactttgggaacccaaggcagacagatagcttgagcccaagcattcgatattagcctgggcaacacagcaagaccccatctctacaaaaaatacaaaaattagccaggtgtggtggcatgtacctgtagtccaaactactcagaaggctggggtgggaagatcatttggacccaggaggtggtggttgtagtgagccgaaatctcaccactggactccagcttgggaggtaaactctgtctcaaaaaaatttgtttaaaaagcctctgtctcaaaaaattttttaagaacgtgtagatgacccacagaatgagagaacatacttaaaatcacacatctgataaaggacttgtatccacaacatataaagaactgttactcaataataaaagacatataacactatttttaaatgggcaaaccatcttaacagacatttttccacaagatgatgtacaaaagaccaaataaacacattaagagatgggcaacatcattagccatcagggatatacaaatgaaaaacacaatgagatcgacttcatacacctttgattggtgtacaaagacaggcaagtgctggtgacgacgtgaagaaactggatccttcatacactgctggtgtgaatgtaaaatggtgcagctgctttaggaagcagtctggcagttactaaaaacttaaagagtttccatttgaaccagcaattccattcccaggtatgtacccaagagaaatgaaaacatatgttcacacaaaaacctgtacatgaatatccatagcagtattactcaccatagccaaaaactaggaacaacccaaatgtccttcaactgatgaatggggaaaaaaatatgtatctatagaatggaacattatttagccattaaaaggaatgaaaagccaggtgtggtagctcacgtctgtaatcccagcactctaggaggctgaggcaggaggatcacttgcagccaggagtctgtgaccagcctggacaacacagcaataccttgtctctacaaaaaacaaataaacaaacaatggaataaagaattgacacatgctactatgtaaataatactgaaaatactatgctaagaagccagtcacaaaagacctcacacagcagttcacatttatatgaaatataaatagccaaatccaaaaagacagaaaacagatttgtagctgcctagaacttgggggtaggggagtgatacagaaaaggtaaagggtttgttgttgagatgatgaaaatgttaagttagacttcagagatggctgcacaattctctgaatatatttaaagtatttagttgtaaactttaaatgagtgatttgtatggtatttgaattatatcttaataaagctgttatgtatttcagaaaagaaaggaatcaggaaaaaggagaataaatgactacgaaatttacaaaatgttttttacaaaacccttaaggctactgaggttgcatgaggaaatggaaaaaacacatgactatgaccaatgtcagaggtgcacagatctatttgtagctctgcctctccatatcgatcagccccatgaccttggtaaagacacttatctcctccaggcctctctgaaaatgaaggactacaataggtcatactgtagttcccttccagccctactatatcctcattcttaaagatgcattacagtttagtgaccacagcctaacataataatgaagaagaagataaaggaataataacagctagtactgactgagctcttacttcacgccactgctgttcctgtctcagctcgttaaattttcacaacacctccctgagaccgctgttatcctcattgcacagatgaggaactgtggctgagaggggatgagagttgtggaatcaacatagaaaccaaccagtccacattaaagcaagtggacagaaaacagtaagagggaggaaaccaagcattcgttttttaagggactgatggattctttaataggtttagctatgctgtgagggtttttcagttctgctgtgagggtttttcagttttgctggagagtttagggaagaattagagatgaggatgaagaaaattaagcaaaaaaaaaaaaagcaaagcattttattcacgtcataaaaaagcaatacagctgggtacagtggcacatgtctgtggtcccagctactcaggaggctgatgcaagaggatcacttgggcccaggagttcaatgctacagtgtgctacgatcacgcctgtgaacagccactgcactccagcctgggcaatatggtaagaatccatctcctaacccactcaccaccccccccaaaaaaggcaatataattatagtgtcctatgtggctcagctgagaaatgctgatgtactgatactactatgtagttaggaataaggtagacgggaaaaaagtgtgggttttacggagtaaaacaaaattaaatcctcaacttctttaccagggataacagaaaataacaatagataatacctaaaattgaaatcacaataaatataaatatgaacatatcatttctaaatatagagggaaatgccagaaggaacagcttacagagttaaaggtggtgccctctgtgatgtcacactgaagaatgggcagcagtgatattaaagattaatgtttttgtgataaatcttaaagtacttttgaatttcttaagattatctgcatgtatcatgcttttttttttttttttgagacagagtcttgctctgtcgcccaggatggagtgcagtggcccaatctcagctcactgcaagctccgcttcccaggttcatgccattctcctgcctcagcctcccgattagctgggactacaggcacctgccaccacgcccagctaattttttgtatttttagtagagacggggtttcaccatgttagccaggatggtctcaatctcctgacctcatgatccgcccgcctcggcctcccaaagtgctgggattacaggcatgagccactgcgcctggcctatgctctaatttttaagtaaaaattaaattaacacaaaacaaaaaccttatccaagtttaagctgggactcaaatgcaagtgtgagtccaaattccaggctgtgatcaacatactctgtggtccaacttatgggaccttttcccatatgggatttatataaactgctgttggagatgcctttatacaaattaagtagtttttgacataatcaccaatatgagtcaatgtatgggagagaagaaatgaaactctacaaggtacaactccctctttaccaacaaacacgaaactgggatgagtaacatctcagggcatggacttatacaatacttagggcacaaacataaatgttggcagcctccctgaaaatgtgagcagctctcaaacacccacagatattttaatgtgtttttctccacttgtatccacgtagagaggttccccagagatgacctcaatttgaatccagaagaagacagcatgcctctaagacacttggagaaagtgtcttagctctcagacatgaaatcagtaaggtaagaagaaggtgggaaaatattttcctaccaaaacagtcacctgtattttagtttaactgattcccaggttcaagcaattctcctgcctaagcctcccaagtggctgggattacagacacccaccatcatgcctggctaatttttgtatttttgtagagacaaactcaaaagctttctgatcactggaaaagaacctgatcatctatgagaacagaacaccccataacaaaacaggaacatggggccaggcatgtggctcatgtctgtaattccagcactttgggaagtcaaggtaggaggactgcttgagcccaggactttgagaccagcctgggcaatatggtgagacactgtctctacaaaaagtgttttaaaaaattagtcaggcacagtggcgcacacctgtgacaccagcttctcaggaggcttaggcaggaggatcacctgtgccgaggagttggaaactgcagtaagtcatcatcacaccactgcactccagcctacgtgacagagtgaggttctgtctcaaaaaaaaaaggaaaaaaaacacaggaacacggacatcacaaaaccacactgggctttggcaaaacctcacctaacacggtttccaggcttcaagtcaaaagttggatataagaatgcagacttggccgggcacggtggctcacgcctgtaatcccatcactttgggaggccaaggcgggcagatcacctgatatcaggtgttcaagaccagcctggccaatatggtgaaacctcgtctcgacagaaatacaaaaattagccaggcatggtggtgggtgcctgtaatcccagctacttgggaggctgaagtaggcgaattgcttgaacctgggaagcagaggttgcagtgagccaagattgcgctattgcactccagcctggacaacagagcgagactcagtctcaaaaaaaaaaaaaaaaaagaacgcagacttatttttttatttgccaaaataaagaaaaaataaattattattctctaccatcctcgaataagtgtttattataccccaatattagaaggaagaaataaaagtaaaagataaagcacaccagtgacaaaatggatatgtttcccaccatgaatgcatatttcgtttgtggcagtttaaatattacactttgcttcaatgctgtctgctggttacaaatagcccagggccctgctcctgatcacagctcaaaggaaggctgcctggactgatttaacgaccatctccaaccagaagctgcctccaatttatctacgaaacaggtataggtaggggaaagagcagaggtgagtatggttttctgcagtgggcagtttccttctccaaggccttcctccacatcattcagcccgcctgacttcctttcacctgcccctgctgcctgagctcctgctgggggttgcagtgatcaaagtcaatacaagcctcactttagaatggcttccataccatcaatccacgtttgaaaaacaaccaccaaaaagacttgtgctcattggtaaacaagagtatccccaccaggcaggcccacagcctaattgggagtgactcagctcatcaatgcaccagactcggccgaaaatttctcaacttgttgatacaaagctagacattaaggtggaagcggagagcaaagagaagcatttaagttcgctgggagtcccagggtccaccattaagccccctgttttcggcaatcattttgcattgctaaggacagtggaagacctggccccaatccaccacagtaggcagaatctgaatatgggagtaaaggttccaagcagagagaagtcaggcgattaagggaagaaacaggtctctttaacaattaaagcctaccttatgatcatgttattacacttggaataaatgttacctaggagacatcatgcttaaagcttcacatattataacaaccttgggcaacctgaccacctgtgacataatcccagctctactatgtgctggctgtgtgttctcaggcaaagttcttaacctctctgtgctcagaatcatctgtaaactgggaataatcatgagttctacaactcaatttagagttataaggtttgaagttgatagtctaggtacaatacctggtacatagaaaggagcaaaatggtagcattatcatttcatgatggttattattattattcccactttacagactaggaaaccaaccttagaaagaatcacaaatttgtctcaagtcacacagctgataagtgggctgaactgggtctgtctgatgaactctgaagcccattctctaattacctattacagtctctcctctccccttgtagttcctgcccttgtcatccctaacagacacatggcatcagctactagaatctgtgtgattaaaaagttgggctcagtggctcacgcctgtaatcccagcactttgggaggccgaagcaggagttcaagaccagcctgggcaacatgatgaaacccagtctctactaaaaatataaaaattagctgggtatggtggcacacacctgtagtcccagctactcagaaggctaaggcaggaggactgcttgagcctcagaggtagaagttgcattaagctgagattgcaccactgcactccaacctgggtgacagagcaagaccctgtctcaagaaagaaaaaaaaaaatagccttggaagaaaattcctgtaaaaacccacacagtagtaatgataacagtagtaacagtagtgctggcagtgatggctgctgtcatcatcacagtagtagccaaaatcagtgacccttagcgcatgtcactgtgggctaaatggtatatatacaacatctcatatcccctgtcaggaaggactccatgtgtcacaattcagccaaaacatcagggatttggaaatggtatcaccaaaggagagctatatgttggcaggacaattatgaacaagaaatactgctgactggtcccaaaacaaatatctttatgacagatgaggtgggagaatcagcatatgaaatggccatgtcataaaagtagcattccacgcttcaaacttgaggagataataaacggctgacaactagattccaccgggagaacatcctcactagcccatcacagcagcaaaggcagggaagaaacacttttaagttttattcacttagttccactgcactgagagtaaaatccaaaaaactagttgtaacctcctgaattaaagaaaagagaaagatactactgttggcctgggacacatctcagcaatatctcatcactttcgtcctcttccgcattttcatgggaaataaaatatctctggcgtgtgtgtgtgtgtgtgtgtgtgtgtatgtaacagggtctccctctgtcacccaggctggagtgcagtggcatgctgccacctctgcctcccgggctcaagcgatcttcccgcctcagactcccaactagctggggctacctaattttagtattttttgtagatacagggtttctccatgttgcctaggctggtcttgaactcctgagctcaagcgatccacctgcctcagcctcccaaagtgctgggattacagaaatgagccactctggcatctgattttaactcttctgcaccctgagattaagaaaggcaagcactgggacttgttcactgctaaacacccaatactcttagataagagagtacctggtattaggaaacagataataaatatctgatcaatgcataaatgatggatctaaatctcttgacaaagccaagtgcagtggctcacacctgtaatcccagcactttggggggccaaggcaggaggatcactcgaggccaggagtccaagactaggctgggcagggtggcaagaccccatctctaaaaaattttttgtaattagctgggcatggtggtgtgtgcctatagtcccagatactcaggaggctgaggcaggggcatcacttgtgcccaggcgttggaggctgtagtgagccatgatctcaccactctactccagcttgggtgacagagccagaccccttcctcaaaaaaaaaaaaagttaggacttccatatgagtataataagctcatcacacatttgtaagctcatcaaatgatttttattttgtcttaagaacgtctaggtgtacaggaatgtgttctcaagtctatgggagggggattcagctcctagtgttcatccaagcacttttttttagcaactgggctgaataggagaggaagcccttaaattcctttcttcatctaagtaggttgtggtcaaaaaggcataagagcctctggaaagccagtagaggaaacggccctagctaggcagtgcccatccaaggcctgtcaagaggagatcaagttctatcacagatcaaatgacaacacttcctattccccaagcaaccttcagtttaggaaactcctgacttcccctctgaggtttgccaacagggagaaatgcattaaaatgcaacaataaacattctatccaaagaaagttggttttctttctgtaaattcataagcagtcattttgatctctgtatcattctctgtgaggtgggttgatgtgagtttcttgggaaacaccctttgtgaggctccttgggatcactctaagatgtacctttcagacaggcttcttcagttagtaacagaaaccaactctgcctaacttaaagaagaaaaagctgtttactacatggacacaaaagacaaagctgaagaaatcgccttaggaaggtaggaaatcaaaataactctaaagacctaggaggcaggaactagcaatctcttctgttcacctctgggtgaatagtttttatatcactcagttccatactcaaattcaggaagagtatgtctgattgacagagcttaagttacatgttttcccatctacaggatggcagggaacctcggttgaccatcccattaagactaagggagacattcctcaactggggggaaaaaaggaggaggcaagagagagaaagaaaggaaaaagaagagaataaatcagaaaagaaaatgtgcacgccaaaaatgcacaagttgaccaggcacagtggctcacatctgtaatccctgcactttgggaagctgaggcaggcagatggcttgagctcaggtgatcaagatcagcctgggcaacatggtgaaaccccatctctacagaatatcagaaaaaattagccaggcatggtggtgtgcacctgtagtctcagctacttgggaggctgaggtgggaggatcacttgagcccaggaggttgaggctgcagtgagccatgatcacgcaactgcatttcagcctgggcaacagagcaagaccctgtctcaaaaaaaaaaaaaaaaaggaaaaaagaaaggaaagaaaagggaaaagggaagagaaaggacaagttgacctcacaaacaagcagtcaggtatcttagctgcccctaaccagtggcctacatcaacaatttatacacccatttatctccccagtttcttttaacattccagtcatttcgtggctcaagctgtagtaaaacgtcacaggtctggcaataccacagccactcaagtgaagagtacagtttaaaagcatatgttcgaaatgagcccaaaatattagcaaatggcataaaaaaggattcaggcattttactacacaacagttattgaagttggattttgtgttacctaaacaagttgaaaaaaatatttcacaaaaccctcctccacagaagttgtactagcaaattccagtctaaaagaagtaaaatcaaataattctgaaacgcaaccctcaagaataaacaagaatatatattttataaacagggtgggtcacagtaaggaagaatttaatacttgctagacaaacaattcttcacaacaattataacaaagacttagctctggaattgtacagaaactggcaatttgctatgagattctacttctggaagaccacccagtttacatggaatgtgtcctttactgaattattaatattcacaagtttcagaagatattctatgaaaaagaagtgttgctttaaacactggcatcagactatccagttgtgagacaaatgacaccttcctgaattgccactgcatttcccactgttctaaccctctcctcagtctgattttccctgtctcttgccctcagacagagggagaaacaatggctgcagcagtaacaactgtttatcttaggttttgtgtacacatgaattgcctgtgggcgttttgcaaaatgtcactcccccgaataaactactggagccagaacatttcctgttcatcgaaagaaataaacttttcagtcttaattccccagtctaccaaaaagaaaaaagaaaagaattctttctgaatcattccctaaaaggcttttaaaaaaaatcagaaagaaggaaaatgaaatgagactctagcagaaaagcaagacagaatacacttatcttaaagggaaaagaacaagaatgaaaagagcaagataaacagagagtagaagaaaccaaccacaggttttattaaagggatttcaaggtgatggtcaactaattagattcctgaattcacaatgtaacagaaagaaaaacacgtccgaataaagcctaccaactctctccaccctgccatgtgctgccttttcttagatacaacaaggaactagtgacactgtgcatatagcacatagcgatactgtgcatgaggtatccaagtgcagactcattactgatacacaaggaaaaattgtaccacatggggtggaagaacgaagggagaacttgaccaagctcccatctagaaacacacaagataggtgaacaatggccaaaaagtacttcccttaaatacaaaaagcatggcatcaaaatgtgagataaaattaaggaagaatacatttaagacaacttgaatccattttctaactactaaaatactgagctattaaacaactaattttgctatcaaatgaacaaagattttcttttcttttttctttttttttaagattcagggggtacatgtgcaggttagttacatgggtatattgcatgatgctggggtttgggcttccaatgatcctgtcacccaggtaatgaacacaatcccaccaggcatttttcaaccccttcctccatctctccatccccactttgggaggcccagtgtctgctgttcaacgttagttcccacttataaatgagagcacatggaatttggttttctgttagaggaacagagatttaaggattggagagagtataagaaaatttgtattagcatgatatgtaccaaaacctaaagatctaaaaccaagtaattccacatgtaatatttgtctcaaggaaatattcagagagatatataaggctgtatgcacaaaaattgttcatcacatcattgtttatgaaagcacttcagaaacaacctaaatattcaacaaaaaaatcacatataaaataaattacaaaacagtcataaaatagatacctggatgaaaaaacgttttcaggtcgggcgcagcagctcacatctgtaatcccaacaatttgggaggccgaggtgggcagatcacctgaggtcaagagttcaagaccagcctggctaacacagtgaaaccccatttctaccaaaaacacaaattagcccggtgtggtggtgcgcatctgtaatcccagctacttgggaggctaagccaggagaatcacttgaacccaggaggcagaagttgcagtgagctgagattgtgccactgcactccagcttgggcaagaagagcaaaactctgtctcaaaaaaaaaaaaaatagttttcacatatattgtgaacgttattccctatcaagtataatgagggggaaaaacaaaactcagagtgtgtgatatggtttggctgtgtccccactcaaatcacatctggaattgtagcttccttaatccttacatgtcatggagggacccagtgggaggtaccttaatcatgggggtgggttttacccatgctattctcatgatagtgaataagtatcatgagatctgacggttttataaagggcagttcccctgcacacgctctcttgcctgccaccatgtaagacttgactttgctcctccttcaccttccaccatgattatgaggcctccccacccatgtggaactgtaagtccattaaacctttttcctttataaattacccagtctcaggtatgtgtgtactagcagcgtgagaacgaactaacacagtacgaaatggttataatttatacaataaatgctcatgtgcttataggtggcatctgtctgcatgtgtatacatgcatacacacatatacactcatactacataatactatttaaaaatcaaatattgaatggtggttatctctgagcggagatgttacagttttatttatctatattatctaactatgcaaacaagtataactgaaagcaaaaatcaccttacaaagaataatgtgctatatacttaagtttagaactgtaatgggccaacctttcattccattgagaaataggctcttatattccgtatctccctattttgcatagttttattacctaataagatactgtttcacaccaattctgcacagaaagttcatatgtaaatgtcctattattagcaagattatatgttgtattttttgacagtcaaactgcataaatggatgaggacaagaaaatattctaaatagcaattttttttcatttggtacatcaaagggatttttcatttaatctcaaataagcgtgtctcaagattctctttttaaaaaaataataaaggcatgatcttcagcaaagactgagttacctccaaaaatacattctccccttcctccaaactctcagttgagcatatggctgccctcattaaaggcttttgttgcagctagttatggccacacgagcaaggtctggcttatgagatgtgagcagaagcacagtgtgtcatttccaagccgtgtctgtgaagagaagagacctgctctcctcttgtctccgtctcactagccagaatgcacaggaggacaatatctctataatgacagagcaatatatgagacagaatctcagtccccaaccttgcagaatcacagtagcgtaggactgttacatggctagaccgttacataaggtagaaatgaacttctactatattgaagccactgtgatttgaggtaactgctaatgcagccaaacctatatgttggctgatacacagaaagcttgaacaaaataaccagtattgaaccagtaaactattaatttctcctacctgatcctacacatctcttctccaaaaaacatttcagaatgggtatacaccactgtcatttcttaataatttaagaaaataaagtacctagttaatgtcaaaggcttctgtgcaaactcataaaatacaaggtgcacttaaaataaatataaaatactgattaagaatagtctaagttgaaaccaagattctcagacatgagtaaaataagtatgtatgccatctcaaaaaaagattccaaagatcatatgcatatttttatctgtatagaaaaattgaaaaaatatatcccaaactggttgcctctggaggattagaattttaggttgagaacagaaggagataacaggaaaaatttagttttctactttatattcctgtgttttatttgaatttttgccacaaacatgtattactttagtaatacacaaaaactacaaaaataaagcacatattagaactctgtacagcagactgataccagaaaaaaaaaaaaaaaagggcaggggcaagagggggaaataagatttctatctacaaataaaaccacagccttctgaattctgggatgtaaattcataaacctgtaacttctactgtgcattaaaaaaaactataacataccataaaacctgtatctatttctttaacttccttacctttaccaaataccacaatttctcttagacagagacagtaaacataaaactcatgaaaaactaaagagacagaaaaataaaaattctatgtctggttaggacgttaataagctcacaatcataggacaccactattatctaaggcacagtgttttcaatttggatagtaagtcagttcatctttgagcttcgatcaatgtcttaaagctttcaagaccacatgaggatatggtacattgcccattatctcacttactgagtgacctattattcattgaatttatttccacacaagagaacagcatagatacagtatcctaaatgatcatgcacataaaacaaacattaacatcatattcatcgttagcaactattagaacctgtatattacactctcaataactgactgtatcattcaagttgatattagttcaatatggtatattctgtgtttcataaagaacctatcaccaaactaagattttttgagatcagcaaaacccaatctttataaaaggtgcccagttgattagcgaaattaccttctctctactgtgaaaacaattcccactatccaacctgatggtaagaaagctgctacataattgtgtgtgaaggccctgaacttcaaacattcctagaacagatttttcctaatggtgacaggacttaaaatctaagaagccatatgaagcatcagaacccatctcaataactttacaaaagcacaagaatagtcaaggagaggttgagaaaggaagactatgtctttcatcttcagagtcagagccaagggaagtactgagcagggaattagtatatgtctagcattggcaaccaaagtattcaagaggcccattataaacctttatgtccaaaagaattcctatgaggctacgttaagaagaaaaacatgttggaatacattgcaagttaccactggcagatgttaagaaaataaaattatacaagtagtaaatgggataaaatttttaatgacattagaaatgaaaggagatttagaattaaaactagcaactggattcacaagtcttaaacacacacatatacacaagtacatacacatttaagaatctttaagattttttttaaacactcaaaaatgaaatactgagtttaaagaactaaaagctttaatttctcctttctaaaaaaaagaaaaaagccagaagactggccaggatgcccaagaccttccaattcaatgctcccaaaaactatgaaccacaaaatctgacagatggaaaatggttattccaaggggtttgggattctacaggtacaccagaaattatctgtgcgctaaaaaaatgtgagtaaaagtattttctataatatacagatgccatatatgtgtgtatgtttatgtatatatttatatatgtgtgtatgtatacatatgtaacaaatataatattacaaagatataatgtataatgacctctataggctagtactattcattatcagattcatagcagttttccaaaaccaagagacgctaaaagtacaactaatattaagtaagcatctgtgaaactttctgaagcatagcctctaaaagactgaaaccaccacactaatccagagtgatccttcagttgacctggctgatataatgtccatgggtcagagtgagatggctgaattaaataagcaaagaaagtaatcatctgatatgtaggagagaatgtgggcaaggagatgggaaagatccatcactttaaaaaggcaagaaccccttctgtttctgtctttttagaagaccagttgctgctacatattttgtatctgcacagacttttctcttctgggcttagcgacacactcaacattttcagtacagagtcatgattctctgttctctcctctattcagctacatcatgagtcatagtaatgactattcttgaataccactggtgacgttcaaaaaattctaagctcatgccaaccaacttttgaacatctgtgaggcaggggagaaatactcgcctaaaagctgctgccagaaacagtagtctgcattccaaagtcagtgcaacacaggagtttaacttgggaggccttaacataacagtaagtaacacaacagtgaaagaatctgtactaataaggaaaataataatgtcagttaccatctattgagagctactatattgagaaaatttacactcatagtatgggggcatggggggttgtcaggtaaggcttcctggagggggagccacctgagccaacaccaaaaagataagcagaatgtactggtatatacagaaatgtattggtatgtgttcacaacagagaagcatgaggatgctgccacatgtatgaagatggtcactgcagtgttccttataaaagccaaagcacacaagcaagctttgtgcctttcaacagattgttatcttaatgtctacctcatgctgttcacagaaaaaaataaaagtgggcaaccagtttttagctccagatgacattaaaaactcatgatatgccggccagtcgcggtggctcacgcctgtaatcccggcactttgggaggccgagtggacggatcacgaggtcaggagatcgagaccatcctggctaacacagtgaaaccccgtctctactaaaaatacaaaaaaattagccgggcgtggtggcgggcgcctgcagtcccagctactcgggaggctgaggcaggagaatggcgtcaacccaggaggcggagcttgcagtgagcagagatagcgccactgcacttcagcctgggcgacagagcgagactccgtctcaaaacaaaaaacaaacaaacaaaaaaactcatcatatgccttcccaactcacacacaggcacacacacacaccgaggaggtcagaaacatgttcttgtgcatccaacttcaaaacattaagctttataaaattcaacaatatttttctcatttcatgtctgaacaaggcccagcacagatccaaggaccaaaatttcccaaaggacttgcaagaacattccaactttaacaccacatccaacgcaaacacttctttaaaagaacgagcagattcacatagccaaaaactcaggagttgaacaagtcacaaaatatcagcccatccatttataagaggtacaagttgagaaccactatggttgaaggatcttgcccaaggccagtcatacagctggaatggcaacccagattccaattttagaactatcccaataagctacattgattgaactcctcctattgtacttgtcaatagacagctggaacagcacaaaacattaacttggaaagaaaaacaaaaataaaatgtatcgcctcgtttgtttagacaacaaaacctattccagcctgggcagtggttcacacctctaatcctagcactttgtgaaggctgacaggcaggaggattgcttgaggccaggagttcaagaccagtctgggcaacacggcaaaaccccatctctacaaaaattacaaaaattagccaggcacggtggcatgcacctgtagtcctagctacttgggaggctgaggtgggaggatagcttgagctcaggaggcagaggatgcagtgcgccattacacttcagcctgggcgactgagtgagcccctgtcacagaaaaacacacacaaaaaaaaaaaaaggaaagaaagaaaccaataacaagaagaaaaaaactattctaatgggtttgtaacatggacaactacttgctctttaaagaatgagacagataactgtaatggtaagaagtcatttactgagcacctattacaaatctggtaatatgccaggcgctaccacccatcactgaccaatcactgaactaggacttaggtaagcaccatcaataaaacccttaaagcacaacgggaagagaagcctgggctgctagcacaataagccccaacaaactaaaatgttagattaagggacagaagtattttctacttcataagttaattatacattaccaaggttacttttccccactattttgcaggagtcaacgtgatacacaatataaccaagggtgacaaaagcaaccatactccaaagtattcagcaaaatacttgacaagcaacatgcatgacaatagccctaaggtgttggaagactgggatacaaacccctgttgtctggggcctgttgtggggtggggggagggggagggatagctttaggagatatacctaatgtaaatgatgagttaatgggtgcagcacaccaacatggcacatgtatacatacgtaacaaacctgcacattgtgcaaatgtaccctagaacttaaagtataatatatatatatatatatatatatatatatatatatatatatatatatatatatatacccgtgttgctccaattcaaatttgtgacaagtaaccagttattataggattatgctggacaatgagatacaccccctcccatattgttctaaatagatactttatacagaaaactcattatagatactcattatatagagaacacagtctttaattagagtctctgaaatagctattccccatccttaattatgtaacacataacacgaaaacttctgatcacagcctgatgggcagccaatgggcaaattccctcaaggttcagtgaccctaactgtgaagctatttttctttaattatgttacagaaaaagatgtctcaatccatggtcctcctaagcttcaagaggaaaggttgggaggaaactcattaacttagttatgatcgtctatatttcagagaggaaagaaaaagagaaaactttgcataactttttgatggacataaaataatagcagaatcagattttgtttaagataataatagcagaatcagattttattaagtggcataccaacattttattaagtggcatacaaggcattcttgtgtttattttttagaaattatcaaaacctaccaaagcaaatctaaagaacgtatataaaagaacttacctaaaacattaaattaatgttaagtataattataacagcagctaacatttatgtattaggtgttaactgttcaactttacacattgttttaatgtctcccaaatcagcctaacagtaagacttacctggggcacttaatcacagaatccctggaaattctaattctgtagctctgggatgggtcccattattttaaaaaatgcattacaatcattcttatgaccaagctaggttaggaaacagattctcatgggctcttctttaacaatgacaggaaataggaaacactattagacccatttgacaactgaagaaactgaggcttagagaggtcacaaagccacccagggtcagaggcagaaacaaacagaaatgtgagctcagatttgtagcttttagcctgaaagtaaaactgcaatcattgttcctttccccaggtaacacaccagagaaggacactaacaacctcaatttcagggacgataaaaattaagtaacaatccattcttctcttattatctctctcagagtatctaagaaggctacactggtaaaaggctacagtgcagtttctggcacataagttactgaaaataagatttctttcctatctcccatccttcatcccttcttctctactgatgtcctctaattggagtcattagtcctctttctaccaagcaaagccaaaggttcccagacatatacaacctcagaaaaaaaaatgtgaaataaatggcagatactaacatcagatttactattcatttttctttttttttttcatttcatgaaaattacattcaaaccggtttcttgcctggagaaaagcacaaaacaaaatttacataacgcctttaaaaatcaaaacacaattaacgttaagtttcttcatgcattctcaaaaatccaacaatatagtttaatagaaaataatgacaagcaacatttattgagcgtatcaagtattaaatcactaattctcatcagaagtccagagggaattacgcgagtcccatttacaattaagaaaacagacacaaagaaattacaaattttgccccaggttacacagttactaagtggtaaagacagtatgcaaaattagaagaagaactactatttgaattcatgatttctttattacaattatctactgctgcgtaataaatcatcccaaaatataacggcttaaactaacaacaatcattttattatctttcacaatttctgtgagtcaggaatttgtacaaagcacagctgaaatgcttgtctctgcttcctgatgtctgaatcttacactgggaagactgcaggcaactcaatggcccagggctagaatcatctgaaacctcaggtgtgtttcacctcccctggaacacttggatgtggcctcaccatttggctccttgagctcccctgcagcctcctagctggtttccaaagtcaagtgtcccaaaagaaccaggtagaagctataccaccttttatgaccctatcttggaagtctcacagcactgctccaccataatcacatggccacccctccatacaaaaagaaggaacgagacatcactacccgcctccctatggaaagaatctcaaagttgtaagaacagcataatttctgccacaacccctaaataacaatcaataatatcatccctacctactagtgagaaaatggaagttcagaaaggctatgtgattgcccaaggtcacacaataaataatggcactaagatgccaacacaggcccttgtgactccaaatcctgttcaatttccattacatcatatttataaaacattccatctaaactgagttgttccttggtgaaagctaggacacatccatcttttaaaaataataataaagtgaaccattccaccaaaaatatgctaaaaggatatccaaatataaattatcaaatttggaaaggcagcaaatggaaatcctaatctaaagcattcttagtttaccagtgatgtcaaatgttagcattttctttgttgttgtaattgaggattcgtgtaagaaaagagaaatacaataccaagagtattcagtaaggatagtccttgaaaagactagcaaccacctaggacagtggtgcaaaccatccaattaagtctaaataggagatacccaggcaacacaatgaagccaatgagctacaaactccatctgatgccaaaactaaaaggggagttatcactcatcaccatcaactgcttttgaaaaggccaatcccagctatgagtgtctcttctggcatgggaaatttcataacacatctttattgccggctgaggccacttgcctcatccagattcactgccttatgaaaatgtgcaatatgaatgtttaccgttgtcatggaaccttcacatgagttcaaaataacacacacccatcactgtggcatttccaaacaggactgaatggttggaaacggaggtgctagctaatgttatttattaaaacaaataaaaacgtctcttttattttagatatctgtgatgttcatggaggacttggcaatatgtgcatggttgggcataatctgataataaatccatcagtcctttattttgctactggttaactaaaatgccagacataaaggcaactgtacttctttaacaaatgtgtcttcttctaagtgggcagtgtcagcacttgttccctagacgggttcacagctagtacaacacacagagtcccccattcaaaacttcagcacctcttctccagcccctattctctccactcaatgtcttaaccatgggcattaaggaacacaacatgtgaaatatacaggcaatttgctggtctgagtttgtgtgacaccttcaggtttcagaaattaaactgccaccctcagggtcagagaccagaattctcaaaagtactacaattcattcgagaaggcaaggcatggtagacactacctttgtcttcaaacaataatctaattttttctttccaaatccctacaaagactctttatatgatcaatgaccatctatctatccggcagctttctgtatcaaagggaataacttaacctaaattcattatagtttcatgtgccaagtgcacagtaatggctaaaatcaaagtcattgagatgatgaagccccatccaaacttacgtcagttaccctccattttaacattgaaaaacagtatttatcagtaccatcaatatatttgcttctaaacactttttcctcaaagggacttttcaatcatcaaactatagctggcattaaatccaaaagaatattcaactatagcaagtaatatttccctggaaagctattaattattcagcattccttagctgcctacaagcagatagatacccaggttgttctttgttggaaacactcactcagcgcccctgcccccagcttggagaggaatacaggctgacccactaccattgcatctctgtaaacctcaagaagtgatgctgcaaggaccagctcaatagtacctaacagcctggctgacatggggaagcccccagccagaccaaaatctccacccactgcggtatttttctccctataggcaatagacaaaaggccaatgttcccactcactttaaattcaggcataagtaacaggactcagacaaggaagaaaactgaagtcccagtcaaaactgaaacccaccagcgtatataataagtatttttattattatcactaacagcagtaatcacgacaaaaaaaaaaaagtacaaccatgcccatggctgacaggaaggttatcaatcgaggacaatttagttatatgtggtttaggaagaagaaaaaacgacttgaaattatcaaaaccttggactcaggaatatcacatctgtggagcttgtccaagaaaactacgaatcatgtggacaaagatttagctacaaggacattcaacaaagagttgtttaaaacatgaaaaactggctggacacggtggttcacacttgtagtcccagctatgcaggaggctggggcaggaggatcgctggagcccataagtttgaagttacagtgaactatgattgtgccactgcactccaggcagggcatcagagaccccgtctcaaacaaacaaacaaacaaacaaactggaaacaacctaaatacccaacaataatatggacagtatacatccatacaatgaaatactaagtaaaactttaaaatgatagtgtaaaagcaggtgaggcttttctttgacatggcaacctgttcatgatttcacaggaaatgaatattcaagtaacaaaatgtatactgttcaatataaattttgattttatacacctacacataatacaactagaataatacaattgcccctccatatccgagaaaaattggttcccaggatccccttggataccaaaaatccacagatgctcacatctctgatataaaatggtacagtacttgcataaaacctatgcacatcctcctgtatagtttaaatcatctctagattacttataatacctaatacaatacaaatgttatgtaaatagttgttatactgtttttttatttgtactatatttagtacatcactaaagaataaaactggttatatttgataggtggaaaaacaggtgagtttttgggttagctcttcctaatagttctgtaataaacatgtaccacactcttttgcattagaaaattaatggactttaattccaacactttgaggggccaaggcaggaggatagcttaagcccaggagttccagaccagctgaggaaacacagcaagaacctgtctcccagaaaaccaaacaccgcatgttctcactcacaggtgggaattcaacaacgagaacacttggacacagggtggggaacatcacaccctggggcctgctgtggggtggggggcaggggcggaatagcattaggagaaatacctaatgtaaatgacgagttaatgggtgcagcaaaccaacatggcacatgtatacctatgtaacaaacctgcatgttgtgcacatgtacccctatgtaacaaacctgcatgttgtgcacatgtaccctaggacttaaagtataattaaaaaacaacaacaacaacaacaaaaaagaacctgtctccacaaaatttttttttaaaattcagccaggcatggtggtgtacccctgcagtcccagctactagggaggctgaagtgggaggatcacttaagcccaggaggttgaggccgaagtgagctatgatagcaccaccgcactccagcctgagcaacagagtaaaatcctgtccaaaaaaaataaaaaaagaaagaaaggaaaaggggggaaaaaaaaaacttaatggaaagcatttaagcatttcaacaacattctaccacagggatcacttttaaaggcatactgttttcagaaagacagatgttttctccctaaaattaacttgcagtccaaatccaaatatttaactcaagatacagccataaacagctttttctctctgtaggacacttaagaataaatgcttgtgattagactgaccaccagccagagagtttgatatacgatttggtttaatgttttctacaaaaatccctgctcaaaaggattcttctcaatgtatctatttccacctgtttcctgtatttgtttctccccaaaatcctacctttctgtggcataacatcgaatttttattcatcccaaataatggtccactgaacactttaaataaaaggcggctgggtagtagcttggagataaagcactattttacaaaaccctagggaaaggcagtaatatggaagagtttagtgtggcatcataaaaagtaggcatttacttgtaaaaattaaatgcacacaggcttgttcatttgtatgtgtacatatgtacgtgtaaaaaaattatatacacaaataaagaaaaacaacaaaacaaaacaaaagaaccctgaaattcaaattgttgacaggtatagaaaataggagtaagttcatggctccttcatttgctatgtctcatttcacaaaagttcctattattttgaaacacttagtatacaaagtccttcaaaatatactgacatagaaaagcaaatgaaaatgacagcaaccaaaggcaaagtaatagttaataataatatattgtatagtttcaactagctagaaggaaaatattgaacattcccaacataaagaaatgataaatgtttgagaagatggatatgctaattaccctgatctgatcactatacattatatgttttcaaaatatcatatgtaccccatgaatatgtacaattattatttgtcaatttaagtaaatatatttttaaataattaaagaaaatttaaaaaaatttttttttgagacttgggtctcactctgcagcccaggctgaagtgcagtggcacaatcttgcctcactgaagcctcaacttcccaggctcgggtgatcctcccacctcagcctcctgggcagctgggactacaggcacacaccaccaccacgctcagctaatttttttgtagagacgggtttcgccatgttgcccaggctggtctggaactcctgggctcaagcaaccctcctacctcagtctcccaaagtgctggtattacaggtgtgacccaccacgcccagcctaaaggtgttttaagtaatatattctaaatggatatctttcaaaacagaaaatacattcacagtggaaaaagtaaaatgtgaggattcagctccaggaaaagagtcatcagaggaaggaagttcataactactcaggtccattttctctttacaattcttactaataacatgtcccattatgaccattccgctgaagaaatcagacttatcaagaaatgaaaacagatcacaggaaggcaggggaggaaatgtcaacctcagaaaaaactgagatcatttcagaggtgctgacagataatggaaatgccaccatggcaaaacactaccatccttttgtgacataactgggataaaaatccctacagacaacaataccaggggaataaaattaagagagctgaaaacagaaagaacaactatgacctattctcatgttttatgctggaaaaatgaatttgcagcaagggccttggtgccaatgttaattctccatacatatggagccccaaagatatatctaatacagtttcatatatacttctgctaacttgcttacattctgaatgggactttcaaagggggataaagttaaaactggattaaggaacccaaattaaaataaacccttcctgatgcactaatttttcagataccatagaagtcttggtcaagtccaaagtgagagtgctaagatggcattgcacccacagaaatacagatcttgcttccaaagatgaggggaaaggaacatttttcacatatcttgcagttaatcacttacatacttagatcaaagggagtaatcaaagttccaaaagaatttcagattagcttttacattatcatgtgtcccatgattacaattacctggacccaaaaaaaaaaacgagctttctacactaatggatttgtcttggggacaagagataggcagtatacacccatcgtcttgctttgcacgttattgcaaggacacacgcaacatcgtgtctttcctatgtcaggcatccttggactcattaactcttaaaaatcccatccatcacccaggacataaaaggtaaaagtcacaacatcactaaccaaccttcaagataacttctcactcactacaatgaacatgatgtgtaagaggtagacagaaaacacagtgttataattgggaagaggtgataaaggtgtgagcaaaaattaaaagagtcatgtattatttgcctagtgttagacttgaaaaagggcttagtatatggtaagcactcaataaatgttcacttaatcataatatactagtacagaattacttagccatatctgtctgtccaacaccacacatataaatactcaccatttgactaggttttgatgaacttgaaattggcgtgaagagggagttagtaagaggccccacaaagaaacacaaaaaggcaactgtggtgaacaccaccaggttaccagatgaataccctgtctccccagtcttctagccattttcttacccctataggttacaaaagacatactttcagccatcattttcgcatagaacgccattacgctggccacaggtgcagacatctgacctattatgaaccattgagaatccttctccctggtatttacaatcagaactaagagattccagcttcagtctggatgaacccttgagaggaagaagtatatgctaggagtgtggacagccaggctctgggaagcagatcagtctattttgagagaacagaagaatgaagtaagagcgcattcagcaggaaatgaaaaatacctacagaaaaacctgataaggttcaaagtcttagtcccggggtgtttccaaaactggcctacactggataacccttaccttgggtatgcttcagatacccttacagtaaacatcctctttttatttttgctcaagagcatttatactacttgcaacgcagagcccaacataaagactattcctctctaaccaaaacaatccagagacaaggaaaaaataaaagatgacgccacacaaaaggaagagcaaaatagcccagggtggtctttccaatgatgaggaatccaccatgcaggcccagaccagagactgggagctcagagaaagtgtatggatgacatttctgttcatcctcggtggaagggtgagagtcacgtggtgacgaaattggctggagatatgagcgttgtttttacaatgttttagtatctgtgaataccacattcttttcctttcttgtacagtcttgtttgaaactctggcaaaacgctgcaaaggggaagcaattggaagttggctgagatgaagttatgtgatttcaattaaaaacattctctcacttgtggcttgctatcgctgtggaaaataaagaactgcaacggcaaggttttttccctattgaaaatatttctgttaagcttcagaacggtgaaaatcatttatctacatacacaaataacttctgttcaagttatatcggggctctggtccaatccccagattctgcgaaaaaggcaaattttgtatagactaattctactgttctcatttcctcagcaccctccacaattttgcatgtatacatcccagaatgcctaaaaactcacaaatgcctgctatcccacagggttccaataattagcacttttacaagtacatccttattttgctgcagaaaatacttacgaggttttaaaattcattattttttttaatacatcattttcactacacaaaaagaactaccaagactggtctcctcaaaaggataacatacttcttaatgtttccccatgatatttattaaacgctaaggaatgcaaaaataacatatatttgtgagagttctctgatatggattaatgatcatttctaaatatagcaatagtagggaataaatgtctggatttgcttatgtttactaaacaataatcttacaggttggtattttactgctttacaaatacgagggagacaaacaagcaaagctgtaggagagagaaaactctcacatcgcaattgtgtctgcctagagaatcaggttcctgaacactgctcccacctccaaagtatctgacaaggagggaagccacagactgctcccagtctgaatgcaagcccaacctcatatagtagaatgaaaacaaactcagccaagatggttccttagcagtaaaattcgcagcaattcaggaagatagcagcccctagacacggacttgagaacttgagaaggcagccacagcccagccccttgcgtatgtaaagtaagctcctacaagtcattcattcctgcaggaagcacccctggccctcctaagaatcacagcagaagggctaagttttagctgtgaaaagacagagcttgagctctcttacctgtaccagcctgtggctccctcccacttattccaatttgcgacaggcatccagggctcttcctgcaactctgaacggggcggatcctgccaagtctctgctcgtacctgaatgcaggaaactgagcatgctccccatcagggagcagcactagggcaggacacacgccattacctccagcttgggaatcagaccagatcagcagcatcaccctgccaacattaccaggaaagcagagagaaaatgaaaattgccttaaggagctttaacaaaatcagaaattaaggatcaaaaggaatagaatgaaagggtcataggtgtcactaaatggctagaatgagaacaccaaggtcaatccagtaaaaatcagcaggggttctcagctcaaagtcttttttggggggagtggtggggagaggtataactctgtcacccaagttagagtacactggcgcaatctcggctcactgcagcctcaacctcgcaggctaaagcaatccccccacctcagcctcccaagcagctgggactaggactactggcacacaccaacactcccagccaatgttgtttattttttgtatagacagggtctctatggtgcccaggctggttctgaactcctgggctcaaacgatcctcccaccttggcctcccaaagtggtgggattacaggcataagccaccacagcttgaagtcttaatattagtacaggagtggcaagtggaagcttggactaggagtcctgggtatgtatcctggatgccgtttctaactcaggtgtgactgtgggcaagtaacttctctctagagttcagtttcctcatttaaaaaaccaggataacagcaatgcctacttcctagggcagcataagaatgaaatttctgacacacaaagagcactcatgaaatgttcttatcaaatgtaatgcaacacacacatacgcacatacacgcatgcctgcacgtacacacaccttctccagagatcagtttccctaagacagagggaaaagaaggtactttctgaaaggttttgtttttatccttgccagtcagcttgatttactcaaacttcctaagtgcttatttcgatttgcctaaaatcaggcacagaaaataattctaggccaggcgcagtggctcacacctgtaatcccagcattttgggaggccgaggtgggaggatcacctgaggtctggaggtcaaaaccagcctggccaatgtggtgaaaccctgtctctactaaaaatacaaaaattagccaggtgtggtggtgcacacctgtagtcccagtttcttgggaggctgatgcaggagaatcgcttgaacccagaaggtggaggttgcagtgagccgagatcgtgccactgcattccagcctgggtgacagagcaagactctttctcaaaaaaaaaaaagaaagaaagaaaatcattctaatttcctcaaaaccatgtaaatctagcaaattagaaaggagcacagactacttaatctttgaggaagctgtcaagattgtgccataactttttgattcagttctcaactttccaactaattccagacagtaatgagacaccactaccctgatggctgatatttcacaaaatatgcagcaaggagagcccatgagggcaagaatggcctggaatgaccaaccctatgtcagtttctgttttgcctgcttgactctcaggattagaagggtgataaggtcacacaatctcaggccccttctcacctaccacatcttcaaagagacatccaccctctgatatatcaaactgggtgacaggaaacttggttcctgctaaaacccctccagtgaatggccactgcccttagaacaaaatccaaaaccctgaccacggccttcagggccctgcggcccggcctctgctgcccttcccaacccagctcccactgttctaccccagacctaccctcatccaacactccaagctctgcccacttctaggatgtagcttccaccatccctcagcccagaatgccctttctccatcaatcctatctctggctttctcattctccaggtcttagaccaccctggctaagacagatcacctacccaccattcagttcacaagtatcattgacaaaatagtgaagagtttaattgtttacagcctgcctccctctcctcactagactggaagctccaggaggtcagggccatatgctggtcattatgtggatgcagcacctgccacatggggagggtgaccaggcacataaggtggtgactgcctcttgaggctgcccatcccctctttggacagcatttggagacaaagcttaagcaggtaacaggacaagaaaacgcctcatcctggaactttctctgcaatggaaatcaatatgattcaacaaaattaggtactccgtataggggatcttaaccagaaccccacattacaatacacaggggagcttaaaaattatactaaaaataagaataacactaatactgatgcctatgctatatccccaagattctgatttaattgatattaaatctggtttatgtgatttaaatgatatgatattcagctagggttgagaactactgttttagagcactgcttctcaaactagttgtgagaaaggaccagctgtttcttatttcccaaagtatcaaaagataataaaaattaatgaccagaaaaaacacaagcacaccctacaaaatacaagacccaacttttaattattaaactcaacagatagacaactgtcttgtgcaattacatttctttttcttagcctgggcaacctagtgagacctcatctctatgaaatattttttttttctaattagctgggcattgtggtgtacacaccctgggtgacagagtaagaccttgccttaaaaaaaaaaaaaaattctttttcttatttttttagagacagggtctcactctgtcgcccacatcagtcttgaactcctgggctcaaatgatcctcccacctcagtctcccaaggagctaggattacacactcagccaattactattacatttctaaattctaagtctcaatttctatatttataccattgtgcacaggttaacaaaaacagactttgcacctcagctcaggtctacagagcaaatttagagtacactactcagaagttacagaaaaaggacaaaatgtagtctaacaacttagttgaggactgcactctactcaaattatactacacagtagtaaatgactacatatctaggcaggaatgcaccacacagatcagaacagacttttcatctgacagatttttgtggtgctttccggatataagaaagagttctccaagtgtttttaaaataccgaaataaaagagtttctgggatggtttatccacaattaaggcattctcttattaaaaacataaccttgcttttgctcacttggtttctttaacatcactatatttgagcatgtgttttccattagctaataatgcagaagtgtgtcattcttctccctgaaaatatactgttactatgaaggcacatcttgaaaatggtagcatctaataataaaaagaatatattactcgaaataggactaaactaggaaagggagactgatggtctgaagtgaattcaaggatgggagacatcaatgtgggttggaatagcacgtaaaagctccatgaagaaggaagcaccagggctgggtgcttaaagagaggttaggatgaggcaggcagatgggagcagggaaggaatttcagcccagtctgaaagggcagcatgtccactggtcagtttaatacagggctgaaccacagcaaggggaagatgcaatgggtgggcttcttttcccaggggatatcacccccacctttcttccaggcccattcctgccctccacaaaagtatccacaaaagtcaatgttttcattaaactctcaagggaaatgccaaagacaaagaaaagtttcaataatcaaaatcaaaatatacagccatcttagctgggtgtggtggctcatgcctggaatcccagcattttgggaggctgaggtgggcagatcatttgaggtcaggagttagagaccagcctgaccaacatggtgaaaccccatctctactaaaaatacaaaaattaagtgggcgtggtggtgggcacctataatcccagctactagggaggctgaggtaagagaattgcttgaacccaggaggtggaggttgcagtgagccaagatcacgccattgcactacagcctgggcaacagagcaagactctgtcttaaaaaaaaaaaaaaaatctacagacatcctagtaaattttggcaaaaaaaaaagaaaaagaacttgacaatgtacttctggacctgaacagtggtagagaaatgagatttcccttttgtctctagcattgatccacaaattcagtgagaaaaatcttgcctcttgtttacaaaaaaaaaaaaacactccacttggtgaagactaaggatttgtaaaaagaaatggctcgatgacaaaattaacatgaattctactctactgcctaaggagagcccttaattagatttttcaaattgctaaaaatattactgcttaactccctttggtttcaaatatagcatgatgcatagtattattgaaaataaacattttattaacatatatgttattcccatggatccttgagataactctagtgggtggatgagattatccttttcacaggctgagacctggtaaggctgagttatttgctcaaagtcctacagcttgtcagtgacaaaaccaagacttaaacccaggtctctgctgtcaaatcctttgaaagtcaccacatgcaaagtacttatccccccacacccgccttccctggaacttacaacaactcagccagtaaagctttggctatggaaatataagcaacgttggaagtaaaacgggcacattaaaagcaaaagcacagattggttaaaaatctaggaatccactgccttctggaaatgaccaaaagactttacctttttcaggttgaagtcttcagtggatctggtgttttcagatgcccagttctgaattctcattcagagttgccatagctccctctaggtgacttcacagtaacctcctgtgagcctgaggctattccttctccaccccaactaccttctcaagcatctgatggtcttttcaggcttgttcctgcctcagagtcttggtgtttgtcactggctttttaggaaacattcttgttcccagtatccatttgcctgacttggcctcatacttgcgtctcaacttaaaatgtcccctgtcacgtgttaccccggctccatcactctctgtggaatccctctgtttcactttctctctagtgcttatgattatctgaaattcttacgattcatggagcatgcaaataccacacgaacacaactaaaaaagaatcaaagttaacacaagaaatacaccaaacgccactcataaacaaacatgccctgaaggaaaagttcttataaatgaatccaaaataacagaagacatcaaatattgaatattttgctagctcacatacaccacacaataagaaacattcaaaggtagtatacgcagaaaatgtctacgaaacaacaaaacaccaacctctttttcctggtgttgaacactcttctctctgccaatactgtccacaataatccttaatttttttttttttaatcgagacagagtcttacactgtcacccaggctggagcacagtggtgcaatctcagctcactgcaacctccacctcccgggttcaagcaattctctgctggaattacaggcacccactaccacacccggctaattttttgtaattttagtagagacagggtttcaccatcttggccaggctggtcttgaactcctgacttcgtgatccacccgcctcggcctcccaaagtgctgggattagaggcgtgagccactgcacccggccaatccttattatttccgaatgaaacaacttttaattcctgcaaatcatcttctatatttttctctccatgaaataagtgaggttgcaaaaatcagctacgtaaaaactagtatctgagctgtccagcgtaaaggatattaggactccctggccgacttcccctctggaaaatgtggatcagcctttctaacagactcctggggcagctctccagcatgccttatcattagaggactctcttggtcattaaccataatgaccactcatagtctacatttcaatctgcaacacagtggggcagacactcagaagtctgcttattctcagcatgtaatgctgacatgagtcaattttttaataaaagtcataaatttatggttctaaaatatagagaatgacttctagttgtgatcaaataacccattttctagggatggtcttttataatgccaattccatgcacaattgggaatcaagttaaggtgtgtctatgaccaggtagagtattctcattaccagaagcctttgctcacagtgcctcatgaagctaccctcaaaatgtactcaagtatataaattttctcttcccgtactgacaccatcactgaagggctagtatcaacattatttccatagcccacctttaaggagttaatatagtctgggcatggtggctcatgcctgtaatctcaacattttgcaaggcagaagcaggaggatcacttgagcccaggagttcaagatcagcctgcacaacaaagttgagaccccatctctacaaaaaaaaaaaaaattgtttaattagctaggtgttgtggcacatgcctgtagtccaagttacttgggaggccaaggtgggaggactggcttgagcctgggaggttgaagctgcagtgagccgtgatcacaccactgcactccaacctgggtgacaaagcaagaccctgtctcaaaaaataataattaggccagtgtggtggtgggtgcctataatcccaactattcaggaggctgatgcaggaggatcacttgagctcaaaaagtcaaggctgcagtgagctgtgatcataccactgtactccagactgagtgacagagtgagaccctgtatccccaaaaattaaaaaaatgtaaaaagaaaagaatgtaaattagctgctgcccgctttatttcagggatgtggggattccaagcaagataatcaaacccagatagtatctacaccagcgatcactaacctttttggcaccatggaccggtttggtggaagacaatatttccatgggccaggggtgggggatggtttggggacgaaactgtcccacctcagatcatcaggcactaattagattctcataaggagcgcacaactagatccctcacatgtgcagttcacaacagggttcacactccaatgagaatctaatgccaccactgatctgacaggaggcggaactcaggcagtaatgctcacttgcccactgctcaccttctgctgttcggctcagttcctaacaggccacagaccagcatcagtccatgacctgggggttggggacccctcatctagctcataaccttctgtctatgtttggataatattaccttaaataactgaatataaaacaataaacatgtttaagtatttgaggctgccaaagtgaagagttacagagtacttttgttaagagatagatataattgagaatctcaaatttggaaaaagatcttttatccccccatgaaaaagttatcacaatgaaaacacatttaaaaatgaggataaatgcaatgctgtactgttgaaaatacacaagtctttcaaatgcatattccagaggaaaaacaagcacccttgaaaatcaatcactgaaaaacaaccaataaagtacgccaccattgcaaatggctttcctgtttacatactaatcgaagtggttgttggggcagcaccatgccaaacactgatacgatggaggacatggaagcatgagatagctgggaaagtgatcatctaatctgagaaaagagtcactactacttattaaagaactacttacttaaaacatcctgcgttagaaacgagtgcccccaacctccatcaaaactctacagtagcttcctatcactttcaggccataatcccaaaatacctctttaattttacttctcgacatgaaggtcctgacctagtagttaaatctctgctcatcacctatccaacacagtagatgggtgtctaccttgaggcctctttcagacatggtggacttttttttttttttttttttgagatggagactcgctctgtagcccaggctggagtgcagtggcatgatcttggctcaatgcaacctctgcctcctgggttcaagcgattctcctgcctcagcctcctgagtggctgggactacaggtgcacgccagcacacccggctaatttttgtattctgaatagagacggggtttcaccatattggtcaggctggtgtcgaactcctgacctcaggcgatccgcctgcctcggcctcccaaagtgataggattacaagagtgagccacagcgcctggcctggacatggtggacttttgctatccaacatctattttccccatttctgatagaagcaacccagttttgtcaaatgaaaataacttatctccataggctggtttagacattttactcaaactgggacatttgaacgtttgtccatggaatttgaatctcaagcagaaaaagacagaaaagggttggagttggctcatcctccgggggacgctctacagagatgtggcttcagctccctccaccagcagccccagagctgcccagcgtccacctttctgatcccatttttcaggtgtttctcagatcctgtaaactgctccatgtatctattgtttgttcacaacaaatttattttctgcttagggtggattcagggtagattttttttgcacttaggaccaaactatatcctaacttgcatgcttattaaagtcattcttaaaccttgggatcaaaactcaacacccctgattatttttaagcccttcaaagccacaccccaacagcataaccgctctctcttcaaaacttttatataagcctattatgtattcttactgttttcatttacccatgctccaaacaaattaccaaatcatacttttatagcccattggattatttcctagcatcaaacttggcacccagaaggtgatacaaatatttttatctattattaaagtttctgtgtaaggcactgtgcttagtggcttcctgttcgttactgcatttcattcctcattataggtagggttatcccatttggaggataaccagtccaaggcaaagagattaacttgcccaagggcattcacagctactaaatggacaaactgagatttaaatccaagtgtgcccttgaaagcctaaattctcaatcactgatgatagaacttgaaagggaaaaggcaggtgtgaaaataattctatcttagacatatttattttgtcatctctcgagtctagatatgaaactctgcccactgacatgttcatgaacccaatcttgaaagctatttaagtttaaatgaaacaatgcattacttcaggtaaatggaaaacaaagaaaactctgatctcaaaaaaaaaaaaaaaagagttctgcttcctaaatcatacacatcgtgttctcgcactgtagaatttctctctaatctgctctgacaaaaccaagtcaggggctggggagacttgaacagcaggctgaaaaactggaagagcccagtctgggattaaaaactagctacaaagggataattcacacatggatcattacgattcagggatggttaaaagcagctcacatctggttttatttgggctccctgtttcgtctaataaacaagtacatgtttaaacaaacaaaaacaggtaacaaaaaaatgtttttcaggtcacacgcaaagtaggattagtttggaaaaggaagaccagcacctggaaaaccaatttcacttaagtacctcaccaagagaccctgaccaagtgacttaatctcttaggaccagcttccttaatcaaatgtgaaaataaggattcttttttagttaccttagaagattattatgagaatcaaaagaaagcatgaacatggaaaattttatcaactctgacaagacattaacaaatatccccagaggaggtcaagcaggcctacctgagtctacaagtggaaaagtttgtcaaatacactataaatagctacactaggtacaagtcatgaaaggaaaaccagacacagcacctatatcagcaaacaacctatcagacatcatgaagaataaagtaaacttttatctagtttgatctctttaaatactaccaagccataaggggctgggcgcagtggctcacacctataatcccagcactttgggaggcaaggcaggcagatcacttgaggtcaggagttcgagaccagcctggccaacatggtgaaaaccctactacaaaaattagccaggcgtggtggtgcacacctgtaatcccagatactcagcaggctgaggcacaggaggcggaggttgaacccaggaggcagaggttgcagtgggcagagattgtgccattgaactccagcctgagcaacagagcaagactgtctcaaaaaacaaacaaaaaataataaataaacacttccaagccatgaagttcaattctttgagaaccattttttcatatttgacaaaattgcatttagatggaattaggattattcctcctccccaacccccccaaaaaatccaaaacatggttcaatgctttcaggtaatttctacctaaattctgacctaaatttgggagaggcaaccccaaagtatggcctgtagaaagctaataggtataggttgtttcggaagatggggaggtagtgttcagaaaggagagattccagaaagggttctgttagttcactaatttgggaaatgctgcattgggcaaaacaggttccttaaacacagtactgcttggagcatttaccatgagatgcctttcaaatccctaacaaagtattggaataaaaagcattttgcaaacttatttgcaaagagcatccttcaggcaggtgttccacagaaaacaaactgaaaacacagcagaagacagttaacagaggaaatacagggaggagaaattccttcggaacatatcgtattttttgaaggcaatgtgagtagagtaccatggaggaattctaccactgactgtgtatcccaaggtctttatcttcaattcaaggggttctaacactcctgaatattcttggcaatttagaaaacactcacatggacccagaaagcaattgctttaaacccagagagaccattagaaaggacaaagggagacaaagaaggaagaaaagaggatcttagaccctgctttctcccctaatgcttattaacaactaattggctttcatgttttctccattaggtttagcttcatgatcaaaatcacctcagggcatactacaatcaaccaaacatcagccttcaagagatgcaccatatgactacatccacaggtcagcatacatactcagccagcataaacccggcggggacttctaccaacagagggcctcctgtgaaaagcctggaaaaaaaagtcaactctctgttgcatagtgagcaacataaatccagcaacatttatttcagaacaaagatcgatctgttaactaattaatctgaacccacaaatgaacacattcaaactggggtacttcctggtttcatcacaaattcaaatgccatcaggggccatgcagataacctcaactagtgaagcagacaatgtctgaaaaagtagagaattatggagactaagaggggacctgagagttcaagccaagcctcaaggcattcacgctcaattcaattaaaacacagtgctgactctagctcccctcagacaaaacaaaacaggtgcagtccaaatccagcccacaggctaccagtttgagagctctgggaaggccaccatccttaagaggatttgagcctaatgttcgacaaatgcctaataagcatattaaatttacaaatcacaaagttgagaacagtatcaacccaaatgtgccaaacaaatttgcttatggtggatggatatttacaggatatatgtacatatacaaagggtttcagcactgtacaacagagttcaattgcttagagtaacctgctgcatgacctcgggtaagatatgttacttttctgagcatcaacttccccatctataaaatgaagataatagcacccccttgggatagtagtgaaagttacacaggaataaatttgtaaagctctcagcatgtagtaggcactcaataaatgatagttgataatttttttacaaagcatatttaggctagcattataatgcacatttagaacaactcattcaaggacaaagtcaatctcttaggcaaattgtgtggtaaatgatgttgatcagtcccttgcaagaaactgctaatcatatgaccagtctcacttagcctcttgccacacagaggtcatgaaaggatgctggtgccatctcatggtaatgctcagagcccacaggagatacaaatgctaggactgttcacatttgaacagcagcttgtacatatttagcattaattctgttaaatatttttaaatactcaattcagaagcataaatccaaacaccaacgggatgctaacacatcgctccatgccaaacaccttgcaatgtgcacagtcatttgccctctaaaattcacacccgttcaagttactcttctcaccttgtcttccagcagatgatctgcacacttgcccctttttagacactggctgctttctcctacagaaaatttaaattccaaattgtttgggtctttttctttttttaaaatccctgaagagactggactgggaagaggaaaaacgatgaataacacacaggtgcttcctacctaattaaaagaaaagtttacagctgcactggttgtgaatcatccctctgggttatccagtgtatccttcaagtggcacgtagttccatcaagagccatattccatatgctttcctgaaaactgccttctctttgcttggtaaaatgatgactatcaggtaactaatggcattttatacttcctggctttcctctctatggacaaagcagttcatttgtgcttccttatttctaaaaataaataaccctgaaaaaaggactcaacttagtgaatcaagctttgatttatgttgaaaaagcaagatgcaaatttgtgtatttattatcatttctgtgtaagaaatacatatacatttatatgatacatatataaaatgtgaatatatataatatgtatatatttatatacatataatttataatattcaatacacagtatattatatatatatattcatctatttctttcttttcttttttttgagacagagtcttgctctgttgctcaggctggagcgcagtggcacattttcagctcactgcaacctttgcctcccgggttgacgcgattctcatgcctaaacctcccaagaagctgggattgcaggcacatgccaccacacccaaccagtttttttgtatttttagtagagacggggtttcgccatgatagctaggctgatctcaaatttctggcctcaagtgatcttcccgtctcagccattgtattagtctgttctcatgctgcttgataaagacatacccaagactggataatttataaagaaaaagaggtttaatggactcacagttccatgtggctggggaggcctcacaatcatggcagaaggcgaaaggcacaccttacgtggtggcacacaagagagaaaataagagccaagtgaaagaggaaaccccttataaaaccatcagatattgtgagactttttcactaccacaagaacagaatgggaaaaaccactccatgattcaattatctcccaccagctccctcccacaacacatgggaattatgggagctacaattaaaaatgagatttgggtggggacacagccaaaccacaatcgcctcccacagtgctgagattacagatgtgagctactgcacctggcctatatacatgaatttcttacttaagtacatgtatcatacacacactaacacacacacacacacatacacacacacacaccctgccactacctccagagaaaccaaataatgaaataatgaggataggagaagacagttgtcagggataagttctactgttctcattgtatactttttaaaatcttggataatcatacacgtaatatattaatggtccaaaaaagttaactttgacttctttaaaaatttgtctggactgccaggtgttttcttatattttaaatttataatgtcaaaggtaattgaaataatctgtttttatttcttaagcttatccttagacatttccaccttcttacacataaagagagaaacatctagaaagatacatattataccattaactctaaaggatgaggagttacatggggctacagggtttcctttctcctctatccttctacatcactagtagcacttttgaaattgaaaaataaaaccaacaatgagataccactacacacctattagcaaagccaaaatcctaaacactgacaccaccaaatgctgacaaggatatggagcaacaggaactctcactcactgctggtgggaatgcaaaattatattgccactttggaagacagtttggcagtttcttataaaactaaacataatcttaccacacaatctagctagcaatcatgttccttggtattcagcaaaggagttgaaaacttatgtccacacaaaaacctgcacatgaaagtttataaaagctttatgtgcaattaccaagtcatccttcagtaaatgaatggataaaagaactatggtacatctagacaaggcaatatgattcaacactaaaaagaaacacaccatcaagccatgaaaacacatggaggaaacttacaaatgcatagtgctaagtgaaagaagccaatgtgaaacggctacatactatatgattccaattatctgacattctggaaaaggcaaaacgatggagacagtaaaaagatcaaaagttaggggagtggggagataaataagtagagcaccaagaatttttaggcggtgaaactagtctgtatattataatggtggacacgtgtcattacatatttgttcaaccctataaaatgtacaacaccaagaatgaaccctaatgtaaactaaggtctttgggtgataatgatgtgtcaatgtaggttcatcaattgtaacaaatgtaccaccttggtgggggacgttgataatgggggaggctgtgcacaggctggaagcagagggtacataggaaatctttgtaccttcctctcaattttattgtgaatctaaaaatgctctaacgaagtctattgtttttaaacagctactcagaaaaataaaagaatgaaactaattttacagttacaaagagaatatctacacactgaggtagggtcagaatcagtaaacatgaattcctatcattaagcatttttattaaatacctagaagggcatctgtagtttaagaagaaacttacataactctctcaggtcaattttctgcactctacttttgcttctcttggttaaaaatctggggttgggaacatatattcacctgtgcattatactcttgctccaaaacattttttttttttttttttgtgagacggagtctcgctctgtcaccaggctggagtgcaatggcgcgatctcggctcactgaaacctctgcttcccaggttcaagcaattctcctgcctcagcctctcgagtagctgggattacaggtgtgcaccaccacgcccagctaatttttgtatttttagtagcgatggggtttcaccatgttggtcaggctggtctcaatctcgtgacctcatgatccgcctgccttggcctcccaaaatgctgggattacaggtgtgagccaccgcgcccggcctccacaacattcttaaactgatttcttttgccaacaaatgagttgttttcatcctattgcttggtgactacgcaggtcagcttaaaattattgtttgcttaaattcaaagaatttaaaatgctcttctcttcaaattatccctaccaacaaataaatgcaagttaaggagaatgcttacaaaaagttaagaggagttcaattatactgcagagtgatctgtttttctcaaggaaggataataatcctcattttcaaaaaaaaaacaaacaaacaaaacaaaatgtaaactagccaaaagggtataaaattggaatcccaaattattctgggaaacaatactgtgcccacaagggcactcactacacatgaaaccagatagtatggttaacattgatctgtgaagactgaagactatcagttttcatgatccttgctcaacagaatttcactggcttttcctttggagaacactaaactaatttcattgaatttgagggagctttccccccaggagacaaaatgctgacttctcattctgaagttataaatgtaaaaacaatttgattttctacttcttaacctccaaaatgcttacacaagggccagatgtaatggctcatgcctgtaaattccagcactttgggaagctaaggcaggacgatcgtttgagcccaggagtttgagaccagcctgggcaacacagggagaccccatctctacaaaaaaatttttaaattggccaggagtggcgcacgctcctgtggtcccagctacttgggaggctaagggggaggatctcttgagcccaggagtttgaggctgtagtgagctacagttgtgccactgtactctagcccaggtgacagagcaagaccctgtctcaaaaaaaaacaaaaagaaaaaacaaacaaacaaaaaagaaacaaacaaaaaatgcttacacaagagaaggtatcaggaggtaacttggatatattttcattctctcattctctctccttctctctctctctctctctctctctctctcacatttttcaagttagaaaaaggcaacgttcccccattcgaggctttgttaacagtgaccattatacacggctggaataatttctctcatacagtctgtcagcctgcttcctgatatctaactactgctttgaacactagaactctcagttttagccagacatcacagaccttccatcatcttaaccccttttaacttttttcaatcttatcccattggtcaccaacttaagattcctggaaactcaggaatgaaataaatctaagtggtcacttggtctaacttcaggtccgatgtttaaattcacacaaacttctcgcaatgacccagactagacttggaaagctctgaatcagtgaacaaaccacatttcttggcagccacacttattttagggagttttgcacatcacaaattacccacaacagtcctgttcacatcctttagggcccacacagaatctggccaacttcatttacacatattagccatctatttaaagagctggtttccacctgcatcctgctgtattttttccttccagctaaacacctcgacctgtgccctcaatttctcaaagacccctgtgatagtcattaaaaacagtgatattaaaaaacaagggctctaaaattatcttctttttagttttaagcagtggggaacagaacatattggatcttccatcaaattctgacagtcacacacaaacaccgtatgaatttctaatcctgaaccatctctttttaaggtataatacatgtgtcaggtgaaaacctaatctctcttctcctagattcaatcacctcaaggcattccatatttataagcttcactctcttctgggacttaagaaatatttttaaaacaatatagtacaattaaatttagcccattcttccccttcccaaaaacatttttaacaacttttatttaatttcacatttcagaagaaaatgaaaattaagattaattgaattaccctccccccatgggttttaatttatatgacaacatttacatttggtaagaacaaaatggcagggcgcagtggctcacgcctgtaatcccagcactttgggaggccgaggtgggtggatcacgaggtcaggggttcaagaccagcctgaccaacatggtgaaactccgtctctactaaaaatacaaaaagtagctgggccaggtggcgggcacctgtaatcccagctactcaggaggctgaggcaggagaattgcttgaacccgggaagcagaggttgcagagagccgagatcacgccactgcactccagcctgggtgacagagcaaggttctgtctcaaaaaaaaaaaacaaaatggaattgggctgcagtttttagttacaattgacgctactgccaaactgagttcagttcagaagttataattgcacagaaaatgcaaacatataatcttgacttttactatcattttaacccactgcagaattatttaacaatgtttgccatgttggaagaaagctactacgtggtattttgctcaggccaatgtataacaaaaaaaattgatttgagaagataagattattaaatcaatctgtattttagcaatgacgtataattttttttttttttttgagacagggtctcactctgctgcccaggctggagtgcagggggcacaatctcagcttactgcaatctctgtgtcccgggttcaagtaattctcccatctcagcctcccgagtagctgggactacagatatgcgccaccaggcctggctaatttttgtattttttggtagagacggggtttcaccatgttggccaggctggtctcgaacttctggcttcaagtgatcctcccacctcagcctcccaaagtactggaatcataggcatgagccaccgtgcccggctgacttataattttcttaagatctttaccaccatattggaataacctccaatcaatacagaagctcttaccactcttttaatccattcctcctcaagaaaaggtcattccacaaaatcaatcaaaggagaatcaatcaaaatgattgacaattgtctgtagcctgctagtaaaagttaaaggaacacagaagaaaatcaggaaagaaagttagcctgagcccaggaggttgaggctgcagtgagccacgatggcgccactgcactccaacctgggcaacagagtgagaccctatctccaaccacacacacgacacacacacacacacacacacacacacacacacactacacaaaaggaaagaatatacaaaatgcattttggttagatatgaaaaacgaataataataattataggagtgtatcaagtacctgccatgtgctagctcttgttaacatggtttatctccatcactcatttaaccttcaaaatcgcctaagatacaggtactattattagttcccttttacagaaacagagactctaagagatgaaatgacatgcacaaggtcacacacaaaaatacagcagagactagacctagattcatgcattagcaaccaatgcaagagataaaacctggtataccggggttgaatagcatcccctcaaagttcatgtccacctggaaccacatgtgaccctatttagaaataggacctttgcagatataatcagttgaggtcataatgaatcagggtaatccctaaaaccaatatgactggtgtccttttacaaaaatgagcagatactcagagacatggacacacacagaaggaagacagccatgtgaagaggaggtaaaaactggaatgacacagatacaaaccaaggatgccaaggattgctggaaaccaccagaagctagaaagagacaaggaaggcaaaggatctatagatccttcaaaggaagcaaggccctgcttgacttcagacttctagcttccaaaactatgagagaatacatttctgatgttttaagtcacccagtttgtgatattttattacagcagcccagggaaatgatgacacctgagaggagaacacgatgaatcaacggagcattgcaatgccagcacttcatccccaaagaaaattggtgtacagaaaggagagacagtaataagaaccagccagttggaagttcagcaggtttctgtcaaataataaccactggcgtatttcctgctccttcctatagtctttagaagacccaacttacaactatgtctatgaggaactctggtaggactatacataataggaaaacataacatttttttcttgataacaggaacatctggctatgctgaacataagagattcaaaacagaggagatttgcaaattatagcttcccttagggcttagaagtgcttagataaaatttgattattccatactggcctgcaatttgactccaagatcccaggatcacatgccccaggcaaaagatttctaattcttctatgtaagacctatacttgctctatccattccgtatgtatccatccacccgtccatgcatgcacatgttaagcttgcattcaacagacatctttttttttttttttttgagatggagtctcgctctgtcacccaggctggagtgcagtggtgtgatctcggctcactgcaacctccacctcccaagttcaaacaattctcctgcctcagtctcccgagtagctaggactacaggcgcgcaccaccacgcccagctaactttttgtatttttagtagagatggggtttcaccatgttggtcaggatggtctcgatctcttgacctcatgatccgcccacctcggcctcccaaagtgctgggattacaggcatgagccaccacgcctggcctcaataaacatcttaaataataaacatcataaaaagcccactaggtacctggcactgttatgtccttggaataaatatgacaagtatatgccatatctgagggagtctaccctctagcaagaatgagagacattcaacaagtaactttaagtgagatgagagttaacaaggagacattaaggctgctatgggagataagagataaggttggccaatcacatacagctgtacagggggtacactgcacaagcacatttggccaagtaacatgttgggcctaaggtacagctctctccatatgcaaaaaagagcgttgtttcctcattaccacaaagaagcaattccaactagcatcagctctgaaactgtagaggataagcacctaatcttgcagcatcaatgcacctgaattttatattaagagtaatattaacagaaaataattaaagtgttttttaagtattagactcagctgtccacagaagcagaagcagtaatttatccaacattatttcatctcttgggtaatactaaaataattcaaggagatgtatgaataattgaagctaagaccatctgtaaaaaatgccattatggctctttaccaattgacactcatttaaaaccttgatttaaaaagtagcattttccatcattttaactttaggaagatttaaatgatttattaatcaagtgctgtttcactggactaaagtaggatcacaagccctattcaaacctgtctttcctttccacatatcaaattcttgccttccagagaagctactaaaatgcccgaattaagaaaggtcggtctacagcagtgggattgcatctccctccccagaacactgtaaaattagaaaattaagcctgtcactttaagatacatgagtcccatttcaagaatttctagcatcaaaccaagcaagaatatcattgggaggtgaatttatataacacaaggattctaggagaagccatcatttccgtggcaggaatcagaatgctcaaacaatatgaggcaagaatgaggccatcccgcatccccaaattatctacctgtaagtcacagcttgcttagagtactagagcaggtttcccagattgctttggtgggctcttaattaccgaaggtccaccactaaacctgtctctggtcagattcggttaggaaaccccacatcccacactgcccctcgctgctccatgcttcagttttcttatatatcaaatgagaataaacagccatgcctacctcataagactgttgtgggaatttacgagttaatccatgtaaagtactcacagtcatgcctggcacatagttaagtgctaaataaaaggtaattgttattattattttcttttgtagagcatttgatgaatttctgtccataaaaaccctctgagagaagtcatgaaaacaaataagtctgttgagctttacatatgccggtcttagccaaatttgtctgaccacaagatcctttgatctccccataaaacattttctatcactgggggagctcaagtcctgtagagctcaccatgggatacactgctccatgacgactgtgtctctgcctcgtctacttccattgctcatccaggaattgagaagactttatcatttaagccatgagatggctgaggaagaaaaaaccagatgcctgtttaagtcacctttagatttccacttcttcttccactgaattgtccttgaaatttcctttggaaataaattccaaggtaataaaaggcctcagtgcaggtagtgtttttttttgttttgtttttttgtttttgtattacttatacacaaaaagctggctgaaaggccaaacagaatgacaataaagggcaccttgcccagatttgatgtaaaaaggcccaccttgacccaacaaggacaactgcaaacaacccaaggccagtgaccacataattccctgatgcagagttaagagaaaaacaacaggaactttgttcactatagtcacacaatactggttattcctctttctatttctataacctagaacactaaatactcctttaacaattagaacgtttgttagattgataaaaataaagaaccccaacctctcaaaaaaatagtaatagctctctcatataaccttaaccatccttaatggactaactttttttttagacaggatctccctctgttgcccaggctgaagtgcaatggggcaatgttggctcactgcaatctccacctcctgggctcaagccatcctctcacctcagcctcctgagtagctaggactacagtcacgagccaccacactctgccaatttttgtattttttgtagagacagtttcaccatattgcccaggctggtcttgaactcctaggttaaagcgatccacctgcctcagcctcccaaagtgctaggattacaggcgtgagccactgcacctggccatatgtactcatataatcctcacaactaccctttgaggtaaatgcttttatctccattttgcagataagtaaactgaggtggcaagtactaagtaccttactcaagatcacacaactagtaaaagaaaaattcaaatcaaaatcatttctgttatttagtatttctttaaatgaagtcattttttaacttcaatagatttaacctgaaaggaaattttattacattattgtgtgttatcacctacactaaatagaaggtagtctgaaaaataaatacaatgtaaataaaagaatgttattgttacctaaaaactgtcatctgcagaagatccaagactgaagtcttcttttctctctctctctctctctctctctctctctctctctctctccctctttccctccctacacctccctctgtcagaggggttggaacagagcaactccatcttgaaaaggggctagataaaataagactaagacctgctggactgtattaccagtaaattaaggcattcttagtcacaggatgagacaggaggtcagcacaagatacaggtaataaagaccttgctgataaaataggctgcagtaaagaagccagccaaaacctaccaaaaccaagatggtgatgagagtgacctctggttgtcctcactgctacactcccaccagtaacatgacagtttacaaatgccatggcaacatcagaaagcctatatagtctaaaatgggggccgggcgtggtggctcacacctctaatcccaacactttgggaggctgaggcagatggatcacctgagatcaggagttcaagaccagcctggccaacatggtgtaacccccatctctactaaaagtacaaaatttgctgggcgcggtggtgcacacctgtaaccccagctactcaagaggctgaggcagaagaatcacttgaacccaggaggcggagtttgcagtgagccgagattgcgccattgcacaccagcctgggcaacaagagtgaaactctgtctcaaataaataaataaaaatggggagaaaccctcagttgcaggaattgcccaccccttccctggaaaactcatgaataatccaccccttgtgtagcatataatcaagaaataaccataaagatgggcaaccggcagccctcagggctggtctgcctatggagtagccattcttttatttctttactttcttaataaacttcctttcattttactctatgaattcgcctcaaattctttcttgtgcaagatccagggaccctctcttggggtctggatggggacccctttccggtaacaactctgccttttcatctcctgaaaaggtagatttgctagtgcaagaagatattaaagactcacaggcaccaaactaacattttctccaccacataatcacgcccactgaatgtgacctgcaaagggtctgtctcattgcaggatccaaagccatttaatgccacaagtgtgaactgctcccaatgccctcacccatcacaggtggtcccacactggaaaacattgcttcaagcagcattaacaactaaggatgtcacaaatgcagatttatttgccaagaaatcagggtgcttctgtaggttttttacataatgagaaatcaaagctatcaatgtaaagtactgcttttaggttcaatcaatcattggtaaaatgatacaatgaggaaaacctggcttggctggcagttcctgtggaaagggactgtggtttgggctgaccacaagatcaacatcagccaagagtatgacagggttctgaggtgagagaagggactcttaggctcattcctaacctgtcagggattgaatcaagggaagggagatcctgtcctcacagtgagccaagcagaccacacctggcgctcaggaaaatcaactacttaacacagcatgtccttttcagaaaaagcaatcaagaatgatgagtatctgaaaattaagccacttgaggaatatgatcaccctacttaaaattgcaacccaagtcccttcagtatacataatccccctcactctgttcttttttttcttagaattttcacctcctaatatgcaacacgagttacttttacatgaatttattttcggccccactccatgaagacaaggatttttttacagcagtgttcactgatgcacccctggtgtgtagagcaatgactgatacatattaacaccagacagccaactgtgtgcaactcctcccaatactaggttcactgagtttacagtggtcacttaatactggccgtggagggagcatttatacaaaggaaattggcaaacactacaatcagtgctccctgcccagagctggttcttaaccattaactagcactgattgcacttgctctgagaacttgaggcaacaagaatataagaatgaacttaaagaaagtttttcagatattgaactggtaccattgtttcaacagaaactggatgacctcatttgtcaggagcacatgagatgaaatcaatgtattgcttttccgctggcctcaactgctctatgagggcaggaatctcaactacatctctcaacattgtcacggtggcaagcaagtaactttgagttagttgctgtattccattgtttcctttcagccgaaagactaaaattctatagtacatgtcaaactacattaagtctaatttccacggttctaatcactagagaaaatgggtcaatgccttcttttaaatatgaaatgtgtagtttcccttttaaaacctacgttttcaaataaaaatgcaaccacaatgagagctgttacataaggaaaaccacaccttgcagggtgcccattatttcagcctctaagcaaaataatgaaaccttctctgtacttcaaaaggaccccgaagatgactgaaacagttttaattaaaaatgcaattagcatgagttttctgagatacaatgataatgggtgggcaggacataagaggctatcattgatgctttcagcttatttaatgaaaaaagcaggcccagaaccacagagactcacacctataatccaccagtttgggaagccgaagcgggagggatcacttaagcccagcaggtcgaggctgcagtgagccatgatcctgccggtgcaccccagcctgagtgacaaagggagacaatgccgcaaaaaaaaagaaaaaagaaaaaaacctgtgacaatgaacctgtttgtagagcacccctgtttgggacaacctatctatatacctcattcatcctttcatcctttctcctcaatctaactcaaattcatttcatatgtaggctttctaaaattgacaaaaactcagtcatcacacatgcagatatcaaggatgatttttttttttttgagaccgagtctcgctctgtcaccatgctggagtgcagtggcgcgatctcagcttactgcaacctccacctcccaggttcaagcgattctcctgcctcagcctcccaagtagctgggacccccaactaccatgcccagctaatttttgtatttttagtagagatggggtttcaccatattggccaggatggtctcgatctcctgacctcgtgatccacccacctcggcctcccaaagtgctgggattacaggcgtgagccaccgcgcccagccaaggaagatttttacgtcaagaattcaacaatgcaatccacataagatactagataattctatcttgaataacttgagaccctttcggggcacaaaagccataaaagtttaaaactccaacaaatgcccacaaacaaaagggcctcaaagagcaaatcaatccatggtaataattcagggtaagaagctgagttacaccaaaggcctgtggaatggagagtgggctggggagaaattctggggtctaatccattctttgacttttactaagagttatgaaactttgggcaagtcacttgaaccaagttgcagtttcctttatcagccaaagaggaaaatacttcccctgtgtatctcacagctttcctagaagggcaaatcacattaaaaattatatttctaggccgggcgcgttggctcacacctgtaatcccagcactttgggaggccgaggcgggtggatcaccaggtcaggagatcgagaccatcctggctaacacggtgaaaccctgtctctactgaaaatacaaaaaattagtcgggcgcagtggcgggcgcctgtagtcccggctactcagggggctgaggcaggagaatgacgtgaacccgggaggcggagcttgcagtgagccgagatagcgccactgcactccagcctgggcgaaagagcaagactccgtctcaaaaaaaaaaaaaaaaaaaaaaaaaatgttatttgtatctaaaggaaaaaccaaggtctttccattgtgtctcagtctttactactaacttccccaaataagatggagacgtatttatcaaaatgtccacttgtggccaggcacggtggctcacacctgtggttccagcactttgggaggcagaggcaggcagatcactttgtcagaggtgtttgaaccacagcaactccatcttgaataggggctaggtaaaatgaggctgatacctactgggctgcattcccaggaggttgggcattctaagttacaggatcagattggtcggcacaagaaacaggtcacaaagaccttgctgattaaacaggttgcggtaaagaagccagccaaaacccaccaaaaccaagatgataacgcaagtgacctctggtcctcctaactgctcattatatgcttattataatgcattagaaggctaaaagacactcccaccagtgtcctgacagtgtacaaatgccatggcaacgtcaggaagttaccgtatatggtctaaaaagggaagaaccctcagctctgggaattgcccgcccctttcctggaaaactcatgaataatccaccccttgtttagcatataatcaagaagtaaacataaaaatagccaacaatcagtccatgcttctgctctgcctacgaagtagctattcttttactccattgcttgcttctttttttttttgagatagagcctcactctgtgtcccagggtagagtgcagtggcacagtcttggttcactgcaacctccacctgccaggttcaagccattctcctgtctcagcctcccgagtagctgagactacaggagcgtgccaccacgcccagctgattgtttatattttttagtagagatgaggtttcactgtgttagccaggatggtctcaatctgttgacctcgtgatccacccgcctcagcctcccaaagtgctgagattacaggcatgagccaccgcacccggccctcccttgctttcttaataaacatcctttcactttgtggatttgcctcaagttcttatgtgagatccaagaaccctctcttgaggtctagatcgagacccctttccagtaacagcttgaacacaggagttccagaccagccagggcaacatggcgaagccctgtgtctataaaaaatacaaaaattagccaggtgtggtggcagacactgtagtccctgctacttgggaggctgaggtgggaggatcatttgagcccagaagtcaaggttgcagtgggccgagattgtgctactgcactctagcccaggtgacagagaaagaccttgtctcaacaacaacagtaaaagtccacttgcattcttgtgctctcttcaacttatattacagggtaaaaaaacagttccgctattattcctctctgtggcatatgaaaacctgccattacatgtggatttgaacccaattgtgggttcaaatgaaacagatcattggaaaccaatgaaaatcactacctatattttttattgcactgtgactagagaagggtaagtgtatacgccaactcatagaaaagcttgatgacaccaaactacctgctctccattgtaatactatcacatttttaaatactttcctgaaacttggagttaccaaatagtccagaaaatcagccacagagataaatcaacagattgaaaatccaaacacatggaaacaggggaaaaaatcgtatcgagttttctaatgtttgtggacacaaatgcttacaaatatttcaaaatacttcactaaactgttttatttgttaggacagaatgccttgaacttgcactcttctgatacgacttgtagattattttcttgcacattttctctcccaaccaacataaaataatgcaaacaaggtctgttcgaagactatggattatgttcttttcaaattacttgaacctgggaggcgggggttgcagtgagctgagatcacaccactgcactccagcctaagcgacagagtgaaactcagtttcacgaaacaaaaataaaaaagaaagattaggtaatatgttttctaaaactgctctctcccatagcaggtaactttgaggtatgtgtctgccccctaggtttcttctttggaacacaatccccttcagcattcccaccatcccgaacatatatataccatcaacagaaaaaagctccgggcagccctagagttccacccaccccagcaatggctgattgccttaggcatcggcacctaattgaagctctacctatgaaattctctctttccaggaagctaaaccacagaaactctctgtgactaaagccatcatataataagagagccaaaggggcttccaaattccacctcgtagatggaaaatcagagaaagcccatctatagaaagaaacataatcagaggaaagaagatccttcatgaggccctctccatccttccccttgggttccatgagactttgccgtctctagataataaattatccttcctgcttaggctattacttgcaaccaaagctgattcataattatgtttaaataaagtatgatgctacattactctataccagactacatttacttaacagtcctatcttttcaaagtttaaatcttgatatgaaagagaataccatctgcctctaggcagcacctaagaccaaatgctccattgaaaatcaggcattcagggaagcttacagttatacttgtttcaataagtattttgtttaagtgtgtatggctgaaagaacctgttccaggactaaactcaatattaatccacttgaagacaaaagccatatcttagccttggagtccagagagaatgcaaaatggctgaagtgcagtggcctaaaacaataagcatttattatctcacagagtttctacaagtaaggaacagtttagttcgtggctcaggatctcatgtggttgcaatcaaaatattggtcagggctgcactcatctgaaggcttgactggggctgagggatctgcttctgcttctaaaatggttcactaatatggctgctgatgagagaccctggttccatgctacgtggacctttctcattggttgcttgtctgtcctcatactatagcagctagccttccccagagtgacagatccaagaaagcaaggcagaagccacaattctgttacgacctagccttgggaacaatactgtgccatttctaccacatactgttggcttgaatgtcagtcctactcagcttaggaggagtccatacaaggccatgaatatatggaggtgaaaattattgggaggagaggaggggtcttggaggctagctacaattggctagattaggatagatactccttgaaactccaaagttacactaaatatagtattcggagtaaaagaagaaagatatcttaaatgagcctattttattaattgtttatcatcatatgtatgcacagcagcaaataaatgtattataaacatatccccattccggtcaggtgcgggggctcatgcctataatcccagcactttgggaggccgaggtgggcagattacctgaggtcaggagttcgagaccagcctgaccaacatggtgaaaccccatctctactaaaaatacaaaaaattagctgggcttggtggtgggcatctgtaatcccagctactcgggaggctgaggcaggagaatcacttgaactgcgaaggttgcagtgagctgagatcgcgccactgcactccagcctgggcacgacagagcgagactctgtctcaaacaaaaaacaaaaacaaaaacaaatccctattccttcaaagaggtgaatctaggtgagacaccaagatgtgcacaagaataattagagggtaattagggtaatgaactgattcttttttttttaatatattttaccatttttttttttttaagatagggagaggatcttgctgggttgcccaggctggtctcaaactcctggcctccagggatcctcctgtctcagcctcccaaaatggtaggattataggcatgattctaaatacaacagaggttcagaaaaagaagaaacaataggtcggataaagcaggggaaaatctttctctgttctttacaaataaaggcttaccttcaggtggcatctttaaccatctattttatagactacaagtaggactttttccaaacattcatttgatgttagcaagtgatttaacaggactaatggtgcagtacatttaagaaaaaggctcccaacctaattataaaaccgagtccctcttatattgggccatttaatggtgccagattgtggtgcagtacatttaagaaaaaggctcccaacctaattataaaaccgagtccctcttatattgggccatttaatggtgccagattgtgggctgagaagaaaaagttgttgtttttttttttttttaaggggaggttgtggtgggacattccaaaggggaacattgaaatcctcttgtgagcaaacatcaataagtaatctgcaccaatttaatctgcattgcacaagtatttatttaatcctatctatagtaagccactgtggttggtacaaacacagtaaagaacaacacagataccagtcctgcctttatcaggaaagacaaaacaaaaacaaaaagtaaacattccagtaaaggaatgattagtgctattatgacaaggaaagcatagggaactattcgatcaaagaagagaggttacagttccccaaatctagggtgtttggaaaggaagaatatccttagtaaatgacattgaagctaaaacctaaactatgtatagcagtcagctagaaaaaacaggcaagaaagaatatttcaggtggagagaaacacatgttttcaggccaaaagctggagaacaaggtgagtttaaagaactgaaagaggtttagtgattacaatgttgaacaaaagggggcatgtggaatgaataagaagaatggttttgtagattgaattctctgcagcaaactccatcaagaggtagaggtcaggcatggtggttcactttggaaggccgaggtgggcaggagttcatgatcagcctgggcaaaaaagtgagaacccatctctaccaaaaaaaatgttttaattagctgactgtggtggtatgtgcctgtggtcctagctactcgggaggctgagatggaaggatcgcttgagcccaggaggttgaggctgcagtgagccatgaggctgctactgcactccagagtgggcaatagagcgcaattctgtctcaaagaaaaaagaggtagagtctactacctcaccctttgaattttggctggcctggaagttgctttgaccaatagaatgtggtaaaggtgacactgtgtgagctctgaagaaagggcctcaaggggccttgccacttccaccttcctgcttttgaaatgctgccctgaaactgccaaataaggaagccagtctagcctactggaggaaaataaaccattgtggaaaagacaccaaggtgcctcagaggacagccagtaccaaggccagagacatgtgaaggaagtcacatcagaacttccagctcaaccaccacccaggtgaactcggcagatgagtaagcccaggtgaaaccagcctaagaactatctggccaactcacaaaatgatgagcaataacaaatcattggttttctttaaagctactaagcctgggggctttgttaggcagcagacagaaaaaagccacaacacacaggaccaggttaaggacttcaactgaccttcatcctaaaatcaatggaaagccatggaagggttttaagaacagactgacataatccattagtaccacagacacagtacctatgccaacaaacctcccaaggccctagaaataacaggaatatggtgggaggaagggaactgactgcaaaatacaaagagaaacagcagaatcaaaattcctaagcgtaacccacagcaagtcaactgcaaatcaaaaattcctaggtagtgaccaggtgtagtggctcacgtctataatcccagcactttgggaggctgaggcataccgatcacctgagggcaggagttcgagaccagcctggccaacatggcgaaaccccgtctctactaaaaatacaaaaattagctgggtgtggctggtacacgcctgtaatcccagctactcaggcagtgggccaagatcacaccactgcactccagcctgggtgacagagactccctctcaaaaaaaaaaaaaaatcttatgtagatatatatatattatatttcatcaggaaggtgggtacattttaatatgttagttatagaagagggcaatctccaaagtaccttacaccttcaaagtctcgtgcggggtgtgtgtgtatctgtgtggtgtgtgtgtagacagggtctcactctgccatcgaggctggagtacagtagcacaatcacagctcactgcaatttcaaactcctggactcaagcaatcctcccacctcagcctcctgagtagctggggctacaggtgtgcgccactgagctcaggttcaaagttgttgttgttgttgttggtggtggtggtggtgatggtggtggtgatggtgatggtggtggtggtggtgatggtggtggtggtggtgatggtggtggtggtggttgttttaatctctacctaattttctccacagacagtatctcctcctgatgattaacaattttgtatagcttaccaagagcaaaccctacaccacacccactgtcccaggaagagaatctcatcagggaaataaactagcaatagacaaggaggcctatgttctgaaatctgaattccaatagcaagttattactgtttgagattttgaagagctgtcaaaagaatggcagcctgacaaacaccttgaaaactcttgcagcctatttgcagacctcagccagccccaccctgacacttctcccttgcccttttgcctcagatttccaacgcttgctagctttgtctgttttgaatggccgtgctcagtgttcagctacggaaatcctctccttccccagctggctcaccaggaaattgtttagaagtcaggtttttcctggaggtggcccacaggcccacagagaaagagagaggttgtgtcaggggctgagagcactcccctggtgaagcaatttgtggatgatggtctgaccacaggcaccggcagcctctgcggtgtgaagccatcagggtgcatgtgtgtttgctaggtggcttgctttggataagcacaagcacaactggctatgcctaacctgctaaatagaatttttaagccacttcttttattttgtgggttttttggggtttttttagttacaacttaattaacttctgacaagcagaagagccactgcagacagtaaggtttgacaccaaaaaaagggaaagagataagtaatgaaactacaccaaaattaagtaagattttgcctaagggacattgttctgttagatgattactccagcccaaataagaattaatcaggctatcattccgtttgttggaaaataaaatatggcatttatttttttaatgtacttttataaaaaaagaaaaagagacattatcagaatcaagagaatacggatcaagcaatactctattaggaaataaatggctgaccagataacttgaccttaaaaagtatattccatattatgggtcaatatgatcactcttcctatcaaatccaagtgcatacaaggaagacagacttcaagctaccaagaacattcttcaattacctaagctacaaataaaaatagagcttccatgagaaataaagaattaggtcagtggataggaacagtttctttccatttaagttaactaaaatgttacttggggaaacaattttgaaatgtgctttaatgtaaatgttatattaaattaatatgaatattataatatattaacataattatactaaataaattaatataaatatattaaatgaactaatataaatattatattaaatatattaacttaatataaataaaggtctttaaggacctttaacaacaagctctgttctcacttatctgttcaaggtgattcgagtactattaatatttgcaggctggagatggacaagatgaccaacctctgaatgtcccctccatcttataaggacattgttaaaaatgacaacctccctactcgccaagagacttgacacttcttccttttccgcactgagacaggacaatttaaagcccagaataaaataaattaaaataaagtatcaagcatgcacctctttgaatgaagatttctcgtaataaacctaggcgggacatcctaattatctaaggcctgaagatgttcttcggtgtaacaatgacctaagatttatttatagttttcctgagactcattaaacatttcctgcaatgagaccacatcactgaaatcattttattgtgatagactggcagagcacaaggggaaacagtcctcaaagacaaaagaactggtgggtgtctttgtagcagagggcagtgcatatttttttagtgaggatgcaaccattgtaggtaaacagcaggaactctcttctgatgctatatcctgtcctgtttaactcattaatttaggagacctcagccactagagtaaaacactagcactagtaattcgtttgcgcccccatcccaaaatcaatttattaaaattatattgctaaagaaaaagaaaaacacataaactagtttactttgaactaacatggattatgcattaaatgggctactaagtcatcaatgaaataaattcttttgaagttattgtggccctacagttgtacatgaagagtctttctatttcccttttttaaaaaaaatgccttttgtatctcctgcaggtttccacatttctattcctatgggcaggaagactcatacagccaaatgtttagtcctcattattaaaaaatatacaaacatttcaccagcaagatcattatttcatagtctttcatgtttacactgtagggggtaaaatcaataactcaatgtgaactccgcacaaattaccaacagctaaatgtagatgatgacagtggatcttaaattactcataaacaaactgaatgaggaaaagtatcccaaagaaatattgtcaaatagccctaacgatggttcattttctaacttcagaaaaaatatttcaatggtgaatgtgaaattatgagcccatctaagtcattaagtaggagtgtcataggctatataaaataccagctcgtacttctccatactcagacaggccctccgatcttccctggactgtgtcatctgcatctaaaacccagtaagaaaggaaagggaaatcgatttggggaataaaaggacattagtagtcatggtatcaagtctcatgagggtttgagtctaacaaggtttggggagcaaagctgacattcctcatagtatttgaacattaataagcacattgtggccagctgataaatgcttgttcataatattactaagtttctggattgttttacagtccctggagatcaaggaagaataaaacaagaaggaagaatcattaagtgactaaaatgaaaaaaatcaaagaagaatcttgaaatatgagtgtggcagaggctgcaagttgcctaattattttcatccctacctctttaatccttagaaacagaatttctacatcactggcaaacatgtgccaggagctaggctaggccgccctttaagagggaaagcagtgaagcactagaataacacccaggggagtgttctccaaaccctcctacctcttattccaagcaaagcagagagcgcttagggaaagcaatactaggaatggctgctcaaagaatttactctgtatgccacactctcacaagaaattaggggatgttttagtccgttcatgttgctataacgaaatatcatagactgagtcacttataaataacagaaatttatttcccagagctctggaggctgaagtctaagatcagggttccagcacagtcagattctgctgaggaccctcttctgggatatggactgccatcttctcactgtatcttcacgtggcagaaaagaaagtgagaaagctctctggggtctgttttataagagcactaatcccattcatgagggctccacccctatgatctaaatacctcccaaaggttccaacagtcccacttccttacaccatcacattgagggttatgatttcaacatataaattttggggagattcacattcagtctataacacgggtcccattacttttctactgagattgtttcctcagctttagtattggtaacattctgaattttatggaactactacaaggagtaaacaaaataaatgtaaccaaagtgcgtatcagactgcacaatccagaggcaacccacaaggtattaaccatgatttagtttgttcatagcacgtttcagtggaagatctctcaactcctcacaaaccccaaaccttaaaccatcccgtcatattcaattagggaaactctaagaggtattacagttttcctggcaactgacaccagatgtcacctcttccctcccctgcttccaccctcaaaatttgtaatttcacatgaaacagtattcaagaaaaaaactataaatggaaccaaggtacaaagaattataattatattgcccctgccgggcacggtggctcatgcctgtaatcccagcactttgggaggctgaggtgggcggatcacctgaggtcaggagttcgagaccagcctggccaacatggtgaaaccccatctctactaaaaactacaaaaattagctgagcatggtagcaggtgcctgtaatcccagctacttgggaggctgaggcaggagaatagcttgaacccaggaggtggaggttgcagtgagccgagattgagccactgcactccagcctaggtgacacagcaagactccgtctcaaaaaaaaaaaaagaattatattgcccctagttaaaaccaagacagttcactaatacaaaacggcatcagattgctccaaagtaggcttcctcagccttggtactattgacatttggcgctagttattgcttctgtgcactgtaggatgttgaagcagtatccctggcctctaccctgtagatgcagtagcactctcccagttttgacaaccaaaaataagtctagattgtgaactgtcccctatggggacaacatccccacccccacctccccttaagaaccactgctatttgaacaccactgaaatgaaaaccccaactttaaagtctaaagctcttgagtttggcttctctcataaatgaagaaaataacatcctcagaaataagaactgtttcccaatggctttcaggcattaaaggaaaagtattaactttctgttgttgttgttgctgctgttgtttggaacagggtctcactctgctgaccaggctggagtgcagtggtggaatcttggctcactgcagcctctgcctcccgggctccattaatcttcccacctcagcctcctgaagctgggactacaggcatgagccatcatcccaactatttttattttttgtagagacaggggtttcgccgtgttgcccaggttggtcttgaactcctgggctcaagtgatccgcctgccttggcctcccaaaatgctgggattataggcgtgagccaccatacccagccttagctttcttagaaaatgccattttccttcctgacctgtgaccaggagctttaccacacagcatgttgctatatgcacagcacagtctgagagaagtgttactttaatggctaatataataccatttgcagaaaaaaaaaaaacacatacaaaaccaccaaaaggagaaatcctgacattagtgaaatattcagttgtaaaccaaaagaattccttactgagagtgattggctttcacatgctttgcccagtaatgagcaaatgatatctgaagacgttttatctgtgctctggagaactactatcttttagtagcctcaaacagacagttgatcattctgggatttggacatgattttcttggtctcccagccccattacccgggggccagaaaaaacatttggcatgatcccgactctaatataaaagggttggctccctttttggtttctaactaccactgttaaatatgaggtcaaagttctaatgattactgtcactttctgattttacagttaagtatatcatacagaatgttagcaagtgcctcactttcctcatccataaaggcagataatagcacctacaccctagagggttgttatgcagatcaaattttattttgaggatcagtatttgtaaaatgcgaccaggtgcggtggctcacccctataatccctacactttagtaggaggccaaaccagacagataacaagaggttgggagttcgagaccagcctggccaatagggtgaaaccccatctctactaaaaatacaaaaatgagctgggcgtggtggtgtgcacctgtaatcccatctactcgggaggctgaggcaagagaatcccttgaactcgggaggtggaggttgcagtgagccgagatcatgccactgcactccagcctgggtggtggagggagactctgtctcaaaagaaaacaaatttgtaaaatgttcacaatactgtttatatatagcaagtggtatataagtgcttgttaaacaaatacaatctatataactcttgttatttgatggagaaattataatgtttacagttgcattcgtcgtgccagattggctgtatttttgttttgttctgtgtttcttttgctgggagaagatggagaaacattctttgaaaatgtccctttttctctctgaaccttcactcatgccctagaaaaaagaaaatcatctcagggccaggcacagtggctcacacctgtaatcccagcactttgggaggccaaggtgggcagatcacgaggtcaggagtttgagaccagcctggccaacatcgtgaaaccctgtctctactaaaaatacaaaaaattagctgggcgtggtggcaggcgcctgtaatcccggctagtcgggaggctgaggcaggagaatcgcttgaacccgggaggcggagcttgcagtgagccaagatcatcactgcactccagcccaggtgacagtgcgagactccatctcaaaaaaaaaaaaaacttctcaggaaacaataccctactatatgtgatgcactaattgtgtgtgtgattgtgtgtgtgtgtgtgtatatatatatgtgtgtatatagattctggtttgtaatccacagtacagatttcactacagtcactaatcttgtcctacaatttgaaaaacactgctttagatgagtattccaagaagaatattctgtagagaagcagtatcacaacatattaaagagtttcatgttcaagaaagtttgagaaagccttactttgtacaccttaacaacagtacaagtcattagatatcctgcaattaagaaatatattcattctacagaactcaaaacttatttgtgaactgggcattgttttcctccactgtgacagggcagcatcatatagcttgtgggccaattttcatatttctcaaatgaaaaaagttgagttccaggaaaaaaacattctttctgactgaatctaaaagtgcctaactctgtgcctaactcaagtagctgtttaagaatcctggttcaactccattaagcagttttgccatttcttagtaaaatttaataaaaagtgaccctggattatttttcccttaaaagggaatgttacttgttaagcaggcaagatagcagaaattgaaagtgctcagctaggtgcaatggctcaggcctgtaatcccagccctttggaaggcagaggcaggacagcttgagcccaggagttcaagaccagcctgggcaacatagcgagactctatctctacaaaaaataaaaataaaaaaatgagatggatgtggggtacgtgcctgtagtcctagctgctcgagaggctgaggttggaggatagtttgagcccaggaagttgaagatgcagtaagacatgctcatagcactgcactccagcctgggcaacagagcaagaccctatctcaagggaaaaaaaaataaagtgctatttaaatgctaatagctttccaatgcctttttttgagaaaaagaactaaggaaaggaagagcaaaagagagaaagaacagaaggaaggaaaaggaagggacggagggagggagccatgaagggagtcctttggatattagatctcctgtgtgcaagaaacttctagaagtatgaccagctcaccaaggaaatagctaaaaaataaaacaaagatatatgtctaaatttcatactctttgcagcattacagaataagggaagatagttggggtagagaggtggataacccaacaatagggaaatggttaggtaataaagagagtgtcaattttgtccgacagcattaaaatataacaaccaggcaaatattcattatgtaatattagcattcattcattatattgaggatatccattacataatattgctgtgatggggcatgaaatagaggacgggaaccaaattcatccatcacgttacaacatatatgaaaagcaacaaggaaattggaaacaagtggtgtgtccgtagggcaagagtgctcaaatctgggagcaccaatggatctggtggggaagccctttttaaaatgcagagtctgtgggctctctcccaaacatcctgattttgaagggccagggtggactcaagaaactgcatttggtttttttgttgttgtttttaacttttactttaggttcagggatacatgtgcaggtttgttatatggataaactcgtgtcatgagggtttgatgtacagattatttcatcacccaggtactaaacttagtacccaatagttattttgtaatgaccacctaggagattctgaggctgatgatctggggaccacacattcatttcatgaaaacttaatgggtatgtagtatctgctgtgaaagcaaactaagtatagcctgagaaggactctgtacttttatatttgagtccttgtggaccaaccttgtctaataggtagacaagggtgaaaaactaatttaggagtatgcagctgtaacaatagctgagtcttggccaatcccagtagccatgcttcaaccagtcatacactgctgagtgttcaactcttttccaaataaggcaaatgccaaggtgtaacccatccagctatttctgtatctcacttccgatttctgtatgtcatttctcttttcttgcctataaatttattctgaccacagggcatccctggagtctctgtgaatctgctgtgattctggggactacccaattcgtgaatcattcgttgctcacttaaacttctttaaatttaatttggctgaagttgttcttctaacactgccaatccctgttctaggtgctagagacagagcagtggctaaaggcacacttgagaggcaagcaataaagtggtaatcattcttttaaaaatctttagtattaaaatagtatttattaaataaattccctgaaaaaaaatcaagagccaacattttcctgctctctaatttatgttttacttaagaggaaatgcaccttagaaagctctctgggcctggccctagggtccgcctacagcatggacactggaagggggtggccaccgagggtatctgtccaagtgaggtcctggcacttcctgccattcctgcatgccctcccagggcactaagggtgatgactgggaattagaaagggtggtgatgaagaaggaataaaaaatgtgttacttcaactcacaagaaacacaagttaaagaactttcgggaactacaagtcctcgtcagcgtcttgtgggctattgacgctgacctcccaacttggtgccagttagaatttcctccctgccttttctgcatttcatcatttatttcctggtttggaatattaaaactttgcttacatcctgttttggtccctttggtttttttttccgttgggcagaaatttcagcaacctcctccaggttagagaaaagcagagccaagggtggcaatgactttcagcatggacgagaacagccaccaagaggggagagctcaaacctatttgtcttggcaatggcattcagtgagctgctggttatgtcatctgcctacaagtaggcctcactgttttgcagtcatccatttcccaataatggtatcctgacaccacacacgcacacccagatctggcagcgcacccaccagcctgcgctgactccagaagaggtagggccagggacaagaaaacgaaaaacaatccacatgaaacagatcacttaagaatgttaaatattaaaaatgctgttttcacctgcagagtaagaaaatataggaaaaagtggatagctggagaattttatgcagctaatgagtttatacagtttaaaagcacacttttgaactaaaatctaaagtgacaaaatcatgaaagctaagcagtatgcaaaactctacaactgaagtgtttcacctcagtattttatatgaattaatttcaatttacagctaaatgtcaaggcaaatttgtttcttttctatcttgtgttatgtttggtaccctaaggcttttagacactgaataacttataaacaaataacatctcatcctcattgttatgtaaaataactcccgagcttgtgtttcctgtagttcttcaaggaaagaggatcctaatgttgaaagaaaattgtattggtaagccatagcaaatggttcctaaaagcagactaacaaaatgctaagataataggcccctatcattttatatttatggttttatctatagtaattctgggattagaatttgtaataccccaaacagcatatgtaaggtataaatatctcctaaatatatttaaaacctggaaaaattatacaatcaacctaaaatggaggaacacaaagaataatacaacatgtctctaaattctgacataaatttaagggatgaaaactcctatatttatatttttaaatcatcaaatgaatacactgagataagctataataaaattattatgctcaatttacactaattataaattgtacgtttctgattaactgttgaggctttcaagtgaaagctttaatcagcaatatcagttttttggtttgtttttctgagacggggtctcggtctgttacccagactggagtacagaagtgcaatcacagctcactgcagcttggatctcctaggctcaagcgagcctcccacatcagcctcctgagtagctggtaccacaggcatgcaccatcatgcccagctaatttattttatttttagtattgatgagatctcactatgttacccaggctggtcccaaaccctgagctcaagcaatcttcctgcctcagcctcccaaagtgctgggattacaggcattgagcaactgctgtgcccagcaatcagcaatatctttctctttttttttttttttttttttgagacagagtctcactctgtcacccaggctagagtgcactggtacgatcttggctcactgctacctccgcctcccaggttcaagcgattgtcctgcctcagcctcctgagtagctgggattacaggcacatgccaccacaccaggctaatttttttgtatttttagtagagacggggtttcaccatgttggccaggctggtctcaaactcctaaccttaagtgatcagcccacctcagcctcccaaagggctgggattacaggcatgagccactgcacccagcctggcagtatctttttaaaaataattgctgctagcagcaatggacactctgccctggaatattataagatatatctccagccttcctaaatgactcccttgtttcataaaaccccaaattttctgccttttctttgagactttcttcattaatgaaagttctctttattgcaatagcctaaataaaaaacccaatacatgtgcccttttattatactaaaacccaaatggttcaagtagagcttatggtaacttttaaatgagattaaaaatcacttggccggcctcatgaaattacagtttgagttaggcccagaagcctgaaaattttggaaagttcagtagggttaacccaaaaaacatctaaatccaggtttaaatttgggaaatcttttctttaaaagagaaggacacaattcaaactggctcaacttattcaacatacttataaaacaaatcactaagtctcaaatgagtacatctatctttgacccacagacttaaaaagctatatatgccaagaaataatatttaagcaactgttaaaatctgttaggattttagaatcgtaaaatcctttggcagtcaacccattctacagggcacgaagacgatgctgcagatacctatccatgaattatgcagttcaattttatgtccctaagccaaacaactgaattgaattctccacagtctcttccaactgcccagtaaccagcctaagaaaggtgacaagagcaaagcaaatgcagcacagagaaaaagacaggcaaagatggcagctgtcatttcttcacattgtgctgtcagacactctatattcctcaaagcatttgtcacctccggagcacacttccattgctgccaacatgacatttggctataaatttttattcactccacttattaaaatgcaaggcccttggtccagagcacgtgtcatatcagaaaccttcccatcacctgcataataaacctgtgcaagctgtgtccaacatttgtgtccctatattctagaataatgcttaacacagagtaaccacccactaaacattgttggacgaggtgttaaaggtcaattgctatttctgttgttattactactagctggctggaaattgctaagttcctgttaggtgcagacttaagaaaacaaaacagaattcactgacaaatgttatcttctgtctcaatcgtcatttagacttgaccaagtttactgcttcattttaccaagactacaatccctcaaaagaaggaaatgtactttttattgttggtcacaagccctagcacagtataatattcaacatgtccagcattcagctgaagtatgagacatgcctccaagtttctaaggctgaaaagagttcaactttctctccaaagtgctaagatataccacaagtgctacatggggagagtctacttactggtaggatctaaacttaaacctccacatctatctaaattcccaagtttttaaactttcctatctagggaaaaaagtttcttttacttttatatcttggctccagttttatatttaaactagattggggctgggcacggtggcacatgcctgtaatcccagctcaagagtttgagaccagcctgcgcaacatggcgaaaccctgcctctgcaaaaaatacataaattagccgggcagagtggcatgtgcctatattcccagctactcaggaggctgagatgggaggatgacttgagcccaggatggggaggctgcagtgagccgagatggcaccactgcactccagcctgggcaacagagccagatcatcaaaaaaaaaaaaaacaaaaaaacaaaaaaaaaacaaaaaaaaaaacaaacaaaaaaaaaaaacagaactagcaatattactgttttttttttttttactttacagcttgtcaattttaatcaaaagaaacgaaaagccacattcagtattaaagttaaacaagttaggagatgaaagtagactagaccacccaagtgggtaacttagcactggctgaaattacctagctttagttcagagaccactcctgaaaaggaaaagacatttctaacaactttagccaaagatctgggttctttgaagcctcaaagaaccctcctggtaagggtactctgcatagatctgcatattctcccatggccccaaaagactaaaagcccaggcttgtaccccgccctcgctgttgaaggatcctcagagaaagtatgttgagaatccatgaaaaactaatttaaaagattaaaatgtgccctgcagctcaccctctctagaaaacactacaggagaaaaacaaacaaagaatataagcaaagtactaaaaatccctatgtaaattaaactctgttgttataccaaagattgctcaaaggaaaaaaaattatcatctttccaagaatttgtaaatccctcttcaactggttggaacggaaattacaaaatgctaccccccactggtcggcaaaagccaccacttaaatggaaaagcttcccttgaatcaaatgaagtcccagacagaggtatgcactgtgtgctgtcactaccaacatgaggacctactcagggacagatagagtgcagggatacctcagggcaggggtgtccattcttttggcttccctgggccacattaaaagaattgtcttggaccgcacataaaatacactaggaacaatgatagttggtgagaagaaagagaaggaaggaaggaaggaaggaaggaaggaaggaaggaaggaaggaaggaaggaaggaaggaaggaaggaaggaaggaaaggagggagggagggaggaaggtgggagggaaagaaaagaaaagagagagggaaagagagagaatctcataatgttttaagaaagttcatgaatgtatgaatttatgttgggccgcattcaaagcatccattcaatcactgttttctcctcccagagaattctgcatgtagtcaggctctggagctgcatggtccaatatggtaacccccagcagaccctgaggacttgtcatatacctcacatggctgaagaattgaatttctcgttttatttcatcttcaatgattcaaattgaaaatactcaatgctgttagtggaaaacatttcattgtgtttggaaccacctgaatctactttttcagtgaaattttgttaaacgtaaaaacagatcaaatgtttccaatgaaactgttgcatcgaaatggagatatactctgaagtataaattacgcatctgattcaaagacagtatgaaaaacacgtcaaatatctcacaagtaacttttattattgactacctgttgaaatattattttaaatatatctaattgaataaaatgtattattaaaattaatttcacttcttttttactctttttaaagtagctaccagacaattttaaattacaagtggttcgcattatatttctattggacagaacagctctagagattccaatcagcttaagccttcaactttaaaactccttaatcatttttacgcatggagttctttggcagtctggtgatgactattattacctcagaataatgtttataaatgaataaaatatgtaagagtccaaaggaacctaattatactgaactgtagtgagcaaaatattcttaaataatcatgctttttcttaaggcactgaagaacaataaataaataatggtgaatctattagctactgtagtgataagagtaaatgagattgcaatgtgatattaaaatatctgagattcctactgacgacaaagtcataagtattgcttctgtcactgtggtttgttgcctacattcataattcaaggaaatgctcaaattcagttaggggttagtgaaagtgtagatagataactcttagcccacccaaatttgcagatcccctatttctctgacagactttttggggacccgtggattccaaggttaagaatgctgttttaatgcctgatgaatctgtgtgtctgtttgtcaaagatgacccccatccttaggatgtaattttgccttggctcattcctgtcaatttggtgttcatgactcataattcctgtttttgaccacaactaaaccaatattagaaggaagtgcttgcacttgtttttttccgatacttttgctctgcaaagggaacaggaagaacagcaaggagtgtatatttaaaagaaaagagcaccttaactacgtaccaaaacacaattcttttgatctaatgattaatttgtgtgtgttagaatatttaccaaccagaaagaccacataaggccgggcacggtggctcgcgcctgtaatcccaacactttgggaggccgaggcgggtggatcacgagatcaggagatcaagatcatcctggctaaaacagtaaaaccccatctctactaaagatacaaaaaattagccaagcgtggtggcgggcgcctgtagtcccagctactcgggaggctgaggcaggagaatggcgtgaacccaggaggtggagcttgcagtgagccaagatcatgccactgcactccagcctcggcgacagagcgagacttcatctcaaaaacaaacaaacaacaacaaaaagccacataaatatcactggcacttcatataattaactgtacaaagtatttcctgttgtttgtcttgacaaacactttcataacacttaccatgtgcagatactgttctaaggactacaaatactaactctgcaatccctaatacaacctatgagtcaagtactattattatcccccttttacagatgagacaactgaggctcagggaaaggttaagtaatttgcccaaggtcacagaattggaattccaacagagagcagctgcctatggtgttctcaaagggagggcaatgccaaacgaaaacaagcaacaagactctactcattgcaagtgagcaaaggttctgatcaaatcttcattcttgcttccaaatcacttgctgaaaaattaaaactagataagtaaggacagctgcctttataccttctggcctattcacaggcagatttccagacgaaaccaaaggccttcatgaggaaaaacaaagctcctcagtctcagggcagctaatgctgggcctggcattttttccactcttatctaaaatatgctacaggagaatctaggcccagtgataagccaggtttcaacttcacctccccagcctgagagcgattacacacatacttgggatttaaccagcaagagaaggacacggaaacctgggtccctccgagcccagtttctgttgacactgttgccagggctgagccaattgcaccagtgtcaagagctccacagggaggtttcagcagggaaaccagccctacaggtgtatccagggaggcaggtgtacaaggccacattctttcctccactgaacaaatcaaggtttgtctccctgctgtgcggggctcacagggccagataaatctctctcagacaacaacctcagcacagaaacagtgtagcttgctgccactctgtagcaccgaaagtaaaatgccaaccactgaaagagagaagcagataatgttacaataacatttatctagaaaggcaatgttcgttaggtaaaatttaactatggcaaaaatctttaggacagatagactcaataaatgtttgtggaactgaaaacctagtgctaccttttaaaaggtttcttggactaatttaaaagcttcatttggctgtgtgaactggcattccctttctaaaatgatagagtcccagtggtagctataatgttaaataaaatgacttcatttcctccagaggaatatttttaccccaaccccccatactccggcactcaactactcaagactccaacatcagggggcaaaaagtcaggcctattaggcctggatcgttctcagattaacaaccttgggggaataatcctataagaaaatattttcaagattttgggtaataacatttttgggccagatgaaatttgttagagtttgcacttctgtttctaaaaacctctgaagccatttgtttcccacagtttttttcagaagctattttgtgggaaagaaagccagggcctaggcagcaggccagctagaacggggttgctctgaaagaaagccagccccggcaagcaggagcgacatgggcagcgcttgccaaggtggttaattttttacctgggtagagccataggcactgacatagaaaatgtctgtgacacggcggatccggaaacaggcaagatgcacaggcagtggagtgtctgaccccaggtttgttgctacaaattacaaaggaagttatgccaaactgaaatagttatctacagagagaaggaggaggggcggggtgtgttgtcaggcggcacggcggggaaatggcagtgctgcgacagaggacctcgactctggactacacagcctcgcactccaatctcagttctgccacttgttgctggaggaatcttaagtcaagtttcttaaacactctctgcctcagtttcttcacctataaaccacaggccccaacccccagggctgctgggatatataccaagcaggtactcagaacagtgcctggcactgaggaagtgccaggtaagggcagctgttgctatttgtgcaaattctgacatttgtcattctgaacataaccctcataacaaaagaggtacaactgttacctccactgagagatgaaagaattgagacttagaaaaatgaaggaatttgctcaaaatcatgcagttagcaaaagactacctgtttgtgaaatcagagcccagcagttttaacctctctcatctggtctttcttcccttacttaacttcccgaaagagagagacagagacagaaagagagaatgagagatggggagaaacacagagacagggaggaggggggaagcgaagaaaacacgttagaggtaaataactttttaagctaataaaaaataaccttggccaggtgtggtggctgacgcctgtaatcccaaaactttgggaggccaaagcaggaggatcacttgagcccagcagttcagggccagcctggacaacactgcctcttaaaactaaataaataaataaacgtaattaattgcaaatgaaattccaccaggccaaactctcagtggctacatagtaagtggttacacctctcctagcctcctagaccagttgcaccttgattctagctgagtttcactaagcagggcaaatgaagcaggagaaggctcggagggaacccacctgaaatgaagctcagctgtctttgaagagtctatctattctaaggctcaggagtggtggcatgatgaatatcgctgctaggagaagaaatgcaaaaccatataacatttttgcctttccatccttgaaatgccttacaatttcccttggaaaaaaaaaattgtcttgtaattcttatttttctttacttcactttttcatttccagaactgctatggttctggctgaagtatcagaatgacaaccatggatcttctacaatgccaccatcagtctctcagcaattgtagcaaagggaaaaacaacaccactgaggccgccagtcacaatatttacccatgccagagtgttctgtttgttttcggtggaggatgcagagagtagataaacgaaaagcaaaacttctctgtgtcaaaacacaagctgaagatgatttccttctccactgcccatgtatgaaatatacacaaatccagggcagccctgggccgaaggagtgtttatggttctgcccggccataaacatgccagccttcaaaacaccaggacatcaaacaaacaaggcagttccagaaaggatatatcgacttttgacgtctaatgctctgggtgaaataactttgtttcccctaaaaatagataaactaaaataaatataagagtattctacagcaatgtagctagccgcatcttcctgtgactcactgtttgataataactatgggccaggaactaagtgctttttggtggaatgactgatgctcttcataccaactcggtgaggaatttaaaatgacatccctttgcagataaggagactgagtctcaaagaggtaaataactatgtaggtttacatagcctgccaccggcatttggaccttggtgtgtgagattctgtagggtgaagtctaacaaaatggccccaccttcagttaaggattcaaatgatcacctagtagcccttcaaccagggttaaagctaaactcattcagagtttctggctctaaacctcactctcatttctttacagtgaaacacagaaatttaaaaaattcaaagtaggcatactttcaggtggctaaaattaaaagatcatcaataccaagcgccgacaaggacgttaaataatggaaacccatagactactcgtggtaacataaactagaagagctggaacactgcttaaaattacctattgaaggcagggcatggtggctcacacctgtaatctcagcacttcaggaggctgaggcgggaggaccacttgaggtcagaagttcaagaacagcctggccaacatgatgagaccccatctctatataaaaaatgcaaaaaaattagcctggcatggtggcacacacctgtaatcccagctacttgggtggctgagacaggagaatcacttgaaccgtggagggagaagctgcagtgagccaagatcacgtcactgcactccagcctgggtgacagagtgagaatccttctcaaaaaaaattatgttattgggattagaaaaatgcatagtctaacccaatcctacaagtccactctgaggcataccctagagaaatgaaaatacatatataccaaaaggcataatgacagtataataatttgtaatagtccaaactacaagcaacacaaatctcatcaaaagtaggacacatgagtaaatgtagatatatgcatgctatagtattatacagaagtcaaaatgggctgggcacactagctcacatctataatacagtactttgggaggcgtcgatgggtagatcacttgaggccaggagttcaagacctgcctggataacatggcaaaaccctgtctctacaaaaaaaaaaaaaaaaaaaatttagctgaggatggtggcacatgcctgtagtcccagctacccgcggcgctgaggtgggaagatcgcttgagcctgggaggtggaggctgcaataagccatgattgcaccaatgcactctagccttggccacagagcaagacttcatctcaaaaaaaaaaaaaagaaaaagaaaagaaaaaggaatgaactacagctacatgcgacatggacaaatctcaatacaatgttgaggaaatgaagtcaggtataaaagaatccatactgagtgaatctatctgtacaaagttccaaaacaagaaaatgggaatagaggtcaggacaatggttaccagggagcgagcctacccgggggcttcctggttgctattatgttttagttctttgttgttgttgttgttgttttgttttgttttgggatggagttttgctcttgttgcccaagctggagtacagtggtatgatcttggctcattgcaacctctgcctcccaggttcaagtgattctcctgcctcagcctcccaagtagctgagattacatgcatgcagcaccacgcgcagctaattttgtagaaagggggtttcaccatgttgttcaggctggtctctaactcttgacctcaggtgatacacccgcctcagcctcccaaagtgctggaattacaggtgtgagccaccgcgcctggcctagttcttgattgaactgttgtaacccatatggactgactttgtggtaactcatccactgcgatttatgcccttctcaatcaaatgacctccctctccttccctcttcctccctcttaaaacaaaaaagtagggacattcataaaaccttcaagtctaaatcaagtttttgagacttacacaggaaaaaataggtacagtgtaagacattctaaatttagctcaatattcttaacatgcaggaacaactctatggagaaatcccttcaccctccaatgttcaactcagcaacattttaaactctgttcacatccaataaagacctgcttattgtatcatcaaaaaggtatgcatgcaatccatctcaagaagaggcttacctgcacagtgactagggtttactgcaatgacaaagtcatttcatgccttgaccgaaaatagccttagactgggtaaaaactgggcattctctgcagtggttcctaagagaagctgaggttagtgtggaattaaatatccttatctgcatgggtagacttaacttccaaaagtcgtacagaagacaacagagttccgggtaatatggcccatatatcggaggtttaaagctgatgcccatggtgcttgtgagcaaaaatacacatttagccaggcgggggagctcaggcctataatcccagcactttgggaggtcaaagcaggaggatcacttgaggccaagagttcgagaccagcctagccaacatggtgaaaccctgtctatattaaaaatacaaaaattagctgggcacagtggcgtgtgcctgtaatcccagctcctggggaggttgaggcacgagaatcgtttgaaccccgaaggcagaggatacagtgagctgagatcgtgccactgcactccagcttggccaactgagtgagactgtaactcaaaaaaaaaaaacaacaaaaaaaaccacattttgccccttgtccagagtagaaagaattgtggtgcttcttacaactgccaaagccaaagcctgaatgagttctaaaagtctctggaagtttctgagggcacagtcactccaaaagatacaaatcctgggactctgaactagctttgtttgacagccccttcctttggttaaattccaaaaatatctcaggctcacctcaagcttactgcattcaaacgttctctgatttctccttcctctctactgcatcctttgtcttctactcccttaagacattattcctttcctacttgccctttactcaagttgtctttatcctcttagctatacaatgatttaattcagtacaaagaacatcactattctacccatcactgattccccagggcaaggcactatgtctgtgcacagtaagtgagtgatgctctttttgttattttggtttttccttttttgagacagggtctggagtgcagtggtgtgatcatagctcagtgtagcctctacttcctgggttcaagatcctcccaccttagcctactaagtagctgggactacagacatgggccaccatcccagcatttttattattattattattattattattattattattattattattattgagacaaggtctccctatgtttcccaggctggtctcaaactcctggactcaagtgatcctcccatctcagcctcccaaagtgctgggattacaggtgtaaggcaccacgcccatcctaatgtcttaatggacaaataaataaattctctctttttttttttttttttttttttttgagacagagtctcactctgtcgcccaggctggagtgcagtggcgcaaactcggctcactgcaagctccacctcccgggttcacaccattctcctgcctcagcctccagagtagctgtgattacaggagcccgccatcacgcccagctaatttttttgtattttttagtagagacagggttttaccgtgttagccaggatggtctcgacctcctgacctcatgatccgcctgcctcagcctcccaaagagttgagattacaggtgtgagccaccgcgcccggccaataaattctcttttaatactagcaacaacagagacaagtatctttctgttcttgtcaaaccaatgactgcagctctgtatgtttccggagtgatttaaacttgccagatgagcttttagccagtcaaactgattttcctttgagcctagattcctcatgtggaaaagctcccagaaaagcttgactagataagaaaaaagtgatgtctagacaattctgcgttagccttctgctgggaaaacctccagctgtttcactgaacctcatacaaccaaatcatagttcacatttcacagattcctcaccagggttttgacatcttgggggaaaagaactgaagaagggtgggcaagacatctgactatagggcggtttctaataaagcaataagtacaaacaattccaagaaaactaggatgtcactggtccctgtggtcaccaaacaagaaggatgtctgtcctatgtaaggacactgaagaggggaaaaagtgcgtaatcctaatttaattataatattttttcctataatcagagaggagaaagtcacccaagcttgaagccaaaattataaatttcattgtccacacaaattgtacaagatttcccttgagcagactgcagggaggtgggctcttgttatccttccttcctttcaactcttccatttctgtctgtaatttccccacctttgtttccatataacttcaccatccttgctcctatatggccacaaagaaaattctgagaaaagagttgaaataccccagttaaatagattccttccttgtctattaagaagacatcactcttatttactttctgtaccttggctctaagctataagttcatctgtcttttctatgctataggcagtacagagcatgggccagcctgaaatggcaggcctgcaaaaattgatatgccaaatgagaaataagaaaacttgctttcaactaacatgaaatcccggaataacctttgaatttccatgacaccattcatctagggataagaggggaaggcagaagggggcattcctgtgtccatttggtgtacccctgcaacaggctattaccacttactgcaatgcattaaaggtaggacagacagctaggaaacgaactggtctctgtccagtcgaagaattagtcaacacaaatctacagaagtcaccttgagcttggtactatctacccataatgcatttcccctcacctctttaaattcattcagttattcagcccctcccttcctgggtggtaactacaactgttattttcaactccagttccttatgcaacactgcaaaatgcataactgaactgtacactgttaactaaatagatgatcagtataataaagagtcctcatgtaaattaaggaaaacatgtaaaaaccccccaaaaatccactgaaaaatcatttgtgcattcaacatagaaagacccttaaatatgctatgcagggtatcttagaaaataatattaaaatgaagccctcttggagaaactaatgacttgtttttaaaggtctagtgagtgcctagatagtgccttactaaggcattccgcagaaaacagggttccttgtattcagcgcagtcaggaggtgaactgatatcaaagaaccacatccattcgtgtcattttacacgtttcaagaaacaaactttccaataaagacagactccattcctcttcccccaaccttcctgtcaggcttcccttaataaagtttctgccagataaacatcatgaatgttccattgtgctgagaagaaagaagtttacagcaaattgcttggttagagctaagagtctgggagccacctgagcaaatcagctaagtgctttggaaaaagctatttccaaattgggacagcttccatgaagtgactgggcatagtcttcatgaagaggttgtttgtctcctcctatccgtcatatcagtagtttcaagataagaagaaagcatatttggactgtttgttctcatggacattaatctgattgtattttttttttttttttttttgacggagtctctctctgtcgcccaggctggagtgcagtggtgcgatctccgttcactgcaagctctgcagtggttcacgccattctcctactcagcctcctgagtagctgggactacaggcacccgccaccatgcccggctaatttttttttgtatttttagtagagacggggtttcaccatgttagccaggatggtcttgatctcctgatctcgtgatccacccgcctcggcctcccaaagtgctaggattacaggcgtgagccaccgcgcccggcctctgaattgtatttttcaagtgtactaaagttcctccaggaactacacacacaacaaatgtactttccaacttgcttatttaggaagatcagctttgttacatcaaaacgtccattagaaagtcatgacactggccaggcgaggtggttcacgtctgtaattacagcacttcgggaggctgaggtgggaagactgcttgaggtcaggagttcaagaccagcctggccaacatggtgaaacccaatatctactaaaaacgctgggcgtggtggcccacatctgtaatcccagctactcaggaggttgagacacaagaaacacttgaacatgggaggcagaggttgcagtgagcagagatcatgccactgtattccagcctgggcaacagagcgagactctgtctcggggggaaaaaaaaaaaaaaaaagaagcagaagaaaaagaagaagaagaggagaaaagaaaaagaaagtcacaaaaaaatgagcagagaaattaggttttacctcaagtgtcagcaaaaaaaaaaaaaaagttaaaacaagatgagtttttttttttaaacactgcatataaaacaatgaagtaatttgttcagagagttctgctgttaaaataatgacaatctggccaggcgcagtggctcacgtctgtaaccctagcactttgggaggccaaggcagatggattgcctgagcttaggagttcgaaaacagcctggccaacacagtggggaaaaaaaaaaaaaattagctgggagtggcatttgtagtcccagctactgggaaggctgaagcagaagaattgcttgaacccgggaggtggaggttgcagtgagtcgagagcgcaccactgcactccagcctggtcaacagagcgagactctgtctcttaaaaaaaaaaaaaaagtagctcggccaggtgtggtggctcacgcctgtaatcccaccactttgggaggccaaggtgggtggatcacaaggtcaagagatccagaccatcctggccaacatggtgaaaccccgtctctactaaaaacacaaaaattcgctgggcatggtgtcatgcgcctatagtcccagctactcaggaagctgaggcaggagaatcacttgaacccagaaggcggaggttgtagtgagccaagatcgcgccactgtactccagcctaggtgacaaagcgagactcagtctctaaataaataaataaataaaaataatgacaatgtaatgtaggatgggcagtttgtaacttttctataataattcttatatgattttaaaagggccctatgcgaactactttaacatgcactattttacttgaaatcgcacaacactcccaaaacaggagaaaaatttcataaagacagagagctttgcttgttgtatacatttatttatttcaagatttggcacaatgccagggatagagtggtacttaatgatatctgtggactgaaggtcaacactttttcatatattagacaaatacagctcataatgattaagaaatttgtctgagaccacaaggctgggaaatgactaagccaagcttccaatgaagggcagtgagtcagattcctgagtctagttcatctaatataattgttaagggtgttaacattaatctttactgcatcacatttctgcaaggaagctttgagccaccatcctgaagactgagaaaccaacacaattttaacccattaagcacagcaactgccctgccctgtctttcaatatcctgtccctgtctcattcacagtgtacctctgcccccagtaattaccttagcgtcagagatccacaaacaaaaacaatgttaagacttgagagaagccaaaccactcacctgctgaggtatggcagccctaactgtgggagtatcacctccctactgatatcaaaatcagaccctacaaaggagaaagaaaggtcatctgaaatcaccttgacactccaaacagggacttatatctgtgggtcagagagtgaatgagtcatagagagaagaacacttcatagaacagggcatgagtcactggttcctttcttattgagatagaaagaaaggtatatccttttatacatcttgggggtagtgcgggggcggggggaaccaccatctctttcatttgctcccattctcatagctccatgaactgtccacaagttatcaccggtgagtatgtggttctcttttcaaggcagggctatcgcccttaacttccactcctctccaaacttcaggttgtttagcactaactccactcagacagattttttgagcagctgcacacctttgtctccctgaccagaatccccaggaatcatgcaaatcctcaggcatatcctaggttcactttcaggggattccctgaggatgccccttttttatgttcaacagccttaggaagccacccccaagtccaacagatacacagtcccctttttgtggatgtccaggccacacaagaaatggaaagaatttcaataagaaactctcccggaaactatatgcatatgcatatctacttctaggtactgatgatgccaaggactctttcataaagacaagcacattcgccaaagccccaaggcataattagccttgctctaaaactttcctaagtggccagaatctactgcatatatttttcttagccaagaaacagatgtagagtataaatggttttccactgagtaccttcaaaacagatgcaactatttggtaaatgttccatctgcccagagtatccattgtcaatggagaccagacatacaaactccgaggatcatttaattcagtgttcaaaagaacttccatcatttgcatcccagcctcctgacttttgccacatatgggtaccacttctactattccacgttaccctttttaaaaccactttattttcatgtaattaaatatattttaaatggaaacttcatatcacctctaggaatagacatgcagaaccagctgccataaaaatgaagtaactaaaagcaaatacattgaaagcaaaatcttgccattaaaaggtatggtctctcaattaggaaggaaaattagcaaatgttagggggtgctgaagacatattaacacctgatagagacttacttgatgtaatctcaagaactgagaaaggattaatggaagaggaggaaaggaatgaatttgaactgaagcaggaactcaagtgagaagacaaaatctgaggactctgtttcaccctttttttttttctttttggttttgtttgtttgtttttgagacggagtcttactcggtcgcccagcctggagtgcagtggctcacttcaacctccatctcccaagttcaagcaacactcctgcttcagtctgcctagtagaatgcaccaccatgcccagctaatattctgtatttttaagagatgggatttcgccatgttggctgggctggtctcgaactctgacctcaagtgatccgcctgcctccacctcccaaagtgctgggattacagatgtgagccatcacgccccaccagtcaccctcctctttatactgcttactatgggttacttctcagagatagaagacggtatcaatgccacaatctagggtaaatgaccaactggagtgtggtttgtcctcaaaacttccatgtatgagatagagtcagtagtatacttatttctattttctaaccttcttcccacaaaatattttggacaacaaactaagagtaatttgctagcatctcagaagctaaacaggtgaccaatgatggcactgccaaaataccccatggtaattcctattcagctaagtcagttaaagcccatacagcaaaagccctctgaattggaaatactaatggaagggacagtattttaccaaactacaaaaaacagcaaggtgttctctcttctgcaagactgacttttcaatagctaaaagttacaccaaaataataataataataaataatagttaggtgcgtctacctatttgttttattcaatcacagaaatctctgccaccttatagaatcctgaaatttctgcatcttgcgactgacaaaaagagaaagggcaactattgggaggccagggcaggaggattgcttgagcctagaagttcgaggtcgcagtggactatgatggcaccactgtactccaggataggtgggcaggggtaggggggagcggggagagtgggggcgcggccaaagcctagagattatggccatagaaataaaatagatttgtgatcaaaccccattgctgctaattacgaggcatcagcttgttcatctgcaagtggggataatctgcttaaggtggttttgaagaccaaatgaggcaatgtacataaaatgtctggcacagtaccaggcacacagttgcttctccctaaaatccatgacacctactgaattagtcttttttaaatccatgaaatgaacattactttagcacttactctctttcatataccaaatggttaatagacagtaaccgttgttttaagtgtcgtacatgtattaatacatttaatctcacaaaactctatgaagttagcactaccgcgatttccattatacagatgacaatactgaggcacaaagaggctcagcaacttgcccagagtcacagagttagtggacagtagaccaggattcaaacccagacagtctggcaccacagcacatattcctaactacccataccatggtgcctttgaaatgctggagaaacatcactgaaaaagcccaaaaaggtagacagagtgatagacagttggacagctatgtgataaaacagcatggtaaaatgtcagtggcagaatctaagtagcgggcatacaggtgtttgctaaaaaattctttcaacgttgctgtatgtttaaaatttttcataagaaaacatcgggaggagagcaaggaagagcccagagtgtcatctcctcctcaaagatggaagcgtactgaaaaaaaaggttacgccaataatgtcaggatgaaaggatttccccaccccgacctgcctcccctccaaaaagtaacccagttaaaatctataggccacagattccagttacaggttgccccaactggggccaatggctgagaaacagagagaagcagatgggctgtaaaactgggtcctctgccagctaagctagagaaaccatctcccaattgaaagtgttaatggaaatgccaggccaaagcagtcgacaggaaacgtttcttgacgctgtacatgcaaacaaatatggcttctcctacaaagacaaagaatgcagtggtccaaccaggcctgtctttaagtactggcaagcacccaaggcaagttaacagatttcaacttctcaggctctatagatgagtaccagctcttgaagacctcccaggggatggaagggaaggaagagtgaggaaggggatttcatccaggtgaagctgagccagcgattaaaggggaggaggcgtgagtctgcagcggtaatgcccacacctgggggtcaaggaggaaactgaggcagtgctctcaaaggagacaggttatgtctttcacaaatgctcctatgactggtgctgtacggaatgtaatgagataaacccttgaactgaaagcctgacagcttctagactaggtctaagggaagcaagtaaatgagagacagaaatggaaagaaaaatatggtaagaaagggaattaaattttaggcatgttcttatacagttggcaaaagtgaaaaatgatgcatctttttgaaagagcaatttggcaatatcgaacaaaaacatgaaatgtgtccaccttttgaaccaggaaagtccactactgggattttattttacaaatgcaattatatgtgcataaagatcaaaatacaacgatatattactgattccagcattgtttgtaaaaacaaaagtctgaaaagaaccttaatgctcatcagcagaggacaggcttaatgaattacatacagaacactgattcaaaggtaaactccaagtcattgaaaagaatggaatccatcttggtgctgatggaaaaagagctctaaaatgtagctgtaaacgtgaagtggaaaaaaacaaggagcagaaactcatatacacatatcatttttaaaataaggtgtgtgtgtatatgcacacagattctctatataatatatatatattatatttttttaaaggcgagcaagagaaaggaggggaaacaagtatacttgtatacgtataaacaattctaggacaagaaactggagaagtcaggatattagagacttttcactctatacccttttttattatgattgaattttttaattctacacagttttctcactttaaattacatatatacgaatattctacataagaccatttaaaataaacttttattcataggaaatgtaatggtttgtttgaaatttagtcataacatccctgtaagtttcatgcaattaaatgcttatcgtatgctaaacatttgatgagacgaccttaaatccaaggtagtcagagagcatatttgtagaccaagttttacatgggatacaatcaaaagaaggactacgtaatttgctgtattaggaacatttagcaaaaggctaacactcagctcagagtaattcaagcgaaagagtaaagttattatcatactgaggtccttcatagaacccaagggaagaattgaggctggtctggagaacaagggaagtgaagacttgaacaccgtggggagtctctccatcttcatgacttcatttcctctcactgtacaatagtagcttcttccacatgccacaaaacattgctctcacagttcctagctgttatctgtaaccatttcaccgggagcggagttatttctcaagtttggaagtactggcattttggctggtatggttctgtgttaggggctggggggtggctgtcctgtgcattgtagaatgtttatcagcatccctggcctccattccccctcctcgtagttgcaataaccaaaaatatctccagatattgccaagtgctccctaggggataaaattgccactgacctgggagaaactgaactgcttgctcattcaccttcccaagtgctggggaaggacgctgactgcctagcttttggctcaaatgtggctgaataactagagcacgcttgcactcacaaggtgaccccttcataagcttgtggtttaaggagttgttgctctttaccactgctatagggctttccctaaaccctctaagtcagtactgtccaacacaactttctgcaagaagatatccatcatgtgctgtccaaaacagcagccactagccatatggggctattaagcacctgaaatacagctcctattatcgaagaactgcattttaaaattttttatttgactttcattaattaaatttaaatagacacatgtaaccctcgaccacctaacagcacagctctaagtactgagagcatttaagctcctttagaacagttgccagcataccatgggggcttaataagtacttgctgaataaaggaatgaataggattgggctcagggtcttggttggcaaaagtcattaaaccaactcagatggttccacccataggaaaaatgggaactcagtgagaaaggagcagaaacagaagcaacccactgtccatcaacagatgaatgaataaacaaatcgaggtgtgcatacatggcagaatatttattaagctctaaaaaagaacactattttgacacatgctacaacgtgaataaccttgaagacattttgctaagtgaactatgccgatcacaaaaggacaaatactctatgagtccacttatatgaggtaccaagaataattaaattcatagagctagaatacaatgttggttgccagggatcgggggtaccaggaagtggggacttaatatgtaatcgataaagagtttcagtttgggaagatgaaaaagttgtggagaggaatggtggtgacgactgcacaacaatataaacataactaatgccacagaagtgtacatgcaaaagtggctaaaagggtaaattttgtgtcaggtatactttacaattttgttaaaaaaaaaaaaaaagaatcaagaaagcttaatatggtatggtggactgaaccattgctcacaattctttacagcatccctatactccagaaataaatggaacaaacctgaacccaaccccacactctggagccaacaccagccaacccacaccctaagtaaagctaccctacaaagctatgactgagagaatgagatccttgctgttgcaggttatgggttccagggaagtttgttacacagcatgtttatagcaagagtcagatacattaagtctcaatggtcatggctttgccaccaagagaacattgaaagaataatgaatacttgccacagtgtggctaaggatcagctgcattctaaaactacagatagatcagttttaaaaaataaataaataggctgggcacggtggctcatgcctgtaatcccagcactttgggaggccgaggtgggcggatcacgggtacaagagattgagaccatcatggccaacatggtgaaaccccatctctactaaaaatacaaaaattagccaggcatggtggcgggcgcctgtagtcccagctactcgggaggctgaggcaggagaatcacttgaacccaggaggtagaggctgcagttagccaagattgtgccactgcactccagcctggaaacagagcgagactccgtctcaaaaatacataaataaaaccatgaactatgacatttgatgaatcattatttaaaaggtccactaagcctcagatccttgaagaaggtgggtccaatgtagaactgtgcttcattccttaagagtctatggattatggtcttaagtgatgttgagcctgaagaaaacaaaccctggcacctctcataacccattatgatctctggagaccatctgattctaaagagatgcaatttgaaatgctccctgaagcacttcaggcctcaacattctcgttaaatttcccctttcagctgtccctggcagtcactccaagctggcagccaacatcttctactgtctgcaaccctccaccctgaaaggaaataaaatctacatccaagtcaagcacatgttttcacgcaattcaaagaaaacaaactgtgaacaacctgagggctcacaggagccctgttatcatctacaaagactcgtgaagcagactcgggcacatcatcacttccacaagacacagaagccttcctgcaccctgctgggagaagccctcccagcttcctgcctgacacacttccctggactttaaccagctctacttctctccacctctgtaccagtgaccaaggaccagaaccagttaagatttttatttttcctaaggagcaaacttcttacgctgcttcaccccaagagctcaatggagtttcctcttgggcacacttaataatcatgtcgtacctcagcaagaaggagcagataataaaatccaaaggcaaataggacaagctgttagccagggatgagagaactagcaaagggcaacagactattctaggaaataagaaaggaggtgcttgggcaaggcttgctcaggcccaccttcctccagcctggcagcctgactggtccctaattctgccacctcacattgcaaagcagttcttatctctcatttgaaaaactgacagggacagaagacagcagacaagaagtccacacacactagcagcagaaaagaaggtgaaggagagaagaccgtggaaagaggtttataacataaagccattgttgctaattcaaattgttaactattgcgagaaaggagcagagaatatattttagaaaatgtccagcagaagaaattttgctggttaattgactacatcttggtagttttaaatattttctgatgcagtcaggttcctatgtctaagacatatgcctgtgacatatacatgtttcttcctttattaaaattataataaattaattaattaggtattccttttaactttgtttctattatgtaaacaacttctgggcagtaggcactatatgatctttactcggccagagccatttcacttccttttatttgcagtttctattcagtccaaaatatcatgtatttttgctaaaatcattatgatcccccctgaagggctaggactgggtgagatcagctgctaacaataagaataacgatgaagaacaacaaggggaaaaacatcaagagaagcagtcagatactcaactattcacggtccacatttattaggcacatatacgcatacacttaatcctcagaacaacacaaaaacatgtttgttttattcttattttatatatggaaaataagctcaaatgagttccagcaagttgatgaaagttaaacatatgaaagacagcggtgctcctatgaaagccagagccaatcaatcaagtcttgttctcccaaccacttcactagtatactacctcctggtggttaccaactacacttttactcagatgaaaagtaaggcagtccaggtgtggtggctcacacctgtagtcccagctacttgggaggctgagatgggatgatcacttgggcccaggagttggaggctgcagtgagctatgatcatgccactacactccagctgggtgacacagtgagaccctgtctcaaaaaataataaaataaaataaaatataaaataaaataaataaaaggcaatttgttctcctctcagcagaacaggtgccccctattctcactcatctcagccccctttcctaacagtcaccaaaatgttatgagataaagtaaatttttgttaagttctctaacctggtattttctactcttttttcttcatcttcagtacctttgtaagggaagtagaaaaaatttcctttgggttgtacacgatttaataagatacaccatttaaagttctgactattgcagctcccatgatactctgatacaaatttggccaaaccacgctttaagggctctgtgtacacacaggagatggtataagtgaatgtctcctagccaaactatgcactcccgaagcatggtactgcatgtcactacacagccatataaacatatgcacaacagagcagctaagagcttagttctgcatttgaaattcaccttcaattcttactgatttttggactttgttcctaattattctaaatcttagtttcattatccataaaatagggataatacttacaattccttgtgaggattaataaaagaaatgtacataaattgcttagcacagagtatggcatagagaaagcactctatcaatattattatttatttgacccaagtctcattttctttcttaaattccttagtacctttttgttttcagaacaattcatataatcagggaaaaaaatgtaaacagtgaagacaaataatccacttaaagcattacataatttataaatgctgatgccataaaatatgctttgcattaatttcatctaaaattcagttttatagtatacatcaaatatggtttaaatggatgttgattgttcctttttcagaattagcatgaagaatattaaaaaaggaaaggtacagaaaaataaaatctttcttatttacttctagaattcaaatttaatactatgaaagtaacaaagtagaattcaactcttgttttgctgaagacaactagatattttgctccttcaaagcatggattgtggcaatcatcttagcatcctaatcactatgcactgttcctgggaaatagtaggccctcaaacatttgttgaaagcataaagagtgagcaaatgggagagtgggagggaagaagggagagtgggagggaagaagggagggagggaggagtggatggatggatgggtgggcgggtgggcgggtggctgggtggatgggtggatgggtggatggatggatggatggatggatggatgcatggattaaccaaccttatgttgccagtttgtatcagttatttattgctgtgtaacaagtaaccccagtcttattggcttcaaacaataagcatttattatctgacagtttctgtgggtcaggaatccaagactggcctagctgggtggttctggctcaacatctctcacacctctgcagtgttagtggggctgcagtcatctacagcttgactggtccaaaggatactcttccaagctcattcgcatggctgtcagcagggggcttcagttcctcactgtgtgcgcctctccacagcactgctcacagcatagcttctcccagagcaagagatccaagagagagggaaatagaaaggatgactaggacagaaggcagatttttataaccttatcctggaagtgaaacgccatcattaggctattggtctcacagacctgggaacagactgcacgaaggtgtaaatacaagaaggcagggatcattggaggacatcatagaggctgtggagtttgaaataatcaaatcttctaaattgcaaagccagtaacaaattaacatagtaccataggcagggttatttttgtacagctgcaaaaacttattcaaatcattcatattatgttgcaaagattaaaagggaaatagctatttaaaaaaaaaaaaacagtaaatatccatgagaaatgtcaacttggattttcttcctaacccaaaaatgattgaaatgttcttcctgcccaactttcaactcatggcaatagttcgttttcattctaaaaattcaagacttgactcagcaaacacatcagtgccaagaaagcgaatttccaaaattatgtctgtctctttatggagcacaggccaaacttaaaggaaaaagaatttagaccacaaaataatctgtcatttctagtcttcataccagcatattgaaatgctggggtcttcgacattttatataaggcataaaatttaagaaaatactttctagaatgccttattacccaagtctgaattgaaagatggtttttaggccgggcacagtggctcaagcctgtaatcccagcactttggaaggtggaggtgggcggatcgttcgagcctaggagttcaagaccagcctgggcaacatggcaaaatcccctctctaccaaaaatacaaaaattagacagtctcataacccaatctcaaaataataaatagataaaaattaaaaataaaataaaataataaagaaagatgatttttgcatcaccaaatctttacactgatttctctctagtttttcctttgcaatgaaatgtcactcagacttggactaagattaagtcataactgacagctgttgactctctcaagctcttctctgaccgtatcaagcctgagtatccttattttgcacattcttccttatgtaagatgcttctgagggatggtggcagtggctggcatgtactaatacaaaatacttcaaattatatttttgagctggaaattcaagagaaacaaataccaggctgaagtcagttgctactgaatgatggagaatctccattccaaaggacagtctttatttatggcttcatcctaggttggtgccttcaaagttgtcctttgcaagtgtttcatcccagttctactctgagtgccaagaagccaggaacatttggtgaactcggctatgtctctctgcactggtggtgactttttgctgctcctccctagacaacccctatgtgacataagatgatattgtaaaagtcataagatattcacgaattaagcaaaccatcaccaataccttaaatgatgtaattacttatatatagccattttttaaacggagtgggatgagggatgctaagatgtaggccatacaaaatttatttaaaagatcttttttgggccaggcatggtggctcatgcctgtaatcccagcactgtggggagacggaggagggtggatcacttgaggacaagagttcaagaccagcctggccaacatggcaaaatcctgtctctactaaaaatacaaaaaattagccaggtgtggtggtgtgctcctgtaatcccagctactcaggaggctgcaacacgagaatcacttgaacctgggaggcagaggttgcagtgagccaagatggcaccactgcactccagcctgggtgacagactgggactctgtctcaaacaaacaaaaaaaagacctttctcactaatgagtttgtcgatggctaaaaaatattttgatcatgttctggagttaattaccctcacgtttgactttgaaccaaactcaattacatacaagaattaatcgaaacacacttagcttaaggcacaggtaaaccatgaagaagacttagaagctgtgcagtgtcatcgtaaattagcagaagctttattacctgccctaattcaaattacatgctttcacacttgctttgttcaaaaggtacaacaggtagaaggcatcctcaaatgacagcttcactctcagtggtgtctcttacaggtattttcaagcagaaattgtgcacatattacaagttaacaagaaatggaaaccatctcagcaggtaatctttcaaatcccaattccaggaaaccaaaatgtcaattaaagcaccctgggctttttagtgatgctcaatacctacttataaatgattgtgatgttataggttttctttccatctaacttgtgctttaggcatctcaacattggaaaggagaccataggtcatcatggagtctaatcctttggccccaccaccatcccgcagtggcatatgtgaaaggttgtcaacatcatcactttgttgtcactgtcaccctcaacctacgaggactccacttgacttcatcctgaaaacacacttaggtacaggtaagtatgctttcagtgtcccagaacagcgtattcgaaaccagatcacgccaccgctcagctggacctgccacccttataataaaatcaaaactcggccgggcgcggtggttcatgcctgtaatcccagcactttgggaggccaaggcaggtggatcacctgaggccacaagttcaccaccaacccggccaacatagtgaaacctcgtctctactaaaaatacaaaaatgagctgggcatggtggcacacacctgtagtcccagatactcaggaggctgaggcacaagaatcacttgaacccgggtggcagaggttgcagtgagccgagatcacaccactgcactccagcctggatgatagagtgagactccatcctcctgccactaccaaataaaaaaaaaaaagaaacctcatctccatgacctgaaaggccctacaggcctccatctcctgtttgtgcccgacttgagccacattcatctgctagttcttcctcaaacctgccacgttctttgccgcctcggtgaattgttggcactgctccctctgcccgctgtcctctgcccccagatcaccaggagaccaactcctactcaaaatccaggtcctgtctcaagtttctaacttccagagaggccttccctgaccagtgcatctaacacctattgcattacccattatctctcaaaactagctgttatttttttccgcatttattcactcacatgcctattacgtgccatatgtgtgcacacaagatggtaagctttataataatagcagctgatcaaagctaaagcttacactgtatggaaaatttactatgtgacaggctcagttctaagcacttcagtttctcacaagcctataaggcaagtaagaatattatcctcctcttacaaatgagaaaactaaagcacaaagaggttaagtaacttgtccaagacacacaaccactaaatggtaaagctgggatccaagtctggaagtttgtggctctagaatccacactgataagtaggaaattctgcctccttcccacaagagcagagacctgctctgtcttgctcactgctgaatctccaggagcctagaatgcttggaagagaaggccaggggagggagctgactgtctcctagcctaggtggacttcctttttctctcctatcataccccaaatacttccaacccagggatcctatcccccattcctaacagtatcctcagttccatcactgcaagtgtcatctgaaatcctacaatggggtgactcagctcaaaatttcttttttttttttttttttctttttgagatggagtttcactcttgttgcccaggctggagtgcaatggtgcaatctcagctcactgcaacctccgcctcccaggttcaagcaattttccagccttgcgtcctgagtagctgggattacaggcatgcgccaccacgcccagttaattttgtatttttagtacagacggggtctcatcatgttggccaggctggtctcaaactcctgacctcaagtgatctgccctcctcagcctaccaaagtgctgggattacaggtgtgagccaccacgcctggctcagctcttaatttcttcattcacaaagcaataatttcgaggactcagaaagcatctcttccttcattcactgagcccaactatccatctcactcacgtttttttaaaattctggaaaaagaagtcaagttagaaagaacagccaaagtttttttcttttcttccccccccccgccaccccccacagctactcacagagatatcaagatgtctggaacagaaaataaggactgaatattaaactcacccagttcaattttcttatagtaatttaccaaataaggcataacctcagcctacaagcccttccttctactccagcttctatttgggtcataatatatctatcttcaaatgatcacattcccggggtggaaaagtagcctgttgcttaatcaaaacgtcatccaacaaaaaccattctcgcagttaaattccgtttccttcaggagcagttggctgaaagctcgctgggacatgtggtttcagctattcttactcttcagggaagtgctatttttcttcaaagcaacgtagcccagcaaccccaaggaaacctgattaacttctttggtgatgtgctagtaaaactcactgttgtcttgcttcagggaattttaatggcagcatttctgtttcattcattagaaccttgaagtacccaaagaaatgaatatcctttctctttctttgttcctcattttgttttcagaatgcaggtcaggatcagaaactgggaaccatgtgacacctctgcaaagagtcgataggtagataaacttgatggcttgcaatccaaagggtgctcataaaggaaaagcttaggtgttaataggacatgccaattactccagtgtcgggctgcatagctcagatggctccagcaccaggccaagagaccaaaaattcagaatcagtcttctcaataaactgtgagctcagcaatattccaatattaagcagcaccctggactccagagagtcatcttgaaagtatgtgcgggtgattaaagaggaactggcctctagagtgggtcactacaaactgaccatcattcccggaaaagctgctgagcacatggccttcagcacatggccttgtccctgggcaaccgacacatctggatgagggtgggacaagtgaacagtggtgggattaattatacaagcaaacagtggtggctttaaggtccagcttttaaaaagctggggccaaaaagttaggtgttttaaattctgggtcatgccccttattagctgtgtgacactggacaaattacttagcctctctaagccatacttttggagatcatttgaaatatagcacataggtatatgaaaaataaacaggtaatggctgggtgtggtagctcacgcctataatcccagcattttggcaggccaaggtgaacagattacctgaggtcaggagttcaagaccagcctggccaacatggtgaaacaccgtctctactacaaatacaaaaattagccacacatggtggtgcacgcctataatcccagctactcgagaggctgaggcaggagaatcgcttgaacccaggaggtgaaggttgcagcgagccaagatcgccctactgtgtactccagcctgggcaagagactgagactccatctcaaaaaaaaaaaaaaaggcaagatagagaagtcattgtgacttagcacagagttgcttatcagtagctgaggtgcagactggttaaatgatgggtatatataagagaactagttagtacacaggtcccctaatgtttggtattgtggaagaggccctggcctgagagttggaatgctcgcttattagtgcaagcacagccacagattatatatgtgctgtagagcttaccccgtccaatgtttattctacttaaatctaaataattacaattaaatgaattaaaatgaaatagaattagaaatttaatttcccggccaggtgcagtggctcatgcctgtaatcccagcactttgggaggccaaagcaggcagatcacttgaggtcaggagttcgagaccagcctggccagcatagtaaaacccagtctctactaaaaatccaaaaaaattagctgggcatcaaggcgtgtgcctgtaatcccaggtacttgggaggcagaggcagaagaatcacttgaacccgggaggcggaggttgcagatcacgccactgcactccagcctgggtgacagagtgagactccatctcaaaaaaaaaaaaaaagaaaaggaaagaaaagaaatttaatttcctagtcacactagccacatttatttcaagagctccgtagccatgtgtggcttttagcttctatattggatagctccactgtagaacattttaaacatcactgcaagttctgttggacagtactgctttagcaagcaggtgaaccttttggctcccacttcggcttttttgaggagttggtaaaatatgaccattaagcataactttggagttatgctgacttcagattctgattctggtttctcaaatcctgcctgacattgaacaaacaacttgccttcagtttcatcatctgtaaaattgagataataatagcccctcacagacttataaaatattatatgagagactgtattagatatatgtggttagtacttcatatggtttggctgtgtcctcacccttctcatcttgaattgtagctcccataattcccacgtgttgtgggaggcacccggtgggagataactgaatcatgggggtggtttcccccatattgctctggtggtagtgaataagtctcacaagaactgatggttttataaggggaaaccccttttgctcggttcttattttttccttttgcctgctgccatgtaagacatgtcttttaccttccaccatgagtgtgccgcctccccagccatgtggaactgtgagtccattaaacctatttttctttataaattacctagtctcaggtatgtccttattggcagtgtgagaacagactaatacagtattaaatgctcaagagatagcatgtatgtattttacatagagtttatcatttgtatcaggtctcgtaagtcgaggcatctgtctgcctccagagaccaatctcttaaaacactttctccccttgcagggttggagactttcactatgtaacttaaaataaaacagtgaaggaagatttttcctgcagtgccattttgaccagagctggatttactctaacaagtgcctgcacctcttggtcgagttccctgagcatcggccctctcctgtggctttgggaagaggtcttgacttaggaagaaggcttccatgatcctctcagcctgagactggcctggggttttaattcccaccctctgcttatctcttggccgacatttgggcatgccacatgccccttctttggtgcaaggtctatcatctgcaaggtgcattttacagaaaaaaaggcagagtcctgctcttgacctttctccttctcaccagggaaatgcttcatgccatccaccctgagcagaagtccagagacacctgggcaacttccatggtgcatttaaaaagggaagaaatgccagaatacagctgtaaaaatgatggtatattttaaatatcaatacctaataaatcaatgcttttaatgcctacataatatgccacgtggagtgactgccattacgagacaattatggtctcataaaaaatattaattatcagtgtcttgtattgtagagtgtgtggtctggtaatagggctcatgtgtaacatcgtaatgattgtattgtcatttcagtcaccattatagtgactgtatatctaagctcagtaggcaccagtgccaaaaatctacatttgaagccctttgtgactgatgcatcccaggtactaaaagctctcatgagaggtcctgagagcacaagtcctggcttacttcaaaaaatatatatttttgtttgtttgtttcttaacagtaaggaaaatgattttttatttttttatttttctaaagacaggctctccctccgtcacctaggctacagtacagtggcacaatcatagctcactgcaacctccaactcctgggctcaagggatccttctgcagcagccttttgaacagctgggaccacaggctcatgctgccatgcccaggttatttttgtttttgttgaaatggggtcttgctttgttgcccaggctgggaaaatgaatattttaatgcaaggggtttctcagaatagaggaaaagttcaagacacatcataaagtaaaacttgtttgccttctgacataaatatttgcttttctttatatgtgcatataatttatttctctggtcttgccttctgcttcagtagttactgatttatgaaccaatgtttagtagtgctctcctttgaagctggggaaaattaagtgaagttcttttatgtgaataatgtggagtacaatgagactctccgaggcctctctgtgaaatgactttaaaaccactggtgagcatttcaactctggacttttctgtcttttaaaattcactcacatagtttggatgaaaagaatttcaacagacaatgagatttagatagcctgattctaagtttcggtgctcttctccaaatacagtttctttttaggtgaatattatgttttaaaattttttaaaaatgaaattagagtttgatagcagtcttttaaataagtcatttccccacccctccttatctctctctccctcccaattattctgtcacttattcactgatgccctggctaacacagtcactcagcactcctcctagagagaacattagttgacaatggccgcttccagggtgggtaactttgccaaattacttaacttctttatgtttcagttttttatatttgtaaaatgggaatagtgatggtactcaccccataaggtgattataatagtacagtttataagttggtgggaggtttgaatgagttaatgcatctaaagtacttgaagtcgtacctagcacccaggaagtactcatgttgtcatattttactcatcaaatagtaattgagtgccttcttaaaaggtagtgtaggccgggcacaatggctcatgcctgtaattcccaacactttgggaggctaaggcgggtggatcacctgaggtcaggagttcaagaccagcttggccaagatggtgaaaccccatctctactaaaaatacaaaaattagccaagcatggtggcaggaacctgtaatcccagctacttgggaggctgaggcaggaaaatcacttgaagccaggaggcagaggttgcagtgagccaagattgtgccattgcactccagcctgcgtgacagagtgagacaccatctaaaaactatataaatagtgtgttgggtactaggaatctggtggttagtagaaagatgcggttttgcattcatggatcctcaaacacaccatttatttattaaaaattctgttgatactgggatgtaagtgcttcatggaactgtgatgaccaatctgcatgttcatatttcccctctccttcttttaaaacacgtttaatataatattttcaaaataaaatgtgtgtgtgtgtgtgtgtgtgtgtgtgtgtgtgtgtgacagggtctcactctatcgcccaggctggagtacagtgttacgatcaccactcactgcagcttcagcctccccagcttaagtgatcctcccacttcagccttactctcgggagtagctgggaccacaggcatgcaccaccatgccttgctaatttttttttctttttttttttttttttagagataggagtctcactatgttgcccagggtggtcttgaacttctgggcccaagtgattctccagcctcaacgtcccaaagtgttaggatttacaggtgtgaaccaccatgcctggcacaaaataccatttcattctcagattaattttgtaccatggagacaaggggaagttttctcttttctttgtagatgaagcaacttgaggacagatatttggaggtcttgtctgaggttcatttaaaatggggcagaggccccaggccttctaactctccatccagttctctgtagtagcccttcctaccccagctttggtactgatgtcaaccccagtgtttcctcatttactgagcatgtgtgactttcaaaaggctctgttactctcttgatttctgtgaggagcgagatagccatgactttaccctgaccatgtgactggaaacatactgaatattattggatggagaagttcacagtgtttcacaaacacatgacaagttattgttaacattatatgaatgggaggtggcaggtcaagtaaggccagagaagcattcaagctgacaccttgttcatgaatttaatctcttatgagaacagctagaatgatcatagtggccagtttggtagcctgatcattttggtcatatgcagaaatgttctcaatggactttgagagttagaattagttggtatacaggctcctccttggaaatgtacacaccaagcaattgagaaaagctggaaatgcacctgtctcaagtctcattgaaaattcctttaggtatcatactccaaaagattacatggaattgaacatttttgaaataaggacaggactaatagactttcttaagtggaaatctctcgtctttttttcccctggtactttgaaaacttaaaataaacatcgtttccagtatttgatggtttatttactaactacctgtttggaggaaatgtcatattgtctcagaacaatggaagctctgctcacaagagagcaaggagagggggtggttttcagtagtcagttgggatagacccagtttggctcacattttttgcatctctgagttcagatgaaaaggatagtgagtggcactgcagaaaacccaagaaaactggaaatagaaaatggcaattttgaaactaaagcaattaaactagtgccccatttgaacatgctcagtgacttggcttagaactgttagtcaagaagaatgtattaaatgctgtatttgtaaagacgtcttccctagttgatagattctctgcccttcattggcttttggagaatcagctcaagggtaaaagggtataggatagaaggagcaaatgggccagatgtttgtggtcatttccttccatttccagccagacatagctgattgatcatggtgcctcttctcactaaacacaggcatgtttgcaacatcattctctattggaattggcacatgaaacttatataccatccttgataaatgacattgtttttttctgttgatgtagtcccaattttacccatattaacttttaaaaaaaaagattgtcttatcttagtagaaatatctaagctcagctgaagaaatagattctataaatacccttacaacctaaacgctaattttatccctagatgagttgagatgtgcacctgaatttgtctcttgcatctgaatcagggccaattgctaagctctattaacagaagtatgtaattaagataaagggcaggagcaggacagccagtcctaaaattagctcttgccttgatgttccccaggtgcaagtgcacacagccttggtcctttcattctggatgcacccgatttccttttcaagatgtgtgcaggccttaccaggatttccaaaagcttggttctggctcaggttgggaagctgagattgttttctcctgtgggttgttattcgtgtttgaaatgtcgtctggcaccttagaagctttttgcgtaaatattctttaagataggtgtcacattatttatgtttagcttgtgatagtccaacggtcttcttacaagctgtttctggactggtactttgagaataatgtaatttttatcagctgtccattctttacaatgaaggtaagtagtgcaattaaggaagggattttttttttttttttttgagacagagtctaactctgttgcccaggctggagtacagtggcatgatctcagttcactgtaacctccacttcccaggttcaagtgattttcctgcctcagtttccagagtagctgggactacaggtatacgccaccatgttcggctaaatttttacatttttagtagagacggggttttgccatgttggccagactggtctcgaactcctgacctcaagtgatccgcctcgatctcccaaagtgctgggattacaggcgtgagctaccgcgcctggcctaaagaagggattttaagcctacctgtcaagggataccagtatagctacacatttcactcatgtgactttgggagggaagagcttgaactctgctattcctaatgtgcatccttgggcaaggcatgcaccttgtcatgtgctctagtatcctagatgaaatggagatggcatcagtaccgacccctcagggttggtataaggattaaatcaaagacataacagacatttgtaagtcaacgaacacagtgcttggcatatgaagctaagatgtaggtaactgcacattagaggtgggaggccagggtaggaactagggtgaggcaggcgagccacttaccttgggtgcaaaatttaagaggcaccaaaaccctcaagaattaagaattaatgcaatactttcacttcttccttcctgcctgcctgcttttctttcctttcttttttaaggcagagtcttactctgtcacccaggctggagtgcaatggcatgatccccacacactgcaacctctgcctcctgggcccaagcaattcgggactacaggtgagtaccaccatgcccagctaattttgcattttttgtagggatggggtttccccacattgcccaggctagtctcaaactcttgggctcaagcaatctgcctgccttggcctcccaatgtattgagattacagtcatgagccactgctcccgactacagtacttttaaaaataaaaattagtgtggtaaagtccatcacgaattacatatcaaaactgtaaataaattcaaggactgcccctgcacttgcatgcccctgcctcctagtgttataaggacaaaataagaccatgaatctgaaaacgggttgaagatataagtgtaagttattatctgaacacattgttaaaagcttaaaaaatgaacaaaacaaaaaacctctcagcttttcagagcctatttggggctcaagacattccaatcaagtatgaaaacaaagtcagtaagtaccaggaaacattcagggacccctacaagttactcaaatctacacttgtcccgaaattcaggatatccatttgtgttggtgacatcctattttttttcattcaacacagaagccagagtggtcagctatttttgaggtgaaagttaaagcaggcataactgtgctgttgacaatgttggcgactggccccagtgaagggggttatgcagacaatacccctaagtacagtggcagattgggagggtggaggtctctcctcagtcacatcactccagatgagccatcagcggctgcaaggcaagatttctactaacaacgtagagatgtgccacttccaggaatctacctacaaatgagggcaaaaccagagttaacctaccatagcagaaacacaacaaagaacacaatgagatacagtgaaagggagtctaacctctagaaaccataatcagatcagcctgtagtttttccttgagttgtaattagcagctgttgttcagttcaagcactaagatgagcccagctgtctcattctgaggacaatcaacagtccaagagcaaaaacatggcacagcttctatcattataattagaaagaactcatttttaagaattatcacacctaatatgaaatattttgtcctcaaacttttcctattctattttttatcaccacccccacccactgacttattaacaatatttttatgccctgattccctgaagacagttaacagaccattttaaaaatatattttctcattcgacccttactcaattctgggagatatgcctggtaaggattagtctccccatctgacagctgacttaactaaggctcagaaagatgcagacaactgcctgtaatcctcaagttaataagtcgaaggacagagccaagaacctaggtttgctcagttttataccaacgctccatcacaaaattacacatttaaaatgcttcctatgcagacactattcaaagcactgtcactgcctttatataaccagtaagcctcaaacatggaagattttaagaggatttatatagaaataatgtaaaacatacattcaaacaggtagagagtgaagatgggaaggatatttgaccacattctcagctcagtgtttttaaattctggctgcacgctagacttgtccaatgaactttttagaagttctgtactccattcccataaattttgatttaatcagtgaagcatgaggcattggtatttttttatatcttcccacatgagtctaatataatgctactgtggagaaccactgctataggtcaaagattagtataaacagtacatgagccaggagtggtacgtgagatgaatttgtaataccagacataaatttatttttatttatttatctattttgagatggagtctagctttgccacccaggctggagggcagtggcatgatctcggctcactgcaaactccacctcctgggttcaagtgatcctcctgcctcagcctcccgagtagctgggattacaggcaccagccaccacacccggctaatttttgtatttttggtagagacagggttttgccacattggccaggctggtctcgaactcctggcctcaagtgacccgcccacctcagcttcccaaagtgctgggattaacaggcatgagccactgcacctgacccagacataattttttaatgttatacagttgttgtgttcattttactgaatatttggggaaagttagctgtcatataaaacctatgattttacagtttttacagactaaagtttaagaagtaatttgattgaaagaaaaatataaataaaactggttcaggtggtacacagatatgaagaaattaagaaagtagttcaagaatgactaaagtctagagatctgatgatgatgatgatgataatgaagaggattatcttgtgaggaaataaagaggaagtagcagacacaggaggaagagctggcaagacctgagtgagattaacgtgaggcaggggagggaaagaaagaggtaatacaagtcaccacggcaaggtgcgggatcatgaactcaagttcagtatcttgctccaagtactataaataccaggcaggttctcggtcagcattccaccactggcaaaaatggaaaagttaaagattagggaggttactgagggaagaccaacatctaaatcaaccgctcaggcttgttccctaacggaagatttacaagtctcttaggatgagtaccgcctaccaaagaatgaccctctggtaagggagactctccttgtttagccgaagcttctaacaccagatgagcatagctgtcaggccattctcaagcacatgcttcaagattcattcttcagatttcagttcctgctatggcatgatgttcctttgagccggtttgcctcttagcacagagtaactatgatgagcctgaacccagtataacgtaacattcctaaaggccaagtgttgtaaactggacctgctcagaaagagaatgctgactataaaaacttagtcatcttcaaatatataggccattgtgcagaagaacttaggtggtatatatacagatacagaaataaataatggtaaatcatattttgggaaaaattatttcctttctaattctctatcaaaccttctgattttgaatctcagatctcagctggatgtggtggtgcatgcctgtcgtcctagatacttgggaggctgaggcaaaagaatcacttgagcccaggagtttgagcctgcagtgacctatgatcatatcactgcactccagcctgggtgatggagtgagaccctgtctctaaaaaataaaagtaaatgaggctgggcacggtggctcacacctgtaatcccagcactttgggaggccaaggtgggcagatcacttgaggtcaggagttggagaccagcctggccaacagcgtgaaactccatttctactaaaaatgcaaaaatcagccaggcgtggtagcatgcgcctgtagtcccagctactcaggaagctgaggcaggagaattgtttgaacccagaaggtggcggttgcaatgagctgagatctgccactgcactccagtctgggcgacagagcgagagactctgtctaaaaaaaaaaaaaaaaggtaaaaaaaaaaaaaaaagaaagttaatgatactgtaatatatgaatatggcaaaactcatgaagctggtttccaagtgacttacatttgacacttctgcctccaataccatttctgagtgtccttcctcaatggtactatgaaagtgttcctctccagtgtcagtgtacttatgaaacctaggtgacagaaccagacgtcgctttttcttgttcccaggaaactgaggaaatagcttgggtgagctaatgcaagcagactacctcctggcctgtttctgatgcaatgaaattctaatacttaacaaacactacaacattttaagactttgctctgactgaccaaatatgagttttgatctagatatctttcttgcttagactcttccctaaatcacacggtggtatcagtttaaaaaataaatccaggccaggcacggtggctcgtgattgtaatcccagcactttgagaggccgaggtgggtggatcacctgaggtcaggagtttgagaccagcctggccaacatggtgaaaccccatctctactaaaaatacaaaagttagctgggcatgacagcaggcacctgtaatgccagctactcgggaggctgaggcaggagaattgcctgaacccaggaggcagaggttgcagtgagccgagatcgcaccactgcactccagcctgggtgacaagagcagaactccatctcaaaataaataaataaaaataaaaatacataaatccgaatgccatgagaaacaagcatgcaagatgatggcatggaagggtttgggtgccagagaaagtcggagtttggtcatgggtaagttaacctcacaaaaccataacatcctcaagaagttgtaggagaatcagatgaaaaaatgcacagaaggtacctcatacactaactggcatataataggcacttcataaatgtcagctctccctttcttgaataacccacacagttgcacatctaaggaaacagtgactcacctatatcttgacaaagacagtccttccatagattatttagtacaagtatttcctctactcctccagatccttgagtactagcctttattgtctgtggtgaaataacatggactgagtgcagtttgcattgaagaaaacctgagcaaaaaacagtgaactgtggtagctatgtcttgcctgccagaaagcagtacctttcccttgatttccaacactctgcttcccttcaataccaggactgtctaaccaaagctttccaaggacccttccaaggggatcttgttaaaatgcagattatcatctaatacatctgggagggcaaccaaaattctgtatttaacaagctctcgggagatgtgaaagctgctagttggcacatggaccatattttgagtaataaaaccctcaataccaccaacgccttccagatccaggaaagacaacaagggaacaaggggcagagactttatcagaaattcctttctctttccaagaatctgggcatcatttcggctttatttttattgttgttgttgttattgtagggtttcactctctcacctaggctggagtgaagtggcatgatcatggctcactgcagcctcaatctcctgggtcaaaagatcctcccgcctcagcctcctgagtagatgggactacaggcacacgccatcatgcctggctatgttttttttaattatttttagtagaggcagggtctcactatattgcccagggtggtctagaactcctgtgctcaagcgatcctcttgcctcagcctcccaaagtgctgggactacatgcacctggcttcattacagctttatttccagatgcttcatatgcaaatgaaatgtctaagagcatcccatttaactgagagccatcacagcaggccacatggagctgcttataaatgacagattactcattttcttttttttgctttacatggttttaccagcaacccatctgataccagtttccccactgaggcttaaaatgacacctctgcctcacttattccacagggtgtggacctatgttgacagaacaagaacccatgtagctagagatgggtgatttgcagcagaaacccacaggcaattagaagaaccagcaagcccttactgaacacctactgaacaagaataactcacagagaaacacacttcacacattagtctttcattcaacaaatagttatggggcactaattgggtgccaagcactgttcaagcctccatggactgaacccaaaaacttgttcaccattgtagcctttacacccttgatacgcttaattttcttttaatcaaattgaatgaaacttgatcacaagcctgtgagttaggcagttcaagtgtgatctcatcaaccactgtgtgacatcatcttacatcattttcagactctgtgaagtaagcattacctgtagctaataaatcactcacacacacacatagcttggggtcagtaagtcaacttctcccaggtaacacaattagctaaccctggaaatggaacaaaattctacctgattgcaaggttcatgcccataacctctagtctgtgctccctccccagagaagaaaggtaattccctgcctgccctcaagaagtttaccatctcctaaataagagaggacaacccacagccatgagacactaaaacaaatatggtaggccggatgcagtgactcaagcctgtaatcccagcactttgggaggcagggatgggcagatcactaaaggtctggagttcgagaccagcctggccaacatggtgaaaccccatctctactaaaaatacaaaaattagccaggcgtggtggtgggtgcctgtaatcctagctacttgggagactgaggcatgagaatcacttgaacctggaaagcagaggttgcaatgagccgagatcacaccactgcactccagcctgggcgacaaagcaagactccatctcaaaaaaaaaaaaaaaaacactggtaaatgactaaagcatgaaagtgagtggttccaagatgcaatgctctagaacacagcaaagagtgagagactcagtgcccttttcaaaatactttcaacttagaaatgcttattagtatctcccctcctcatatgctaagcaccccctgaggtagacaggcaacccagtcggtccaccctgggtgctgactaaagacttcttgaatgtatctgtttcaattatctactgttttatatcagactacccaaaacttagtggcttagaacaaccaaccaccatttcatctctcttacaactctgtgcatttagaatgtgaacagggaatgcagtatcttctgtctcagctccctgagctatctgttggggtgaaccatctggggtcccagctagaatggctcagacagctgggtgctggctcaaattgcttagctggaatcacagtatcatcacttctaccacactcttaaagtggtgcacaagccctgtgtaccttcaacaggaggggactctctaggcacatgaagtgggtttcactgaggctatctagccaacagctgactgtaacttacacacatcaatgaatgaacaaacttcaatcactggctccattcctctttcctctgtcctccacaaagaccagtcatttgcagagaggaaattaactcattgtttcccttaaccatgggaaagaaacaaagggttaagtggtcaggtgctaaacctgaggggcatggagttcttagacagaaagctcctccatccacatataagtttctcggggacaaaaacattgtctgttccccactgaccctcaactcttgcccatactgcaggctctagaaaactcggaaggaaccgtgatcctctgatgagtcactcagccttggcttctccctggtgaagacagacaacaagaaacacatttccataaaggtgctgagataagcaaaaacataaataacaaatgcaatatggtctagagatggacttgttacacaatggtgctgtccagaggagttcagcaatagccaataattacaatgagtcattagtaggtgagtggctcacaccgtcccaatgcaggagagccaagaaataataagacaggtcaattcaatcccactgaaagctcaagttaataagaaatttaaatatttttcaaagagtagaggtgatacagacaagaggacacatccttttcatccatttccccataaggatatacggctcccttaaagggttttttttttgagaaagagatcagatcctaaatgtatcacgaggccccaaatggtaaattcaaatcctattcaaactattgtcagggaaggagagaaaatgacagaccagcaagcacattcctgaagcagcaaatttaacaacctcccataatctcttccagctgagcatgcgctgctccaccgggcccttctattcccatttgtaattattcagtgcattcatttctatcctcctcaacagctatctaagtctgttctctgggaatcctgtgaatattttcagacaaaaaattgtgcggcaattaaaaagctagctgcgtgtggtagcatgcacctgtagtcctagctattcaggaggctgaggcaggaggatctcttgagcccaggagtttgaggttgtagggagctatgatcgtgccactgtactctaggctgggtgacagagaaagaccctttctcaaaaaacaaaacaaaacaaaaacgggatctttttcagctttctaaaaaataaccagagttctaagaatttgggtcccagaacctacaaattaaattggaatctacgacccaccattcattagttaggtaacactactgaacttcgcaactgggcaactattgaacttctctgagcctcagtttcctcatctagaatatgaaaataattacagcacctacctcctagaatgttaaggaggataaaaaaaatgataccatgtatttcaaggtcttcacctgcaacacagaacacaataagctctcaataattgccagctactattataacttgtctttttatactgcacctaaccctaaattaacagtgcaacacttcatttttttttaaatctcataattccaccccattcaatcctaactaaatttaaaatacacaccaaaaactaaaaaagagatacaggcacagctgccaaatggcaagtaaaaagccgtaattttccatcattggaatatatttagtgataactataaatgaaaaactaaggggggggggggggaagcgagcccccacttaaagttacccttccagtctgacagtctgaaaaccaaaaatgaagtcagacttccgctcgcttcactcctttccactcccgtctgtcaaagttgggtggagaactcccacatttcctgttctgagcccggagctctctgccaggtaaagcaatagacactccagcttgtgctgggacagctgggaccatcggagggccgggcactcacgaagtttcatatcattctttctaggttagttctgatgaaatcaacaccctgaactgaaggccccgggcggccaagataaaagattaagtcatcaaatgactagcatacttgcttcttaacaagcaactcttgtggttgtcatacacgaatgacgtcatctccaacacacaccttgtcaggtattctattcccaattttctcacagctgaaaaggaaccagactgctgattttctcaatttgcttagcagaggcagaaatttaattgggatatatatggttctttagattttcttctgcagattattttgcctccagcactttacattccccagggaatggtttttgttgtagggagtacttaaaaatgcatctatgtacccaccctacctcagtggaagtggtctggcagcacctcctcacataccctgaccaccagcagcactgtgcaagaccttatacaagatccaaaccactaaaacctccaccaacttatccacagaccaaaattcagatttgccaagatttataaaatgattgcaatgtcatgctacaaagaaaagaatatcggcctcacagaactcagtaaaaataatatcagccaggcgcggtggctcacgcctgtaatcccagcactttgggaggctgaggcaggtggatcacgaggtcaagagatcaagaccttcctggccaacatggtgaaaccccatctctactaaatatacaaaaaattagccaggcgtggtagcgggtgcctgtagtcccagctactcgggaggctgaggcaggagaatggcatgaacctgggaggcggaggttgcagtgagccgagatcgcgccactgcactccagcctgggcgacagagcaagactccgtctcaaaaagaaaatatcatatccatgatgaaatttcatggagttctgtaccaagtcaacctacccaccatctaaaattctcttgttcaactattgcttttgtgtttcctcttttccctctccacacacaccctctccccctcgacaccaggaacctaagacccatgagagcaaggactgttcgccaactctagtctcacaagacaaggcaaaatagtagttgttggctgggtgtggtggctcctgcctgtaatcccagcagtttgagaggccaaggtgggtgtatcacttgaggtcaggagttcaagaccagcctgaccaacagggggaaaccccagctactcaggaggatgaggctggagaaacgcttgaacccgggaggcagaggttgcagtgagccaagattgcgccattgcactccagcctgggcgacagagctagactctgtctcgggaaaaaaaaaaaaaaaacaaacagtagttgtggtggattccgttattttttttggcaaatattctctccctcctcctcccccagccttcatgggaagactatacttccctgacttgctctgggtatgtgctgaaatgacagtgtgtcatgtcagtcccaggaccaggctgcagaatgagacacatacagcacagtttcccagtcaacttgcagacccctgagtgtgagaatacttcatgctgaatgccacacagtttagggtagtttgttacatagctttttcgtgccaagaaatgagtgatacagcaagctctcaataaacatttgctgaagtaacaaatgaaaagactcaacttgttagcacttgcaaaaacccattaattgtgacaattctgcaacaaatcaagtattaagcctagtttttactctagaatatactcctttaataaaaattacatatttagaggttaagatttaagagaccaagactaatctgttaggccttccttatttgactagagccaaaagataatgatcacttatcccatttgtagattatactctgaaaccatttgatggtttttttggggggtttttctttttttttaccctttcctttcctaaaatgctggtgaaagcttcaagcccataagataccaatttttacagggtactattcctttcatctaatgcaaaaagccttgaagctcataaaaatgaggctatgaacttttaaggcacatagcttgtagggttagtgttgatgtatttccattacttgaaacatttaatggaagtagtttaacagttcacttacatattgtgtttacagttatttcatttcttaacagagaatagaatcacatctaaatggggataaaatcgcattacattctagaagtaccttttcattctgaccctttatcactcaaggtaagggctataaaagaatcccttttttaaaaaaaaaatttatttgaagttccggggtacatgtgcaggatgtgcaggtttgttaggtaggtaaacatgtgccatggtggtttgctgcacctatcagccatcccttaggtattaagcccagcatgcattagctatttttcctgatgctctcctccgcacaaccccgcactccctgacaggcaccagtgtgtgttgaaaagaagccctttttcaatgaaattataatttagggggataaggagaggaaagacaggcagaaatgagaaagaatcaataaaatctgggagcaatatgcttcctcatctatggtactgatatgcttactttcaatgtgccaagcatatgcaatatcaaaatttcacatgtataaatgattatgacctaccgatatctttctttacccctcaagtgtgaggggaaaaaaatgggaaaagcacctaacagagtcttcaggccttatggcaaatatatggtgaaatattccatgaataaaacaagtctattttaacatatactttcagaccaccttgggaagttaatcgttttctccatctcaaatcactttctacacatggtattaatgttggtttattcctttctttattatctgattgctaagttcccttttaagccacaataggacacaccaatgctccacaatcgttttgccattaagaactagttgcatcatgttttgcaaatacagcccagttcgagaagtctgtgttccccaattgtgctttcgaactaataagtaacctatctgcccccgagagagccactgtaaccacacagagttaaccttactctacctaaaagtaaagaaacttgacattttagttaaactaggtaaccatatcttgagaaaatgtactctggttaatcaggtcttgttccccccacgcttttttttttttttttttgatacggagtctcgctctgtcccccaggctggagtgcagtggcgcgaactaggctcattgcaagctccacctcccgggtccacgccattctcctgcctcagcctcccgagcagctgggactacaggcgcccgctaccatgcccggctaattttctttttgtatttttagtagagacagggtttcaccgtgttagccagaacggtctcgatctcctgacctcgtgatctgcccgcctcggcctcccaaagtgcccagattacaggctcaagccaccgcgcccagcccttgttcccttttaatgataaaacagcttgacattccttccccagatgccttttaaggcctccaattgggctcaagaaaccaggctgggaggtgatgttctgttttaatctctatttctccatctctttcttcctaccccaattaaattttcttattgaaataaacgcagggtttaaaaaaaaaaatttttaaacctaatacgactaaggcaaaaataatcccaacacatatactgtgatgcttctaccttgattacttaccaagggtaaataatggcacaagatgggccttgtgggaaataaaagctaaaactgtccaaaggcaccagacatgatgaaaggtattccacactggagtatttcaaccaggaagcaggtgagccagagagctctgctcagcccccatggtggggcaggactcagcacaaggggcttggcccaacatgggcagttaatgggtgtttacttcctgtccatggcagggcaacatcctgcatcacaggctaaacctttcatatcaggcttttacagaagggcagcaattattatcctctcagcccaccaattttaatgaaaacccatggcaggccaggccctgtctaaagtgcttcacagccattatttcatttagtcatcccaatgacccagtgaacaattaggaaattgaagctccaaaagttgcagtcggcatgtattaagatattataaagatgtcttgtcctggtgctggagatacatagcaaaatggaaaagatgaaattattctcttcaagggacctgctatcaaataggggagacagaaaggtctttagaaaataatagaatgtagttagaagaaacaaattcagggtgcccagagaaggcccctaagtatttgggggtggaggatctcaaggccatggtatttgagctcagtcttgaagaacaagtaggaattggttcgattaggatggaataggtgaagggggatgaagacctcccaggagtaaagaactcacctcagtgaggttttcaaaaagaaaattttaaaataaactttgaatattcaaaaaagatatataatatctaaaaattattatgattatgctagatccaaaccactaaaacctccaccaacttatccacagaccaaagttcagatatgccaagatttataaaacgactgcaatgtcatgctagaaagaaaagagtatcagcctcacaggactcaataaaaatctaaaatgtaaacacttgacagacaagatccctctgaatcctcacaactggaggaggcaggtccgataattatccctgttttatacagggggaaactgaggctcagacaggttacataacatggcttaaaatcacatgacaaataagcagaccccaaccctatataatgcagaaacttacatgtccgtggccttaacagctgctcctacctgcccttccaattttgcttcctgtccagttcataacaatgtgtctacctaacaaaaaacaagtagtctgaagaacaatggaaaattttggacatctgtgccaattttaattaaataattgcttgtccacaggccaagctgttaaagcctttagaaaaacacggaagctgaaagctctcacatatattaaacaaaagtgatcctatatgatcactagcaaggtccaaaccttccccttgcctcagtacttgttcccaaagcaagctcaggtttgatcaaccacttcccgcctcaagtcttataagccccagtgtgctcagaccttctgaagccacttgacaggcttcctgcctcaatttcatagattgagtctcataaacaaaaacaaatgccaagcacaaaaatctcttggcaataaaggggcctgcattagttctcctcaggtaaggattaacttcaatatttagcttagaaataaggcattttaaattcgcattttcagaaacactgggcaaatttgcagaaaagaaaaaaacacgtctggatggggaggggagatctcactgcattaaatgtttctataataaataattccctgaggtaccaattttaatcacttgacattttgtttccttttaatgcaaacatacagaacacaatactaccatttccaattttatttgtaaggatctagctcttaggtaggaattagggacatttcatggggtggggggtggtggtgaagatctctgtcttttctgaaatgacttgatgctgcttaaaactcacctgtcccacatagactatttttcttttctttttttgttttttggggacagactctcactctcttcccaggctggagtacagtggcgcgatctcgactcactgcagcctccacctccctggtagagggattctcctgcctgagcctcccgagtagctgggatcacaggcacccgccaccacacgcagctaattttttgtatttttggtagagacagggtttctccatgttggtcaggctggtctcgcactcctgacctcaggtgatctgcccacctcagcctcccaaagtgctgggattacaggcatgagccactgcacctggcctatttttcaaaaatagtgcttctgattcactgcacttcaaaggtggccttcctggtattttcaggtacaacaagcatagtaagggccatttgtccagacaggtaaattgcacctaatgattgacactaacaggagaattattaatagtacagagctggaattaacaacaaccactacatacacacacatatacacagtcccagggagtattagatctatagtcatgtatttaggcaaaacttccctttgaactgctttgatccatctgccctgaacatatgaaagaagaagagataactttgatacctgtaagactgtgaagatgaacagggcagttggtgcaaaactacaaagccctttccccttgaacagcagagtcacaggggcagccataaaccctaatacaaactcttccctccttccctctccttcttaccagccattcgccaccacctccccatgtggagacaaggacacaccacagcaactgcaattcagccacagagtaatggagagtggagatttggcttgttgattcaaggttaaagaggagaggcaggacatgcacggtggctcatgcctgtaatcccaacactttgggaggccaaggtgggtggatcacaaggttaggagttcgagaccagcctggcccaacatggtgaaacctcgtctcactctgttgcccagactggaatgcaatggtgtgatcttggctcactgcaacctccacctcccaggttgaagagattctcctgcctcagcctcctgagtagctgggattacagacacacaccacaacacccagttaatttttgtatttttagtattctgtatttcagagatggggtttcacatgttagccaggctgctcttgacctcctgacctcaagtgatccactcacctcggcctcctaaagtggtgggattacaggcgtgagccaccgcacctggccagcttcaactgtttttaagggtaacttggtaactgtgtagagcaaattctcacttttttgtttgtttggtttttggttagtcaagtaaagtagtgagagtagagaaagaacaaagaaatctgtaaccagttgtgaccaaccagttgtaaacaccactgcactcagacaagctgtttatttgtttataataatagtaacaagagaaggcgggggacatcacaataatctactcccaccccctttgtaaactaaaatgctacttcctttatacctgtgagactatctaaaacaattcagaagctgacgctcctgttcgccaaaacagatgtggggaaaaaaatcctgctcggattttattagaagccaaggactttcctcattctctctctctggttactaatgctccaaaataagccacctcaactttgtggcataaaacaaccctttcattatgctcacggttctgtggttcaggaagtcagacagaaatggggacagtttgactccacagtgtctggggcttcagttgggggtgacttgatggctaaaggctggaatatccggaggcatcttcactcgcatgtctagaggttgacactggctgtcggccgaaacacctacacgtggcctctctgcgtggtctctctgtgtgggcttagtctgggcttcctcatagcatggtggctgggatccaggaacaagcatcccaagatagcaaggcagaagcacatggcatttttacggtcctgcctcaagagtcacatggtgtgactttctgtcatactctgttggtccagataatcacaaaggtctgtccaggtttaaaaggatggtatatagacatcaccttccccactcccatggaagcacagtcaagttcacattgtatctggcatgggagctattttttgccaccaactttgggaaaaaaatgcaatctgccattgcagacaaaccactgatagatgaaatcccatgaacaaggtaagtccaaaaattctgagtctcaggcatcttcgactatcgcagatttaaagcaaactctgacaggcaaaagatcacaggagagagctagaagaatggggttttagccacagaagcccaccaaggtgcctttgaagccatgattacaaacactactcctggcaacaattagaagggtcctcaacatatattattgtatatacctttgctgttttattgcagcttggttccttctgtatcccattgacatctgatttaatgtacaagagtattaaaacatctgctgaattataattccaaagttcagatgacatcaagataaaatctatgaaactatgaatttgccatgttaaatggcttttttatttttaatggatcacagagggcagctgttttaaagcagtcccatatgcaaagctgtgggttaggtttaactaagaatcaatgtgacctacagatctttgaatgtgttgcaagggagaccacagtcttcaataatgctgcatctcccagcaggctgcttttgggccaagcaggagatggggaggcagagaagatcatctgcaatgagtggcccatatcttgattttcttttgtctcaacctaaaaatgatactacaggctcttcctatgttttaaggacaaaataggcccacctttcagacttctggttacatcactaagcaggaacaccattcccatcaggataatatcctcatcttataagtaacagcctcatcctcagctgttcaaaatcaatattcacagcctctttgcctctcctcacccactaagaaaatctttagcacttcccactcagcactaaccccattcctaaatctcccacgccttccccttgtgtcttactatacatattgaggccatcagtgtgtgtgagtggaaggggggaaatcaaagggagagaagaaaatagctgaaggacaaagacaaggaaagaagatgacacaaaaaggaatggcagcaccatgccagggagagatttggtagaggacaagaaacataccacaaagagatcttccatgcatctcccatggatctaccaggaatctagagatggaatgatgacaaataaacagagagggaaagggcacttaggaagggctgcaaaagggaatcacctgacttccaataagattgcaatcacttctagggttggttcctggactggatttctttgaatgacacactgggcctcgagtcagtcacttcaaaactctggatttacttgggttatgttgagctgataaaaaattatatttagagagatcagtaatttgttaagtgacaactcaattcttcccatcactgaaatttgtgactttaccactaccagacacagccaagtaaacagaaatctatcacattcatttagcccttattgtctattgctcatgaggatttagctgtccaccagacaggaaccagcaaccagtatggaagcacttgtgtggctggctgctatatgaataatgtcagcaaatgtgaattaactcatgagaggctgaaaaactattactgccagtattggatacgacaaaaaatgaaatcccaccttctaaagacagaaagttgcccagcattttatttcaaatgttaaagtcttaaaagcttctcctaaagtcaaacaagtaacttttcacttgtgacacatatatacacacatataggtatacatgtatatgtgtttatgtgtaggtatatatgtatatatgtgtgtatgggtatgtatatgtgtctatacatatacatatgagtaagacaaactagaatggtttattttcagcatatgtcaaaccctaggcaatgctgaagtaaagctttttcatctgtttagactctgatcatcctatggtaccagaactttaaggaggtttctaatgatgtcacatataatactgtcgtttaaagaaagtatgacataaaaacatatcaacacacagacacataaataaaacaggggaatgggattatgagttttaaatttttgtttcagttttttcttggtttagcggtcctctctttgaagaacatggttttgttttgttttgttttgttttgttttgttttgtttattagagatgcagtatcactctctcacccagtctggaatgtagtagctcaatcatagctcactgcaacctcaaattcctaggctcaagtgatcttcccacctcagcctcccaagtagctagaactacaggtgcatgtcaccatgcccagctatttatttatttatttatttatttatgtagaaacagagtcccacttcgttgcctaggctggtctcaaactcctggcttcaagcaattctcccacctcgacctcccaaagtgctgagattacaggtgtgagccaccacacctggcctgaagatcacatatgtcacgtaaagtctattaagcttgactacactcagggtacagtgcagatgctgggtcccatggcgctcaagagggaaggagtccctggacctgcctcggtagaactttatcagttctatctcattgtctcctttaagccccacggcgatcctatcttcccaatgacacactgtctcttttcctatatcattaacaggtaagaatcaagttgtaaacagaagaattaggaagccaaaaagcaggaaagctgagcaacacactcaaaatctaatcgctgcctgagaaatcaggaattgactctaaacacttggacacagcatgtcaccaacacagtccaactctagtgaggaggaggagagcgaggaagaggaaactcaagagcataaatgtgcaggataagggaaatggtgcaaggctgaagagaaattccttaactgcatcctaagcagctgttgtcagtaggtctgttgctgatgcttccgaggaaacatttcaggaccatttatcaagggaactggtagcagtaatatggatgggcttgactcaaacaagaaaatatactgcagacaacaaggaacatagctcataagtgagatgagccctagtacagcaataaccatttcagtgtatttgctatactttccttagggcagaagagaaggaaagatactaaattggaggagggaagaatgtgtgccccacacactagtcctctggagcttatctggctccatagattttttttttttttttttttttggacatagagtctcactctgtcaccctggttggaatacagtggcctgatctcggctcactgcaacctccgcctcccaggttcaagcgattctcttgcttcagcctcccaagtagctgggactacaggcatgtgccaccatgcccagctaatttgtgtatttttagtacagatggggttccaccatgttggccacgctagtcttgaaatcctgactccaggtgatcagcctgcctcagcctcccaaagtgctgggatcataggtgtgagccaccatgcccagcctggctccatagattcttactatttagtatagttcataggaccagcatcagcatcacgtgggagtttgttagagatgcccaacctgggcctactgaatcaggacctgcatccccagataattcacaagcacagtcaacgtgtgaatttacaatgctgggccctacaccatctggtgaaccgagagatttcaatcttttcctcatctcctcctccatttagtctctaaaacatgagcacccaccacatgtaggcactatacctggcaggcacagcaatgcccttgaccctcacgcagctcagagctgggcattctggggaacagacacaacccatacaaccacaaacgcacataaagatacaactgagtggcaagtgctgcaaaagggaaacaagtggtcttatgagagcattaaacaagatgagattctgtcaggccaggatccctggagaaaatgatgttagaattgaaatctgcaggatgactacatattaagtaggaagagtatgggggggcagggaacagtgtccagccaaagaggaaaggcttgtgcaaagaccccatggcataccacattacaggaacgacaagagaacaccacatgtacaatgaagctggccggggggcaggggccagaccatgagggctcttgtagctctaaatactttgatcctaagaacagagagaagccctgagaggctttaagcagggtatgccaggttagagaaaagaaggtataggcagatcccaggaattttactgaggaagcaggtctcagaccccagctatccccatttgtataaaagtttatcttcccttcccttctaacccagggccgtatcaggcgtaagccggcctgcctgccaccaaccccacaagacaaactgagcccctttcctaccaaagaaataagcaagaagtgccccagtgctaaagcaaaagaaaaacacacacaaagatgaatatgcctggtggctgccccaggacattggagggagtgatgcatagtacttcagattcttaaaaataaagaatatccggccaggtgcggtggctcacgcctataatcccagcactttgggaggcaggcggatcacctgaggtcaagagctcgagataagcctggccaatacagagaaaccccgtctccactaaaaatacaaaaattagccgggcgtggtggccggtgcttgtaatcccagctacccgggaggctgaggcaggagaatcacttgaaccccagagaccgaggttgcagtgagccaagaccatgccactgcactccagcctgggcgacaagagtaaaactctgcctcaaaataaaaaaagtaaggaatatctgaattcaagacctggttctacccctgactacctacacaaggtaaactttccaaggttcctaagaatgcctaacgatacctacataataatgttactgagagaattaaacagtagtgtctacaaagctctaagcatgaaacttaacacatagtaggtgttcaataaaaaatgtatatctttacacagcactgtggttctcaacctgccctcatgagcacattaactcttcaacctaaaagaatcattgttggctgggtgcagtggctcacatccataatcccagcactttgggaggccgagataggtgaggcaggtggattgcttgaggtcaggagttccagaccagcctggttaacatggtgaaaccctgtctctactaaaaatacaaaaatgagatgggtatgctggtgggtgcctgtaatcccagttactcagcaggctgaggtaggagaatcgcttgaacccgggaggtggaagttgcagagagctgagattgtcccagtgtactccagcctgggtgacaaagtgatactctctgtctcaaaaaaaaaaaaaaaaaaaaaaaaaaagaatcattgtttatttttaaaaacaataacgactaacatatagaaaatgcttagccacaacattaagcaatgctaagcatcacatgtattagtaagtcatcacaataacactatgaaatgggtgctgctattaactccattttacaacaaaaagtatacagaaagtaaggagcctgctcaggtactgagtgtgagtctctgttctgtggtgccttggccactcctcagggctcccaatatgcatatccctaggcaataacttgggcaattcacaaagtgctttcccccttattctaggtctccttgaactacggaactcttagcatgatattcactgatgcccaacaagcctgcttcactcaagtaaaaggctgaatgaaagaaactgcctcttgaaagaatctgatcctctgaccagggtgcaggccggcagatgataagaggctgaaaacaagcacacttctaggcgttcctcacttacaccattataatgaaacgaagctttctctggctatatggggctctgatgtcattagtaggacagctctttgaaaatcccaaacacccaaattttgataaaatctaactttcttttcagaatttccagtttgtggtatttggagaagtcccataacccctacatgaactgaactgtgtttatttccaaattttctgcacaccactcactaccaacttggtgtttacaaagcacctttgccctcaggatttccaggcagtgataaaagcatagagcaaatattttatggccggtctcatcctagtgccgtagtgggtacacagaatgccagccagctgtaagcaaaggggcaggacttgaaagctttctcagaggaagccaagtgttacctgtggtatttaaatggaaagaggcctgttgagtcaagtgccttcccagggaactggagggacaccaatttgcccaaagtcatccctggctggggaatataatagagggctagagttcagacttttcttccagctgatgattcatttaggacaaaagaatttacctttcctttcaactctctgtgacaaaaggttggagataccagaggaagccaattcagctaacttcaagggtgtccccacatggcagcacacataaatgcgccaaagggaaaatgaaagggaacggcccaagtattcttttctcgacaacaaacgttgcaacagtcctagagcgacgaaaagataggtttgaaagctagtcaaacatgagctcaaatccaagcacacccacttcccagatgtgtgttcttggtcatgttactgaagaaggtggtgcttattaagccaattacacacacacaaacatacacccctatgtcatatgcccacatgcagtgaacactatgctgtactatgccacccgcctccaggatccccctccaagacttgtgttggctgcagagagtcaccttccctgaggtcacatagccttcccagaacagccgcctccaatccttgttgacttgagggtatacaagccttgccctatcatcccaacccaggacaatactgaagaaccatctcaatgtcagagcttcctgcaggtcggctgggccttggttgagacgacttcacagcctaacttctcctccagcccaattccttcaacaggaattgattccaaaagcattccctaaccaatgtcctatatggtaatcatctctgagtttgctttccaggaagccagacaatatgctgaaccaaaaaaaaaaaaaaaaactggaatgagagatagtgaagtatggccaggtaatagtattaagttatttggattgtccttttttcaaggtcaagtaaaatgcaattctagcgaaaaaaatgagttaacttttttaaagggcaataggatacccaacagatgtccaatacttcctttttccttagctgtaactccccctacatcacacaaccttgtctatatcgatttgcttttgcttgttttagttaggatgggcaacaaaatggtatttcaaagttacatccttcaaattcaaaagaatgacagccactgaaacattctatgctcagttaacccaaaacaccaaacttccagatgcatacaggctttaatctgtcaaacttttaagtaaacttttcttggacaagttatcaagtaacatcttagaaattatttttttagcagagggcaaataaaaaggaattacaccatgatccactcaacatgaataatacaaactatactttatgcagtaaacattcattccaagtttttcctataaatataaatatgagaagaggtagtattaaaagttccatatcaccagtcttaccttgaaacaaaaaaaaaatattaagactcagtaataactagctaatttcagaaaagcagaggtagaaatggatgagagataaaaacagacaaccatttgggagcctgaggcgagtggatcacttgagaccaggagtttgagaccagcctggccaacatggcgaaaccccatctctactaaaaatacaaaaattagctgggtatggtggtacacatctgtaatcccagctacttgggaggctgaggcaggagaacaacttgaacctgggaagcagaggctgcagtaagccaagatcgtgctactgcactccagcctgggcaatagggtgagactccatctcaaaaaaaaaaaaaaaagaataaataaggggacagatgtgaaatcatctagcacagtgcctggcacatcagaagtgcccctgtaatgtccggtaaatctgaatcactgctattttttaactgcagctctttcccacccatccccatttcctctagggttttactgggaagcaaagaaaagaggaacctagccaactctgaagcccactctaggtcaatagtttgcatgtagctcatttaatcattttaactcctattgtgtctaaatttatgtttgaggaacccaggggtggggagggtcacagttttaaattttttaaaaaggtgtgctgttttcccaaagaagaacttcaattctggctgggcacagcggctcacgcctgcaatcccagcactttgggaggccgaggcgggtggattacctgaggtcaggagtttgagaccagcctgaccaacatggagaaaccccatctctactaaaaatacaaaattagccaggcatggtggcacatgcctgtaatcccagctacttaggaggctgaggcaggagaatcacttgtacccaggtggcagaggttgcagtgagcaaagattgcaccactgtactccagcctgggcaatacagtgaaactctgtctcaaataaaaaaaaaaaaagaaaaaaaaaaaagaacttcaatccaactaccttggaaccaaattaaagaaaaagatagaggccagactcggtggctcaagcctgtaatcccagcactttgggaggccaaggtgggcggatcacgagatcaggagaccgagaccatcctggctaacacagtgaaactccgtctctactaaaaatacaaaaaattagctggtcgtggtggcgggcacctgtagtcccagctactcgggagactgaagcaggagaatggcttgaacccaggacgtgaggcttgcagtgagctgagatcgcaccactgcactccagccagggcaacagagtgagactctgtctcaaaaaaaaaaaaaaaagaaagaaagaaatgcaaacatccccactaggtatttgaaaaagcatgttagggccaatgctacccacttttctcagacaatgaaaacatcgtcaatgatttgactgaagacttatttaagtaaaacggagatactcatacacctgacgaaaagaaaaaaggtaacttctcccctgataaagaccatgcaatggtggctccgcagtgaaccactacataatgtatcagggccatcttcctcaatttccctcataaaaataatacctgcttgctgtaaactacaccaacgagtcacctatgtcacagcccatttcccatttctcttgccccaattccaatcctcagaggaaggtagggtaaacacataattcaccatccaaagcagttcaccaaacactgaaagagggtactattaataattataccagaacaacaggtgtaaaccagatatttcccaaacaaaccgagacatatggtcacccttctcagaggtagccacagggaacatatccttgttgttccagatctttttttatttttaaggcacacacaagcatacccaaccaggtcagcagtagctgtgatataacaatgggatcatcctatagatgctgtctcttacttttttatttaatatatcatcatctgtttacatgtcaggacagagatccacctcacttttttaactgactacagaataagccactgtagggagataccatataatttttcaaccacccacaacacatataagccaacttgaaatttttgtctttacaagcaatgctatatagagaacacagccccacatatatcttttatgagtttgagtatttccaaagaataggtttctagtggtagaaaggctaggtcaaaatgttaccatttttaataggttcttctcaatactctccaaagaggccttatcaaatcatttcaagaccaagagttaataaacacttgtgaaattctgccaggctggtaaaggacacatgctatctcattccgtcattttcttaaatgttaacttaagacactctgggtccatggtacacttggaattttcctgcctccaggcctttgctcccactgttgcctccacttagaataacattccaccccatctctataaatatcctacagacaaatactaccttccccttaaggccagttctaaccctaactgacaacaaatcatcgctacatgatcttttccttctgggaatgcctgcagcactgtttaatcctgccccaccaccatcccctcacccagcaccctctcccagaccagacagggtggctcatgcctgtaatcccagcaccttgggaggctgaggcaggaggattgcttgagcccaggagttcaagaccagcctaggcaatacagtgagaccctgtctctacaaaaaaaaaaaaaaaaaatctaaaaaataaaaatagaaatacaaagacataatacacacgtactaattgataaattaagacagctatggtaaataaaaataagctttggatatataaaagacctggatataaagccctggctctgctgagcccagtaaagcaccttacgtcctgcaggcatccatttcctcattgataactgtggacgcagccaaccccctcccagcctgaacctaagaacctggtttgtttcccaactttgcctaccattaacagcagtgaaaaaaaaaaatcttaactcctctgtgcctcaatttcctactctcaaaaatgggaatgattataacacatttcatagagctgattgagaagtaaatgagttgataaaaagcacttccagcaaaggatggcatagagtaaggggtacatatatgctagatattctatagctactgccttaaaataacaattagatgatattttttaaatatgccaaaaagtttataagcaataaatgtctagtagcttaatttttatcccatctacactggaataatcaacagaaagaaaaattgaccaaaccaggaaactaccctgacataaagtttattggaaaatgtctatacgcattttctctctttctatctgtacatcaatcattctagaacactaaagactcagggatcacttaattgctctatcatcatttgtagcttcctacagagtggtgactaaattgagacttcaagaaatcgaaaggaaataacatgaggacataaagacagtatacttagaatgtgtttctatcaaatatgctccatataatttggtccaacaaattcagctctataaaatctcaaaggaggtagtggtgccaggaaagaagataaaaacccagagtgttaaaacagaagtgttttgagtcaattacgaagtctattcagcgcctccacaagcctagaatcaagtgatcagattcaaaggaggaaaactgacaaaattaatatggtaataactatcagtcattcagtgttgcctttgctctgtgttccatgccgagagttgactgcatcatttcattgaatccctgtagcaatcatataagatatgtgctcttattactgctacttcacagaagtaaaaacatgtacccaaggccacatagcaaggaagcagcaggaccagatttgaacccggactacatgaaattcaaatcctgtgcacataattactgagcatacagcctccaagccagaaaggtggaagggtcgactgggtcaaagctgatggcgggaccgaagaacagctgaccaatacacacaccctttgcaaagaagcgacgaggacacgttgctggcaaggctctactctggcaatatgtgccccagcaccggagctggagactttgggtaagtggtgctccggagagacccagggaaagtcaggcaaaactgagcaagaaagaaaagcagaatggaggaggtcaggacatcaagaaaatctgactccacctgcttccaaggggagtgggaagataaaagtcaaataggacaaggtggaaacaacccaatctccatcaacagatgaagggtgagcaaaatggggtacatacacaatggaatattattcagactttagaaggaaggaaattctgacacgctgcagcgtggatgaatcttgaggacattacactaattgagataagccagtcgcaaaagggtaaacactgtacgatttcacttttatgaggtatctggagtagtcaaattcacagagaaagaaatttagaggtcaccaggggccaggggaaaggggaatggggagttggtaataggcacagtaggagaagatgaaaaagttctggagatggatggtggtaataactgcataataacctgaatatacttaatgccacttaattgtataattaaaatggttaattttatgttatgttacgtatattttaccacaattttgtttaagtctcatagaaccttgctacgttcatgaagtgccaagttgcactgccgggaaccccaaggagaaagtaggagttagtcagtgcgggaagacgcaagcacttgtgtctcaacacgcgcagggcgcggctgcagatggaaaaaccgggaagctccgcgctgcaatgagccaggctcgcagtgaaaccatcgccaaggcaccaacgtctccctcccaacggagggtgcaaggaagggtgcctggcctcagctttcttcagatcaaactccagggggtcacctacccttaattcacacaatggtacatcacaccctgaaggggatcctgccacctgtcaccaggcaacaatgcagcctcctgacgaacaccaagctagaggaaacccaccgctgtcacctaatctgctgtcacctaatctcagacaagtaacaacttccaaggctcagggttctgaccgctaaactggagaggatggtacacacacttcacagcacgtgctaaggatgaaggatggtgcacgtgtggccctcagtgcaaagcctgagtagagaggcactaaatcaagctccactattgttatcatccgtataggtctactctcctcggttttcactttcatacatgaagcccaacagccaggtgacaggacagattgggcaggtgagagctggaagtcatcccaactttgaaaagaaaggactcttaggaaaacacaaagaaggaggcagaaaccattagaatagttaaacaatgagaatgctgagaaccaacaagctgagagaaaaagcaaacatctttactcttctttgggaattaatatctgtaaattgctttgtcttggactcatttatttttcctcctttgatcttggtcagagatgcggtccacaatttttggtggttgtgcttcatgaacacacaaccaggagacaaagataaggaaggacactttggtggggggggggggtgtctgcacatgcccatttaatgttgttttcttttacaagcctggctggaacaaaatacctttaacctccactacaccctcaccccaacacacacaggagcagcccctgcatattttcacacgtgtaactttctgctaccaccaggggatgtaaaagcagagtattttcttccaaagactgactgcctggttaacagcatttggccatactctagtaccccagaggtgacatcccattctctaccttccaacaagggtattcagtgccaggagttaaaccctgggattccaaaattctaggctaagtggcctccagccaggcacaaagagccaggcattttttttttaatagatgcagaaactgaggcacagagaggttaagcaagtgatcaaggtcacacagccggtaagggccggtgaaggaattgaaaataggccagtgaccactgtaaccagtaaactatcttgcctcacatggatcatgatcaccatcccttgtggctaggttccaggtggacttggtacagcctttggtggccgctgatgggctggtgaccctctttgcagccttctgcattctgagtgctcggggtcttaatcagccacctgagctctgactctcacctcactcagcacagcatgggttggtctcattacttacctcccatcctcctctttcaagtcattgcttgtcaagttttgcaagaatgagaactggctgtctgatcacctctcgctcttccctttgggaagccacagtgtgtctccattgttccccagaactgttcaaggcttccggtaaattctcgtatcttccctgagccatatccaattggaaggtacctacccacaccaagaaggatgccatcttgattggttcattcattcactcattcattccacaaatgtttatgctgctcagctgccaggtactgcctggccataaggagagtagaatacatggattatggatcagattcctgctctcaagtgattacactccagtggaacagataataggcaggctaacttcagatggtgatgagagctaagaagaaaataaagtgagctcaggagatggtgagtgaatctatggggaattctgtgagaactagaaggcagggtttcccaatcttgctgctattggcatttgggccagataaatctttgttggcagtgggctctctggtgcattaaaggatgtttacagtaccccgacccctacccctctatataccagtggcacttcccagatgtaacaatcaaaactgtcttcagacattgccaaatgttccctggaaaggcaacattacctcagttgaaaaccactgatcttgaatactatttaacagcacaggctctgcaattagaaccagattagaattgcagtttactagctgttaagttaaagcaaattacttcacctctctaagacttggtttcttcatcactaaaatgggttaaattttatctacttgcaaagttgttgcaaaaataataataataagatagtgtctgtggagagtttgacaagagctcaggtaacaaatgatcaataaatgggagctgtattttttaactcatcgggtcaagttaaaactcatatccaaggagtccactcttacctcatccatactcaattgcaattaaatttcccatggcacctgtccaatttgacctttctctaaatccaccatcccattggaggtagctgtcagaagtggggatcagttggttacttgacctggcatctattccatggcttctctcttctcaacagcacctccctcttccttagggaaccatgttttgctcccagtgcaacagtcaaaaggcccagataaggactgaccccacccgttactgcaagtgggcaccaatttgcataagcatcaatgattagggattgcagaactaaggcattcagcacacagtacatgacgttcctctgggtctctctctccctggctgtgagtaacaaggcatatcacccgtttgcccctgttatccatctgcaaataagagccatcttggccgggcgcagtggctcacgcctataattccagcactttgcgaggctgaggcagacggatcacttgagctcagtttgagaccagcctagccaacatggtgaaactccatctctattaaaaatacaaaaattagcagggcatggtggtgcacgcctacaatcccagctacttgggaagcagaggtaggagaatcgcttgaacctggaggttgcaatgagccaaaatcacatcattacactccagcctcggtgacagagcgagactctatctcaaaaagaagagccattttgaggctcaagacaggaggagggtgaaaacagcagctctgagagaatcaaggctgtccattacagatatgtaggttgtatcttcacaggtagtcaatacagactatcggcagctctgaagcaaattacagagaaattggacccatacgctgattgagccatacctgaagctccatccttctgaaattctaagttatatgcatcagttcatctcctttgctacctaagccatttgagttgcattttttaaattaattataaccaaaagcatcaagtgatacaacagtttaactatacaacctcggggtaacacagagtctcccaccctgcataaaatactcaagttgaaatcacttttcagtcatccattatattcactcattacaggtgctggagacagagcagtcaacaggagaaaacatcacccctaacctacttcacctgggacaatgagcgcactaccatatgctgagcttaagaaaactgtcatcggtaaatgtaccgattaaaaagaaaaaggccaaaggacactaaaacatgatctaccccaagctttcaaagttaagaagcatcaacccaacgtatcactccaaccgtgtcttggagcagctggatgtgacaccaaagatctgtaactgtcctcactatttgtggaggcactgtcttctgtgccattcaatacggtagacactagccacaagcagatagatttaaactgtgtgtcagtacaatgtaaaattcagttcctcagccacattacaggtacacaattgccacatgtggctagggaataaaatattgcacagtgtagataaagaatattccatcatcacagaaagttctattagtcaatgctgtctttccaccggagttccctttctgccttaaaagggcaagcatggtacagaggaaaaggtccctctaaattactaaaaccctgaagcaagaaaatgaacttccacaaacacatatgcacacacctagcatttgccccctagaagaacttgcagctcaaataactcaatttgtctttctattcttgactgcctcccacaatcagtgttcattcgagtgtacagtggggtctgttaccatcacttgttagataactggaagaaaggccaatattttagagcctggagcatcacacgctggacttgccacattcagccagagcacctttaaacactggattcacagagtccacacccccaggattctgatcccgtaggtctgggatggggtctagtaatccccatatttaacaaacaccctgcctgattctatgtaagtggctgttctgtggaccactctttggaggtggagtatcaggactgtgctgagcagggagacatgagtcagaatcactaataaagccacgccccggtgactataacttgaaaactctcccaggtaattctgatatactttccattcacccaaatccaatgtgtggggtactgtgttcaaagttgatgattttcttcaagaagctgtgcctgcaatctgttagcagccatcaggtgaatataagtgcctggtaacaggtgcacaggactgcaaatttcccccgcagccttttcccgaatgtctctttcccctctggaattcaggcaacagggtgactcaccatgttgtattaaaccccatggataagctccttccaccaaaaaaaagcctccaatccttacaaccagctgtcttattcccattaatggcttcttctcacaattatctttctttgggataatttatttcacacagaatatcttgagcttacatttttagctaaaatgtcgcagaaacaaattcacattgcttaagaaagccagggcctttcttccctatggcagtattttcccacggagttgaagagacatacctaggcaacagctacatgaatttttcctttgctgggcatcctattttcccgatttttctcttataaataatgacacatgtataatatatcaatattgagataacactttgtgtcttcaaaagttttctctttttaattttaaaagaaaaataaatttatagggttaataaatgtggctcatagattcaaataggcagaagccaggacatttccttggatgtaggtatccgaaacaacagtctcatctgctgtccttacactggaatgaacaattactggggatttttttccatctttgcctaaactcaagattcaaagtcccaaattaacccatagcttttggacacgtgtcagccattcgaacatggaatctcattgtctctgttacctattgccattataatgccatataattaacaatcacgaaacctcagtggcatatagcaatatgcatttatcacatatgtacctagagttcacttagggtcagctagagtgctctgctaatcctaactgaaataaaacaggtttcatatacactgtggaggaacttaactgtgcatttgcactgtgacatggctaaactctttaacaaagacgaaagcacagaaatttaacctgggatcgcccagcctgaaacaccatgaaatataagctttttgtgccacattatccttgagcattttatagtagcagaaagaagtcaaacttcacgccaagctaggggacttctgggtgctccaaaagcagtgaccacaatgaaggaagtggatcggggcatacagtagtctaaacttgaaaactctcctaagttgcatctcacatcagaagttctggattacatatagaatatcctatctaaaatttgaattcctagacagtctattggaatgttccattctgatatggaaatggagggggaaaggggactagagaaggagagaaaagacacacagtacaagtccaaaccaagtaagattttaaccctgcattggacttttgctgacaattttatagttttaatttaatagaggacctttcttggctccttgatagaaaaaaaactgcactgactaaatttctcatctgaattacctgaatccctttcctcatcctagtgcagcaaacctggtgcccgacatgaattatgcaatgcagaacaatccattatgcaggcaggaaagcaagaagggctacactggtttgcaaaaaacaaaaaacaaaattctaccatgtaatgctggcactgaaaaacagatgactaccggtcttagaggttaatcatgttctgacactgtccactcctggggtaaaggttagggtcccaatttatctatagaaaagtccaaacaagttgtattattaggaactttcctgccaaatttaaaacctccctaaatggtatacataaacttcattcgttcttgttggtaaagctacacatttcacaatcaaatcacttcagggcagagaatagattctattcctgtactaagaactcaaattcacgtgaacatcaatttcaagatgtgactttgcacccagttctaagacccggcagaccagggccctgggacaaaatattccaagaattatgatcagctgtcaaaatatgctctctccccagctcttcataacttgaattggaaagctgtcaccagctgggcctcaaataaacctacatggactataatgccaaagtagaccacttccaaaatgtactattcatttcaacacacatttcctgaccctttttgtgagttggtcagtatcctgggccctgagaatacagaaagagtaatgcaattactgcttttggagagatgaagtatgagagaaaccaagtgagagacaaatatataaacaaggcattgcaagcttgtcatctgaggaccaaatatggctcccagatgtgttttgtttggttcaccctttttttaaaaaaaagaaaactttgaaccagtgctttaaaactggcaaagttcattaaaaaaaaaaaaaaaaaaaaaaagaacaggcttctggttctcttgaaaacctgaaaaatctacactagaaacaccgggccaatgttcctacatggcagcaagaggccaaagcagaatggcagcttttcccattgaacagaataagcccttccaggtaatcctagtccccaccactccctaattgtcctttaaaatactactcagtatccagccgggcgcggtggctcacgcctgtaatcccagcactttgggaggccaaggtgggcggatcacctgaggtcgggagttcaagaccagcctggccaacatggtgaaaccctgtctctaataaaaatacaaaattagctgggtgtggtggtgcatgcctgtaatcccagctactcgggaggctgaagcaggagaattgcctgaacccaggaggcggaggttgcagtgagccaagatcgcatcattgcactccagcctgggcaacaagagtgagactccgtttccaaaacaaacaaacaaacaaaaaactactcagtttctgacttgtgaagaccaccataaataaacaattccagtagaaggtattatctttacaagtgagataagtgaaaaattacaggactctcgatatacagccagaagggatattagttaatatattctctgggggggtaaaatgatgatggataccaaaagccttaaaaagaaataattcatgtgagccaacagctttatttctagatagctatccaaagaaaatatctgaagatgttcgctaaaatgtatgtatgagggtagtcatcaatatgttatataaaagagaactgaaaacactctaaatgttcaaccttaaagtagagcttattatattataaagtaaccaaaaataaattttgcagtcactgaaatagtcaacttgatctacatatagtatttttttaaagtccatgattggccaggcacagtggcccacgcctgtaatcccagcactttgggaggccaaggtgggtggattgcttgagcccaggattctgagaccagcctgagcaagacagtgaaaccctgtctctacccaaaaaaaaattaattatttgggcacggtggcacccacctgtggtcccagctagtcagtaggctgggatgggaagatcgcttgagcccaggagatacaggtgagccaagaccgtgccactacactccagcctaggcgacagagaagtaaggctctgtctcaaaaacaaaaaaacaaaaaaacaaacaaacaaaaaaagtccatgatatgctgttaggcatgaagaaaactcccacccaaacagcatgtactgtacagtcttattttcataagaaaaagcccccccatcttcaaaagtatatgtttgtgtttctgtttgtgtatgtgtgtgtgtctgtgtgtgtgtatgtgtacgtctggataaaaatagtgttaacacatgtatttctctggggtgggattacgggcaattcggacatatttttctgccatattaacatatttctgtattgtatacattgtttaaatgagaaaaaatttaaatttcaccaggaaaatacataagctgtggaatcacagaccaattttagatagtgattgatagtcatataaggtcacgatactatttaagtttttaaaagattagaaaccaaaatctagatgcctacgctttttataaaataaaatgttaaaaaaacacatgctgcaacaccggagaaagcttttttttttttaacaacttgatcttgagttctgaattcttaactaactcacacagacttaaacaggctgatagatggaggaggaaatgaacatgctctccctatcagatgtaaattctaacgcttggccaagaatccaggtggtaaaatactatttaaaccaggccaaggtggtaccttccacggccacattacataagcaacaggcgcaagcagatgcacacatctggccagaataaaggccctctaagaccttcaacataattaattcaatatttttctctatagttcaaaatgctacaacaactggcagacaaccatcttaaatcatcacggaaaagtcagacatatggctaagtatatttaatatgctttaaaaataagacatggattttctagccaacaagatctcagacaattttttttttaattttgcctactcattaccctcaaaaagaattcaattcaacagatattcctgagtacctacagagggcagagactacaaagatccataaaataaggatgttgccttcaagaaacacataatctagtatgggagacagttgggcaaaactatagttacaaggcaccattgtgactctttgaaataatgaagtgcatggaggatagagagagggcacacgggaggaaagaatggacagtgttggtgagactgatcagagagaagaggagatggcggcaattaagcagaattgcttgaaaatatatagcagcacaccgttttttggcaggaaacactttgggaaaccattttttatttatcggactatcttccgtggggtcaccaagcatgtctctctggcagcaaaagggccagcctaagaccggtgtctctacattgacatgagggctccaggctatggggtagacacatttctttcttttttcttttttttttcttctttttcttaaaaaaagagaggaccggctgggcgcggtggctcacacttgtaatcccagcactttgggaggccgaggcgggcggatcacaaggtcaggagatcgagatcatcctggctaacacggtgaaaccccatctctactaaaaatacaaaaaatagccaggcgtggtggcgggtgcctgtagtctcagctactcgagaggctgaggcaggagaatggcgtgaaccccagaggtggagcttgcagcgagccaagatcgcaccactgcactccaagctgggtgacaatgagactccgtctcaaataaataaataaataaataaataaataaataaataaataaataaataataaaaaaagagagggtctttctctgtcacccagggtggagtgcagtggttccatcatagctcactgcagcctcggactccttggctcaagcaatcctcccaccacagcctccctccctagtagctgggactacaagcatgaaccaccatgcccctgctgtcaaggcatttctaacatggaaacctagagtaagattattggaatcagatagatctgagtttgaatctcacctaggtcagcagtcagggaaccaggagaacctgacttctcaagctaattttctcacagctgaaatgagaataagctcatctacctagacaaacccttaacctgggtttaagtgatgtatcagaggaacaataaataatagttacaattactagcatatccctcctaactcagattcccagtatcaagcatggagtcatgcctgtagaggggctttctcaacctcagccttactgacattttgggctggataattctcccttgaggggctgttgtgtacattgtggggtgttcagcagggtcccgggcctctactctctagatgccagaagcaaccctctccttaattgtgacaaccaaaaatggctccagacgttgccaaatgtcccctggggaacaaacttgcccccagctgagaaccactgattcagaggcactaactgacgtacctccatttctcagctgaaaatatcacagctggccaggcacgaaggctcatgcctgtaatcccagcactttgggaggccaaggcaggcagatcgcttgagcccaggagctcgagaccagcctgagcaatgtagtgaaaccccatctctacaaacaaacaaatagccaggtgtggtgggtgcatgcctgcagtcccagccactcaggaggctgaggtaggaggatcgcttgagcccaggaggtgggtgttgcagtgagctgagatcaagaaaagaaaagatcacagctgcttgtagggtaggtacttcaatgagcaccacttaagagccaggcagggtagtacaagttttacatacattatctcatttaatccttacaaccactttatgacacaggtaacattctcattttcaactgggagaactgatgttctgggaggctaacctgtccctggtctctcagctgggaagtgcgagagcctggatttgaacccaggcggtctgactccaaacccttatgaccactaagccccactgcttccccagccattcctgatgtaggagcccagacgtggtaccaggaagatgagaggaccacagagtcccattctcaagaatcatcgttgatggtaaaagcctgcctgaacacgcaagaactcgccctccctccacactaccacaacctgcgacctgcgaacaatcattaaaagcaattcctcaccgaggacaatgtgggagaaactcgggcaactcaaacctccgtgaggtccggaggcttccttcctacttgtctgaactaatccagtctcagcctttcaaaaaggcagcatctgaatcaagcagaaaaaagagtgttttttttctagacttgaaaagctctccagagaactgtacactgcaatctccatctctcaagagattctttcttctctcccaagggctttcaaatggggagcattcaaacaattacagaagccaacatttattgagcactcactatgtgccaagccctgtgtcatgtggtttactttctacttttccaacaaccctagagagtaggtatcattattatccccattttccgagggggaaacctggcacaaagaggttcagcatcttgccccagaacacccagctcataaagtgtaaagcctgcctcttcacccaagccaaccttgggtccaaaatctgactctatgacacatcagtaaattgctatttgtggatcattttatgagcagtactacggtcctgatgacactatatatagcagtaattttgaaacatggcttataatcagggcacgatcgccttttaattgcaccatcatgcccctgtccataaagagagcctcgagtcttgtctcataaaggagtaaagattatccttattgtaagaagcataactgtggcccattaaacagacacacaaatgcctccatccacagtaatggtggggttgataccttagccatgagaatgtaattatcttatggaactcatcttcatgacactggagatggtaacagaaaaagtctatacacacagccagaagaacctctcagtctgtttaggggtgagagagtctgcaaagttccatgacacactcagcatggggctgccttagacacacagtggtgacttgctctttaaagcatctccattggccttcttgactcactggtctcacctcttccttgccctactggaacttcctgggagcacctcccagataagccctgtgcattcaaatcctgacctagagttgccttctagggattcatgttggtggggagcacacaggactgaaagtggactgaggccaatgacttggctaagtaagggatgctgtgcacagacctatccctaactcgacaagatcttcatggtgactctagtagcctcagctctcctgtttggatcagccacctggtaccccttgttaccgtcatttcccaaatcaaagtaacctctgaaaatcaggacactcaattaattttaaagtcaaggacctcttccatgcagggaaacctaaaattggaaatgtgaccttatctctgactccaaggagactccagtggactcttccctccccttcttgacaagaaaccaaggacccacatgttcttacttgtaaacccataatactaagaccaactgaagcaggccagcaatgttcactgactttaagaatattcctggatcaatcggctaagctctattttagccccagccattgactgtaaatgttaaactctaaccaactttaatgtgatccatcatcagtcacctaaattttcagggacttctatatatctacattttcagaggtaactgacctcagaagagatttattctagttctaaacttgactgtaaacatttaacaaatacccaagcaagtactaggcaccatgcactgtttttgctactggggatactgtgggagaacaagacaacattcctgccatctcagagcttacattctagagaaagaggtaaaataagaaatttacttgtggtgaagcgatctacatactatggagtaaaataaagctgagagggggaacagggaatgacacgtggcagtggagttatggttttcaataatgtgctcacaagaggcctcactgggcaggtgacatttcagaaagacttgaagctcaagagatagcaagcctgtaagatgatcaggtgggcactagcaggcaggacagagaaagagaagtaatatccttaggacaggtcacgggcagccttggaagtcactataaggacttcggctttcactcagatacagagactacagaaatgattaataatggattattccattatgtaattactgagccataaaaagagaagatttctatttaatcataaaagacactgctcaaattacattttctaattttgctacatgccttcggaaaagttgacatccagaacacattagaccctccacaggacacttaactagaaagcagagtcaatatgataggaccaaccttgacatctgttgaaacaacaaaatgaattcataagaaatactacatcgatgccgacctccataggggagaagtctagcaatgcaccagtgtgtactagggatttttcaaggttacagatctcacatatgagctgcaaaaagacaggcaggcatgcagtaacctacttttttaggatgtgaatgtcagcccttaacgaatttgacagcctttattctcagtgtatacaaaatcagtatatcctgttacttgtatatacaaactcaaggaaagggccactaacaccagagagtggtgctttgcattaaataaccctcgtttacaaagcaacatccttcatgtaaacccttgtggtaaggagatgtcagaatgttttctcttataaaccacttaattccccttggtggatatcatcaattctgccatctaaaaccagctgggtaatgaatgccaagaaacacggtgagccaactgtatgccattgccacagaaggtcaagttaatctatttttaaataacacagccaatgacaaggggtggccactggaaacgatggacaagtgcgttgtacgtccttgcttcattttttgtaaaacctgtacagtgttccacagtgtaacctaaaaatatccttccaagagtggtcttttggcaccaagaacaaaaacaggttgatttttgaaagtttaagttaaaaaaaaaaagacataaatacaaagtacaatttaagagcgagagggctaaaattggattgtgttctgtagcaaagatctgatttgctattagccaaaaaaaaaagtacacagggacaatgctgcaagaaaacggagggaaagaatcatttttaggcatgaggacacaggtcccacatcaacaaaaaaaatcctcatcatcctgcctgctgaacatctgaaatttcacgtttagaggctcacttgttaaacttcagttagagtcaacaggcagaaatacttgaataggattcattaatccttgtcagtcatttatagcccagtataaattattagacacagaaagcctgctaattggaagatctgattacgagaaagtgaagacctctggatcctaaacaagaagtaaaagacaaatcgagagaaagggaggaaagatgttgcaagtggcctagttgcacttaccttccgaaacaatggaatagtcattcaggcatccaaccaattttagtgagcacctattatttgctgggtcttttttttgagatgagtctcactctgtcacccaggctggagtgcagtggcgcgatctcagctcactgcaacctcagcctcccgggttcaagcaattctctgcctcagcctccctagtggctgggattacaggcgcccaccaccacgcccggctaatttttttgttttttttttttttttagtagagacagggtttcaccatcttggccaggctggtcttgaactcctgaccttgtgatccacccacctcggcctcccaaagtgctgggattacaggcatgagccaccacgcctggccctgctgggtcttttttagacactgagaaatacagcagtgaacaagagagacaagcttcttgttttcatggaacttctattctcatgggaggggaaacagacaataaagaagaaacagggcccgttgcggtggctcacgcctacaatcctagcacttcgggaggccaaggcggcaggcagattgcctgagctcaagagaccagcctgggcaacatggcgaaaccccacctgtactaaaatacaaaaaattagccaggcatggtggtacatgcctataatgccagctactcgggaggctaagcatcagaattgcttgaacccgggaggcaaaggttgcagtgagccgagatcgcaccactgcactccagcctgggcaacagagcgaaactccatctcaaaaaaaaaaaaaaaaaaaacaacaacaacaacaacagaagataatacgagattgtgtcaaggctatgaaggaacaaacagggtgagggaatggcactttactcagggagctatcttttgtgtgtgtgtgtgagatgggggtctcactctgtcacccaggctggagtgcagtggtacaatcttggctcactgcaacctctgcctcctggtctcaagcgattctcccactctgcctcccgagtagctgggactacagaagttcgccaccacgcccagctagtttatgtattttttggtagagacttcaccatgttgcccaggctggtcttaaactcctgagctcaagtgatccacccaccttggcctcccaaggtgctgggattacaggtgagccaccacaagggcactatcttatatgcagtcagtggtgtgtgggggccagctcacattggcttgggaacagcaagtatacgcgtctcttcccaactccagctatgctataaatcagggtctacccactactagcactggttgttaagcattttacagcacaccagaaggaggtcactgaggagaaagaagcaagaccagagattcatgagaaaccaaacaactctgaaagacaaggccctgtgttttaaaatgagagttattgtcatacattccaatgaatcaaaacaataccaaaacaaaaaaccacacaaagaactatattcaaccatatgtgatcacaatttccctcattacagtgaggggaagggtctggtggtggtttggtttggcttttaaattgtatctcttttattatctccacactgccacacatacacaaaaagtagagggatagttacagttcctgggtaatttgaaaaaccacaaaattcacctgcaaaaatatgtaagcatgacctgtaatacaccactttgggaaactacaatcataccattttaaacctttggagtctgggtgattcatggaaacaaaggatttcacgagcacaaataacctgaagaggctcacccacttatttttggcatagagaaatgtaggctccaagaatgtgactggcagagcttattctagaacccaggtcacctgtctcatctgatgtcatcttctcaattttggtctataccctagtacagtagttcttaaaactgaacccttgaatcccttaataagcccatcagaatcccttgagggtttattaaaacaccccatggttgttaccccaccccccaaccccaaccccatcccccgcaaagcttctgaattggtagaactaaggtggggcccaggaatctggatttctaaccagttcccaggttactatactaatgccactggtctgaggacctcacttggagacctactgtcccaggaattgggagcacaggctttggaatcagacagagctgggttgcagctctactgccactgtggtatgacccttggaaaagttacccaaattctctgaacctcagcttctaacatctgagtccaattgtaaggactgaaaaagagaatgcccacgaagcatcagcttagccaagcacctattatattctaaggcaagatcttaatacatactagcgacatcttatatcctgtatcaaagtttccttaattacatttttccgaagcatatactaggacggctaaaattcaaaagacaaacaaaatcaaagatggccaaagatgtagagcaactgaaacattaataacagctttattcgtaatagtaaaaaatggtaaatactccaaatgtccataaacaagcaaaaggacaaactggtatgtgtatacaatggaatattacttagcaataaaaaaagaaccaaatgaagtacacatgcaacaaaacgaaatctccaaaatattttgttgagtaacaaaagccaaacacaaaagagtacatactgcattagttcatttttatgaagttgaagacaaaattattctatggtagatctatggtgcagggggaggggggaattaactggacaggaacatgagaaaaatttctggggtgatgaaaatgttctctatcttcatttgagtgattaacatgagtgcatacatcgcttaaaactcatcaaattatatatctaagatatgcattttactataggtaaatgatacctgaatacacataattatatataactttgtaaaggcattttatgacaaagtactgtcttccccacttaaaatgaaccaactccaacctgacaaaggactgtcttctccatttaaaatgaaccaagtccaacctggcagatccattgagtttgattcctgcacaatccagtcctgtcacagacagttttggtccatgtatctttccagagaactgccatgaagtagaaaaacagaattttctcccaccatgtagacagtatccagagtgatctgtgtccctggaagtggctaacttgggatgcaaacaacacaaaagtagtatttttctttaccatataccaagtatgagcctgcttgatatgactttaaaaggcacagtaatgaagacacattaagagcaattctgtcatacaatctaaatcatattctcaacatggaagagggagcagaaaactggtgaaatggtttctagggccatcattactggtaatgaagacgtcagaagatccaactgtgcctgtgtaattattacatgaaatagtcactttcagactgcaatgaattccaggccattcaggtttcccaatcagtatcatatttctatcccattacaagtagattcacgtacatccatccatacatacatatacacacacacacagaaacatacccacacactcgcccctgctgtgaacaatctgtgcacaaggggtgaagagagctaacacctggagacactacagtttcctttcaactcagaggtgtctgtttccaaacccacttgattatctcaccaagccttcctaaactccatgatgagagagccctgggacatcgcctcccagaaatttggcaactagtggaaggaagagacacaagcccatgcagcatcttgcacactgcaaacactgcaagccagcccctattcaggacccgttagacactgcgaggcatccccctagttgggcaggtacccttgcctgtccttcctccaccctttctccaaaatggtcctgaactgagacctgcagctgctcccatcctatgccttcacacagtattttctctacagccctatcaagtcataattatccaggttcctgacactaaaaactagtttcagaaataaatagctgctaaaatcaattcaaacataaatagctaatctttatggagcacttactatgtacaggcactgttgggtgcactttccacgtgttagcttatgtaatacccacaggaaagccagtgtgaggaagacgcattgtcaggccaggaaaggttttgaacctcaagcaaaacctggagaggtatgccaggaatgaggcacaatctctccctttaatgagctcactaccttgtatggaaatgaggacctaactcagagttcagagtaagtaaaaaagccacaaagtagacattaaaggagcccaaaggaggaagaatttgtgcatcctagcaggattctggagggcttcttggaggaggtatcccagtggagaatgaagtcataaatacaaggagctttccatagctaagtgtcagctcctcagctcccaaagctgctaaaaggccaggcgagtcggccgccccctcctccatttcatctggagcacgcctgtttccaagagaggaccagctaggcccagcccttcctttgacacattcctccagctgctgcctgtccttatggaaacacatgggaacttttcaccatgttcaacttcacgacttccttcggtgctttcactggggagaacctgcgtcatggcacttgcttgcacaagggagccctttaagggcctcagctggtctccattgggttgacatgaggacagccccttgtctgtaccaaagtgagatgtaagggacctacatcaccagcagccagcaaatgcatcttttaaaaggcctctacagatttctgagagaggaatttgcttccactccctcctcaggaatcagccccttcagtgcggtagggtcatccccccactccttcctcctccatacttaaggctctgcagcaagggctcaaaccctcgcttttggcaactgtgtgaccttgagcaagtcacttaaccagtatcaatcccagtttccttatctctaatttggggtatataaataagaacaactcgttcttagaactgttgtgaatcggagtgagatagtgcaagtaaagtattttacacagagccgggcatgtagtaaaccaacaatgaatagtagcttcattttcatcatcaataatgacgatgatggtggtggtgggagggtaaacttggacccgattcgagctaaaagcaagcaccccttccccctctccccctcccaagtgtatggctgagccacacggtggagacacatgcgtcatccggctgaggggtgaatgcaggctcttctggcggcgggctcaggaaccgccaggcagtggtgtcctagctcacctggaggggtcgcggggtgaagcagattttctgatgggggaggtccaataaactacagaccctctctttctgtatacccactcagcaggtatggaaactgactcgtggccaaagaacgccagctgcatccctcccccaaggagccaggacagcgtccaccatgcccctgactcagttccccaactctctctcgggtgcaggcgagactgcgctgcacttagtggcggagataacaggttggccagccaggcctgagaaacgtccccccgctaccttgcgcaaacccagccccctcttcgaaacgcaggtgggcaaacaaccctcaacctcgcaacaactttgtgtatttcaccgccaccacagggcgcacggcctcaacttctcttcactgcgctccgaggagggaagcaggaaatcgagaataaggggcagcccacagaccaccctccttttctcggggcgccccccaaaggcgcgccctgccttaccttgtctgacggccttgaaggtgacggcctccttgcagctgtcgatgacccccagcacgtcatagcggggcaagccggacacccggaccccctgcacctccagaagcagctccccttcgcccagcctcgggccctcgccgccgccgggaagccccgctgcctcgaccgccgccaccgctccgacgtacggaaactccccgtgctccgcgcctcccagcaccgtcacccccagctcgccctggggtccccgcttcacggtgcattcgtgaaccctgctagtccagtggttcttcttctggatcactttggacatgatgagttacacccctcctccaaaaaaataaaacgagagacaggtgccccccacagcacgagcccccaagcctccgcttgttcatgggagaaacatctctccccaaatcacaaaacaggagagagaaacttggcagcctcgctcccctgcacacgctcgcgcactcaagccatcataaaacaaactttctgggcttccccgcgagccccgcacaggcgcccgcgagctttgtttgcattccggtgcctctgggtccacgttccggcgcccgcccgtgctctcccggaccagagtccactctgcgccgctcgggttatttttttttccttccttcctttctctcttgccttttacaaatgcggtgcctcctctttgcctcccgcccggctcgcctctcctcgctggcaggctgttactgagggtgagggaagcccttccagccagttgccgggagccctgaagacgcggtggcggggcggcggggagcagggcgggaggtaagtgctcgcggcccctttaagcagatacaaaggctcggcttgttttgttacagttcattctattccgcgccgcggagcgcagcggccggcgacaggagacgcgcgcgcatgcgccccgcggccgccagccggccggcccacccctcccctcctccccgaagggagagattccaacgtgcttcccgatgggtcctaaaaccgacctgccgggagaaggcaactcccccccaacccttcctgaacccctatcctctctccttttctttcagtgccctggactccgcggattcctttggggctggagggccgcacacgtgttttactccaactgtttgcaacttttgaaacccgggcaatctggctttggcatttgaaaaccatttcaaacaggtgggggttggggaggctgccacactcaccctggcgctcacactcacgcacacgcgcacgcactcgcgccggccctaagcctcctaaccgccctcggccagtggctggccaggctgtcggtcacccagcccggctggttcgccgccccccttgccgcaggtcccactgaaacccccgagacccgccccggggcgctcgccgcctccctgcctgccctgcgcttgcgggttcgggtcctggcgcggggtctgccagggtctctgcgacccgggggagggggacggtgggatcctccggttccccaactgggatccctgtgcgggtcacacgcgctcttacacacacccgcatccttaaactttgggaccaactttttaggacacgggaaactacaggcaagagagagaagccatggtgctagtgtgggttcaggtattcaaccaaaaaagagatccctctagcttttcaactgccctgccagcagagactgctggacccagtcaatcatctgccccggcctcaagttcctggcagggccgagaagcctgcggacctactccggggccaggagataaggatccccgccgggcgcggacatgccctgcgtcctggcgcccgcgggggcgtgagagaactcggaattcgcagcccgggggtagctgcggcctccggaggtcgcccgggggtgcggatggagtgacttctgtcccggcgaggtggcggacagaaagactcccataccacaggaaggctgcccttcccaaatactcctcaaatcaggctgctgagtagtctccccagcagtttgttttcctctttagtgatgtataattttgttcatctttggtcacaggagagattccaagaaatgaggggggtacgttgaaacgatgaagaaaggatggacacagcagtcgaggttgagaggtaggctcaggggtccacccttgtgtgaccttgagcaagcttggtgacctccgcgcctccgtttctcgctgatcaaataagtagaacaagacctcacagggttcttggaagtattacgtgggaaaacacttataaagtggcaaataataaaaactcattatattcttaatagtagtattactatttgggaagaaaattgggaaatcatttggggattcaagttagtaagtatgataatttatcctctcctttctagaacttagaaaatatgggcatactttgtgtgtttgttttttgatggtggtggtggtgtttttagaaacgtggtcttgctttgtccccaagctggagtgcagtagctcgactagctgattgtaacctcgaacttctggactcaagcaatcctaccacctcagcctcctgagtatctggaattataggcacatgccaccatgcccagctagttttatttttttgattttttgtagacatgggggggtctccctatgttgattgcccaggctggtctcaaactcctgggctcaagccaacctcctgactcagcttcccaaagtgctggggttatagatgtgagccaccatacctggtttaggcatacgtttaaacatccttttaaagcattgtagggtgctattctaagctaataaaagtaaggagggatgttgatgcttctctcttgggatatccagaactgaaaatcccattgcattgttgtgtttctgaaaaaaggaggtgaccaattttccatggctttgcttggtgagaggaactttgtctccagctttttttcagaagcaatctaggtcaatatgaacagcacttcaaaacataaattatcaaacccgagcacagatccagccaatcagaatgtcaaggaagggctaagtcatttgaacttttaaggttccccttatgtgttgttggtacacaacgctgagcaccataggtttagtatcttgattccaaagcattgtttgggtcccagacctttttgtcaaataaacctgtgatccacatctctgtgtaaaataaaaactcaaggaggtcaggacactttgacagtttggtttactgatgtattattcccagttcctagaatggtgcctcgtactagcaaatgctaaaatatttgtcaaatgactctttccacaaaaatgtacatttttactttccatgttagtggggagtcacagattcccctgcaaatcattagtaagcttagtaagcttagccttgtgtgtttccccactttgccacttcatattctagtaaagtgtaattgtttgctaagaatacccacaaccaaccttgaattaggagtcccctacctctccactcaactctcacctctgcctgggggagtccaagggctggacaagaccaggcgttttgtgattcctcccaatgcaacaacatccccctcttgccaggattccaggtgtcaccacagcagctgagaaaggaaagaacttggaatttagcatacgtcaggttttagatgtggaaaagccccaaaagaaggagtagtacctgtgggcacagagggcaatatggagagaatagacattattctaattcaggaaaaggaaaaataatttgaaccttcaaagtagccaaggctgccagtttccaggatgctccctctgcatcttcccggctggtgtttcacctggtctagttcctgtgtcccagactggagaagttcaaggcagagatcatctctctcctatccaacctttgaaacctcaataccaaaaaccatgaaccatgccttgtgtggagtgtgcaccatacacagttgttgagtgaattgatgaagtgtgacatgaaattgttgaataaatggatgaagtatgacatgaaattgtgtaatatgtgacctttgatccaaagccagtttagatttggttgccaaaacaggggtatttatattaggttggtgcaagagtaattgcaggttttgccattactttcaatgaaaagagcttatagttatgtcattgtgaagtagatttttcctgaatagatctaagatcctagtattctgacttgtctcactttagctatgaatttggcaatacattctgttgggagaaataatgctataaaatacctaactttcaagcttactgtatatgtcagcgtagtgatgtgagttgggggtttttttgtttggtttttgtttgtttgtttgtttgtttgttttgagacaaactctcactctgtcatccaggctggagtgcagtggtgccgtctcggcacactgcaacctcagcctcctgggtttaagtgattctcacgcctcaacctcccaagtagctgggattgcaggagtacaccaccatgcccagctaatttttgcttttttagtagagacagggttttgccatgttggccaggctggtctcaaactcctgacctcaggtgatccacctacctcggcctcccaaagtgttgggattacaggcgtgagccatcgcgcccagctgatgtgagttattttatgcaatcaccacagttgtgtaaggtaggaactatcaggaatgaccttgattttataactgaggaaaatgaagctaagaaagtgaagaaacttgccccagagcttacaagtaacaaaaccaggaagtgaacccggaggcatgacccaaaacccatgctcagaacactgtagtctgagaggataggatgtggccatttagcatatttgggtaacagcatgctctggactcttgaatctgctacatagtgtatacacagtaattaagtccccctcctttctgtctcttcactttaagctaaaggatacagtgtttcactccagaactcaatctcctgttctccatctatgggctttgaagattcaaataattcaggaatgcaaagagaattaatttgcaaacatttctacagtgtttaggctgcagtacaggtgacatgccaaacagtcttatattattgcataagcatttcaacaatgaactcctaatacagagggtagattcagctgagaaataaactataacagaataaacactagacaaattaagatcttatttgtatatagctagttctactagggggaagaaaaaaaaacgaatatgaaatgtgcatttctttcccttctccgaaatatatttctttccaaagttttccagttgtgattaaagaaatgtgtcattgcagtttaaagtggtaattttcctcctttttctgaaaatatgaggatgggaaataagttggtcagttgcaggggcaaaggaggacatataaattggttatttttttaatttctgaagaaagctatcaggaggcatacattagaggttttagtataaataggttatatacggtagggtaaccgactccaaacaggtaactcagggcagaagaccagtaggggagattgaagccagggtagcttcctctgaccatagtattcctccctttagtactttcagctaagcaagaaaaaataaaatgttgtactttggcaaaccaaggtggatgatcacttgagcccaggagttcgaaaccagcctaggcaacatggtgaaaccccatctctataacacatacaaaaaatttgccaagtgtggtgacatccacctgtagtctcagctactcaggaggctgaggaaggaggattgcttgagcccagaaggtcgaggctgctgtgagctatcattgcaccattgtactccagcctaggcaacagagcaggaccctgtctcaaaaaataaaaataaaaaacaaaataagtctgggcacagtggctcacacctgtaatcccagcacttcaggaggccaagacaggcagatcacttgaaatcagcagttcaagaccagcctggccaacatggtgaaaccccatctctactaaaaatacaaaaattagccaggcgtggtggcacacacctgtaatcccagctactagggaggctgaggcaagagaattgcttgaacccaggaggtggaggttgcagtgagcgaagatcatgccactgccctccagcctaggtgacacagcaagactccatttcaataaataaataaataaaatattaaattgtgtgacaattgtgtgacttttcaagacatcatatatgaactattattttaatagccctggaagtaactccaggaagggtttaaatcctggttaatgttctgtttcacttaagtgcaaaaaaaaaataaatcttgggaactggaatatttggttagacttttggtctgaggaaccaagggaaatcaaaaaatgtatcacgagtatctctcctaaaatttcccaaatggttcagctatataaaacactaagtatctcaaattatcctatcatcctccataattccactgaaactatacctgatggtttactaacacttaatttccttgagaacaggaaactctcattttcccgagaacagacgtgtgtacctcttttatattgtctcccatcaactttgtcaaaatatggtaattagaacatggcttactctatatttctttttttcttcttttttttttttttttttttttttttttttttgagacagggtctcattctgttgcccaggctggaatgcaagatcacagctcactgcagcctccacctcccaggctcaagtgatcctcccatctcagcctcctgagtagctgggactgcaagtgtgagccactacacccaaccttcctcttctttattgtatatctttatcaatttactgtaccaaaacagaactgagagggagaaaaaggaaaatacacattgaaactaagggtaaaatgcccatatttttaaaaataccatactaatataaatttttgcaagaaatttttaaaacagacaagtaaacaggcacattaaattaaatcatttgtaatcttaccaccaataattaaccactttttatatttggtgaatcttatactggacctacatgaacttgcatttattactttcaataattgaataatattttattctctgaatgtttccaaatttatttaatcttaatagtccattgatgattaggattctgaagaaggctaaaataacaatttgtattagggtgtttttgattgtcagagacagaaacccagtttaactaccttaagcaaaaaatgaaatatattactccatgtaagtggcaagaccagaggtgaaactagttttcaatatgtctggatgaagaggttcaagtgacatcctcagctttctctctctctctgtgtcttgattctcctttgctgtcttgccctcaccctctcccactacatacagatgggtcttctccagccagccaggaaagatagctagctacaagcagcctacatgatccaggtttagcaatcccagccaaaaggagattttcactaacaggagggaaaaggaatagagaaacttcagtctctaataaagcaatttcagttgttgagggtagaggtagagtctgcctgctttgcggtggcttccacaataaacacgagtgattcaaaaacctcatcagctgcctaatcaagcctggcagagtgtttggggctccttagggaaacctcatcgaggtgggttcctctgcagactcttatcatggtctccttttctgcagttacctaaaggttccacgaattcaagtatagtgggagtttgatttcaatcaaagctgcagtggttggcccatatttttatagatgttttgaagatattctaaagctggcaacactgcaggattgaaccccttacaatggaagccagtcaagtgttatacttgtttaatacagatggctcgttaaactacataacattgatttcaaatgtcccaaaatgagtcttgagtttctctgaggctaaactgaaaataacaattaaatatcccatgatggcacatgacagttggtagattgtttttattcattcattcattcattcatttagcaattttttttttttttcttgagacagagtctggctctgtctgtcatccagactggagtgcagtggcgcattctcagctcactgcaacctctgcctcttgggctcaagccatcctcccacctcagcctccctaatagctgagtctacaagtacacaccaccacgcctggctagtttttgtattttttgtagagacggggttttgccatgttgcccaggctggtcttgaatggtcttgaattcctgggctccagcaatctgcccatctctgcctcccaaagtgctgggattataggcatgagccaccgtgcccagcccagcaatttttgtttgttttgagatagcatctcactctgtcacccagactggagtgcagtgacacaatcatggctcactacagcctccaactcctgggctcaaacaatcctcccacctcagcctcccacatagctcagccacaggcacacactaaccaacctgtctaatttttttattttttgcagggactgagtctcactatgttgcccaggctgttcttgaactcctggcttcaagccattctcccgcctcctcctcccaaagtactgagattacaagtgtaagccaccacatctgacttttttttttcctccaagcaattctcctgcctcagcttcctgagcagctgggattacaggcacctgccaccatgcccagctaattttttgtattttaatacagactgggtttcatcatgttggccaggctggtctcgaactcctgacctcaagtgatccacccacttcagcctcccaaagtgctgagattacaagcatgagccagcatacctggccacagctggccttttttttttttttttttttttttttttagcaattattgattaaacacttattttgtcaactccttgtagggactgatggcacagcactaaaagacacttcccccccaccccaacccccggaggaagcctacctcccaatttgatattgaaacaagaaaaaagatcagtacttggtaaggtcaatgacagggaaacccaggttaccgtggaggacatctcattagggaggattttaatttgtaaacatggcattagaaattaaaagtgccattgttagaagaatttcttgtctcctctcctctaatttattttacaagtattttgagaagtgaaagacaaagtccagctttatgattacattatgatactcaaagatatgttttatggaggcattcacagagttctaaggtggttaaagttgcccacgatgtgaatatatagttccataaaggacaatgctatcttgccacaaagctgatccagcaaacactaggtggggttttgaaaaatgactcgggataacgaagcaatctggagtctgagcaaccttgctccttgaactgtgccatctttggaaaattggcccccaccaaactgtatagccagatgaatgaggactcagaaagataatgtattactcactttccagatttagcacgttcctagaattttaaactcatttttatggactgttgcctaactgaggggagacttagacaaacccagagtggttatgagcaacatccccgggggagtcagtgcccaaatttggagtccttgtgtcctgaacattcctgacactcctggcttggatattcagcctgcccgagttggagtaccccagggattttagatgcagctgagaactgctgaattaagccaagtgttggaagatcctgcaattttcattattaagttagccctctgctttattgaatgcacaagctggcatatgcttgggaatgtttctgcttccaaactcacagcatctacatttttcagatgtttgaccttgatcttgtgaccttgcctctagaactctgagagtgctgggaatactcacagctgagtgatggaagcaaaaactagaaaacaatctttttttcttttttaactcacttacaatacagggttacctggcttgagactagactgttttagactagacttaccttccttaagttattaattttatcatataatctcagtatgacttcactttttgaattgataccactaaagcctgaaactattaaagctatgcaatctgcttgctaaggcaagctggtatttcctgatactgctatccagatagctgagaaccttctctagagtcatgtttttcaaacttttctgattgctgtttgcaataggagatgtatttttatcactagcacacacacacacatacacatatatacatatggttgaaacaaacttttcatgaaaccataattatcctttctgggcctgtcacagtggctcacgcctgtaatcccagcacttcggaaggccaaggcaggtggatcacttgaggccaagagttggagaccagcctggctaacatggtgaaaacccgtctttactaaaaatacaaaaattagccaggcgtggtggtacatacctgtaaacccatctacttgggaggctgaggcaggagaatcgcttgaacctgggaggcagaggttgtagtgagcctagatagtgccactgcactccagcctgggcaacagagtgagactctgtctcaaaaaaaataaaataaaataaaataaaaattatcatttctgcctacaatgccctatgccaggggttacaacccatagtcaatccattccttaacctatccctgtctgactcatgagctaagaatggctttacatttttaaatggatgaaaaacaaatc

SEQ ID NO: 320 - DNA, 597079 bp, Homo sapiens
tgctattcttcactgtattttgccagatgtgatatcatagttctatggaatcatattttttaaatttctgtaagagaccttattacaatgtaaataaagctggagaggagatttctgagcagttaagattcagcttttccccatgcattgtttactggcagtttcttaaatctctttgaagttagagttttctaggttgttaatttttaatttcactttgcagaataaaatcatccaagtatatacatattctgtcattttattcattccaagatgaccagaaaaacatttatcctcataaaagtcaaatgtgaaattaattcctttgaattcagcatttcttgaacacctactctgaaccaggtggtgtgcttgacaagggctaactacaaaaaaagaggaaaggcccacagtctaggaaggtaaataaggcttaagtattgtgaattttattgtcttctacatctgctaaaaaattaatttcagtaataattggtgttctgttttagtttataaatgtgaatattcaagtgtccagtactttaatcctttgatgagtattattttagcaattttattttagagtggatagggtgtagggtgtgcttttgcagtcttagtatttttaagcaagcacaaatgcattacactaagatactttatataacctccagaaaatatctgccatttttgtttatgctgctatagaaagttaattaaatgaataccttcacatgaaaaaaatatccatggaatgtgcaatccttatgcctttatacacctttccagttaagcggtgaacttgatgagagcctgtcactgttgctccttaatcagtaggaaggggtcatcttgagtgacatgaggcactctttccctgaggcatttatcacgtagctttcacgccaattgcacctcctgctgacgtggagcttgcaaaactaggaatgataattgtttttatgacaaatgtggattgagttagaaaggtcagtgatagcgttattagaattaagctctgcctggtgttgtcaaaacaggagacatggaattgttaactattccttgtaaatcaaattatgttatcagaaaattcaccttgtaggttaaaatgaactgtagttggagaatatactttggtagttatttgttgtgatatatattttgaaattattataggctataaattaattagaaaaggttgaagtgttgttttacttggctctgagtatacattttcaaggtaaggcaaatcctactcaaagaagaccttttcaaaggaaataaaacatttttaacattattgattattagatgtttaaaaagtttgtcctcttaagtacttatcttacagaacatctaaaatatgtacaagctgttcctaatactttttatatttgaatgtattactatgtcttttttagtgtaagtatatagttttgattataaatacacttgaactatgttttttaaaaagcttgaaatacaatccttagtactagatataagtgatttttttttttagaatgttaatactttttgtttttcaagagatgatccctcccaccccctttttaaaacagaagtataatgaactctgttctgggttttttaactacttgcagagttaaagatcaacaatattaagtcagcaaagtgactattaaaccatatttctaacaaaatatgcagtattgttatatatgtaatatatcatattgcctttaacaaatatagaccccaaaagcccttattcaagtatttataaatagttatttccaattagaattaaaacatatacttccaaattagtcatttttgtatcatggccccaaatctttttagatgtagaacccagatttggtagatctaatcctcttccttgccaaagtatctgagttggatcaagtgaacgttaatgtattatggatgttaaacattaatagagaatggctcactagtttgggacatacaatttcattctaccaaagagtagaaatttaaacaaaaaacaaaacaaaaggtttagcacttccaaaaagtcaggtgcgctgaactgaaaatctggaatccaggtttgaatttatacctatcatactgtcgtttatcttgatagtagatgaactaaaattaccactgcttctctattctgtctcaaagtgaaataaatagtaatattgaaaaatcattaatcttaaagtgttgacagatgaaaataacttagtttgttgtcagtgacttctcaacctaaaggttaggtcaacagtggtttatgtcatgactcttaataaatttttctaatgaccagaatagtttgatttatgatagtttttttgtttttgtttaaaggaatatttatctttgttatctggcttcatcctaaagatgcatttttctactttgcattcattcctttttatattagagataaaattaccgagcaataagtaaaatctggtaaaattaaaatatgtgttttaaggaattttccaggaaaacttaaaagcagaattgtaaaggtgaaaactggacaaggggatgaggggaaaaatggttaagaatcattctgcttaaaggaatccaaagggtaaagatttctaggtactgtttattatattgatggaacttaatgaaggtataaaatcagacaagcatgtagactaatctcagaaataaactgggtctttgaaatttttgaataatattcgataaactaaaccaaaggtccagataattgttttatagaaggttcttttggtcgaaattcaatttaatcaaaaataaagaataataaaattccagttctaatggtatcagaaacaggctagattttttttcactgttttttaaaaaacaattgacacataataattgtacatgtttattagggtacagtgtgatgcttcaatacatgtgtacattgtataatgataaaatcatggtggttaacatgtcatttatcttaaacctttccaatttctttgtggtgataacgttcaagacccacttttctagctatcttgaaatataatacattgttattatctgtagtcgccccactatgtaatagaacatcagcacttactcttcttagttcatctaactaactttgtagcccttcagaccatcctctccccatctttgccttccctccctttcccttcccagcctctggtaaccaccattctactgtctacttctatgagatcacctctcttagcttccacatgtaagtgagatcatgtggtatttgtcttcctgtgagaaaaaggttgtttcgaatagtaatactcagtcctttctcacaggcaaatcttgactcatttcttattttcctgtcatttcagttcttttacactcccaaaaatactgttaagttcctacatgttactggaggaaatggactcagagagttgaaagctacttattaaaagtggttggaccttttacctaaatatcattttttactaatattaatattttaaaattgaaactaaatgttattaaaaaggatcttctcagccagacatggtagcacatgcctatagtcccagctatttgagaggctgaggcagaatgatcacttgagcccaggagttcaaggccaacctgagcaacatagcaagactcttttaaaaaaataataacataaatatatcatctaaattacataaggaaaaagattgtaagtaaaaaattgcttatagtgattgtctttatgtgaaaaaattttggatctttttcacctctccaggtttctttgtaatgatttgtatttgtttataataccagtatccaatttattttgaaagtaatgctcctgatttaagtaagaatcagtccttgaaatttttctaaagttgccttatttaaactggcacctactggatttttaaaaggtaaattacagttttaatatactatttaaagttggatataattaaaagtataattagtattatctaacacagatctcaaaaaatacactatacatgtgctccttttttcaaagtgaatctgaccactttactgatatggttctctactctttaagacacttcaaaatggagccccaagtatgctgaagtgggaactggggggactttactcttttgtagtactcttaaattgctaaagattaaacttgctcatgtggatactatgtggagtcataacatatctttactttgtgattttagtatttatgggacctgaagaattacttgttctctagtgagatttttcagatacgacacagaaaagcagggagaaactggtaagattaaatgatagctacatttattcaaagattgtaccttaaatggctttgaaaggatactactgtataaagaatttttttcttctatcatcactctgaaaaaatatccactttataacttattatttgcaacattaatgcagatacaaacaaccctctgttgagagaattctgagagtgtcttaccacagctctccagagcatattattttgcacctcttctgtgaaggccggcaaaatagcttcttgaaaggtactcttttaagtagtacaactcagaacaatctttttacagttgtgttttgtataaatatcctggatacctacatggtaactatagtacaacctgatagtatcaatctgtttttagggggaagatttcttacctaccggtcagggctgttgtcacagttatgggagggaaatcaagtacatatgcattaaatgtactatgtatcaagtacgtagcatcatagtgtgcaagattggatggtgaatacttggtacccccaatccataagtcagagtattttgcttttgcttaaattaccaagcgctgtatgttttgatttttaaaaaaagtttttctcttacttctgaaaatgaatgtttttaaaagtgatgttaagcaatttcacacaaataatggaacatcacattaatctgtttaaaaactcctttgtcagatatgtatagtgttttctggatggcttctcgtgtgcttcaaagaccctcttatgtttgctaggttctctgttaatggaaactgaagtttgtaagagtttaaggccaaacgtaagaggtaggtataccattgtgtttttttgctcagaaattgttaactacttcctctattataaaacaaagatgacaaaattacatactccgccttgtataatagcaaatagacacttctttgtaaaatttttccaagagcttattagttcttgacaccgataaattgttttccatggttgcagtgttacaaggtacacagagattttgacttttcataattactactatagaaaagaagaatgttttgtggggcatgtagttataaggtttcagttctctgatagctttattaaaaagggttctttgagcttgggacaaatatgtcatttccttcccctcatctctcttctgtggtccagctgtctctaacaatgcttgactattctcaggtgtctccagtaatgcaaaaggcaagtatgagtagtgagggccaggtgtgctttttctatgaatttagcatttcctccaaacctgtcaccatttgaactctggcaaaataaaatccctcaaatggactcaagcccttttgagcttgtctttgactagaaagtgaaactgaacctatattatcatctttcttcactagtgggagcaagttcccactagcaagtgggagtgagttccactcagccaggcctcaggatctccttaaatgtattcctccagagaaaagatagttttcaggttcactcattggttcaggttggccactccttttctctttggaaggaacattgaagaatctgtagtaggggataattgcactgcaattttaattttgctacatactgaaaaaacgtaggcacggctacttacgtaaaccatttccgctttccttgaaacaaatctttctgcctaatataataaacacttaattgactaaagcagaacagcagtgtattttactttgtaaaaaatggagtaataatttttcagtgacatttggaggtacggataatcatataaatttaaaaacctgtctttacaaaaatactgcttgtgcatgtaatagaacacttcttttgtatgggtttttggtggtttttttgtttttttctttttttttttaagcttagaatgtcaaagaagagcccaataaattgaaactcatttgaggtcagttacaatatttgattgtttttattttttgattcttaacccagatccctcctttgaaaagcacagatagaatcattaagttccaggaaacctttcatggtgctcttagtttctacattgtatgattgctttggacatttgatagtttttatttgcatactattttttaatgagatttttcaatagtatttctcaaattttagccattcagctgaagtaaatcttatgtgactgcctctattcaaattgccactatataaaagaaactgaggtaccagagggtaacattttcaccaaaaaaaaaagaaaaaaaaatgttttgttttctttcagtgagttacaccaatcatcccaggaaaaagaattataattgaaaggaatgacactattgtaagaaagaatttaccacattattttctatgtggttttaattcatactttactgagcaattagaaaaggctgattctagataccctaatcaaaccaacgaatagacatcatctgtacactcactcacactagagtgtgaaatcacgctattcatttaaagcccaagaatttaagcaagtattaatttagcaatacctgagacgtttttcaagaagtataatggtagctgtctttacttgtatttctggagcaaaaaggtataactgccttatacctttttgtttgttcttaatgcttagtcaacattataaacatttaggcccatttaacaagtttattcgctgaaattactgcctttgaataacattaatacaaatgtagactactttgagcataggagaccttagatatgagatcaaagtggaaaaaaagctcctgtggtccctagataagcatttacttctgagtttttcttcacttttaaatgcagaataaaaattttataaaagataattttagaaatgtatcaattaaatttggctctcactgtacttcaactccagatttgattttagtatacaatcattggtttgaccgttgtctataacagggtcatacagttggtattcgataaatatatcacagagtccttttaagaatctcccaactcagattatcctagtgcatatagaatgttcaaaaactgattgattgattgataggttctgtaggaattccagtttttgaacattctatatgcactaggataatctgagttgggagattcaatcaatcaatcagtttgagtctggaacagtaccagaatgaatgagaagtactattatgttctttttgataagtggggaaaaatttaaaagcacaaatacgcatttcttatgaattatcacaacgaatgtcagtaatagtttatgaatataaataatgactcagtgaatttactcactaaaagatactaaaggaatatatttagtagttcacaatatctataatagttagcagtccaagtagatgtttgagtgacattcagtctcttaagaaatatttacatcacagatctcaaaatgaaggcaagtcaggcagctctcaagacagaattgcagctatgtgagaaggggaaagaaataaatagttaaaattttaactatacatattctgttttcagcctgtgaatgtagtagtttctaaaagcaatgaagatttccctgaatatcacttttgtgcctcaagctagttcttattcctctgttaatgtcattggttgctcacccctccagaggtattttcatataagagtcagagtttcaggaaaaaggtcttatttgtttaaaccaaatctgtttttctccaagtgacatatagtttttaagaatatgcacacaatccctcatcaatctctgaaccaccaaaaaaaaaaaaaaaaggagtgctgattatacgtgggaaagattattttcttttgtatttaatacagtgaatgtgtagtcagcattaccattgaactaaacatctgaaatttgatacagtgaaacaaattagtcatctgttaatggttactatccactagatacatctgaggttgtagaatatcaggcttatagacatttgagtacacattgtcagcacagaacataaaagtctcacataaggtataattgaaagttatttcaaacagttatctcatcaataaactttctgtagtaacatcatgttcatggaacattatgtttttagcaacaaacagtgatggtatgcagacagaagcatgtcattttaaacatgatacattaaataaagcatgttgaggtcaaagcctttctgtagaaagggaatttaattgacattcaagcatagtatataaacagatcaaaatagttctattataagaaatagtatttaacaacttatctctaaaataaaaatactttaaaaatcagcttcaatgagattacatttattgttaaagaatcttcctttagagtgaaatatacatttcttttagcttttctatagtttttccagtataacccccacttttaccccatccaagtttattattaataaagtagtgcaaagcattgtctgctgcaatttcaactgagtgtagtcccctaccaagtcagggaagtaagacattctcaaccaaccaaattattttttctccagagttatgctcccttagtataccagggagtgagatataaaaactactttaagagtcttgggaatgcaatttttaagtatagattctatgataatagtgaaacattgataaaggcaaccaccacccccaagcagtttattttattttacaaaacaggttttcatgcataatcaagaatgattttttttaataaatgaatgtagtgaaacactggcatatcacttagcacactgaattctctacattaaaattcacactaataacaaaatcatagtatgaattaaagcatttcagtaatctaatgagaaagcaggttttttttttctctgagagcacttgagtatttattaaaatatttttagatgcacagatacaatctgacaccaaaagcgatatggatatagtttcctagtatttttgataactgtacttactgggttgctaatttgctaactaactgtataaattaaagtagtggtaggtataaaaattcagataggcaatcgtttataaactggcagtatttatgttatgtagtcctgtagagattttaaggttttagatggaatgattgattgaaattctataaagaaaactttgtaaccttctgagtattgattctcttgagggagtgaatgtaccttcacttattagcttaaaattagcctaagtcatacctaagtaatttgcacaggagtgaatgtcgggatctaaagccagaatatatgttaaattgaaatgtatccattccattattcaggctttggaatttccctcccttttgaaatgtataaaacatagaaaagtgtaatggattacttttcagataaaaaatagtcgcattaaaaaaaaactttaaaatcaaatcgacatttacaattgatgtagatttaatcagagcacaggtgagtatttaatccactagtaattagataagaatatatcttccagtgttatcattcttatatttgttctttcagtgtgttatattattatccacagctaacaaggttttgacacagcagtagcaaaacctttatcaagttgagtctgtacaatagaagtatatattcaaagacatatgcctttgtacactatttacagattctctcgatcatgataaaaaggcaaaataaataaaaagcagaaagaaaggaaatgctgctgaggctgagggctttttcttttatcttcccaaacagatgctggtctcctcagtgctgggagctggctagccaagattgtttttctttcttttatatgggctatgagaaggatctggtttcagttcttggtattgcacctgtttaaacagagttcagaggaagactggtcaggtggccactttctggcaaagaaaggaacagcaaaggaatgagagacggtgcttgggggaagaaagtgctcactctagaagctgtatgggatctgcagctgagatgcagaaagcaatagaatgacagagcaagaataagggaaatcctgttggaaagtacatggggccctgatgtgaactttagtaatggtattcactgtctataacacattacattaaaagtaaaaccatctacatcaattttttaaagggctcgataatggttttttacaatttatcgtgtgtttgcttaatacagtcttaatctccatccagcccactgtcatgtcatagcaaatgaaaaaggtatcactgtaacccagcttcaggatttaaaaaaaaaaaaacaaacttcttttattttgaaaacagctgatggttaatgggcattaacctcaaaggatttttgagatatgctccactcttcaaaaagcagtcagctttcctctcctcattgatctccaaaatatacttcttcaaaacttacttgtaactcttgcaaattctggaaagacttttttttcttaaatgtccactggcatattttgctttcatcatctaatattcctggtttcctcccctcaggtcatactccctgtcacaaactccagctgaactaacttggaggaggatcttccctgacagctctggtaggttctttatgcaactgctctttctcccattctctgtaagtgcttcttggataacaccccaggtgggctaaatttctgactggtaaaatctgctacacaggctttattaatttttactcagctcttctaaagcctttgaaattagaaggatataaaagctaaaaccccatgccacactacattaaaataatagcaataataataacgaaacctacataccacttgtacatctgaagggactctggaaaggaagtcaagtagttcattgttatcaattgcatatggactccgaagcttttttgtaaatttattgatgcctgaaacaaagttggagttaaacaaagcacatttctgacaaaagtgttgtagtaatttgaagatctaacttgtatgccttgactcaatgaaccaatacacccagttttttccccctcttcctctttttctccttcatttcttcctcctttccagctcaactgctttttttacttgtaccttagtagcttcttccaagcaggaaaggctttctatgtgggaaataaaggagctgccctgggggttaattagcaatatcttggttttttttccccctgtgttacagtctacttagaagccttgctttagtgtttcatttatgatgaaacttgctttcctactttttgggttaagattgttaaggcaagatgtctaacttatttggtttccccttttccaaaagatgcacctttttggaggtgggggtgtgtgctgctgttaatgccagctaaatgtttagaagacacatgatgtttatttttttcaaacctgaaatgaaaagatttgcccccaactttgtaaaaataaataaataaataaacacctttacatgaaatcaacaaactggtaaaaactgagccatacactggagcatcttggctcctcttcagggagttcatgcagaataaacttctggaatcttgattttggtccatctcctcatgtaagacctatgtcttaaatttctggctaatatttcagcaatcacctaccactaaaggaatactgttcttgttttattttgtttaatgaaacaagaggcccaaacacattctgcaaagttacttttaagacagctagtcagtgagggcactgcaggttacacagctagatgtctgccctgggctccagtttctgtaaacctgggagaacagggcattcaccaccacctattgcaacagagatgactccacaagccaaggcaggtctgaccctaggtagattagagttaataaactgccacgacatgacattctaccctaattttttctataaagcagcatctgttttaactatcaggaagaaatgaaagatgaacatacaataggaagcaagaacatagtggaaattattcttcccttatataatgaaagtgctgtctaaattgaatatctttgaattatagaaattaggaaaggaaaaaataattaccatttcccccacctctcacccagactgaaagggtaattatagtgataataaggggtaagagggcttcctcaatatatggcaagttgggccaaaaagaatagggacaaagtatcttaaaagcggagggcttggagtcatcagacttgaactcactttattccaacatatttcttcaaaagccttgaaaagaattttgctttcagtgtaagcacatgctttccgaagctaagactcattttggttctttgcatttgatttgttttagcagtcttaggtgtatgtgtaagcaggtgaggggtaagtagagaattcttcttctaccccgtctagtttatatattattaatgttatagtagatcctagagactgaaaattgttttccaaaccaagaattttgtcaggaaagaaagaaaaaaagaagaatgctgcaactgacagtctcctaaatggagcccaggtgcataagaatcgttggcatgcagcatagttgcattaaaaattaggaccgaaaaaaatcacctttgatgtaggtctttatagaaacattcttgtttagtacacataaaaggatccttttgttcctaaggaacctgcaagtaccaaggacccttttcccgaatgctaaaggtgacctcttaaacaggcagccatgtatagtaccatgtttacatatattccacaagataaaatacaacagcaaaaaaagcatattttcctaaatgcaccatatggattgaaatgcctctgtttgtatataaatggtgaaaataaatcagagggatatctagacaaagctacactttgatatatgaagaatctgcacaactaacatgtttatagtatgatgaagcctagtgtgccagataagaaaaatacattttgcaggtggacctaaatctttatactgttgtgatttttaaccaacctgtctcttttcatcatggagtagcttcatgaccataaatacagggaactgctgacagtgtaactcatctcttaaacatagtttgttcttagcagctaagacagtttgggggagtgggggaggctttacttaccccagacaaggacaatgtatctcagcggaatgcagtacaggatggctgtgaacacacagagggctacaatggccagccagcttaagaatgggacagtccagttgaaagtactgaatggaaaattaacacatcagcaatctgagtacttcatacttttttcaaatattaaaatacatatgattctaacttgggacctagttagtctgcatttctctctggaatagattccaattgtaataggttatcagaggacgcaggctagccataatctgctcagttccatgaacacagggcccaagtaaagagtcttgctgccacctcctccagattgttccaggtgacttcagagtctaaagccattgtgctacttgggtgactccccacatgaaagaagatctttatttttcttctttatttttctactgctaagactagtacccatccttgttttctctggcttttcagaggggaatgcccctggacccaccattcttccttctatcaactctcagtattccccatattgggaataaaatgttgccagcaactcttggtagatgtaactcttacatggttgtgttaaaaatcctctgaatgttagaattccttaaactactcacttgtcctacctcagctatgtttgaaatagaactggaaatcaggaaagaggaacaaaacagccttgcaaaaattcacctcttactgcccttcttcccagaagtacatagataattaataaaatcagcattgcttactattatctctcatgtactccttgtgaaggacagcattctggcaaaagtaattggtaacgtagaggactgggtcagagaaggctgcaagactcagtattgacaacaagacatgataacaaatggaaacgagaccaatgaacagaagtagaagttacaaaaaaaaaaagtactgaggagatgggaaggaatttactgagacaaaaagggaaaagaaaaatgaagacaaaggcaaaaaccatgatgtaaaaatgtttttaaaagtagaaaatcagggaactggaacatgggaagattataatcacttaaggctttttgtgtggaatccagtctggtacttcttaagagtgtgccaaaatcataaagaaaatagaaacactgtgtagagcctccagggttgggcatataaatatatcaccatttacaggcataccattgcattctttgaaatttctcctaagtgttcatccactaaagaggaactaacaaacatatcatgtcctctgaccctttagcatgagagccaagaagttagcagatttgtattcaaagcctagattctattatgtggatttagctgagtcaacctctctaaccttttccccatttataaaatggggatagcttttattctgtcaaggaagactggttgtgatggtaatatgtttatgtgaatcaagatgaaattattagaactaatcaactcaaggaatctcatttatggcacttttttcttatgagacagaaggcccctaagacacttcagcaaaacatattgttcatgtggataaatgtgttttttatttcttctaatttcctggtattgtatattgtacttacttgaggtgagtttttttttttcagggcaattttgacccaataaaggatgattgctaaagagattttcttctatacaatgcctcagcataatacttaggaattagttgttccttacctttgtggcatgtagcttgctttttgtctctctctaggtcaaaattgtttcctaaaatttttttctactaaaagagccaatgttgggtcaatctggttatcctattttcagtaatccctggtgtctggcttttctgtctttgtcttcttcctcttatggtcaagagtgagcatctgcaactcaccaggtaaaggatcatgccttcccttcctgatggatacctgtgcctcccttgcttctgcttgcttgtggagagaacagaaggctaaggggatctgcttgctttcctgtggctcagctcagagtcatccatcacacgactccacgtgtgagggcactggctcttcactcagaaaaccttccttctgggcagccccactgaagaactccctgtgttctccttactcctattggaaggataaatggcaaagaatccccaccagtgtagctgttagaaaaaataaaataaaataaaactgcccttttctatttctacactctgcattatggaatctaaatctagaatatgatcttcccccaaaaagggatgcaattcaagaaagttctggaatgattatttagtaacaagacatggtaagtatagagccctttcattttgtgcttaaagattgcttttgagtctgctttctgggtagatgcttttaattccatgtgacccccaggagaatttcttttttttagcatccaaaagatcattttgcgggagagatggctcctccaagactcactggcccctgtgccatattcctgtaccttagcataggaagttctacaaaacccaggtttccccaaggctgaaccactgccaagatctggtcatatccctcagctagtcatgttttccagccaagcatctgctctgaggccttctaccacctagagttacaaaggagtttcttcctctcaggcattcactgcctgatccatggtcttttggtataaatgagatgtttctgtcaggtatcagcacactgtgtaccccagataaaagaaagacagcactcaatggggaaatgccccaaattgagggcttcacactgtttcagtggatagcgtgtggaggacaggtaaacattcttagagatgagaggaagaaggagagagaaaagatacgggaatagtcttctgaaatccaagactgaatgtttcctaaaggcacatctcggagtgagatgggggctgttctgtctaatgtaagaaagtggaaactcagcacctagacatgtggaaatatacaaaataaaatgcattatcccttacaacatgaaaggcacgagatgaatgactcacacctttagtttaaataatttactcctttcaaattctatgtatgcccaaggattcaaatctgtagaaaacttctggctatgaataacaaacaatgaagagatacattatactaggaaaataaaggtttgtccagaatttggcaccccttcttgaatagaccattagcaatcattatgtaggccaatttttacataatttagaagtatgagggtcttatatcttttaactgataattgctgtaaatacaccttttaaaaaaaatataacattagtttagataaaacacatacgtatataagaatgtaagtttcttaattttgcattagagctcagtgaagctatatttattttattttaaaaagttaaggaaaagggattctgtttttataattttaaaaattgtgtgcattttctaaatgacagagcattagtttattgataattatggatctcagctatttaaatacaaacttgaaaaaaatatttttgcagggtaccataaatatgattaattttttaaaaaatttagtgtcacttgatgaaaatataactagaccaatagtaaaatacaggtgtatcttaattacctgaagtcctcatttagcttggtttatttttttcctatcacaatttcatattccatttaagaacaaagtctttcacagtgaaaaatgtgctaaaatttaggacggtgttatttcttcaaagctacaagtatgacttctttccaaccaatatgttctaaatttcaggaaggaaattgacagaactttcataaagccaaagactggcagaaataaagtaaataatgatgaaactgagcaatagagcacccagaaggagtgtcccctgccaaaaagaatgtggcatttcaccctccaagaaacaaatggacaccttatcccacagaagaatggggctcacaggtcaccgtcactcacttctttatcctttcgccaaaggaagccacttcatctaggatgttctggacactgacacatacctcctggatggcatagattttatttataaatccctttttttcactgtcctaaaatgcaataaaaaagaaattctgtatgagtaaaggtattcttcattgcttgaattctttgtgttgtccctctgttacatttttaaacttaaataaacttcattttcgtgtggttataaatggataattggaacccatgaaaatatcaggatttaaaggaagatgaggaggaaggggacccagcatcatggatttgtgcttgtaaagatggctgcaaagcaagagcctcgggttcctttgctcttgccctgatgagcagaagaaacattttggggaggaaggtataagagagaggggaggtcccagaattaccaaacccggattctacagtgcctctggatccactgatacactacttagtggacccagtttcttgaccgcactgcccataaacccaaattttgttgtggctccagatatttcagcagcagagaatgctggatgcacttgagatttgtgagcaatgaaaactacaaaaaaaaaaaaaaaaaaaaaaaaaacaccaccaccaaaacctggaatccactatgtggatactgcttagatcatatacaaactaagcctgaccaccttcttaaaaataatagtctagtcatatattttatacggtagtatatgctgtattaggttctaactaaacattttttccccttttggtgcttagttcattttaaaacatactgaatttaagcaaagctggtgtgctccaggtaatggatgggtagagattgagcattaaagcacctagagagtggtgtgaccctaggagaaatgtgcatattttgcaattttagacccaaaggaagaaacagtggtggcctttcacaattgaaaattctgcttagtagcctggcatcacaggcacttgcctaggctgtttagtggagaccatccaaccctgattctatgactccattcctccatgccagcttgaatatctatggaaatgtagatccaatttcattactttaacttcttttgaacacttgcacactatgccagaacacttgagacctcatgtggcagtcagtgcttgctgaaagcagccaggaagctagaataataatgtcatgttgcacatttacatactgactttcatttcagaagagtctaaagcactctacagtgtgaacacttggccagggctggcctcccgccacctcagaaactgcgggcaagtgaatgacagatgtgtgtgcctcctccaaggacaacagggtacactgggaccaaggacatggaggccagttttataacgatctttgttatagataccagttacttagagccttaattttaaatttaattcacatgggagaaatttgtctattattcatcttgcttatgccaaaatggattgtcaattagacgagacgcataaagcttaataacagtattgggaacagctagttagctacttagggttccctactgtcttcagaagtcaccattcacttgtcatgacagacgttggtgcatcaatttatctttcacactctccagtaaaaaaaaaaaaaaagttagtttcacctatacaattgtgcacgttagagtaaaatgaataactagtggctttttcctgttcctttcaaaactgcaaagttcgtctgccccaactgtgtgtcccttagtattctcatctcaagcaccagctaagttcatttatgtctatgaagcaaagtactcataaatatttaaccacatacagaataagtcaaacgagttgaagcatgctggttgtacaatgaaagtccattgagaatgtctttcagctcaaaattatgtgaaaaactatttcacagtaacaaaatatatgaaatacctaggtaaaacctcagcaggaaatttacgaaatatataaaaagtttttttttttttagttgaatatataggcttaatgaaatttcaagcaaatcctaatgtttagagtggagaaaacggggagaacttaataatgtttctaaagtttgttggacaaataggtaactatagctaagaaattttacaaaagagaaatcatgagaaggcattcagtgtacccagtatttaattaaaatgagatatgggcatcaaaagattggtatatgataaggtgccatgcacaaaggaaataaggaagtgttgttattgggtagttgcgttaactatttggggaaagttatgttaaatcctacctaaaatagacattcacatctgagatagatagccaaaatctatcttaatatgtgcctcaaatagccccaaatacattccatattaatgttaagaagttaaaaacaatatctaccataatcaagttggcttcatccctgggattcaaggctgattcaacatacacaaatgaataaagtaattcatcacataaacagaactaaagacaaaaatcacgattatttcaatagacgcgaaaaaggccttcgataaaattcaacatcccttcaagttaaaaactcaataaactaggtattgatggaacatacctcaaaataaaaagggccatttatgacaaacccacagccaatatcatactgaatgggcaaaagctggtagcattccccttgaaatctggcacaagacaaggatgccctctctcatcactcctattcaacatagtattggaagttctggtcagggcaatcaggcaagagagagaaataaagggtattcacataggaacataggaagtcaaactgtttctgtttgcagatgacatgatcctatatctagaaaaccctattgtctcaatcctaaagcttaagctgataagcaacttcagcaaagtctcaggatataaaaatcaatgtgcaaaaatttctagcattcctatacaccaaccatagacaagcagagagccaaatcatgaatgaactctcattcacaattgctacaaagagaataaaatacctaggaatacaggtaacaagggaagggaaggacctcttcaaggagaactacaaaccactgctcaaggaaatcagcgaggacacaaatgggaaaatattccatgctcatggataggaacaatcattattgtgaaaatggccatactacccaaagtaatttaaagattcaatgctattcccaaactaccactgaccttcttcacaaaattagaaaaaacttccttaaaattcatatggaaccaaaaaagagcccgtatagctaagacaatcctaagcaaaaagaacaaagctggaggcatcatgctacctgacttcaaactatattacaaggctacagtagccaaaatggcatggtactggtacaaaaacacacatacaccaacggaatagaaaagagatctcagaaataagaccgcacatctacaaccatctgatctttgacaaacttgacaaaaacaagcaatgaggaaaggattccctatataaaaacagtgctgggaaaactggctagccatatgcagaaaattgaaactggacccctttcttataaaaaattaactcaagatggactaaagacttagatgtaaaacacaaaactataaaaaccctagaagaaaatctagacaataccattcaggacatactcacaggcaaagatttcatgacaaaaacttctaaagcgaacattttgatttggttgcaatgcaaccaaagcaaaaattaacagatgggatctaattaaactaaagagcttctgcacagcaaaagaaatcagagtgaacagacaacccacagaatggcagaaaattttttcaatcactctgacaaaggtctaatatccagaatctacaagaacttaaatttacaagaaaaaaatcattaaaaagtaggcaaaagacatgaacagacacttcataaaagaagacattattattattttttttgacatgaagtttcgctcttattgcccaggctgcagcgcgatggtgcagtcttggctcactgcaacctccgcctcccaggttcaagcaattctcctgcctcagcctcccaagtagctggtattacaggcatgtgccaccacacctggctaattttttgtatttttagtagagatggggttttaccatgttggccaggctggtctcgaactcctgaccccaggtgatccacccaccttggcctcccaaagtgctgggattataggcgtgagccactgtgcacagcccaaaagacatttatacagccaacaaacttatgaaaaaaagctctacatcagtgatcattagagaaataaaaatccaaaccacaatgagatactatttcatgccagtcagaatggctattattaaaaagtcaagaaacaacagatgctggcaaggctatggagaaataggaacacttttacactgttggtgggactgtaaactagttcaaccattgtggaagacagtgtggtgattcctcaaagacccagaaccagaaataccatttgacccagcattcccattactgggtatatacccaaaggaatataaattattatattataaagatacatgcacatgtatgttaattgcagactattcacaaaagcaaagacatggaatcaacccaaatgaccaacaatgcataagtgatagactggatgaagaaaatgtggtacatatataccatggaatactatgcagacataaaaaaggaactagatcatgtcctttgcaggtacatggatggagctggaagccattatcctcagcaaactaatgcaggaacagaaaaccaaacaccacatgttctcacatgtaagtgggagctaaacaatgagaacatatagacaaagggaggggaacaaacactgggatctgcaggtggtgtgcggggagcaatgtggggagggagggcatcaggataaatagctaatgcatacagggcttaatacctaggtgatgggttgataggtgcagcaaaccaccatggcacatgtttacctatgtaacaaacctgcatgtcctgcgcatgtgtcccagaacttaaaatataattaaaatttttggctgggcccagtggctcatgcctgtaatcccagcactttgggaggccgagacaggcagatcacctggggtcaggtgttcgagaccagcctcaacgtggagaaaccccgtctctactacaaatacaaaattagccgggcgtggtggtgcatgcctgtaatcccagctactcaggaggctgaggcaggagaatcgcttgaacctgggaggcagaggttgcggtgagctgagatcgcgccattgcactccagcctgggcaacaagagcgaaactcctctcaaaaaaaataaataaataaaaataaaataaaaattttaaaaaagttaaaagcaaaaatgaattataaaaagacaatacagggaagttatttactgaccttggaataggaaagaactttctaaacatacaaaaaataaaataaattacaaaggaaaataatttatagcaatggttacataaaatttaaaacatgtcaaaagtcataaatttaaaaggctaagtgggaaaaaaaatcaacaaatgctacaaatgatgggatgatatttctaaaatagtaaacatctgaaaatgttttaattgcatttttgtttataacaaaaagactaatagtatgttggatgagattatagtacatacaattgatagattatgaaatcagaaaatatttagaaagaatatataatgacatcaaaaacgcttatgatctaatatatatagtgtaatcctaatttaggtttaaaatgcctatgttggggaaaaaaaggatgaaggagatgcatgaaaatattccagtaatggaagtttatcttcttcataccttcctgtaatattcaaattgtttgcaattcatattttacttttgtaataagaatatttccccaattttctttaatgttactaaaggaagatggttagaagaaataaatgaactggtacttggcttgtctatttttaatatttttataagctatcttaaattatttttggaaagaaatggaatataaacagacactcattaagtagtgtaaagtacttttctcataattcatccaatactcacaaccatcctacaatgtagttatttttctccactctacagaagaggaaactgaggctcaggaaaaagtgacagaacttgggttgggacaatgcctggctaactccagagcctatactctataataaccatatgaccttcctattcaatccaggaaggtttcagttcctacaaagaattcctttgagataaagaaaaatgatttcaaaatgtttcgaaaatgcagacaccataatctagccttgagaatcaccatagagctaaaatcttgagcaagagaatgaaatccagaaacttgatttgaaggtagaaagtgaaagatgtgttagaaaccaccacatttaatgtcaataaggtaagcaaatattaaatgcaggtaagcaaatattaaatgcaggaccttcattaataagatgtgtcacttgaggcatctgtgaagaaaatttttaatagccactttaaaatccaagtgctgatgtatgattattggctaaggatttttaaatattcgctcattcttcatttgctttgttactactgcactcccacccagtccaccgccactcccttaccctcaactgccaaaagacaaaataatatggtttgtaatgttggtgcagttttgaaaagcaaatgctttgggataaaattttccttttaaaatctgtcatcaaattctatattctttcattgtggtctccaatcaatgaagtaattactctttctataaagtatatgacccaaaactgcaatggataatggaattgctgtgttgcattccaatatttcatacttttttcaataatgttcaatactttattgtagagaataaattggtacattcctttattgttgtttttgctttactttataaagcagcttggatgaaagaaatatcatagagtagttaatcacccagtcttggtagtgacactgttttgtttttttttttttaatgcattattaaggtttcttttgaaggtgaaaaaaaaaaaatatccacaacaacagctataaccatgaatctgagaatatgtgagatttatattgcacaactatttctaatgattctatacaatatttctaaaagctctcttactaggttttaaatagtccctaaaacatcactaactgtaaaagttgaagtacagtgattctttaatatatgcctactttactatgacatattgcaacagaaagttaactagattcttccaaagaagtacctaccacctagttttgagatatttaagaaaatctaaagacctaaataatcaataggcataccttacatattcgaagaatcctgttcatcgactttcaagccaaaatgacagattctccccttcactgagtctgttctaaatgggaacatgaagccaaagtgatagacatcggggtgaatattctgggactggtttttcctgccgagctgtgtcctagcttagtcattaatacatttaggaaccctgccatagtggtcattgtcaaccatgttgagaagttatctgttgaacacctgtgctgtattaatcagaattagcaggtatgtagaatatatttgctacaaatattactattataaaatcaatgttatttcacttcctaaggtgagagagtcttcagagaaagggagagctgttaaatcttatgctacgataatgaacataaaatggaactatatataccaaggcatatggtcaccttattatttcctggaggaagtatttggatttgagataccttctatcccaaagagctaattaatctttatcataattttgcttctcctttaaagtcttgcttacataacctttggcaaaaggtgaatggtaaggttcatattttctatgagacataattatttattatagtttaccattgattggagctcttctttggacaagtatagactcacatagcacaacgtctaaaattatgtttggaatatgtttatgtttcccgtgatggatgctaaagatggttttggtgcactactttctctagttcacttagtcaggtgccatgcaaaatagacttcctctcagatctataattccaacctaaggaaaatacattagatgagaagtatggagtggataaaggcacaaaaagaagtgatcaaatgttttctctgtgccaatctttcttctttttcagatataaaaaaaacatgtttcaacctgaaatctagaatactgaaattctcagcagtttggcaattcagagtcccttggctactgaatcttatctaagtgtcttactcagttcttactgtatcaaatcttgtgcagtttacttggtgccttgcctctcttcctgatattagccttgaaaaatagaaacactctattgagacactgaagttatttaaggttaacaggatatttaaggttaacaggataaatggacaccttttaacaagatagtatatttttctcttaaaacagttctcaaacattttggcttatgttaaaaacaaaattttgagatattagagggaattctcaactatatgaaacattttatgcatgtttagttttgtaccaggtgactcagtgttaacttgtcagagtctattttagaaaatgatggtaaattctttataatgttacactgagattttttttcccttctgctgacttggcagagttttttttttgttttgtttttgcttttttgcagaatgagtctttacctggttttaatatttgcttcctcttttgcaaggcagccttatgcttttcagagctcatttctactacataatttatgatagcatttagttgtgctttaccttgttggcttaatcttatacatgtaatttgcatgcaactttaaaggtgattgtaatgtaaaaagaatttggagagaaatataccctgggctagacaatgcaaacaacaggcatttttaagtggcagctggcactctaaatgttaaaataaaagccaggaaggaaagaatggaaaaaaaagaaaaagtgaggaaagagaaagaaggaagaaaagagagagagaggaagacacaaaggagaagagggagaggaaaacacggaaagagatactctaacggatggaagaagatgagaagactgagaagttgactgactatgagaaagggaaggaaaatgtctctggtcagaaacacaaatgacataaagtcaagacagaaacaaaacttgctaaccatattaacttctaattcaacaaaaattatttgtaaaaggctgtacataaaatattttttaataaatgtaaataaaccttacagcaagcatccagcaatacagatggacttgttgtcaggagggagagttccctggagccaaagactgaagaaccccccaacttttgctttgagatgaggtctcgctttgttgcccaggctggagtgcagtggctccatcacagctcattacagcttcaacctcctaggctcaagcaatcctcccacttcagcctcttgagtagcggggaccacaggtgtgcaccaccacgtctggctaatttttttttttttttttttggtagagacagggtcttgctgtgttgcccaggctagtctcaaattcttgggttcaagcaatcctcccaccttggtctcccaaagtgctaggattacaggaccaccacacccagccaagaaaaccctttttaactgtcctgcaaatatagtcagccctccacacaatgggtttgcatccatcgatttgaccaatgggttacatcagagacttgagcattcacagattttggatatgattttggtatccatgggaggttctggaatagatctctcaaagttacccagggacctgtatttgaaagatcttaaaagaaccttatcaatatcaatatcaaaacctttgacttaattgcccagccagcagccaggaaaaaggggccttatagattatcccatctcaggcttttgtcccagaagttctgctttcagatggactccaagtgaaagggccaaagaggactagttctaggctaactctgatagaagccacaacagaagctgtgaggctgaggctcccaagtatccagagatttaaaaaaaaaagtaacaaaggctactttcaaccacgataacacaagttttgagataagaatttgtatgcctcacagggttttctgtaaaatcaaaatgaacagattgtggaaaggttttgaaatgtgaaagcacgtgaacctgtgaattaggttgaaaataaagcacaagaaaatgtggaagcacactcaggattacaggtcactgcctgtccttagacctcatttgaaaagaaaagaaaaaaaaggtgaaataagatgtttactaaaatccctcctggttaggtttactcattttacagataagataaaaaggactgtgaatagtctctgcccttcagagtccattgaaagcttatttgagaatagttggtgggtggaatttctcctgctctttctacaagctcagtagttaaagcttgagtgagaataccaaagcttgagtgagctcagaaacactgagcttgtttctgattccagatagcaaatgctgggctaggttttttgtgtgtgtttcttaaatctcaacttctaatgaaaaagttgtaggatgtacgtttgtttttaaaaaaacttcttttgaaattgtttacttcattttcaaatatgtgtttgaacatggttgaaagttcaaatgcagagctgagaaggcagttgagagtttagagaaggaggtgggtactagatgaccatatttagaagatgagtagatttcttagtaactggctctcttgctaagtatggttcaaatgctgcttccatcattttcttagctaggtgattttgagcaatttattaacttcttcatctgtaaaatgaggataataattcaacctacctttgcaatggttataaaattaaattagtttaatccattgaagccataaaatccataaatatctggaacataggaagtgcttggtaaatattagtcgttaatattattaacaacttgaagagactgaaaaaggaaatcctacaacacttttaaaagttaaattgtattaaatcttaataaagacaacagaattttctcctttatatctcaggaatattatttcatgcttgtaaaacttctttgtcatatgtatcatcatatatgatccttacaactattcacacgagggtgatggatattattctcattcccagcttgaagaaactaaagatcagttgcctaaagatccccctcaaacttctgcctcaatttgtgctcactctccttgggtgcctccagttgtgtttgttctcatctgagatatgggacttgaaaaatggcacctgagcagaatgttcatttgtttacaatattccccacccactggaagttgtatgtcctctgaaggccactggttatactcataagatgcatgccttttatcatgtgattttatctgttaatgcttattcagttaaaactatcagaatcagctgttcttcagtaagcctcatggctgaatcagcgccagagttatttaatcttaaatagcacaagttctgttgctaatatacttactagtgcagtttttaaccaaagaaagattccgattcttttattatgattatgtcttttgtataagttacaaaaagtcatatacacaaggtatggggcccgcaaagttttttttttcttaaatagatttgttatgaaaataatcacatcttttataggactttatggcttataaagcatttttaatttatctttccacttgaggtggcagggtcatatggttcctccattttacagatcaggaaagtgaggcttggagaagctaagttttcattactagttaaaaagagttcctgggactataacccatgtctcatggttgaaattgggctcctttcaggtcactgtcaaaaagttgtcgagtcccatatggtattttttcggtacattgttttagatatttaaacttgggtcttccccaaaactaaccttgagttataatcaaatcgtgtgagaaaagaatcatattagtattagaaaaacaatgctctttgtgacatctccacaaccaagtaaggactgctttgtgaagtccagaggctatttttctttacaaatattttacaagacaaacttatacctttctaaaaaggcacatctgttgtaaattactcccttacagaaagagagaatcaccatcccttctccccatctgagcttaaaagagatttgttgatatattctaaggctagcatagacaaaacagcacaggaaagaggaggtggtcagcaggaccagggttcagctttgcttaaagtaattccacatgccccatgaccattagctgttttttatttcctgctctgaagatccatagtgaaaataatctgggatagggaaaagctgcacttattattttttttccccaacaagatgctgtgttagcaaatagaagatatgagccaccttcagcaaaccaaggtctttaataacccatttttcaaacactactggtatttcctttccaaacaaagatggactgtgactggaatcaatttcatcatttgtatggttacaattgccaagtttctggaaataatcgccatttaaatactggataatatttttacatgaagccaacaacagttttattgctatttaatttccatgatttgtttgtttgctgtaagtcttcagtgtctgcgagcatgacgtttggggatagggaacagtcttaagaacaaatcaggataaaagcaatgtcaaagtcatgttaaaggcatgacttgaatccaccaaatgagaaattagcattaggaaaaaatgatttgctccaccactttgggcttttatttctcaatttccttataagctgcaaaacagtaacatcatccaccactttcagaccttggcataatgcaggaaacccagaacaggactgagaattcaattgtcctccttaagataatagagttcttcaatgaaattcaacaaaacatagcagatgtcagtataaataaagggcctggcaaatttgaggggaactaggccatctttctctattgatgccatatgtagcacatacctgaataacaacttagtgttctatgggatgctgctgatatatggggtaggcctgtcccctaaaccccttccttactgcagagtaaatcactagaacaggctcattctgaggtcaacctggaagaaaattccaaaggcctactttattcagcttatgataacgttggttacttagtggtgtggatcatgatgcctttcaatttatttgagggagaaagggcaagaaaaagatgagaatcaatttcaaaaatggctcaaattcttaaactagggatggctattggtttaacaggataaaacagtcttaagagcaaatcaggataaaagcaatgtcgaagtcatgttaaaggcctgacttgaatccaccaaacgagaaattagcattaataaaacaagttctttagaaatggtagtttatgtatctgcgtcttaaaattctgcatttacaataaaagtgggatgggcatggattgaggctatgatgtactttcctgggcctgtcctaatcaagccgagggatgttgtaggcttaaatcctgttgtgcattttacgagtcatgtgacctctcagatacttggttttctcttcagtaagacagagatcatatctacccaataggagttgatgtgggaacagaatgaaatcatgtgtgtaaagcaactggcatgctaatagatactatataaatactagttttcttctcacccactgtctttcttcccaaacggtaatattttcattttttctgcctgatttctctctcattttctttcccccgcactggctagagtttgtatttaggggcctgcttatcattcacttcattcatgtcatctcttcatttgagtagtattttgtttagccaaatctcaattcatttcttttattcatttactcaataaatatttattgaacaccaactacatatcagacactattctaggctctgaggatactggactctggggatacaatgataagcaagatagcaccaagcaaatacatggataaacaaacaaaaacagcagatagtaaaaagcgcaatgaagagacctgaaatgggtacatgggctggacagtgacccagtggtcagtgagggctgctctaatgataaaactctgtagttgagaacagttttggtcaggaaaacagaaactactctaagtatttcaaacaaagggaattgaacacaaggaagtagctacacaggtgatggaagaattgagcatcaaatagagtgtggcagacatgagcaacgcagaaagccactagcagagggacgttactgaagcccagatgatggtcacatggaccaactctgtggcaggagtggcaccatggagcgggtgcttggcagtacaatatttgggattatggagggatctgtctggtggagaactgaaccacagaggagacccagtcacctagtcactgctggataatgtccgtgaaaccagagagacatatcaagggggttgagggagaatgagagaagagaattgtcctgttttcttccttcttcccttttcccagtctccttccagtatctcccattggccaaatccccaaaagaatgtgatttgcaagagaagagtaagtgaggatcacctggaagtatacaagcaagaaccagcacaagataacaatgatgggaaggaattaaccaggagaagtgcacgtagtacaaatgtgctaaggcaaaatacaaactcaacttgcttgaggaaacaaaggatgcctgaacatggtagccagtgaagagggagcacaggatgacagagaaatagtgccacagagggaggcttgtaaccagaatgaggagtagagattttattccaaagcatgatgggaagccattggaatgttttaaacagaggaagaacattacattttgtttacttgttttgttactagctcttacacagaataatttacatttttaaaataccacttaggtagaaatatactgtgtggggaaaacaagatagttaggaggctactacagtagcccacaaaaagatgatagcttagaccagggtggatatattcgggatgttttgaaagtaaagtcaccatagacatattactagattgaatgtggaaaccaagaaaaacagaaatcagagaattgcttacatgtttggcttgagcaactgggtaaatgagacttagttttttgagacagggtctcactctgtcacccaggctgcagtacagtgatgcaaacatggcccactgcagccttaacttctgggctcaagcaatcctcccacctcagcctcctgaatagctgggaccactggcacatgatactacactcagctaattttttgttttttgtagacatggggtcttgccatgttgcccaggctggtctcgaactcaagcaatcctcctgccttggcctcccaaggtgctgagattacaggcatgagccatcacacctggccgaggctgattttactgccctagggaagagtggagcaggagcaagcttgggaaaagggcagatgaagagttgtgtttgggctgtgaaaaagtatgaggtgcccagtggatcttttacctcagtcttgtttgtgccaaagattcctgcatcaagtaaggaggaggacatgttctcaatggaaaccagcaagaaacagtaacacagagacaggttttaaagccatgccttatagaaagaggagctcattggacatctcatgaaagtacccctggcggttatctgtaacttgccctttactcattctttgaggcctcttcttccttggtaacaccctattcccagatgtttcagaaggaaatctgaagtagatacttgtcaccatttgggaacctctataataaaataaaatcataaatactctgagttctggatcatagttgttagcatctccagccaaagaaacaaacacactccacacacacacactccacacacacacactccacacacacacacacattgcagaacaccaatataaaatcaagtacctctgttaaaatgtaagaagaccttcactaggaaggaattgggaaatactgccactgcaagggagggtgatcttactttcacttcttttctttgaatatacattccaggaagacaaagaacaaattttttttggtatagtttcttgtagagcttaataaatctctacatacgtgggggaatttaagattgttttgagtttaatttaggattgttttgggtctaatagggggaatttaggattgttttgataatgtggcccaagacaattcttcttccattgtggcccagggaagtcaaaagattggacaccccgattctaaaggtttgtgtatttcttcttagaattcttatttgcttaacaaatttaaacaattagtcctgaattttttaagtgtttagactactgcctagtatgtagtaagttctcaaaaatgttacttattaacattttattactattatttgttactgtaattatctgagtgctgatagattacaataaatattgacttttcctacctgattcttgatgtttctgtaatgtcagatatacacaaacgtttaaatgcctctgtttatgaatgctccctgattgtaagcaggaaagttacaacaatctgctcttcctcaaacatactgtgcagagttgatagaaattattttgaaccttctggtttgtgtgactttttggcacatctaccagtattatgaattagatgatttatctgagccaaactgctgctatgtagaaatacaaatagaaataccattctgcagacagacagatagctggggaaaacaatgttataaattaacattaaaaatttattattcactttattaatctaaatatcaaaactaatttttacattcttgtttttctatttctgagaataatttagatactttagtaaatgggcatttatttattcttttaccttaggagagataatgggcaatattcaattaaaaatgtaaaatcagtgataccaggtagcattactcctgtaaggtcattttatagaaagctacctagtggcaaatgtcctgtgagtttcatcacttaggggaaaagttagtttttagcaattacatttaaacatggttttaagaaatattaaaagacagtattgctacattccacaaaggattcattgacaggcagtgttaacagtgcagattgctatgattttattctgctaggatacagtgtgcatccatctaaagcaagctcgtccaatccatggcctgcatgcagccaaggatgtctttgaatgtgactcaacacaacttcgtaaacttttcttaaaacattatgagacttcgtgatttttttttttcttagctcattagctgttgttagtgttattgtattttatgtgtggcccaagacaatttttcttccagtgtggcccagggaagccaaaagattggaaacccctgattctaaaggtttgtgtatttcttcttagcactttatttgcttaaaaaatttaagaaactttttagctgcttaaaaaattagtcaaatcatcctggtgctatagactgaatgtttttggtcctgccccatccccaccaaattcatatgttgaaaactaatctccaatcttatgatatttggaggtggggcctttgggaggtgattacatcatgagggtggaactcttatgagtgggattagtgaccttataaaacaaaccctagagagttcttctgctccattctgccatgtgaggacacagctgaaagacagctgtctatagaaccaggaaacaggctctcaccacacactggatctgccagagtctcgatcttggactttctagcctccagaactgtgagatacaagtttctgttgtttataagccactcagtctatgacattctgttacaacagcctgaacagactaagacacttaaaaaattattcaaatcattcaggtatggtttataaaattatttttatatattaaaattttatgcctatagtgtttaaatttaaagttgaagtctgcataattatttagagtaattttatctattccaaatatggcaaattttatcattctcatctactttattatttaagctagttgtgttagagagtgttaaaaattatttggaacacatgttggaaaatcattttcaaagttactatttcaaaaaaattttaatgcaactgaagtcagagaacagggagagcaaagaattttccattagatgtcctgctttatcttacttgcaggaattatatgagggatgaggtatttctcagggctagaaggtggacatcaaaaggtttgtggctttaggcaaatatccaaaacccatactaatgtaataagttatccagtgtcctcaagcacagcaatacgatcaatacaggatttccatcatctttccttagaacaaaattctagaggtcataaagtgggtctgtgtgtattttgtatcagcacagcataggtgctaatcgctggggtgttaggatggtcacaagtaatattcccttctcaaatcagtaaaatgggataatccatatcttaaaggaacattagtaggattaaggaaaatatctgattagaaaagaagcccccttccctatttcctggatatgtctgtagtcaccaacttggaaaaaacaaaaatcacatctaatgttacagaaaatacctcagtatggccgggcaccagtggctcatgcctgtaatcccaacactttgggaggacaaggcaggcagatcacaaggtcaggagttcgagaccagcctggccaatatggtgaaaccccgtctctactaaaaatacaaaaattagccgggcgtggtggcgggcacctgtagtcccagctacccgggaggctgaggcaggagaattgcttgaacccgggaggcagaggttgcagtgagcccagatcgtgccactgtactccagcctaggcaacatagcaagactctgtctgaaaaaaaaaaaaagaaaagaaaagaaaaaggaaaatacctcaatgcttatacaactctgttcaatcaaataaccccaattctagttctgtgatctctcaaacgtgtagagtgatattgtaattaacattgaaattatcccttcatgtacctccaatgcgcactaaatgtaccagctgccacttacataccaccaccaccatcctttccagaatttctgtaagcactgctgatcaaacgcaaacactcactggtactaattaaaatagctgttcattcctctgtagacagacatggcatgaaaatcattaatattttttaggatgcagtcttataacatgtattgtacttctttccaatctattgtggaaaacttggaaaataaacacaaacatagagtaaaaaaaactctggtaaacattattaacattttagggtatatctttctagtatcttttccacttattaatctttgtgttactgttaatcatgtggttactatgtgtcaaacactgtgtcagatgatgggattcaatgaagaagtcaggcctgatctggaatctgttatattgaacatatacatttgttgggcctaaagtaatcctcccacttcagcctcccaagtagctgggactataggctgtgccactacacctggcgaatttttgtacattttggagagataggatctcactattttgtccaggtaggtcttagactcccggcctaaagcaatcctcccacctcggcctcccaaagtgctgggattacagatgtgagtgaggcatcatgcctagtctctttctttcatttttaaggcacaaatagtagcatatgataaatatttccatgcttttttttcttatttaaccatgtttcttagagattgttccatatcagtgttgaaaagcttcctcattcttccagcttcatcatgacctatggtattgatgtaccattatttatttaatccgttttcccttaatagatgtttaggttctttatcagttttttgctaccacaaaaaaagtagtagcaaagaacaccttgtctatgtgataattgacctgtgtgagtgtatctgtagtataaacttctactacaagaagtggaattgtttggccaaaggatttgtgtttttgtaattttggtacttactgccaaatcgccttccaaaagagattgtacagtttccactcccaccaggaggacacggagttacccatttccttgccaggccgtgtcacagacatgccttctcttttccatgtattttcaagactacttggagacccagactagttgctgtgggggctccatagtgtcactttttacacttttaaccacattatttgtctacatttttggtttttgtttttgagacagggtctcaaaatagtttcaacctcctggctcaagcaatcctcccatctcagcctctcaagtagctgagactacaggcgtacaccgccatgcctggttaattttttttttaaatagagacagggtctttccatgatgcccaggctggtcttgaacttccaggctcaagagatctccttatctcagcctcctaaagcgctgggattataggcatgagccactgtgttgggcctacattatgtttcagattaagtgatattcattttgatttacaggatagagtacataatatacataagagaacagtttcactctatataaatagccaaaccagttgagtattttccagtaataggaaggtcatgaataacttctaaactactgatagactaagtataatttttcttaagtgccaatttccaccaaaattgctacactaaaagagactttaaaatatatctgtgcattatatctaaggtatctaactcgacagtatgttcaaataaatgtgtctattttattcctttggatgggttatcaagcagggaagtcaacacagtagtagagaaaggcagtacagcaattgggtaaagtacacaggctatagagccaatcaccttgggtttggacagaccttggtttcaacccactacccctggttttggaccttgctaaccattatgtatgtccatgtgtaccttacttattccattcaaacttcagcttctttatctctaaaagatgattagtaatacttggttatttgaaagattcaattatacacaataaatggccacctcaaccaccactatcacttacaatattgctatggtagcacagtcccaaattcaaatatttgatcttctgggtgcagtggctcatgcctgtaatcccagcactttgggaggctgaggcaggaggattgcttaagctcaggaatttgagaccagcctgggcaacatagtgagaacctgtctgtatgaaaaaaaactagctgggcttggggtgcatgcctctggtcccaaccactcgggaggctgaggtgggggaatcacttgagcctgggaggtcgaggctgcagtgaggcgaaattgtgccactgcactccagcctgggtgacagagcaagaccctgtctcaaaaaaaaatttttttgggggggatccttttgtgatatgcattcccatgtttatatagataaataaaggcaatgtaaatatagattaaccctgagaacttagtgtaaccaaaatcacaatcttgaattaaccttgaaagattaataccaaaatgccagcctctttcacacatacatacacacacacccttgcatgcatattttaaatgagagactgcaagaaacacagagtccatgaagatctctgtgtgaactccttctgagtcattttcaggaggtaatagaggtaaattctgattacttaactggcaaaaatacactacgtagttgtatttgatttactgagataacatggagaggtcactgcattattttttaacttgcagaaaaagttcattaactcattgagagtctactctgtacttggtaccatgccaggcataggatagagagctaatcccaacagacatggagaccctgacttcatgatgcttatagtcaagtgaaatttttcttttctttggagacaggatcttgctcttttaactcaggctgcagtgccgtggcaatgatcatgactcaccacagccctgacctcctgggctgaagcgaacctcctgccttagcctctggagtacctgggaccaaggcatgtaccaccacatccagctaatttttaaatttttttgtagagaaagaatctcactatgttttccaggctgaggtagaatatttttatctcagaggaggagggagggagggagggaaacagtgcaagtaatatgcttttgctgggcctcctggtgatagcagaaacactgccagataatggtagtatctaacatattggggcacacatctaagtagaagagataggctctaacccagagcagtaagcttagatattagaataaagcataatttcaaattctaagcacccaaatagtttgatgtcatttattaccaaaaattcttgtcactgtttgaatactaaatagggatgtttcttgagtgagtactgaatagaaaaaattaaaatagggagtcctgtagttttgtttcaataactccaatttatacaggttcttaaatatttgcaataaccattactgaggaatagttccatttcctctatcaataaccagttacataagttatcaactctttactaaaagaaaatctaatttgattcaattagaattacttttgtttgagacagaatctcactctgtagctcaagctggagtcccgtggtgcgatcttggctcactgcaacctttgcctctggggctcaagtgattctcctgcttcaagcctcccaaatagctgggagtagaggtgtgcgccaccacacttggttaatttttttgtatttttagtagagacggggtttcaccatgttgcccttggtggtctcaaactcctgagctcaggcgatccacctgcctcggcctcccagagtgctgggattgcaggcgtgagccaccgcacccggccagaatttgaattcttaaaactagctaaatgccattcatcagaagcgaaacagctaatctcaagccacgaataatgcgtgctcaccacctagtggcacttgtggcaaactgcaggtacattatacttaaaacagtatgttctgctaatttaattcatgggtaacattcagaagctttatggataaccctcatcttctagttaatttatgaagttttagcccccagaaatttggcagaataatatcttttgaaattccttttcaatccccactgcactatctagatcggaccacccttgccttatcgttgtggtcctgattggattctccactgtctcttaagaattgccatttatatcattcctctgcttgagaaaaatgaaacaaatttgtttgcaatacattcagtagaagcaccttgtcccagtgcaaagtgcccaattctgaacttccttaacaagctgaattctagcaagagggtcagatgtggcctgtgaacacacatcacactcaccagcctgtccccccatactgaacattctacctgaagcagcaccctctccacctcacctctaccttgggaattcttattgtttaagacttaactcaaagcccattgcctacaagaagccctacttgactactacagttgattcatctctccctgttgtgaattctgagaatgatgattgtctgcagcctgagatgtactcctgatctgtttctcctgccctctcattattgtccattatgtctgtgggctagcagatggcttctgtaatgtgaaaaacaccttgaggacggcgattgttgtgtgttttaaaatatccccttctccactgtaccgagctcagtaaagaacacaaagcttcctaaatacttcggttgtgtccaccaatacagcatttcattattctgatcttttaggctgcagatgtctcccaggtgtggcttctgatcaccttgtcatcttttgctagttaaaacacatgtgatcttttcaacagcagcagtagcttcatgtcaatgtatctgcatatttggtgaggaagaaaactggcataatgtttcccagtaatttcggccaagagagcagttctttgattaccttggtatttatggtgaaaattgtgtttaaaatttggcaaggatttgtctaatttattcatttcactttgtatttgcaggttggttgtgatttatgaataccattcaagaggtcactatcgatcttcaaaatacatcaattctaagtagacaaccttccacctttgaagaacaaaacttttactgtttcacaaacacattagacaagaatgtggttcgatcaacagggcataggattcatgaaatcaacatttattcatatggtatcacctggggcagcaggaatgcttctggttctgattaaaaccaccgcaacaacttgtggatctaaggactttgttcttaaattaatttaaatatatcatggaattacaaaatgtattgaacttccctacacaaggcttcaatggcatggcattcgaataagaagatgagttgatcttaataaaatggataatccaaggagtgcccaaacccagccttttggcatctcaaatcgcaattttaaccctgtaattataagtgtacaatgagatcttaatgttccttgatttggaataaggtttaaggtagttttgtttgtttgttttttgttgtttgagacggagtcttactctgtcgcccagcctggagtgcaatggcatgatctcagcccactgcaacctccacctcccaggttcaagcaattttcctgcctcaccactctcccgagtagctgggattactgatgtgtgccaccacgcccagctaatttttgtgtttttagtagagatggggttttgccatgttggccaggctgatctcgaactcctgacctcaggtgatccacccacctcagtctcccaaagtgctgggattacaggcgtgagccactgtgcccggcctgtttaaggtagttttaaataaaattttgttaaggctcaaatctcttcatcacatgaagtgctacagtaattacttgccagacacaatattttcttgaatcatacacgtattggaaatatatgtatatgtacatttcaaaaataaaattcatgttgacttatcattcttaaaataactttctctacacatatccatttatctttagacaaagtcattgaaaatatgatttgccaagattttgaatttgtgtctctacaggctgcatactcttacaataaaaaagcaggaaaacctccttacatgccttcagttatctttgttgaatttgatttttttagatataaataaccaaactctctcaatgcaagcctgacactgataatgagtatgtttcagatggcaacaggaaaacatactactgctgtaattaaatgcaaattttttttagtgcatgcagtattaaagtcgagtttaagccactgaatgggggaaatctagaagttaagtggctcaaaatgaataatttaaacctgctgagtcaggttttcctagtgaacaagctgctacttggagtaaatttggtgtggttgtaagtggcagaaattcaggctgttggatttcataattttaatatgaatagagacattattcccaataccttagcaatttgtatgcaaagtacgtagagcttcattgtgagagaagctctgcttctgtttatttggtcagtcggtccatatttccgagtgccaactgtgtgcagagtatagcaggccaggctttcgaagagatactggacttttatgctcttgaggagttgaacagacccagatgaaaatatttccaaatacttgagaatcctgactctattaactttgggaagaccttcaacaaaggaatgattaattgggaaggtgagattaatcaaagaagacttcctggagaaggtgagaacacaggttgcggaaacacacaaattattgcatgaagatgagaaatcaaagcactggattaaagccaagaatccacagcaaggagaatgaagttagaggaagctggtggggaagctgtcaagagtcttcatgaccaagggcacctgctcggccatcttggtagcatctccttcctccctggagtgtgaaatgttcactattcatctgcaaactgtgtgtaatgtgagaggacctttagaagtaaattagagtcttatttataactctgttgtcaaaacttataatttcacagatatgtcatcgaaaatatttggcttctggaaacactctcacatagtgacccttgtaaattaaaatttcaagttaaaaaaaggaaatgatgattgctcacaataagaagtataaaaatggaacactcgtttattcatttcaagctgcactttccttcttagactaaacaatgagagaaaacatgaagagaccctctggtttctaccattcaaacatttatatctgcttttggtaaataaaatgacttgacttctctttttgtgccaattattatggtgttgaattcaagatagagtccaatacaaaatcaatcttggatgacaaaagaggaaacaggcaagctccaggactcagacctggcagctactttgggaggctctgctaatgctgctaagagcatgattttaaaattaacttgtggtcagcttcctctcagatgctttagtaataattaaataatagcagcccatgccaccaaggtaagaacctcgtctagcaaaagtcactagtaccttttggatgaggaatttctgccaaacagcctataagagcagaattctgggatagcagaggggcaaatgcttgcatgcgttgaattagaattctactctgtgatttactgcttgtgactttgcatgaattccttaacctccctaaacctcagtttcctcagatgtgagattggggttaacagtgctacctatttcttagggttgttagatgcctcaaatgtaatgatccagttaaaatgcttaacccagtgcttggctcatatcagtgttccataaatgttagtccctactttatttctagagtgtttgaacgacactgtataagccatgaagtgtaaggcaaaatctttagtgtcattaaggtaataacattattagggtaaaacggctggaaagtggaagactataggaagaaatgatgctcgaacccatctactatagcccaatagcagaaagtgaaaaagaatgtatgtttttaaatttttttaaattttctattattatttttcttatagagatgcggttttgccatgttgcccaggctggtctcaaactctcgggtataagtgatcctcctgcctcagcctcccaaagtactgggattacaggggtgcactgccatgcctggccaagaatgtatatctttttatcagttttaagtgtgtccactgatttttccatcttgggcttagtgatactaagtaaatgaagtaccatagctatcattgttttggttaacaaagtcagagctgaggcaggaactgtggctgcctaacagccttaggtcaaacccacaagtgctccctgggtcttagagcttgccttggaaagagaatcatgagctaatgatcccaattactgcctgtgaaaaccaacaccaaagaagaatgcatagaaacttctaaagcctttttctttttttttttaatttgacagaatatctctttgctgtttaaggattaacattacatttttaactgaaaagaaatacaaagaaaagtactatattaaactatcaaaaccactgattaacttgaggaagtaaagtctatgttccttcatgtcagactaaagaaatttcaatatatatcttctatctattgtgtacctacttcaggcaataattcactcattgaaactgtattgaaaacctattatctgctaggctgggggagataacgaaaatgaataatgcacagtccctgcctgtaagggaacaggttggtaaacaaatccttaggatactatctgataaattctacaatagaggcataagaaaggtggggagatgactaacctagaagcacggaagacttcatagggaaaataaaatgtgatttcctaatctaccaaaacagagcaatcaagtacgaacatctaataagaatctaatgaaaacactgatgtaacccaatgtaaaaaaaaaaaaaaaaaaatctgggggattattcactggcttctcactcctatttttctataaatgggacgaagcaagaattggctatactaaaattaacctaaaagctgtatttggagcagtattaaatgttgaacttattagcaaatctgcaggcttatatttcaattcaataaaaaaaaaaaaagagagtctatgatatgccaagcactgactccatgctagagagaggaaaaacacagcagagaagacagaaataaaaaaggaagcttgcagcctcacgaaggtgagataagagagaaagtgaaaaatgctttatgacaggtgccaacaaggagctatccgacacaaacggaaacgcctgcacaggccaggctgggtgagagcatggggcccatggagagggcatcccagtcatcatggccatgttggaatccaggcccaatgttgccagaactttccgtctttcaagagaagctcaaaatccacattttttttttttttttttttttttgagatggagtctccctctgtcgcccaggctcgagtgcagtggcgcgatctcggctcactgcaagctccgccttccgggttcacgccattctcctgcctcagcctcccgagtagctgggactacaggcacctgccaccacacccggctaattttttgtatatttttagtagagacggggtttcaccatgttagccaggatggtctcgatcttctgaccttgtgatctgtccacctcggtctcccaaagtgctaggattacaggtgtgagccactgtgcccggccaaaatccacatttttccatgagagctcttgatttttcttgttctttttctgagtcaggatgtggctccatcacccaaggtggagtgcagtggcaccatcacagctcactgcaacctctgcttcccgggctcaagtgatcctcccacctcagcttccggagtagctggaactacagatgcacgccaccacacccagctaatgttattgtttgtttgtttgtttgttttgccatgttgcccaggctggtctctaactcctgggctgatccgaagtgatccacccaccttggcctcccaaagtgctcggattataggcgtgagccgttgagctcagcttctcctgatttttgaagactgttttaaaatcctgtccacagctgaattcagccccttagctgccagttagcagcctctgtacttctaaaatgcacagggagcaaggagcaagaagcatggataacggactaattagatggacaggggatttagcactggattcaaatcctgccctgctggcgttatgcaaacttggtcaagttctgaaaatggatctcagttttggtttcactaacatttttttttttgagacagagtcttgctctgtcacccaggctggagtgcagtggtgccatctcagctcactgcaacctctgtctcccaggttcaagggattctcacgcctcagccttctgagtagctgggattacaggcgtgtgccaccacactgggctaatttttgtattttgtatttttagtagagatggggcttctccatgttggtcaggctgatctcgaactcccaacctcaggtgatccgcccgtctcggcctccaacgtgctgggattacaggtgtgagccaccgcgcccagccaccaataggtagttcttgactggattacatcccgagatttgataccaagactaaaactgtgttcagctcatttcccaaaatacagtaaggggctttaacattggattcaaatcctgccctgcctgtgctgtgcaaacttggacaagtccaagggcacagccttaacacagcatttcttgtcagataaccattgcttttaagatggttgaaacaacaagagaaggaagactccagagtagtcctatgacatgctcccacccacagagagtaagaatgtttcccagccacttctcatgaccatagttttcttactggatacgcctgagtgcagcaaggtctaaggggaagtttagggcttcaggtttgaggacttgcttaataatgcctttctgtctataaccagtatgcccacaagtgaacaaaccttttcccaaaatgggtcaattataatgttctgggtggagattccatagctgctccacagctcggagagtgtgctctttggtgcaagatgtgaggagggataaaggagctgcactggctttcctgttctcttacagagtgtccacttgtttccatttcttctgggagaatggggaggaggcatgtgtaatacatatatttgacttcttttagcctcattttcactttgtctctttttgtctcttattcccattttgcagatgagctggtaggggtagagggcagttaggcgatatgaaagaaaggtggagaggaaagagtcattttactgttctccatttgagtatcttcaaaatcatcaggtattcttgcagagaaaaattaagggaggcatcattatatttatttctagtgcctaacactgagcctgacacataggtgcttaatagaaacttgaagaaaaatgtgttgaagaaataagtactcattgaagaaaaacatatttacagaagagaagcagcacaaagtgctcggctgcaagcaacagaatattctagtagtagattaggtagtagagttaattttcctcatgcaataggaagttcagaagtcaggttattgatattgtaccagatgttcaaagtgatcatttgggccctaagaactttctgtctttccatttcttcatccttatgtttattgcctcatggtgttaatatggctgccccagctgtaagcattgcattcacattcaaaggtagatgagagggggaaggatggagtcagcaatatctgtcctatgttatcaagaaagtaaaaaactttcccagaaacccccggaacacatccttttccagctctttggccagaactatattaaagagtcattcatagatacaatgaaaccttagaaaactgaggatttaggcagaatctttgtcattatgtacaaagtccgtcttccattagcaagggaaaatggggaaataaacactgggtagacaatatccgccacacttgactggagccctttctgcctcctactcctttctgaatactcaaatgactcacagccctctattaattcttttatgtcatttatttcccctcccagattgaaggcgttactcatgtttgactcattttctcctatcttttacacggtaaacccctaataagtgctaatattatgaatgttttgagatatatgtaaaatgatgctctttaagtagttacagaaagaataaaaaccatgacttcatttgtatatttgtgcattagctactactccattttaaatacagtaggtaaagtaggcttaagtgaaattttacaaaggggaataagaacaaatataaacaacaaatataagacatttttataatgtaatagtgcagacaaaactgaaattcatctctttaaaatgaacttaatttcctgtttctttgtcttctcatgcattccatgtcataaagataggtaaattattctagaaatactaatatttttcaggttcagaaaacttcagtggatctcaatgcacataagaaactgtctacattccttgctccagtgctcaaaactccacaacctggtcccaaccaaccattcttaccctgtcactcacaactcttgcgtcagtatattttgctgtggctaaattcttctacaaactgccctctcaaggcctcttgggaattccacttccccttgaccttgaatacctttaagttcctcttttggcttgtttgaatctgacttagccttcaaagtctagctcaagtatcaggttgataattagataatgtaggtttccagctttttttttaggctggagatacagtttgcctttatccatatcttctgcctgtactggattttgttatttcagttgtccaggagttctgtgtgtgaactgccatcttttctgttccatgtaatatcgtagcatagcacgacagcagcaagtattttttctgtaatggaaaactgattgctacaattctgacaatggtcatgctcaccattttaacagttatataattatatgttacctatcatttcctatgtagaaactgtattaagaaccatcatttaatcctcataatcttatgaggcaagtattatttttgttcccattttgcagatgaggagacagaggagctatctcttggatagcttccaattcagaagtaatttttttttctgtaaagggctaaatagtaaatattttaggtgttccaggccacataatctgtgttgccgctattcaccccttcattgaaagcatgaaagcagccgtagatagtaagaaaacaaatgggtgtagttgtatgccaataaaactttatttacagttggctgaatttggcctgtggactgtagtttactgacttctgttctagcccaaataatccttttcatatataaagctaagagaggtaaagtccagattgcaacagaggcggatctagaatcgaggtcttctgattggtgggttagtggtctttaactattatactaactggatgggggtaattattctgtaataaattgagcttctgaaattataaggaggccaggcatggtggctcacgcctgtaaacccagcaccttgggaggccaagacaggtggatcatctgaggtcaggagtttgagaccagtctggccaatgtggtgaaatcccgtctctactaaaagtataaaaattgctcggcgtagtggcgcgcgcctgtaatcccaggtacttgggaggctgaggcaaaataattgcttgaacccaggagtcagaggttgcagcgagctgagattgtgccattgcactccagactgggtgacaagagtgcaactctgtctcaagaaagaaaccataaggaagttttgatactattgacaaattatactgtttgacccagatgattaggtttctgtaatttgatgtgggttttattccatcttctgtgtcttccaaaggtatgtggacttttaaactcagtttcttcatcttttataggaaagcattttccagactagataaacacatgccagttgcatgtacagttaggactcagagcttgctaaagagcacagggtgacgactgtggaactactgaaacattgtcgagacagcagtccgttaaggcttctcagagtagttctgagtacatggctccctgccaactttctaacctggccccctagtttaccaggaaacattttgacatggttaaataggtacatacatcctttgtggctacaggacaaaacccatgattgcctgatctctttagtcccatgctctgaaaaatttagattcaaatctttgactggaaataaaatttctgtggggcaagtttttattctctgatctttgttctttctattaatagacttggaatgtaatggaaaatatagttaacattgccttgcacatttactttttgagcatagttatcagcactctaagtttctcgattgtctcaggacactgatgatactaatagattccaaaaagactttcttgagccagaagcactgtagcactacatttccagctctctgttgagtcttcaaactaagtagaaaaagagaagcaaattgaacctcatatattttactatccaagaggatattaccttgactggacacggtggactgactacacagactggccaccgtctgcaatagcgctcaatgcaattagaagcctgggagatgagctgacactagaaggtcaagaaatacagttttgttttgttttttgatgcttctgctgtaattgtggccccagagcattcttgtccttgacttatgtgatgatctgaagttatgttttgattctgagcatctatgtcttattaggttatatgcatcatatttaaataactagacaaaccttgaaagttcagaatcctcaccagcctgtaaaatttttgctaggccaatctatcatcaagaagactacagaaaaaagtatttcctttgcacagacagatgtaccctttgctgtggatgactcagcaaaaaacacctgcaatagtgtcttattaggtggtatcccctggcacttaagatatatgcaaccctgtgccctggaacctacttttgaagaatgaaagaaatatttaaaacatcttatcggccagctgtggtggctcacgtctgtaatcccagcactttggggggccaaggtagacagatcacctgaggtcagtagttcaaaaccagcctggccaacatggcgaaaccctgtctctactaaaaatacaaaaattagccgggcatgctggcatgtgcctgtaatcccagctgctcaggaggctgaggcaggagaatcacttgaacctgggaagtggaggttgcagtaagctgacatcgtgccactgcactccagcctgggtgacagagcaagacttcatctcaaaaaaaaaaaaaaaaaaaaaaaaaaaaaaaatatcaaggcagtggaaaatgagctacttttcccaaatttcagaatctatagttattggtattaagtgaataatgaaattcagtgattctcctgctagagaacatctctaaagccttgggccaagagctataaatacattttatcaatgctgtaaggtaagcactgttactatatccactccacacatggaagcaatgaggctacagagaggttaagcagtttacccaagatcatttaggtaccaaatgaagctgggatctaaactaaaagaagtctgactccagagcccgaaaaactattacttcagtctgtacaatcacttggtaaaatctacgtcctttagtagaaaacttgctgaatgagaaagagagagaagaacttgctgaatgagaaaaagacagaaaatagcatattccagtcccttgttccctttccctagatcagtgctgacatattacagagtacatcccaccttatgctattgtttatgcctaggcagtcgcagagggagctacccgccacaagaacccgtgatcatatctcatcattgctgttcccctagttaccaaagtctgcactttgcttttgtcatgttattgacgtacagggggaagcattattttctcaatggttcaaattacatatctggggggcaaatgaaacttggtttttattctcattctctcctttcattattttagaatcataaacctactagacaattgtataatcattaaggtcatatacaaatattctggccatctctttttgggcttgtagtaggactgcacttccttatctgctaaaagtgacttgctctgaccaatgaaaggcaaacagaaatggtctatgtctcttctaggaggaagctttaagagccagtgcttctctttccaacatggtgactggcagtatttcaaacagcaaaacatttgagcttagggcttaacgtgagggtgacaacaaagatgtggcatgaagtcccctctgcccatcctggatcgacagatagtataagcaagaaaaaagcattgtggtcttaagcccccaagacttgcagttattactgcagcaaaacctagtcatcttgactggtctattcttacagaaaatactgatgcctaattcaaagcagcaacacagagaatatggcaaaaggggattaagcatctggtgattgtgaaggccatcgatgctgccagctagcaggaaatatccaagtctttccaaaaggactgggagtagcatacaaaaaggaaatgtccccgtcatccagaaccgaaacctgggcaggattcctttggaaagagaattgtggactttctaatccctgcaactgacccaacagtccccatatctctcctatatgcccttaaacaagaacaagcacaccttgaatgcaaggtggaggttttaactaaatactggccgggctgaagtaatcactcagaagcataatataactttcctgacagagtgataagtcagtagagcgaccaagggcctttctctccttttctcctttagtaatagaaaaaatgatgctatgagttaggggtttaaacagaaagaaactgaaatccatgacagtgatgacttaataatattgcaaattatagtttttagttcaggtaatttagcataccaaatcacagtttaatttccttctacagagcccaggcatatgagatagtgtatgagagaaggggcaaggtggggtggagacagggggtgaggatgagcatgaagaaaaaaaattctaagacttctcaaaggcaggtgaccttgaaagcctaataaaagtgacctggagaatgtaaatggcagtttattaatatgtgcgagggctatagccctgacctccgggaagctgagtccttgcttccttttgttcaagtgcttgcttctcctgcctggtggaatgtgaggatcaagtgcccagaaggaatgcataaagcgtacagagccctgacagctgtgaaagaatgactttgagagtgtcagcaaagcagagccgttgttgaatggcatgtgtccttgattgcgcacaatgctgcatgaaggaacagagaagggggagctgaatcacttaatgacttgtcttttgttctaggatcaacgttccagatgaaataagccacgattctcgatccatacttaccagtcgccttacaaaaaaccaaacaccgcatgttctcactcatagatgggaattgaacaatgagaacacatggacacaggaaggggaacatcacactccggggactgttgtggggtgcagggaggggggagggttagcattgggagatatacctaatgctaaatgacgagttaatgggtgcagcacaccagcatggcacatgtatacatatgtaactaacctgcacattgtgcacatgtaccctaaaacttaaataataaaatatatatatatatatatatatatatatatatatatattcaaaatagcttcctcaggtaggtgaattatctcacccggctgaaacagtgtctgcgtgtttggcaggagagtcagggaagagcgcttgtaactggattttatccaaagtggttacctgagttctaacaatgacaaagtggtgaggatgagccctctgagctagcttgggaaatactagttgttcaaccctttcagtattactcagccaaactgcagctgatcagcttgaccaaatgttcgccagagtatcctgaaataagtatgccccttgtacatacctaagttcagaggttaagggtcaaataggtaggctgagtttgcaagtgcttgaagctaaaattctcaaactcaggtgcctaaggaccacccagttaaaacaattcctaggttccaccttattgaatcagaatctcttgaagtggggctaaagaatttgtgttttaacttggttcctaggttattttgaaaactaggatgtttttttaaaaaaatctactcaaacttacctgagtatgaaaaaagaaaatataacccttcatagacataaaaagcacatagccataaaaagcacaaacacaaaaacatccaaggaaacaaaattcagtccaaagacttcatgtaagtagagatcacatagtacttatcatccaaacagggacacctctgaaagtgaaagctattgattatagcaggataacaggtgtaaacagggactgtactctgtaactgggatttatggtcatctgaattctaagactaatctgggcaggaaaattgtttgggatttaggccactaacacaacagaaagccctcatccaagttttgaagtttagcaagagctgcaaatattttgattaggagggctatataaaccataaacccagaggatcttgttcaggggttcactgtggcttgaagtagagcaggatgaactctcaggtcctaattaccctgactgagaagagaccagtagaaactttgaccccacagtggaggagtgcatatggcagtgacatttatccacagcaactgcagaagtcagtcttatgaaatgtaaaggattggacctcagagatggagagagaagaaacaaaccaggcattattctactccctacacttatcttgcaatttctaggaaacaccttttctcctaagtttttagttctctagtcatgcagtttgcacaaaccccctaaaaattattgccatatagcttcctattgccttccgcctctggggaatactgcagtattcttatagggaaaaggaagaatgggttgcgcattttcattattcattggatgcaaaaaattcatcgtgtaaaggttgttttagaagtgcaaaacagctaaatgagaaatcatgttattgctaggaaatttcatttatttcctttgttgtaataatgattgtggtgtgtagttgcttctgtaataattacagtgatgctattgcacatttactttcaggtatcattttcattttaaaattaatctcaaaatatagtgttcattcaattatgcctctcttagcaaacaaactctactctgagctctaaactacccagtattgaaactacctttttaaaatgggaggaccaatgaacatgcatatgcagaagggcctggatcttcacaaagtaacttctcttctagaaattatacttcaggtagactatgcctcttctgtgttcagttgccagtgcatggggtggaaggaaagcgtaattggtgcactggcccccaggagaaaagcagtatctgaggaaacattgaaataattacaaaatatgtgtttaaaagaggcatggtgatagttacaggagaagggaaagagaaggaaaggaagagagaaatcgctcttagatgattataaaatatatcttatttacctgagagagttaaagtgtattggctatgctttttaaaaacgggtcttaattacccttgaggccagaattccatatgagataaatatgtttttagatagttttctaaaatatgtataatttactcaaggaaaaaaggactgtgtcctctggagccaatccagcctcacaggtaaatacaaatttaagtagattcctaagaagcacattatgaacagtggctgatggagtggaatgtctgtgaagaagctgggaaggtccgtcagttaagtacataataaaaatgtattggaaaaatacatcatttcctcagtggactataattggctatgcatagtaaaaagtcttattttcaaaaatgtattctgcatccacagagttttaaatctcaataaccacgttatttttaaaagtcagaatgctaagcaatattagtgagagtggcagaagaaccacatggtagatgtcattctgcaatttacaactctttgacatcttctttttcttcttcttttaaagcagacttcatccaaagccataggtaaaaagttaaagaagatggaggatcaaaattcagctttctttactaaacagtccgatcagtcttttcagaagtgccaaagtacgtttaactttaaaagcatatcctttttttattatccaggcagaaatttctggtataaacaaacaagacagacagatgtaaaggtccacagtaacacaattacctaggcctgccatttacacctttccccatcccactgattttgacctttcccttgcctaccacctcaccgttctcccagcccatccattcggttctggcttcacttgtctccttcccttgcaacctatagggatgttgttggacctgtctttatgttctttctgtattatcctgtttttatacaactcattctgggctgccaagctgtggactgcccgttttggcgaccacacattcctggtgtgtcatgcagccccagggaggccttgacagtgacttgggcatttgtccatttggctcatgctgactggctgtcacagtcctcccagtcctcccactttctccagagcctcccatcctaacattcacactcatagcaggtgaccatttctttgtttttcctgagagagctgaggccatgtgtgcttcttcaacacctgtgctcctcaccgggaggatccccagggagcttcttccctgaccccttccttctgccactgccatcacttctgagaccctgatcctcccctcttctagctctggattcctccttccccactgattccttttaaagagtgagtgacctctctagtattaatactaaaatgagccccaaggtccttccaactccttaattcccactttcctctctttccccgcttcagaatcaaaccagctctcaaaccagagttcacaccagctgcctctcatttgccttctgcgttctgctctcaccacactagggaaactccgaggaccacgaccacaactaatccaatcaccagcgttcatgactttttctttagtgctcatcttccatgaccatttgacatacttcattctagcgatatatttcttaaaacatgtggtttccatgcttgggacccttcggattcccctcctatcactctgaagactccttttcagtatatgttctgtttttcatcctcccgttgccctttaaatagatgcattctccacagaactgtcctcggccctcttcctctcatactcaacttcctctgcctctgtaataactttgtatctctaatgggtaattctcaaatttaaaagtctctgctataacctcttctttgaactctagatttctacttctaccatctgctagaataccttattcgatgtcctggtgacatttcaaactcgacatgttagaaacagaagtaatttttttccctctaaaatctattcttactcagaccttctgttccatttaacaacttgacaattttcctgggcacccatggccgacagtgatgctgctaatgattataacaataacaatattattactcctattagacctaggaaattccgacaacagccagaccttgttctaagcttcactaaatatacagtcatttaatccctacaacaaccctatgaggttggaacaattattaaccccactttgcagatgtggtaactgagggatagaggtaaaatttcttgcccagcatcacatagcagcctggttccagaatccatactcttaaccactatgctctactgcctcaagaagtcttcagtgattgttggcagcaattgtaagatgtgttatagctgacagtagctagaaggtggctaatttgaggtctgtgggatttgacattaggtggtggttatgggaatgaaaaggagagtgactgacaggagacggtggagctctatgaagataggaactgcactcaacgaggtgtcatctatagcattatgggcactggctgtgtctcagaggctggtgaataggcgataagaatgaattatacacatagaaagccgaaactccctttttctaccattctagcaatagtagatgcaattccggttaattacgggaggtataaatatcagaggggagatgacaaagatgttggcaaaatgagatcctttgacagccacttttcttttgctaaagaatacccagcacacaactatggctactttgagtgattatgggactctgatgcctgaattgctatattttattcatatgtatccttctattctttcaatattcaatcaaatgtttactttttgtataggattgtgcatgttatgtattaaagtactcagttctgattactagaatttatgactttttttttgtggaaataaggtatgtgaaagctaaataagatcatgaataaataatacctcaaggtcatagggcaatatggcatgctgttttaaagtatgggctttggagtctatatagaactcgcttctaatttcggcctttgtttgtgactttggacaagttgctttgtcctcatctgtgaaatgtgaatgacagaacctacctaatagagttgtcatgaagaagaaatgagataacgcacatcaagtcctcagcatagtgctgagcaaataattccatgcacatgggcgtacacaaacacatacaactgagtattactctgtgttctgaaggggacttcctattggctgaagcgtttattgggtggcaggaggcagatttcagctgagtcttaaaaaatggatgggtcttagataaacggaaagaacatttcatatagataccaaggcagacctcaacagaggctaagaggaaggtgcaaagtaagaaatatcacaacagcaaagtcaatagaattttgattacaaattacagacagaatcatcaaagatgatttgagtttttatgtcttcatgattaaaataattgtgctactggtagaaatccattagccatgaaaggaagttagttttagaggaagaagacaggtttagagcgaaatatatagaatctgaggttatgatgggacaattttcaatgtctaagaggatggaaagagacaacagacttgagacgaaaggcagaaatggagatttctagctccttgaggagttaggtctcatttctctttaaatccctcagaacagctagcatagtgctttgaacattccacatgcacactgcttgttgcatggatggatgaataagtgaataaaagtaaagattctggagttctctccacggaggagatagttagtctccaaggaagaacaaaacagagaggtacccaaacatcagagacacaagaaaaccaaagtgttagagtaaagcaacaacaacatgagtgcacagggaaacagaaggggatatcaaatggtggtcaagggagtcttgggaaacaggcactgccaaggaggaggatcaagtgaagttattaatgtcttcaggaaacaagtttagtaaggtgttatagatggaggcctcaaaagaaaaaaatgagatccaacaaaagtggggagtaaatggaggcaacagatgtatgtctgagattaatagcaactgaaggaaaagaaaactcactacactcttttctaaaaatgtgtcactatatgatacacagactagacatttgtcataggtactcaaatattaagtgcacatatgcatgaatatatgaacaaatggatgaattgaataaataattcatatttgatatgagaaaagtactatatcttgatttcttgtttcttaattagaaaatccctcgctggatgtggtggcacatgcctatagtcctagctacttggaaggatcacttaaacccaagagttcaaggctgcagtgagctatgattacaccactgcactccagcctgggggacagagcgagaccccatctcttaaaaaggagagagagaaaaaataaaaataaagaaaattccaccttcatttctgtgctgtgggtatgtaaatagatgcaaaagcacctgtaggtaacgaagtcagtcaactcttacaagacaaaaactgatttcttttcaccatattattcttttacctgtttttatggaggctatacaactatgatttagattgtgggaaggtgaatatttatgaataaataagaaattttaatttttcatatcaactgttttagtataagctccaacccctccaagtgactcccacctggataattttttattaaaactaattgttttctatgtttggaaaatgcacaattttgttatcatggagaaaagtctgcacaatataattattatatagaaaaacaaacatgacttgtagaataggaaaaaacatctgaaatcagtaaacatctatttagttttcctgatatacactaaaaacagatattaagaaaatattttagctatggatttgccttttttaatgctatgaaattcatgctgagtagagaaaacctatgcttgatactttcaacttatagtacattttcaaggtgaattattaaattctcaaaacctgaccttctaatgaaggcactgatgcaagcacagagttggtgaagaaaaccacaaagacataaaaatgcacagatatatgatcaactagggacaaattttgatggaattatcaccagatctctacagacaaggcatatctatcaaaccatgcctaccataagctttgattccattaattcccgagaaaagacatcacgtagagttctggataccaggtgtgtaaacactaagagattctgatattatgatatctttcatgtagaaacctgaacacaaccccaccagatgcagaagctagtttccactgggaatgctacctacccttttactactggtatcattatttaaacgtttaatgtaggagaaactaaaggccaaaaaagaacacgtctgcacttaatttcaagtgacagctaatatagtgcattaaaaatgtaatactatacatatgatagttatatataaatagtaacattaaaaagggttacaacatccctacgacatcttacgtctaaaacacttaaaaagcacatttgcagtacaacttaaatcattttaattggtttcaagaagacttcaaattagtgatgggctttgactttttctgattatgaaagagaaacacagatgaatgctttttaggcagcctaatatcattgccaggtagactaccacataacctgtgttacttaaatgccattaactatcaatgaaagttattttcacataagtgttttatgtaaattttgttttcctaaagtcattagttctcctaataaatgtacctaatgcaaaatgtctttttttgttctttctttgcattcattatccaggaactttttcaaagagaaaaaaaaaaaaaaaaaaaaagcagagtgacagagctggaatacttagcaaccattttactgttgagggtttttttttttttttttggtacgaaaaataatccagttacattctctagctcaattgcttacaaataacttatctggaaaaaaaatcaagtaaatctatcagttgtagaagtttatttttccatgtggtatctagagataagccaacctgtagtattagatttccactgacataattgtgcatgaattctgatctgatttgatattacatggtgcaaaaggtgacacattttctctaatataccccattagaaagggaagaaattgccaaagtatgaaatctgaggaccttgattcagaaactatatgactctgaggttagctcaatgggaaaaaaagaacttgtttgactactccaggcactgaaggctgtgacaagcaaactaccaagggtagctattctgttggataatcaatacaatcttacattatcagactgccacagctgtatattcgtttatcatattgccttctatgtctctaaaatatttaagtgtagaatcacaaagagaatacagatgctgtcctcttcccaaatcattgctgatcaggatacttggctaagactccagaacaaagaaatagcatttatgcacataacatgccaaacattgattttaacacccacatatgctacctatgtacagcagagaaacattagctccaggcatataggaaatggctcctaactgagctacctacagtttctacaacaaaattgtttttttttttttgagacagtatcactctgtcacccaggctgagtgcagtggcacgatcacagctcgctgcagccttgagctccccaggctcaagtgatcctcctgcctcagcctcccaaaagctgggacgacaggcatgtgccaccatgccaggctaatttttatatttttcatagagacagggtcccactatgtcacccaagctggtctccaactcctgggctcaagcaattatctcgtctcagcctcccaaagtgctgagattacagatgtgagtcaccatgcccagccctataacaaaagtttagagatattagtgatcttctaaatcctatgataaacgcccttgaacaaatcaataaaataccaaatatgaactgttggcagttttaaattgcattttcaaaatgcagaaactgttacgttttaagaaggaaatgttctgcaacctccttttatcacttgactttttatatttggcagacagtcccagtaggcaaagtctggcttccagaacacagactgttggcatttggatctcttttatcaaaggagggcaatggatgtccattacaatttagattggaatttcctacaggattctttgcaactccttcctgcttcccagctagctttgagggagagcttagctagaaagtgaaatttttggatggaattcttatctacaagcaagataaaagagtaattaggtagtcctttcatattttagtggggacatagaaaatgacaattcatcttgtaaatcaaaaacaaaaataaatatgcacaggataatggaacttgaatctacctgacaatatgaaggcaccttgtttgtataaattttgagataacttaatccagtaccatgtgctgataaatcttggataaagagactcttgggaggcaataggctccgtatttcttaatgctacatgacatctattagaagcttttggtcttgggaaattgtggccaattttattttctacagatggccacacagtatctccaatcccatagattcttatgcactatgacctttataatccccagcaagaggcagaattgaattaccctttccttaaatctgggctggcctaaagtcttgcttgactactaagacaatgtgggaaacgtgacattctgggacttccaaggctaggtcatcagaagcctcgtggcttccactgggtctcttgaaatacttgctttaggattttcccttttcaaaccaagctgccatggtatgagaagccagcaacaactgccagaccaagccaccttgaatgtgcagccaagttgagccttttagatggctgcagtcccaggcatctgactagaaccatacgagagattcaggaaagaagtgccccagtgagcccagtcaacacaatgaataatgacagagtggtcaattattagtttagatcactaagttttgaggagtttgttatgccaaacatggcgggctttggaggcagacagactaaagtttataaagtctggttgtttcactctttaatgacttttaatgagtgacttatgcctcagaggtttctagtctttccatctataaaatagtgacagtagtagcagcttctcaaatgatacaagttcttccagcatcatattgtcctaatgactggttgatcaaagccaaaaaagcatggttactatatgcctttccctctgaaccaacttgaggcactgaaaatatttttccatttacatttgtctttcttgtttccacgttggatctgtgcttacttatgaaagcacactgaatgggtaaaagatactctgtatggacctgtggccatcatttttccaaatgctgtcaagacccagtgcctagggaaaagacagccaggcaggcatatgggacacattctctgtctattctgagcagaatgggctgtgggtacacaagttgcattccaagtggcctaagtgtcacctctacatgggtcaacaggctttgctaaaacatctctgggaaggaaaattaattagaggatttgttttctgatctcagtttcttcaccaccagacaagctactaattcctagtcttagcttctttgtgagactttctaggctcacctacttccccattatctgatttccagtcttagctacttctccactagccaggttaatcttcctgatactggagcatgggaatgatatttcatgtgccaatatatagagttattgtgaatattaaataaggtaagaagggaaagtactttgaaatatgtaaagtgctacacaaatatatctcagctagatacatcatggtcatccacaacattaaaatctcctttactctcttcaacataaattttttcaataatctattagctatttaaaaatctctcaaatttgtttctttctattatcatttttactgttaagttaaagatgcctttatttctcgccagagctattgtaaaacatcctagcatatttctctacttcaagtctcatttccttcttattccagtctgtgtccagttgccaaagttctcttcttaaagcacacatttcatcataacaattctctcctttaaaattgtctatgattcctcattacttgaagaatataattcagactccttagatgatgtccaaagccttcacaatcttaaatgtagatttctagtgtcatttccctcgactctccctcctgcacattatgctcctatgatactacatactccttgattttatatactaaactttctggtacattctcatttatccttcaacacccaaattaaatgtcagttcctttgtggaacattcactgacaattccgtgaagctggctaccttcctgttttctcaccaaaactattcattactttattataacattttcccattgtattataattattggcctacctaaccaaggatcccatcacacaatgactcctggaaggctcatactgtgtcgcattcatctgtgtctacccagtgacttgtctctcaatatatgtttatggaacaaaagcatcatttttcaatgagaaagacataatagcaaaacagttcaacctttatctgaggttgagctttaagtaaggaagggtagcactgtgaactttgaaagaaaaaaaattttaaaactttctgagactttgattactgctatacaaaattcatgttttatgtcaaattatactattaagacattcatttacacagagggatatgaaataagatgctgtatttatcagcctagattaagttatgttgcagtcacaaagacccccaaaatcatagaggcttataatcgagatttattttttttgtttacactacatgtccatatgggttggttccatgccatctttattccaggactcaggctaaaggagtagcttctctgtggatagtgccagccttgttgcagaaggaaaagagatatggcagagccaaggatgactcttaaaccttttgcttggatgtggcctgtgtcacccaaagaaagtcacatggacaagtctgatatcagtatgcagggacatatatccataatgcagtctgccacagacgccatcaaaggtaaaaaggcaggtgacattgtcaccaccatgttaacaactctagaatagcttcccattgataagaacctaattgataagagcccaccatgctaactaacatcactataatccatgcatccttgtttacttcgagtctgtaatccatgcatccttgtttattatgaatctagattaagtgggaaattttcaatgaaaaaacaatagtaccaccaaaagaaactcatttcacctataaagacatatagactgaaagtgaagggatgaaaaaagatattccacacaaatagaaaccaagattgagctggagtagctatacttacatctgataaaacagatgttaagtcaaaaactgtaaaaggagacaaagaaggtcattatataatgataaagggatcaattcagcaagaagatcaacaactataaatatatatgcacctaacactgtagcaccaagacacataaaacaaatattagatctaaaaggagatagagactccaacacaaaaataattggggacttcaataccctactgtcagcactggatagatgacctggaccaaaaaaaaaaaaaaaaaaaaaaaatcaaacaaacattggatttaaaccacactgtagaccaaatggacctaacagagctttatagaccatttaatcgaacagctgcagaatacacattcttctcatcagcacatgggacattcttcaggatagaccatatattaggccacgaaacaactctcaacacatttcacaagatctgaaaccatatgaagtatcttctcaggccccagtgaaataaaactagaaatcaataaaaagaggactttgggaactgtataaatatatggaaaggaaacaacatgccgctaaacaacaattgggtcaatgaagtcattaaaaagaaaataaaagatttcttataacaaataaaaatagaaacacaacatgccaaaacctatggaatatagcaaaagcagtgctacgagggccatttatagaaataaatgccaatatatataaagtagaaagatttcaaataactaatttaatgatgtacctcaaggaactagaacggcaagaacaaaccaaacccaaaattagtagaaggaaagaagtaataaagatcagagcagaactaaacaaaatagactgagtctggttgctcatgcctgtcatctcagcactttgggagggcgaggtgggtggatcacctgaggtcaggagtttgagaccagcctggctaacatggtgaaaccatgtctctgctaaaaaatacaaaaattagccaggtatggtggcatgtgcctgtaatcccagctactcaggaagctgaagcagaagaatcacttgaatgtgggaggtggaggttgctgtgagccgagatcataccactgcactccagcctgggcaacaagagggaaactccatctcaaaaaagaaaaaaaaaaaaaaaagcactaaacaaaatagagactaaaaaattacaaaggagaaacaaaataaaacactggtttttttgaaaagataaaattaagccgttagcaagactagccaagagggggaaaaaaaaaagactcaaataaataaatcagaattgaaaaaagacattataactgataccacagaaatacaaaggattattagaaactattatagacaagtatatactaacaaattagaaaacctagaagaggcctggtgcggtggctcacgcttgtaatcccagcactttgggaggccgaggagggcagatcgcctgaggtcaggagttcaagaccagcccagccaacatggcgaaaccccgtctgtactaaaaacacaaaaaaattagctgggcatggtggcaggcacctgtaatcccagcaattcaggaagctgaggcaggagaatagcttgaactcgggaggtggaggttgcagtgagctgagatcatgccactgcactctagcgagggcgagaagaacaaaactccatctcaaatagcaaagacttggaaacaacccaaatgtccatcaatgatagactggattaagaaaatgtggcacatatacaccatggaatactatgcagccataaaaatggatgagttcatgtcctttgtagggacatggatgaagctggaaaccatcattctgagcaagctatcgcaaggacagaaaaccaaacaccacatgttctcactcataggtgggaatgaacaatgagaacacttagccacagggtggggaacatcacacaccagggcctgtcatggggttgggggagggaggagggatagcattaggagatatacctaatgctaaatgacgagttaacggatgcagcacaccaacatggcacatgtatgatatgtaacaaacctgcacgttgtgcacatgtaccctagaacttaaagtatagttaaaaaaaaaaaaggcaaacctagaggaaaattcctggacacatacagcctaccaagattgaaccaggaagaaacagaaaacctgaataggccaataagaaatagtgagattgagtcagtaacacaatgtctccaaacaaagaagaccccaaactggatagctttactgattaattatggcaatttataaagaactaacaattcttttcaaactgtttcaaacaattgaaaggacggaattcttcctaacgcattctatgaggccaccattacccagatccagacaaggacacaataaaaaaaaattacatgccaatatccctgatgaacatagacacaaaaatccccaacaaaaatactagccaactaaatccaacagtacatcaaaaagataatacaccatgatcaagttggatttatctgaggcatgcaaggattgttcaacataggcaaatcaataaatgtgatacatcacattaacagactggacaaaaccatatcataatctcaatagacacagaacaagcatttggtaaaattcaacatctctttattatacaaactctcaacaaattaggcatagaaggaacatatctcaacgtaataaaggctctatatggcaaacccacagctactacatggaatggggaaaacctgaaagcctttcctctaagaactggaacaagacaatgatgcccctgttcaccactcttgttcaacatagtactgaaagtcctagctagagcaatcaggcaagagaaagaaaaggcatccaaattggaaaaaaaggaagtcaaattatccctctttgcagatgacatgatcttatatatagaaaaacctaaagacaccacaaaaaaacctcttagaacagataaacaaattcaatataattgtaggatgcaaaatcaacatacaaaaatcagtggcatttttatacaccagtaatgaactagctaaaatagaaatcaagacagcagttccatttacactagctacaaaaaaataaaatacctaggaataaatttaaccaaggatgtaaaggacctctacaaggaaaactaaaaaatactaatgaaaggagttgaagaggacacaaatgaaaagggatcccatgcccatggatttgaagaatattgttaaaatgactatactacacaaagcagtctacagattcaatgcaatctctatcaaaataccaataacattcttctgagaaatagaaaaaacaatgctaaaatttgtatggaactataaaagaccctaatagccaaagcaatccagtgcaaaaagaacaaagctgaagacatcacaatccttgacttcaaaatatgctataaagctttaataacctaaacaacacggtattggtattaaaacagacacatcaactaatagaccagaacagagagctcagaagtatatccatatttttaaagcctactgattttcaacagaggtatgaagagcataaattggggaaaggacactctcttcaataaatggggctgggaaaactggatatccatatgcagaagaataaaactagacacctctatctcaccatacacaaaaatcacctcaaaatggattaaagatttaaatgttaagatgtaaaactataaaactactagaagaaaacataggagaaatacatcaggacattggtctaggcaaagttttatggctaatacttcaaaagcacaggcagcagaaacaaaaatagacaaacaggactatattagactaaacagcttctgcacagcaaaggaaataataagaacgaagaaacagctctcttttgcaactatttatccaacaagcgactcgtaatcagaatatacaaagaactcaaacaactcaactaaaaaaacccaaataatccaattaaaaagtgggctaaggatctgaacagacatttctcaaaagaagacatacaaatggctaacagacatatgaaaaaatgctcaatatcactaaatactggagaaatgcaaaccaaaactacaatgaaatatcattccacccagttaagatggctgttatcaaaaacacaaaaaataatggatgtagtcaaagatgcagaaaaagggaactcttgtgcataattggtgggaatgtgaattagtagagccattatggaaatcaacatggaggtttctcaaaaaacttaaaatagaactagcatatgacccacaatcccattactgaatatttagccaaaggaaaggaaatcagtatattaaagggatttctgaatccccatattcattgcagcactattcacaatagacaggataataggatcaatctaagtatccatcaacattttaatgaataaagcaaatgtggtacatatgtacccaatggaatgctatttggccataaaaaggaataaaattacatcacttgcagcaatgtgggtgggacttgaggtccttatgttaaatgaaataagccagacacaaagaaaaatatcacatattctcactcatctgcgggagctaaaaattttggtctcatagaagtgaaaagtagaataatagttactagaggctgggaagcgggtggggtgaagagagattggttaatggaaacaaacatacaattagatagaaggactaagtcctagtgttcaatagcacagtatggtgactatagctaacaatttatatttcaaaatagctagaagatttgaaatattcaacactcaaagaagtgataaatttttaagatgatatatatctcaattaccctgatttgatcatacattaaaatatcacttataatccataaataggtacaattcttatatatcaataaaaaattgaaaaaaccagtaaccccatgaggttttcatatctattatagctttatattaattgtggagtatgatagaccacaaaaattacagaacttcttgtgtggcaatattctaaccaatagaagcacagaaccaataaaattgaaggaatacctcagactgcctactctaaaaatttattagactttgtggatctttttctttatataaaaacaggtcgatttttaaactctgggactttacttgattttggatttgccccaagaaaaaaagacttgtattgaaacttttaaaataaatgaaccatatcaccaagaaagataactcagatgccactggatatagttcagtgaagccacacatttcttgaagttgtgccctcactgacatcaaatgatgtcaactctacagatattctgacatttctttaatatttacctttttgtatataatttaatgaaagtagatacctctatttatatagccaactcctgttggcaagttcttaaaatcaaagaattcctactttgtgaatttcttttagaatctgcagagtcaatgtctttaaaatggtgaagaatttctttgccaaacaaagtttcaggcggaataaaaatcttggcaccctgggttcagatggagcatctgtgatgcttggcaacacatctggttctgctgctttggtgaagaaacatgcttctcatctcaacatgcagtggtgtcagccgtgtcaacgactctgccagcgatcctgaaaaaatcgtgtctatttctatgaatgttgtcaacctcccgagagccagggctgacacactgctatttcgagagtttttgtcaagaaaggggaatagaagaggaaattcactgctgcaatacagaagttaactagctttccagaggacttgtcttgaaacatttgattgactcttaaatgaaagttctttttttgaggcaaagaaaatccaactatcagaataacccaaaaggaaagagtccattcatagtttgctttacttgatggacattcttaccaagttagctatgtaaaacttttcatttaaattattttagcccaactgccactttggagggaatgttggagacagatatctacctaaacattccaagactggagaggtgcttctgcaaagtggaacaaggtgtaacaaagcttgacaggtagaaacccaccaccagccggaatcactagaaaactctttgaaagctagttctgtttccaatgactttaacatagaggcatgagtatgtaattatttttttaaaatatgatgaagcattaatgatggagagttttcaaaagatgattgcaacacaatatgaattcgacaaggattttggagaaccccaggattcctcaccgtgcctaatcatcacctaataaagccacagcagatcccattgtgttactgttttctttcgccaagtcagtgtttccagcacttattgacatgaaactgaaaagccatagtcaaatggatatcaaagataacaagcccattgctgcctcaaaactactccataatatcacaatcaagccaaacaccacccttcttgtagaagcttgctttggaattgaatgaaacattattttttacttgtaaaatttgtatttatctcaggtgtttgaggaaacaggcattaagttcaagagaacagtggtgagggcaacaaagatgactttataaagatactttatagtctctgtaaaataattcaatttccatggcaaaaaaaaagcacataaaaaagtttgtgtattatgtgtgtgtgcatgttttgtgtcctcttctggggagaaagtgtaaatcttcagattctcagagtctgtgacttaaataagactaaaactccctgtcctttgaagggtaaaacattttaaggaatggaattaatgttgagaagaagtaaaattcttcagctgaaaaatgaagaaaaccatgaatttcttctctattcgccaattaataatatagacttctaaaccagaaagtatatgactgcattaaaaatgggcaataacccactctcatttttgaacaagcttttccaaaatcaaaattaagaaatttggataaaaatatttgctttgttagatactgttttcagttttcatattatatgaaaaattgtgtagctgtatttatatagaccagtgggatgaagttaataatgacaaatgaggaactcagatctagtgctttaaaatacagtattgtttggagaagtataggaaatgcagttggaagttacctgtactagtttcctattgctgctgtaacatgttattataaacctaggtgcttggaaatcacaaatgtattatcttaccattccataggtcagaagtctgaaatgagtctcactgggctaaaaatgaaggtgtaggcagggctgcatttcttgtttgaggctctaggggagaatccttttccttgccctttctagcttctagagacattttcttggcttgtggcccgcttcctccatctccaaagccagcaacagcagtccccaccccctaccagttagtttgtgttttactgataccgtgcaccctgtactttcccagtgggtaccagctgttcattcttggttatttcttggtctttaggtccttctcatacttgatgagcctgtggggttcaggtacatgctttcttggggtgcagatataagggcttgtacttcttgcccttgtagaccgccctgtggttctctttctgagtctggttaatgacagtgagaacaagggggttggattgtggaccctgtgccacctgtcacactgtcaatgtgcagctgggagagctctacctttaggtagtccagctgtctcagaagctcttccttcttgccataaaggtcctgaggcttgatcttggccatggcttcacatgcagctgccagctgccatctgctctgatggcctctccacttctgatcacattaggcccaatcagacaaaccaggacaatctccctattttaaggtcagatgattagcacccttcatcctatctgctaccttaattcctctttgtcatgtagcatgacatctccataggttccagggattaagtcatgggcatttttgatattattctgcctactacacactccctcagttgaaactgtaggaaaggattggatatgcaggaaaatagtgaaaagtagtagaaacctagaaataaacagtctctagctggggtgaaaggtatattcccttattgaactaccctaaagacttaaagatcatgtctgaggtaacctgcatctgtactttgacaataccccttcccccggaaaacctagtcataaggaagcgtaaggatgccaaatttggaatcagaaaagttgagtggtaggtctggctcttccacttgtctatatcctttagcaattcacttaaatttggctgaaccacagtctcctcactttaaattaagtgggttgaactagattatttcttgggtaccctccagttgtaatgttgctatgattctagatgaaatagatagtatttctgcggactcaaagtgagtgggctatcagttcaatgggtgtttaagcaccaataggttcacaaaggagaaatggatccttccctgatttttaatcttattatttgctcttctcccaagtaggagaaaacaagaagaaatagccctttcctgtccaaacatccctcaccccagatcagaatagataataagcaaatgggacatattatactgtgactgtaaaatatacctcagtttacacccctggcatgagatgttcctataatctttgaaagaatatgatttgggaggctggttttcctcatttgtttattgtagcatagttgggttatagtattgcaataaatatatccaaggaacacaaggactgttccaattttgctctagagcatgggtgggtctatgcggttttgataggcagaattctaagatggctgccaagattcgcgccttccaatagatatatcatgatagtctccctccccttgagtgtgggagtgggttttgtaatatgatggtgtattagtctgttctcatgctgttaataaagacatacccaagactgggtaatttataaaggaaaaaggttgaattgactcacaattccacatggctggggaggactcacaatcatggtggaaggcaaggaggaataaagtcacatcttacatggtggcaggcaagagtgagtgtgtgcaggggaactcccctttataaaactatcagatctcatgagacttattcactatcatgagaacagcacaggaaagatccactccatgattcagttaccttccaccgggtccctcccacaacacatgggaaatatgggagctacaattcaagatattattgtgtgcggacacggccaaatcatattagatgaaataggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaaaaaaaaaagaaataggtggtcccatgactaggttgtgttctgtggcacaattgcctttaagaaaaagagattatctttgatgggcctggcctaatcaggtgaggccttaaaaggaacttgtctcttcctgaagagatttgaagtatgggagagactcaacccaacagagattctccactgatagatttaaagatggaggaagccatggaaaatggcaactagtatcagaaagccagcaagaaaacaaggacctcagtcctccaactataaggaactgaattctatcaataccctgaatgagtttggacatggattcttctccaaagccttcaggtgagaactcagcctgactgctaccttgaatgtgacaccctgagcagagaacccaactgagctgtgctggacttctgatctactgaaccgagagctaaaaagtgagtgttgttttgagcctctaccatgtgtggcaatttgttatgcagcaatagcaaacaaataaatgaaaacaatgctattccagttaaatgtggcttaggaatttttaaaaagaagtattttccttgtgcctcctttcttcttgcctttctccaaagccttaatctttttccccacggtgcagttatttcattgaatataactagaaaatgccattttgtcagattaaaatcttctctcatatcacatcacttctcatccccctaacccctcatagttcgtttgagatgccagagatgcccaaatcttggatatattatatacatgttttagggctggagaatcaaaccagaaaacacagatttcaagaattaaagcaaagaatctgtttactttgaactaactctagatatgtttcatttgttacatctagttctcttgaaacacagtaaccttgacataatggctgaagaaaaaggagaagcaatgtaagcataaatggctgaatattttaatatcttttatcaataaacattactagaatgccacgcatttgaatccatgctttttctgacaaaaacctgcattttatcttctgcttcctgatatcgcagctggatcttattacaagggtaggatgcaccatgggaagcatgcctaaactttttaaactacaaaaggaaagctgatcttcattaattagatgtctagattatgcagactgaccactgtattattatctataacatggtgaaaaacaccattatatggcttgttgatagctcctcctaggtaatttagctaagccttatttgctaagatattctattaaccacaaaggcaggatttggtgtcaggtcaaaaaatcagatcaaactgtgactttgtggttgatggttcagagaatgctctataacaaagggaattgagaactcagtatgatgtctttctaacatttaattcaggaaaaatgtcatctccagcacggcttaacatagtgctactacataatgcagataagtgaaaatattaacaagtaaatgattcataacgaagactcaccacgtaaaacctgtattctctgcctttgtgaaaaccatggaattggattaaaagagaagccacctaattttagatttaaacaaatgtgaacaatgggtttgagaatgaagggtaagtctgtggatcacaaaccctcacctgaataatgattagctctttgaataaaaaacaactaatatatatatcatataaatatattaatatatattatagaaatatatttatattatatatatatatatatttaaaaagccataatctggaagaacttcaaaatctaggaatccaggtaaatcatgatttagcttttaccaactttaaccaaagtcttccctggtgctacagtcagtactaaagaaaagctattacaaagctattatgttaagtaattacaattttgtctgcttcaacttcttatacctgtgtctttgtcatgtatataattatgcagagggaaaacaccctaagctcaaatgaaataaaagatttcagtttatgcccacacggaccttgtcaagtagccaatgacttgccctttcattgtgagtgactaatatcaatgctggctctaaagaaagacacttttcataatcgcccaacaatctgctaagtgaaaacatatggataggcttagggaacgcctgccaggggtcttggcagaatggaaaacaggtgctctcattctgtgccacgtaataccccatttacccccaagtccaaaggttataggactaatagctgccttgtggtaatcagggaaagccaagacactggccccggtgaaacatctgggacatattttacatacttccaacatatgcttcaggttcaattaaagtgaggctttggcacatttattaatcttttttacttttatcctataagaggacccactgacctgaccttactattataccatatgagaaaacagaaataatgagagctagaggtcagtacctgctcgtatggcaaagaacacatttgttttctcatgaaattccattacccatgactgtgtacacaaactttaaataaaggaaccaacgaattttttaaagtaggaaattacccttcttccactcagacacactgatagccaagacgtaacatttaccgctgtgaaagcctgtcgagatggaagatggaaccttgcaggatcctttctcatttccatttcttataggaaaaactatatttcaagatgtccacaagattcttccctctattattcaagcacttaaaagcctactgtaaattattacatttgagattttattcagatatgatttttatgctatcaattgcattatgagtaaaaaagaaaaacctccttttttatcgctcaaataaaagggttggatttatgaaaatcagctcacagtcctttcacatggaaaacacactgcttgtcggcatcctgtacagaagaatacagttgaattcacactgcaatttaagcactcactttcaatcaactttggtaactagatctgaaaatgtgttagaagcagggtgtcaatttcagactaccaaacactagattacaatagatgttactccagagatttggtgttgtttcccccgggcatgttccacttgacatctatgttttggtgagctggttaaccaggtgtgcctatttctcatatctaacatcctctccattaaaaatggccataaaacggggagagattagaagtacagaatatcaacaaactgactaaaaacataggttgacttcaaacagggacattaagtactagacttcactaagggtttccatttattaacatttctggggaaatgcctgctgctggggtggatctttatggtggctttaataataaagcagcaacaagcaagagaaaacggccataaatggatggcagctcagtgtttatcagcagagaaatgatgattcagagctggcatattgagttaaaatacaagctctctacagctctacaactgaccttagcaataaatcatatcatttattgccagaagtgtatgctcatgttatttaacattaaaaacaagcacatatgtgtttttgcaggaaggagattttgttagtttatgtttgatgatgttgctaatgactaaatgatgtacagaagaaaaatttcacataaaagctctgtcgatttaaaaatgtttgaaatagcgttagaagggagaaagtgtgcgtgtgtgtgtgtgtgtgtgtgtgtgtgtgtttctgttttccttcaagcattgattaggaaaaaaatcatgtggagagttaactaatcactgaattttttgacatttctcgtgtatgctttcaacacacaaattattttatctttggagacacagcctttggtggcacacaaattcttacactgggatataactgtacatctttactggaatcaaaggtcaagggcataaattaaaatatactgttttcctcctttcttcaaaaaaaaaattcactgctttactacaatataagtcagattctggtgaaggtaaaaaaatctggttttacacgccaaacaacgtggaaataactaacgattttctctcctctgcctcccaatctcaccctaggactttttagattttaggtctggaaatgtccagagatgatgatgtaacagcatcactatcctccttgccatagaaagcagtagttccaaccccagccactgctgcagtggtgcaagatcattctaattcctacctccagttgtcccccctccctaggggacaaccaatccaagcagtcccagaaactgctgttatttactgtggtcaccctccccaaatcaaccagcgatcaaatataagcctctctgaatgggctttcctaatggagaaaccacgtggccattccaaacctcggcaagggcggtgagcactggggttatttaaatgtcctctggagcactcggcacattcatgtccttttgctgagcaattgtttgaaaattacagatgacaatatccatgttcaactcatgcaggctatttttccactctctcttcccccaaagcatggcccgatttgtaatactcaaaataggacaaatttttgcccttcaacaacagtcatcactgctgttatcttcacgagagctatcaagttccagacaagctgaattatttttttgtttgttcttggcagaaaaatatttgacccagctctggacaaaagcaaagaggatttatagccttctctccctctttgcaacacgcagtggcattgttaggatgataaacagcactgtccaattttctggactcaaacacttcaactccttttttaactgtctgtgaaaacagtgtcatgtctacatttccccatccccaggtacccaagtgctgggaaagataattaccttgtcatctttgtcatcttcttcttcctcgtcctctagcatgtcctccactacctgcagagagaaacagaagtcgttttttgtgctcttaaaggagagaattttgttctgtcattttgaaccttttggaaatgaaaactttattaacatttgaaacaggcacactgagaagggatatttgatctagagagagtgattaggaaaatgctctgcctttaattgatgaaaaccagggaaccaaatcccagttaggagaaccggatttatgtgaaatgttttgtgacaacctaaagaatttgaaatatgcataaggtaaaccaatattaatttgggggatgctttaaatcaggaaatttcccttctaccgattctgctgtctgtattaatcaggcactttaaattgagaactagataactaggcatgaaacagctctgctatttctaatttacttttcaccaaactctaagattaaaaaaccatgtctgttaattgattcatgctggtggtctatggcataaaactaacaacatattttatggcccaaattttaattcttatgtataaatgtcaagtcttgcctctctctttttgattttgtggattacccaaaactctcattttaattctctgtgattttatacaagaatatcatgagaatgcatagtataataaaatgaaacttaaaataatatataattacatgtgtatagtgtgtgtataacccacatggttggatatgcatgtatgtattttttaacggctatttagcctacctcagcagaatggaacagtcattttggatttaccaaataacttccctttgccttgatcaacatataaccataggcattcagaatgggacttcactccatttcaggctttttaaaattgttttccacacttcacaaacatacacatatgcatgccacagaaacctacagtttaaaaaactgtgggagaagtgttgttattcaagtaagacccaacttattgtgtttgacatttgatatggtttttaaattcctgtgtctttttttttttcctgatcttgtatctctgaatagactcaacagaatcatggttatcaaatactttaaaacttttctcccaaagctcatattagaggacagagacacctagccctcctttcctgtttttgttttttttttgatacaaacaggaatattctattggtgtacactttaataaccaagactgtattatgaaaagagttacataaactgagataacatatcagaactccgttattcctaataatttttctcaaatattctaaaagcattaactgatttaaaagcataacccaaacacaaacctccaggtctcatgaacgaatatataatgaaagcatctgacaacctgtgagactgtcttaatttaatgtcatgctttaaatcttctgttaaatggtagaattttgaggtctttcatttggacattcagctttcaaaagaatcacagtggtgcaatatgcagttttgcatatctgatgagagcttacacttacttcggagacatataaagcaatgaagcttcaacaagaaagatggactcttgacagtctctctaactatattcagctactccatagcatttattataaacccctttgtccaaggcacatagtgctaggtaatgtgggaatacacagataacccacaaatacttccttctttactcctatcagccctcaaatggcttataatccagtaaaatttaaacagggttgatcagataagctttcatgttaacctttcatttcctcacatttaaagtattcacatcacaaatacaaagacaatagtgacaatatatagttgaagtgatatatgccaggctattccaaattgggctatttgtgagggaggtttaagatggaaaagaagctgcattggtacattttgttgcatcagaagaattcacctaacacttgtaagattttctgaaatgatgattattttgtagctgtaataaaattatcttttagatttaaatgaagtattttttttttttttgctgaaattacccatgcagattcttatcaaatacatcaaggaaaatgagatgaatactatacttttactcctgtgaataaagtcattattgtagctacttataattaagaatgtataatatgcctcctctctgcagtacttactatcatatttcaggtgctatgaaggcaggatggtggtgggctgtgcttagcagattgtcaggtacataataggtgttcaagaaatatttgttgattgagtgaacaggtgaatgcatcatctacccttcatatcatttaacacacttgtgggtaaagtgtctatcatgtatctcacagaactgacttagttcacctggaaggacttatacctaatcaatgatgcagatttataaaagcaaatattcaaaatgctttcaaacatttgcctgggaatagaacccatgaatatttaaccattaaggttggagaatctccactatcttcaaattaattttcaaaaattcaaaataagattaagccataaacaagccagtagcttaatttacacattttacagatcagctgtggatcttatgttcaagtatgactcaaagaggtctacagaatcaggctcttcatttgcaaaacccaaactgttcttaccctgcacaagtgggtaattggctacgcacaattgctccacaaatgtgcagccagaaccacccaatacaaccatttgcttttacatttggcagaaaagtgttgtgttagtgagaggcctttttgctgtgttttagcgctctagtgagggcctttcccctcctccagtgcctttttaaagttacatcataaacatctacaagtgaggatttataatatagatggtttcctatcgatgcctttaagctgcttccgaacataccccactattacattttgctcaggtgaagctgaaggtgccttagaaaatggagatgataatagcacctatctcacagtgttgaggatccaatgagataatgcataagagcgcttaatacagttcctgtgtcaaaggaagtactcaaaaatgttagctattaataaaaataaaataacatcaagttactattttaaacattcatttttggaaattaaataatatattttttcctggacaaaatattctgtgctcttaatgacacacaaaattctgattcatgttttcactgaccataagaaacacatagaggggtacaggtagaagtgtggataaagattccaaattaaaatgatgatgctttcacaactaattttcaggctttaatggtccagtgaaatggatggctttgaggacaagagtgtctcagaagctgagctgtgctttaagacatgagctctagccaaatgcaatgaacatcgaaactgcaaactgagcttttaaaaacaaactgtatatattactgaagtgcatttaatgactgcacaaaattgcaacccttcccagagaaatcaaataccaccgctatttaggatgagagtgctggagtttaacacttaactaaggaaaacaaaagaagggagtcctggtatcaaattctagctctttcctcttcaaataaaaccaaataagcactacatcgttttgttttcaagtatacaaagtccagttgcccaaacacttgtgggcaataatttaatgaacaacatacactatacataggatttccttgaaggggaaaaaatgaagagtgacgaaaaatcatgtagtagaaaagatacatttacgaagttcggttttttctcttttttcttaagggggaatatcacagatcggctctagaattctctttccaaattatgctttctgatacctcgcttgaaagcaagtagtattaatcaaacaaaggaagggcactagggaaatcagaaagatgtaatgcaagcagttaaaagtgacatgaccttctgtaatgtcgctcgtcacagacttatgtgccacacagtcgaggaaggtcttgaaagaaactgattcttggtactattccttgaatgtaatactaataaagatgacatttaaaaaaacacacatagacagccccaaatgcagcatgccagctacattgcagccagagagtaagtagacaacattattttaaaaagcatatttcttcctctatattcaatatttgctgaacatttgtcattaacataaaatataatatgtggccatacatttaaaaaatacatttccaaaattaaacaaaattgtatctatagaccatatattttatgtggttttagaggagctctcgtactgttacaagacttctaattgtaatccaacacaacaaaacacatcttgatttgcaaggaaaatgttatttgactggaaatgttaatagtgatgtcaataatctgaataaaaacatgacatgtttggtattattctcccggaacaaaaatgtataagagaggtgaccagaaggatgcagtaacaagaaaaccaatgatgaaaggatgaggaaaagtgggttcaggtagacttcattattaaaatcattatgggatagtggatactaattattgctttttaacaccaatttaaggtatatgtttaatatgacaagagggggttaaaaggcccatgaattatttttaaaacacttcatattataatttttccatgagtaaattcttccacttatttaaatcccttcaaacaaaaaggaaccaaaaaagatcttggttatgttaaccttggaaggattgagtactctgcaaccaaacctttcaaaagccagtgctgatacaaaccagtttctttcgtgtgtttacttcttttccttggaattaaatggatgttttgctatgttcaaaatgaatagttgcacaactcaaattgctttactcaaatatggtctataaaaatgcaacacgtttacacatttaaagaagaaatcactgctgtccagatgtgcaaccatgttaaaatattaaagaaaactgacacaaaagaaagaagtttcatatttagtttcatattcatagatcatccaaacttgtacagatgcttatatttggatacgttgcaaactaaatgcctatttctaccctagagatacggaagaatttggggagggtagtattcttcaacacagtctggagttcatttatatcactgtgtttgtgcataaaccaagcagaacatgcatttatgtgccaattggtttattatacgtgtaagtatgatatgaaatgatggaatgtctattgatggagaagacgcatataatcactcaaatgatttcaaatcacttgaaagtaccaaaggtcaggctaaagacttttgtggtaagatctttataggtgtgctagtgcagacatttttacgacaggacacctacttctcacaagatttttgagaagaaacttttgcaaactggtataattaattgtatacataattcactccacgtttgtaagaataataagattcaatcaagtctgggatatactgtttcatccagtacatctcgaaagcaactgcatatatgatggctgcttagtttgattcacgctattaaggatttgaccttggagtatttcagctacagtagtcatcaagataactgaaccactagatgtaataataattagtgtgataggcttgccagggaggctgaatatattgcagtacaaaagaaggcagaataaaaaaaaaagcattagtacttactgctaaaagacttcctgatttttacagagacactcaaatacaattattcttctcacaaaatgcatttccttggctcattctgggaagtgccacgttgtaatttagtctgattcttaataaggaatgtggctttaatgtggctatcagatgacttttgatgcatgccactgattacgtacagcatggcttctgcatcatcaacagcagtatttgctgtataatctggtttgccataaggtgcaaagacagtaaatttactttactgaccaaaaagtatgttaccttttattttcttaagtgtcagcttaatatgcagaaaaactcttccattaagaaaggcgaaacaataacaaattctataatcagtataagcctcttaaatttcttttcatatttccttttcggtattcttaagtgttcattcttattctcacacaaagcactatgaacagaattctagagtttatttgaactctgtctccatctaaaggctttacaatgtattgggtttttcacttgcaggaaaattctaatcttggtgtctttaggatattgcatattaattcaattgagtaggaaaaaataggtcaactattaacctggaatgtgctttttaaataataatgcttttatgaaactatattatttgtcaagggaaaaaagtatacaccaaaggccaaaaaattgagttgtttaatgtgctttgcaagtaaaattaaaagctaactctactcaccacgaatctactttataaaatttaatgttttcaaaatattttatacattaataacagagtacaaataaaaaagaaaattatgtacttatgcctctatatttagaaccaatttttccattccagaacctcaactttgtaacaaaaaggcataattttaaatgtttcaaactctgaaaatcttagaaattgtttttaagtgtctaataaaaggtacacattatttaaaaaaatttctgtaaagcaagaaaagggagctgctgtgacattttaaagagtagcatgtcctgcaatcttccaaatatcctttgctccaaccccatcaataattttgggagctgcaataggcaagttatttttcaggtaaatgcacagtttagcacaagtatgcaaaatactatggaaatattggaatatatttccatatatgattccatatatggaatagtactgaaaatactacactttgggaacattagggatctttaaagaatatactttgaaaacaacaacaacaaaaaatttatcttggagattaatgccagcagacttttggaccatattgatctgttaggtttgattcacttaaatttacagcagctccctattttaagcaatctgttttgggtcataaagagggtgagtggaacgggtgtacatttgcaaagaatattctgacactaatttgagttttctttttcttttcttttccatctagaacattttgaggcctgaggacattatgtcagagaatttaactttaaaaatggagcatgttttgtgtgtcaaaaaatcataaagtcagaaaacttcagttcttttcttatatccttttctataaataatgatattttttatcttttttatataaagaataatcacctcacaaaagaaagtcctagtgggtttagacctacatttggactgaaaagaatgtctgtggtgaatggtgaattgtagcataaaagcctgaatgaaaagaatgttcacgaaacttcacacaaaacctccaaaccgttatatcatgagcttcccacaatataacacagaactctatatcccaggaaaagcctgcctggtctacttatcatttctgctttatgtagtgtactgtgtgattgctaaattagtgtataatgcatttataatatttatagtaccaacatttagttaaataacctttaggtaagatttatgttgatttttttttatttctcatttaatggcaaattatgaagagcaggtttcataaagataattctccatttaaattcatcagtccattaaatattaaaattatgtttctgatgcaatcgagaacaaatttgtccagcttcagtgattatttgcactcataaaaattaggcttgattaataaaatttaaatgcttgattaagttgacattttcatgttccattctgatttattagaattagtctccatctccaggcctggtatgctggtgtaggtttacctttctcctcctcttacccgacatcctgagcgagatgttagaaagaagaattttgcttttggactcaatgatgatttcagtgaaacgccctgttctttgctcatggtactgcctgtctttgtcttcatgcacggtgcacagtggagatttgtattacaataatcaagaaaaatgtttcttttaaatatctatggatatgacctgtaaaatggcatatgcttatggtatttctgtaaaattcagttactaaggtgctttaaattgttgaagattgctttgctcaaatttctttatatgcttttattgataaaaatacagtttttatttttgtgggacttccgtatacattgcaaggggactatggatacaggaaatcttactgtggcaatgctattatctttgcctacaggcttaaaaccaagaaaaatgactcacggccatgaaaaaccattctcttccacaggacttacaagggaactcttcaagagagatagtgacatataatgtctaagcccccacttgcttgctgttttacacatggcaaagttcccaggtgtcatctattaagcacttactgtttttttttgttttttttttttgagacggcgtctccctctgtcgcccaggctggagtgcagtggcgcgatctcggctcactgcaagctccgcctcctgggttcacgccattctcctgcctcagccttccgagtagctgggactgcaggtgcccgccatcgcgcccggctaatttttttgtattttaatagagacggggtttcactgggttagccaggcacttactctatgcttaacatgttatgttaattgtctcttaaattcttagaagactccaacaaggtacctattgtccccattttattggtgaggaaattgaagcatagcagaatgaataaccttgtatagctaacaagtagaaggtttggaatttaatcccagatcttccgaatttcaaagcttgggcttttaacctcaagccactggaaagatacagcggtaactcttatcttaaaggtgtttttgctgttgcctatgggagtataacccatttgaaaactttatttaggtaaactgactttctcttgtttaagcaacgctaccagaacattcagttagtttttaaagaactgatagagtatactagtttctttttgttgtataatgaagtaaattcagtaagtaacaaatgacaaaaaatgtccttgaaggtatattttagtttggtcactaaaacatactgtttcagttctatgtacacaagggtagaaacaccttaaagttgtatgctcttgacaaaggtatctcatacaacgctttaaaaaatgaacacaaaactctcagcgttattggactcctaatacttctgatttataaacactttccacaagcagataaagacatatcatttgttttccacttttagcttgttaattggggtcttataatttcttgtcacctttctgaaccaaggacaataattctccacaaatatatgaaactctctgctaccatcacccttcccccaccaccaccaaacagagaacaatgatcaagactagaaatgcaaactagttctaaggtcatgagtcaggccgaaggtgcttctgttggcccctttttctccctccctccctccccatgtttagaatagtttggctctctgccaagaggagagtgcaaagtcatttagaaagaacaatcaggaaatcggtaggataacacatccaccctcaaaccagaattgtgggtatccttttttcctccccagtcttacatctcaattacggaaatggtgaagtcctgggggcagatatttggaagaacagaaatgataagaccctttggcagacatatgggtggacgctttggagaaccatcaagatggtgaattctttggatccatggaaggatttgaggggtttaggaagctggtttttcagtgactctctggggctccagggttcaactgcagctcaaataagtgaaaatcaaccacttatgggagcactaatttcagatttccttcacagctgccaaaaacaattcatttgatagaaaaggagttggggaagaaatcctctataagaactaagagtacctctttgcctcatcatattcttatatgcatctctggagaactgagcaaggtgggaagaattcaggaagatggtggaggctaaaatatgagagtaactggaaacaacctctagggcaactaccactaactttaaactggaagtctctcttctgagtcctaatagatctaaagcaagaagtgtgcattccagtgaggagaatctttagtaaattgacttttaaaaatagaagtgtttcctttacatctttctctatttgaactgacatgtcacgtactggtaatactcatcttccaccattctaccattttatcttttcaattttaggttggactgcagtttgagaattgagtaaaaggatagccaataaactcaaaaagtattaaaaccaaacatggagttactaagtgaaagcaacagactgaggcgtgaagaacaaacagtggccacaggtagatatttaatcccgtttcattatatatgcagtactcacacacatatatctgggactatctaaatgtcttttgactaaacattctgcatgctgtatacagacctcttatcactgcacctattatattcatgtattctatcagttgtttgtttctctcactagaccacaaactgtcctgggcaaggcgtgtgtcttcatcatctttgaaccacagtttgtactgttagtgcctataaatattcaataatatttgttgaatgaaagtaattttgcataaaaattagataatttttatttggaaggaaagatcagactaaaatattttcattcaaacattttttgagtaactcagagcaaaatggtccgagccattttgctgtgttgagattagacacacaaatggaagattcaattagaacaatctgaggaggacccacagtgagccagttatgataatatactgagagtgttgtgatttttattgttatgatttctttctaatttggtcgtgaggtctgtctcttgagagtgaccatgagccacgatagccactttctaggagtgctctgatgagaggaaagtaagactcaggtgtgtcagtcagacgagacacattaaggaggtgaacccaaagtgcataaaacaagaaatttagtacttactggtcccagagaggttagggatgccaatgggaggcccagggaaggctggaggccacagggagctcaaccagtgggtgcggcacgcaagagaaaaagaggacccaccagactatgcctttattaaggtccatggatgttatcccgtggctggtttaaagagagcacgaggggaaatgctgacttggctccagtgctaaccattagggttcatcatggtcagcagctgtggggtgtgttgggttaataggatgagaagcaagtgggctgcagcataaacaaccacacagagagggtaagctttaactagccaaaggggacgggtactgctaggtttcaaataactcatgtcgggccttaaaatggatgcctaagcagcaactatatgaaacaaatttatgacagacgtgggaactcagaggtgtgggctcacttaacctcttaagagtatgagttggtagggtcagactggtagtagggggtgagtgtcagggatggtgctccagaagaaataataatgataattagtggttacccaggcacagctgtataaaatgttaaaggcttaatgggtggcaaattaatattaactaccaaaaaccttcaaaatgcatatactctcacccagaaattcttcaaggactttccaaagcatattaccagaaagggacccaaaaatttctttaggattttctttatagtattgagaaggcaaaatatttcaagcgggccaggcgcggtgcctcgcgcctgtaatcccagcactttgggaggccgaggcaggcagatcacttggggtcaggagttccagaccagcctagccaatacggcgaaatcccgtctctactacaaaaaaaaaaaaaaaaaaaaagaaaaaaatacaaaaattagccgggtgcagtggcaggtgcctgtaatcccagctactagaaggctgaggcaggagaatcacttgaacctgggaggtgggagttgcagtgagccgagatcacaccactgcactccagcctgggtgacagagtgagactctgtttcaaaaaaaaaaaattgaaggaaacatttctaaaaacagtgtttaattaagaagactggtgcagtggctcgcacctgttgtcccagctaggcaggaggctgaggtgagaaaactgattgagtctaggagttcgaggctgcagtgagctatgatggcaccactgcactccagcctgggtgacagagggagaccctgtttctaaaatacacacacacacacacactcatatagtgaaaattgtatagaaattaaaactcgtggtgggctgttttccaggaatatgaaggatatttccagatatgttgcagaataaaaaaagtaggtgagctaaaatgcgttaaaggtgattcaatttttataaaaaacaaaatatgtgtgataagaaatatacatttacatttgtaagtatattttaaagaaaacagtagaaggcatagaaagagtatatagaatatttgggaaactacaagtatactctgctccagatactcctgtgaccactggggctaccccaccctggtcctcctctccagacccactatctttgaaggtcttcttttcccagggtgaaaggcccctcttccagcacctttctcaggtgggtcatagccctcatggctggacagccacttcctcatcgacgccaaccggcttgcctacaagtctgctgtgccagtggaggagccccgaagaccatcccaggatgatgcaccccataagagtacagccttgcaggggctacagccacccacagtgcacctgtgtctttgccagccccctgcagctgcatagacaccatgcatcacactcagacctcaaactcttcatgtgcggcaccttgggcaaggatttcaagctcttccaccacgctgcacatctgtcctcagtgctcacgtgacttccaggcctctgccaagttccagaccctgcctgcactgcccttctccaggccaccacatctatcccatgctgtgccattcccacacacgctctgtgagtactggctttgcggatattactgccttattctgggcctgagtttctccatctgtccaaaggcagaagcatcactcctttttcctcttttccagttgtgtcatgaagacaaaaggggttgccttccctgagcctgtggactgggtgaataggagttaaagcagggaacacaggcctgtgagccagctgtgcttcccatccagctgtgctgtgctagcttttgcaagtggcttggtttcctgctctcccaagtggcgagcaattgctgtccagaagaaagtgataacaaaagagtatggccatggtctggttcatttctgtttcctcacccttagcccactactcccaccttttgctcaataaacactgcatactccaaaacaaacaaaagcaaaacaacaacaacaacaacatacacataaacaatcctgttggaatattggagggatgaagctgaaactatggtttaagtggggcctgctccttatgggtcttctatgcttgaagatgttggggaatacctttatttcagaactgtcaccttcctacaggtctggaggtaagaataaaggtacaactgggatagagttaccagatgaatatagaacatccacttaaactggaatttcagacaaattaagaatattataaaaacatataagtgtaagtatgtcctgttgttatctgaaatttccattgaattgggcatctgtgttttcatttgctcaatctggcaaccctaacttgggtaattcatagggctcagggctggaatttgagggaaatttgcaaagtggaaggcctggtcatctactgagagggaggggacagtggtggggggacttgggatgagtgaagaaaatgtagaaatcttgttggtgcaaatccaaagcctgatgacgatggttattaacatgttgggatgcactatgtacagcaagtgattatctaacaaggctaaacagttggtgaacagctttgagaggggtcacaagggataagctttctaccaacatctgattggctgttgattctacttatttatcctagtgatcgtgttggaaaactaaaggtctggttcttttcatggtcctcctcagattttttcaagctgatgaccttttgaaaaaaactgagaaaactgctgttgaaataagcacgaagaagaaaagagtgatcatccatttttagatgtgtttacaggctgtatgactcagtgttgcttctgctaagagcactgaatatgtggtcttttttggtactgagatgcaaacacaggaaacttgtggtctatgctgctttcagtgaatgataaaactcttactgaagtagagagagtctaactgtatgttcagagtgctttgcatatgacgtcctctcctctgtcagcttggctttggccagcctctttagatcctgttaggaatacttgacttattcagtattccacatattccaccacagacttctttggaatggagaacactggctgacaaaataataaatgtgcttgatttataggagttcaagtcaatcagatgtttctttggtggaccatcccaaactgttcaatcaacagcacttatggcacagagtgctgctcttaggagctttatttgtagagataagtgctctggttctcactggaacagacctaatgggagacaatattcagtactattctaaaagggaaatgaagaaacaaatgctttgtcatgagaaggagctaactaaacacttcagtatttcctaaagtattttagcaaggcagactctgtctcaatttgtgtcacagtcatatcatgagtcagagaatgatttcattgatctgccccactcttcagtcttttaatgccaccattgattagataactgagattgttgtgtgggaggaatatcatgacagtaaaaatgaatgttcttttaaagtgtacttaaaaaacattgaagaatttttttgtgtcaaagaaatttttgaatttattcacaaaaaaattattcacgaatatgaagaagtcagctttgatggactcttcccatgctcaccttggtgaatggaaggtagccctcctggtcacgaatgcttctgaaattaacaggggcacctgggatagaacagatgaccagcaccaattcatgcaaggttactggttaccttacaggaaggaatttggagacacccaggattctatgcaaggccctggacactaagaaagcagtcctttgggaaaggaatgcccatgcatgtagcatagatacagcctgggactttacaacagggcacaattgggttcacatcacacttgctctggggagttgcttacttatcctccttgatactgaattttcttacttgtaaaatggggaaaaaactatttagaattatttactttatataattattgtaaagaataaaaggaggtgatgtctctaaaaggcttagcaggatgcctgatacatagaaattgcttgataaatatcatttttgtttccctgaatgagagatatagaagacatggggtgagtggtgtgggaaaattaatactttctattaatgtgtcagcttgaaggtagagttagtgctactggcttttctgtaattcgtgggagaaacttgctgtaacagtgcccagggagaggtgggatatatccccaagaggaaatgtgattgactggtggttcggagtataaacttcagacagactgctctgtgttctaatactggctctgacactttctgtgtgtttttgggtaagttatttaatctttctggccctgtttccctctatgtgcagtagaaatgatacttacagggtgtgcaatagacccctggtttgcttggctaacctatttccttcattctctgagacttgattctcttttctcaaggaagagctcttgcagccatgcttgtctacatgagcatattcctttgcttacaactgatgaagggacctgggcgggggtggggtggggatggcggcaggtcactcgacttaggaggatccaacccattgactgggctaacacaatcagtttctctctcttggaggaggactaaatgacatggtgaatataaagtacttcacacagagcccacggtgtaatgatggttcagtagtttttaaatcaaagtaaaagccatttcctggcatctactcttccactttcaaaatgtctctctacagtaactgtaatttggatagttggtacaagcctaataggcaatgccggtgagaatttttcccaggttttgaagtgacagctcaaaccaacagaaggatgacattcctatctttatatccctttcacgccagggacatttctgaatgaagcatgtcttaaatggttttctctggaaaagcctaacaactctaatgctagaaattttaatgtcatggtcccagtctaggtatattcagacctaagattgcttatttttaacaagtccaactaggaaacagcagaggtgaaataccatttttaaccacgcctctttcgcatgggcaccctctgagtctacagttttaacctcaggaatggctctttacttattctgtccttaacaggttcagctcattaaatgctgcaaaacttattcagcaaggattacatctgattttgctcattaaactagaataggcaccatggtggggaaaaaggtataggggttcaatgcctgtaatcttaaaggtctccaagaaaggaaagactccttaaacaataaacacacaaagaaacactttcctgtttggtattaatctcaactattagccaatacattgaagacagaattttacccatctatgcatttttcatctttcacagtgtttcttttcttttcttcttcaacttcgtatgtcacggaaattttgtttccttttctttctttgctatacagacctgaaggtcattttgatttttcgtttatagttttcaccctaattaaatttttggcagctgaatgtacagatttttgttttgttttggtttgatttttggtggcagaaaattctttctctttctctgtctctctttcctaaaacagaaagtttcctggtttggaatcagccaatggtgtgattaatgcacctcggagatcctgtaaagttttcacacatgctgaaagattctgtggtgtctctgggatatcaatatggacttacgggaaaataccatacttccagtgctatgcgctatgcaggagagtcaatgcatcgcagcatggcaacccctacaaacactttccctaaattcgtatatatgtgtgtgtgtgtgtgtatccacatacacacacacacacacatatatataatatatataatatatataatatatattatatatgtaatatatattatatatattatatatatatgtattctgtaaccagcaaagtataatccaggtttcttttcaaaaggagcaaccggttcaaatgcacagctggatatgccagcaaacacataattagacaaattggatttaagagttacgtaaggtcttaactgagccagtgaataagaagctgaatgaaacgttgtgattgctgctctggtgcctagaaagaacagaatatgtggatctgtgtgttttgggcaaataaaaggcaattactgggagttatggagtgtagttggcattccatgagagttagactatagaatgtttcacagtgggttgtgctggggaagaaaaatgtccatggctaaaagaggagcgtgttagaggagatgtactaaaaggaaaagatttggtaaatactattttgaagctatattttgcaaaaattatatgatatgcaatttttcaataggctataaaatgtcttggataattttaagtacaaaaggatacattatatattatttttcttccaaaagcggatgtttccaaccaagccaggtatattctggagaagataacaagcaaagtctacagtttcagaatttttcactaagaataccaaaaccagtgactaaatattgaagataagccccccctcatagaattaagaaggtaaaactaaattaccagtttttcctatttgcaaataatcttatttgcaaatttgtctcaaggcaactgaatgaaaagtagatattcttctctctctaaaatcgccatgaagtaaatgggacaaaaaagcaattgtctgaaagagtcctattttcttccagaaaacatcctgaattaattgatgaaagtacctattagtccccatgacaccaacgcttatagcatttagggcttgtctcttagtgtgcaatttaaatatatatccataaaatccttgccaataatactaataacgtcttgtctattggtgctgcctaaccattaaaatctctattagcaatctcatgtttggtttgatatacattacaaagaaggttttgaacatgtctaatttccaaagcaggtactacagatggtggcaaatacaaagatgaacagagttccttccctcacatttataatctagtaagagagacagaaatataatagagaaatatggtgcattgttggcaactttgtcacatactaaaggaaattattttgaagaattttatattttgcttacatggctatttgaagtgtattttgcttgtattttaatgaacgggaagttcttttacattgaaggtatgtatgcaaccattatgatggttactattaagtattatattctacttttaagctgatgatcaaataattctgcataattatgggcacagtagtaggcaaaaaatcgatttgtgatctattataatctacagatcataaatcaaatagagatccttgatggtaaaaaaaaaaaaaacatagtaatctgctgaggacaagtagattctcatgtttgccaacctttaaattcttctcaacagctgtctattgagttaccaaattgcaaatgtcatatttggagaggacactcccctcatttatttacatgtgggaaagctttttgaagttgcttgctagggtcatagtgatagacaatccaaggggaacaaagcttggcagaacatatgtgattatagtgtgggcagctcctgcttcttagtctaaaactcttccagaaagagaaggttgtctcatacaatctgctttcaaaaatgccagaggacaggtagatttagtataactttccctaggttaaatgaaagctcctcatccttaagctgatatctcaatacacccctgacacagagaaggatatttactgttgtccagcgaaccttcattgaactaaggtactttatatacatttccaggtcaacaaccatcaatccttcattcttccaatgaccgagcacaaagaatctatctgtcttaagtaaaatacattcacttagtttgatcattagtaattttgtgacattgtatcttaaatcaggattcattaagatataacaaataagaagaataaagcaattatttgaagtagcacccatttatgattgaaaatcatagctcattctttgatgttgctccctgttttagtttctaccaggaggagtaatgttagaaataagtgaatactctctattgtgttaggaccaaagagttgttagttttgacctgataaaactttcctctaaacttgagtatttatagacagaattcctggtttgtaaagccaaattcaatgttgatcttgtcagagggactcagaataagaacaaaaacacatacaagtaagagagtagagacttactgtatcacgttgcctgttatctttccctgatattatcaagaagtagttccatgtcaatagtaacaacaaaaccagtggtatcatgtagagctcaaagttccagacaacaaagagaaagagctggaggagatagaagagagaagaagggatgagtcaacactgaatttcattaaatggactcttatttatactctacttcaaaaacacaaaaccaaatgcttcagaacaggaagatttatcttgaaaacaaagccttggaaacttttagacatttttctaaaaatataactgacccgtgaaaagtcactggtaagattttcaatctgtttaatttctatgaaggaaaagttgatatcattacgttgtcaaagacgaaatttgagtttttctcctccagtgaaattattgttaagttgaacaaaatttttaaaaagcagcaaaatgaactccgctacactgtcagaaataccctggtttatctgccttaatgataaaaaatgaatcactatttaatatcagggacttttaaaaaatctcgcttggataatacaatgtaacaagcttaataggcagatgaaaataccaggtctacacaagacagccccaaagatttcacaatatgaaaaaaagcactgctacggacaagtgtacaaaatggttggcttaatattcagcattaccatagaaatcaaagagctattacaagcaaattttgtcaaaacaaattttaaaatgcctatttgtattgttcttttttaacatacctacttctccaagtatataaactttttcattgtaagacaaatgttagattaagaactcagggtggtagatggagtcattctaagaacacttacattataaaacaacacaaagttggatataaagtatgactcacccccacccgacaccagccttgtaatcctggacagatcatttaaattctctgggtctatggcttttgctgtcaaattaaggtaatgttaagtcaggaggcatttaacaactagattccactcctgactctaatgctaactagccatataactttcaagcaacgtatatatcccctctttcgtttcttccccagtaaaatggggacgataggattatccacctcagggttgtgagaattaaacacaatgcttggtgtgcagtaatttcgcaaaaaccaaaacccaaaccattattgtgtaaatgttattaatacattacaaaacacagaaagtcaactaattattgattaaggtcctcaagtaatacagattataatactggaagctagaaagccctctgcctgctaagatttagctgaaccatagcgtaactgggagtttcagccagctggttggaataacacaaacatcttgcatttgataggtcaggagagttaggggcagtgccctaaggacacccgtctcaggcacagcagcatgggacatttgcagtcttcttaataaatctcagtgaagcctacagcctatttaaatggcagagaaaattaaacagtatgaaatggtagagagactcctggcctcagggccaggagaccaaggttctgagttttagaaagtccctctgccttagtgttctcatatcttgacagaggtctataaatctaatcatctttaatatttctctaatatttaaaatgacttcatgacattactgtaccatccgttttttcaatgtgacattaaattttgaaaattgtatattttaccgaattcttttatattcataaccaagtgggcaccaaaaagcataaataatagttaaataagccaagaaatgattttggacagaattacatagtaactatagattcaagttcctgcataagaaaagttccaaatattgtaatacatgaaacatgagccatatcttttattttatgagaaaagtaggaagatttccagaaaaagaaaaatattttcatttaatttttgaaatttatacaattatacaaagatgatataaataattgatggttatgattattaaaatatattttataaagataattatttttttaggaagtgaattaaggtaaatgtgacagacatcaatacatgtaaaagggaaaatcatttttggctaaagtccatattctttatatatttatttgtagcatttaggcagtcactagaatataagctcctttaaaggtagactttttgttttcattcactgttttatccgtagagcctggaacagtacttggggcatagcaagtgctcaataagtaaatatttactgaattaatggataaatggacactgggttccccaatcattctacagaattctatttaattatttgtattagcaaaagttctatagatctactatataaaaccaagtgacttcaagaaaatgcattcagagttacaatctgggatactactaacaaatttctccctctgacaaaaaagtctaccttagtacttcttctagacaagattttctttccatttggctatgcagtcatgaactattttggatattatggtcttttctcttggaccttcctttatgttccttttctgagggcattcatttgacttagtgtgttctggcgtcatggatgggactcagattatcccattgctaaatatgaccaattgtaatctttttaacctattaagcagatatgttttcccttgtaatgtccattcattggtgttagggtcctcgtcttattcagaatgaatttccttgtaatgtccatggattggtgttagctgcaggcctgtcatccacagaaaaaactacctaggtgacaatcctgcaagcaatcaagacatctttcatgcattcttcttctctagatttgacatcaccacttgcttcaagcatcagttacagattatggtttctaggcacttccccattgtagtcatcttcctcttaccatatccaaatcaatacatcaataactttcttaaaatatagcactcagaactgacacacacttctcataaatgcctaaggtatttttatatgtcctaataacatgggcaccagaacatggattggagaaagacacagaagacagagacacagaaagaaattacattcattttaggaattctggcaatagaaaaaccatctccttttctattgtggttttaagaatctaatatttgggtaattgagtgaggagctcctactattgaaaaaatatatatttttaaaacatgagagctttgaataagttgtaaatacaaaagcatttatttttctttttcagcacctaaatgaagatttcaaaaggttaaagaacatgaacacagattaacaataaaaatgtatttattgaacatatatgttatgaaatattagatgtttgaaagtagaacagccaatcatttattcaatataatattagtgataattctaattcctgttagctggtgaggctcctctaataaagagagctctcgaaggaagaaaggagctttttagctcattcactccacactaaagcctcttctctcctctctctttggaaagagatcagtcttctcctctttcctataaaaaactgagataacacaaaaggtctggcctttagtgtcctactagggtagtaagagaaataaggcagctggaagaaacccaaggagggccaagacaatgaaggatctgtccttggtcctgattatacattttcagaggtattgggggaaacgagagatacaataatgcattaaaatgggatggaaaaagaaatcaagaaacaattttaaaaatctctaatgtattcacagaatacaaaaataaaccataaaatgtctagcatttgtccagatctgcatttctggaattgctttttgcctctgtgggtcatggaaagaggacctgcagattttagaattttttgatgttacagtgcggtgataaggacactcacaaatgtctacagagtgttaaattccttcacctccttcactatagcaccctttctgtattttttcctctctctctgtcacataatctcttcacgtctcccccatctctccttttaataaggaaacaggctgtctacattttactctcatggaatacatgcccaattccaaacaaaacatctacccctatgttagttatccatgttcattagagactagaactattccaagaatttggtggctttcttttttaatcattatatggctgttgtaatttacaattagaattcaataccagaaaatcttcagggggcattagtcaaatggtaataagtacacacaacccctttcattagaaaaagaacattgagagttttactcattatcctgcatgttagaagctctctatcaactggctttgggccgttagccatgactgtgggatccctcaagaagctgctgcagtgtggtacagtagaaagagaacggtgtttgaatcaggcctagaggcatccaagctctctagtcaccagctttgggaccttgggcaagttactagatttctcttagttttgtcgtctgaaaagtgaaaatgatactatttacttggcagatttgagaagcaattaagccgatgcttgacatctataagatgctcaacaagcattaggtgttctgacaagcaggaattgattggcttacactacatataattttttttggcccttctagcagcttatcactttttgtatactaccttagaatccatagctaatgattgtttcaagtataagagctatgctaaagaagccatgccaactaaatagaaagagatgatgaaatgagtgccactttcagtttttcatatttaatttgtggtgactgagtacagtgatgaccccgatttttccatgtctccctgtatccatgacttttataatagcctcccacaatgactgagattaggcacataacttattttggtcaaggatagagtagcaaatatgatgaaaacagaggcttaaaaaaacatggggcatagctgcctccatcaccccagttgaaagccagacagcatccaaagcaaagccacctgacagaccaagaagccaaccaaagatgcaagagtgagcccagagctaggcctagtccaaactgctaacaaaatcatcactaaataaatgatagttgctttaagctactaattgtggagtggtttgttatacagcaaaagctcactaatacatattattctctctccaaggagacaatgtggtagggtaaaatacagtttcgactagaagcccaaagaagtgatttcagttcaatttctgctatttgatcatcataggaccctgtgcaagtcaattattctcttttcctttagtctcttacctataaaatggagatggttacaccagcccatttcacaagttggctatggaaaagcaagtgatacatgtgaagatgcttcatcacaaagtactatattattaatgtaatgcttttcttttcttttcttttcttttttttgagatggagtcttgctgttgcccaggttggggtgcagtggcgcgatgtcggctcactgcaagctctgcctcccaggttcatgccattctcttgcctcagcctcccgagtagctgggactacaggcgcccgccaccacgcccggctaattttttgtatttttagtagagatggggtttcactgtgttagtcaggatggtctcgatctcctgacctcgtgatctgcccgcctcggcctcccaaagtgctgggattacaggcgtgagccaccacaccaggcctatgcttttcaaattataaattaattttaagaaaattacacagactttataaacttaataagtcaatatgatcattgctctttgagcagttgtagaagacgagtggtgttctttagggtgaactgtatttggtgaggaatggagaagtttttggtgggaaatcctaagagttaaacagaagggttccagttaaaagctttactaataattgaaacaaaaaaaatctagatctttacaaaaattcattattactagtaaatggccgaaacattaaagattctgtgaactcaagttaaaacaattcagtattaaaatgttaacaattttttaacaatcttattatgcccctatatatgaaaaaaagcttgttcggaattagcagtttcatgaattctaattcttgttcatagtctttgttcatttttaaattcaaaaatcttttatctaaatcagtattatcttgcctatgatattagtggcaacattacaatatgcaattttgaagtatccatttgggtcaggctttaaaaacattctaaattttaaccataaatattcagaatgagggtttttttttgaaaagttttaatttaccacaaggtaaataggccgggcactgtggctcatgcctgtaatcccaatactttgggaggctgatgcaggaggattgcttgaggccaggagttcaagaccagcctaggtaacctagcgagacctcgtctctactaaaaacaaaaaaatgtagctgggcccggtggcatatgcctatgatcccagctactcaggaggttgaggcaggaggaactcttgagcccaggaggttgaggctgtagtgagccgtgattgcaccactgcactccagcttgggcaacagagcaagaccctgtctcaaaaaatatatgtaacactatttctcctaacaagtatcttatatcatatcatattgcacagagagaactttaaggaaaaagtcctgagaggcagactgggagggcagggactattaccttccttttacaaaggaggaaactgaggcttaggagtttgagacttgtctgaagcaagtctgagtggcagagccaagtcttctccttcctaatctagtatgctgttcccacgaagctccactgactctacagtaaatggtcttagattgaatgttgatgttttaaaggtatcaattatttaggtactgattatccaattgtagattttccatatctttttcttctcttcccccttcctctaggataactactcttgcgtcagtacaaagaaatggaatgccacttcttaggtgttctggtagaggtttggtatggcaaagaggtcaaaaactaacagcggaaatgaggtttgtggagccaattttattcttccttttttcccaccatcttacacgactctgaataatcaaaacttggctattcataagatttctattaagtggggttttcttctgtccaaaatgtttagaagaggttagcaaggtggctgtaaaggcaaagattggaaactgaatgagccaattacatttttacagaaaaaaaaagtcctactttttcaaataaagattaaacaaacaaacaaaaatctgttctgctgagaagttaagtgaaggtggggcaaggcttttcagtcatatgaaacaaggcatactatacaaagtagagtgagcaattccaaattttaagatttttatagcaacaccatttcttaggaggtgcaagacatgcatgattttgatttctttgagcctggggttttatgagtctcaggcaggactgggccattcacatcatcccatcaattgatgctctcattgaagtgcagtggaagatgcctgcattcaatgatcattcagtgcgacacatgacagtatccctgggggagcccacttcaaaaaaaatcatttaagttggaatattgaatatcctattcttttgcaaactacagtatattttaaaaagaaatctcatccaaaatgattaacacttcctactgttcaggaaaaaagcctgccctttcagactaacagctgtggatcattagctctccagtgatgagatgtgtttgatgagtatttttctttctaattaagagatgagattctctatttgactgtctcttcagaaagaagtgaagaaaaaattttctgcctacatggaaaggccatctcctacaaaacaattaattatttcacggtccttttagaaaatccttttccttcctaatttcaattcatttttttcttaaacttaacacacatttacactcagaccttcacagtattaacccattttttacccaatcttcaccccttaatgttttcctgtatagttcatcattcgacaatatctgtttcagaaaaaacagaatgaagaaatgtgccaaaagtgcgtatatgcttagaagagttaatctggaaggacttttttgggtcctaacagagaacatttggtatgagaatgtttcttgatgtgagagagacctcaaattagaaagataacaaatacacaggatatgccttttgaggaactaggcaatgattggggggaaaattcaaggtgtttatcaatatataaaaactgattatagtaatgaatacttaacaggaaattatcttacctctaccaataagattggccttaaagaagagagctgggtaaagtgagacctaaaatatattgcttttcattttgaaaaagccatcatcagagttggcaaagaggtaaaatttctgaattacaaacttgattgaagagtaggatagttagaagccaatgaaagcactgtttgtgaattaaccccaccaattgcctccttaaatcctttttggcacaagaaagggaatataaaaagaaggaggatcaactttcaaacatttcgatgctgagctgccactttcctccctagggcacatttggaaatatgcagggatgtttttagttgtcacaatgactaggatgggagaagggaaatactgggcatttggcgggtgaagccaaagtgaatcactctgaaatatgtgtgacagtcatacccaatgaagaattttcctgccccaaatgctaaaagcactcctctttgagaaaagttgtctgtttctcatatagataatagaatattctataattaacttacaaaagaagaaactatatgtgtatatacaagtgtatacagaaaaaaagctaggtatatttcctatgtgatggcatgaattatgacttagagtaagtcagtagcagagaaaaaattgtccttataagcatttgaactagattctcctactaatgtttaacatttctttaaaacatgcccaaagtactggaggtgaaccccttatgcccatttacactcactcaaattaagtcaggctccaccacatcatcagagtcttcagaacctagtcttctgggaaggaggtggttttgccttgatttaaatagccagatggcaccaccacctgttcaaaggtctttatttctggttggttccactaaagctttttgtaccacctccattcaacaagggagaggagataggcaaagtgaacttaattaattcctagcataacgataaccttttcaaggtggttttaaagtatgatgtgttgctcttctgaagagaggctttgctttgtttggacaattttctaaagtacacggtagcagggaattgatgactaccttagacccactgaatctttccaatttattttgctatttcctgtgatcatgccacaatgatacagggagcattaatatgctcaaaagagcctcatgtacagtggcatctctcccttctcttaattagaatgaaaattgctttctttttgactagtttcaaccagataccaaactgacaagacttgatctgttgtgttttgttgtgtgtgtgtttcttatgtgtagaggaaaaaaaatcaaagtgcactatctaccaaatgactctatattgagtaggcaaagtgtgtcaaaagaactatctatctctgttctggtaacaggatgaggtatatgggaaggagtagaaaaaaagtgagaaattggttgatttattggcaagctgtgacttgaatacatatactgaaactttatttattggtggtgttgaaaaaacattgtttctttggatttactaggatgaacaaatatacatcagaaagttccaattctttatattgtgaaaatgtatgctgggtttttgaagttgctatctgaaacctaaagtctacaatcttagtacatcaatgcttttttgaaaaacatagcttgactctatctattaaagaagcaagtgtgacaactagataggactcatttgaagatgtgctacatacaagccacaaaagcacctagtgaagaatctccacaacaaaatggacccaaacagccttaaagatggagctatcaactaatcatagcataatgcacactactttccttgatggagatattatatcaatagaacctgccagccagaaggcttgggaagttatttatttaaatgtttttttttttcagcttacaagttgtactgataatttgtgtcatttttatcaaagtcagagatgaaaggctctggctttgctttgagaacactgacaactccaaaatgtaaagcccagagtatgtccaacttgagcatcacataaccacacatgaataactgataagaaatccctgcaatgttgtgaatttaatgttagtaaaagtttggatgtagaatgaaagtgacaaatgcttatagatgcctggagaatgttgattctccaaggtccctttcattagaaattagtctgttacctttgtagtttgtaatgcctaccacggtatcaaacacagttgatgttttaattttaacagctttgtaattcacagaagttcagctcattcaaaatcaggctgcaagcacagtcattcttgcagactacagatcagcacatatttattattttaaatgaccaattaagaggaattgatattatgtggcctgtgaggaagttgctggaatcaagtaacaatcactctaaaaaatgctcaagtactacattaaagaaacatttaagaatgagttaacgctgttaaactcactgaagcttgcctttctctagtgccccgttttcccaggatccaactttttctggaaagacccacgactatctcactaatgctaggtaactaacagtccatgctttaattattttctaaggaagaaaaaaaagtgttttaatgttggatctcagttgtgttttagcttttcttcttcttatgcctccaatgaaaaagataactttttcatgatagtctaatcattacatgatgttctgatattccttcctgtctttcaggtttttaaattattgtttaacaaaattgttagattcactgtgatcttttatttaagtatattttacagaaattgacaatttctatatattttctaaggcattagaagtgaggtaaagatttattagagcttattaaaagcagtttccttttaaacttttaaagaaatgaatgttaccactcctatttttgaaatcaatttttgatcagttcccctttgtgtatataaatgctatatctagacacacaaatcttacaccaatgtttgctgatgtacaaaatgtaaaatttccctaagcttgaaatctggctttaaagctatctccatcctgaacaggtacaatatttagggcaacagctggcacttcagttgctcatggggggaaactccctctgttctctatactgtgccagaaaataggatacccagctatctaacaagccaaacacatgttagtaaagtctgtgatacaagttactttaaaaattagtccttcagtctttacacctccagctctaattcactgaacaggaatgcctttagaaaagcagatgatcaattatggtaattccttttttatagtagctgatgtgcagagtgttgcattctgccaagttctgggatatttggtagcattctgacttttttccactcaaattatttcactcagacttatccaacttatcacgactatcttccctgggctactgatttctgatctttcttttttatccttcatgatataaccttgcagttattgttgattattctttgtctgggtttaatatcttcatttaaatcttaaaatcacagagccaaagtcagaaagtgtgtttttaaattttcaccctcataaatagatttaagacctaataatatcatacatttcagctatcatttactagcttctgaaacttcatctcccattccgtcttataattttctaattttctccttcactggtctcattcccccaatccctctgttctggaaaaacttcaagagttatgtttagcagctctagctatgtctgaacatttctctttgcaattcaaataatcatcttaggctgattttaacagccttctttactccattccatcttttacccttgctgcgtaatgtttactgatgaatgtctttctcccatttatttcttaacagctctaagtggtctagttactgcacgggaagcctaaaggtttgagcactaagtatacatttctcttggctattttccacacctctaaacattctcttaaatgcaatggggcttgtgtttcaatggtaacagaagttatcagagaacactagtttagacagcaagcaagccgaactccaactgttcaaacagcctgacttttacagtaaaaggaaaggccctgggccaagaccactgagatgagcaggtatttttagttcacttgtaggccagctctaatgtaattctgaaatgttttcttcaaaccaaacccgactttttcagggctgtccaaatctgttttcttttatagcaagtacaaattcttggagcaagggaagcatgcgtatcatttgcaatgctgctgcatgtctatggtgttgatgcccgatggctcaaattagtccgcaaaacagatgagcgcattgtaattagctcttgtcaaactgttagaaatacaaaaaccaattccactgtaataaaaattatgaaaaagaaaaatctctcctatcattttcagccaaaatagttcctgaaatgtctgtagtttaggattccagagttctaaaagaaggccatttcattttcagaaaagctttcacttcattgacatggagatgccgagatgtattatctttcaggcatttttctcattgtagctgattgcccataaagccctgtttctaaaaatgacctgtcaggagtggacatattttgttgagccacacggtactgatgtacaattctcaagaaacatttatacttctttgagtactgttttaaagaaaattttctgaagtttttaaaatcaatgatttactgtgatcaattttccagaataattgaatattgcattctatttaaacaaaaggggatattaagcaggcattaatcgtaggttcagatgtgatgtcacactctcacatgatgatcctcagtttcttgttcacaatttacttgaatattcattgttgggacactgactctaaagactactttgctcaatcttttaaattattcacaagcttcaggaaggtttcagatctctctgaaatttaatgtcctctcaaggaaaaatgtgagctattggtagatggctattgtaaaaagcaagtgtaaacatgaaccaaaaggtggtgctgtttgtgattaggtcagggatacgaaaaaaaaaaaaaacccaaaaaactaaaactaaaacaaaacaaaaaaaaaacccttctacatgtcttctgaacttttccaaagataaattcaggtgtatttgtgggaatgagcacaataacgtaaaatgaaactatctttaaaagtaataaaattactatatacagaaaattcaggtgaacacctgtagtcttagctacttaggaggctgaggtaggtgatcgcttagcccaggagttcaaaactgcagtgcactgtgattgagcctgtgaatagccatagcactccagcctgagcaacacagtgagaccttgcctcttaaaaaaaaaaaaaggtgatacaaaatggatcatagaactaaaaccataaaacctctaggagaaaatatttgtggccttggggtaagcaaggtatttattcacagacacaacaccaaaagcattctctctctctctctctctctctctctctgtataaatgtctgtgtgtgtgcgtgcgtgtatatataatgtatatttaaaaatttggcctcattaaagttaaaaacatttgtgctccaaaagacaccattaagaaaatgaaaagataagccacacatcgagagaaaataattgcaaataatatatctgattaaggacttgtattcagagtatgtagagtacttaatacgaagacaaaaaccccgtttaaacaatgggaaaaagatttaagtagacatttcaccaaataaaacatctgaatgtcaaataagcacatgaaaagatgttcaaaatcattagttactagggaaacgtaaattaaaccacaatgggataccacttcacacccactagagtggctgtaatcaggacagaaagcactaaatgttggtgaagacacagagaaaccagaaccctcgtatgtcattggtaggaatgtaaaatggtaagcctactttggaaaacagattgttagtttcttaaaaatgtaaacatacatttaccacattaaccaataattctactcctatcaaagaaaaatgaaaacatatgcctacataaagatacatacacggatgtgcattgcagcattattcatgttattccctaaatagaaacaatccaaatgtttatcatctagtaaattgataatcaaaatgtgctatatccaaggaatactattcagtaataaaaagaagatacctgtaatcccagtactttggatggtggatcacttgagtccaggagtttaagaccagcctgggcaacatagtgagaccttgtctctacaacaaaattttaaaaattagctgggaggggtggcgcacacctgtcacttgagtttggaggtcaagtctgcagtgagccataattatatcactgcattccagcctgggcaacagagcaagatcctgtctcaaaaaattaaaataaaagaagacactactgacacattctacatcatgaactcaaaatcaccacactaagtgaaagaagtcagatgtaaaggacatagtgtatgattccatttatatgaaaagttcaaaaaacgcaaatccctagagacagaaaacacattagtggtttccaggagctggaggtgggaatggagaggactgtatcagtcatgaaggatcctctgaggtgatggttgtacaactctggaaatttactaaaaaccagtgaattctgtactcaaaatgggtgaatgttatgacatataaattatatttcagtaaaacaaaatttcacctgttctttatatttcatttaaaataaaaagtgctaaaaataaatacacaatacacaaataaataaataaaaagtgctaaacttttgtgggggtaaattccaatacaaataactgagagaaactaggctgagaaagttaatggtaaggaaccttgggtgtatcttgccaacacttccaaaatattttaaaatgctagtcgatgacactatccacatgatgattctttggacagttggtcctcatttgagttcagagaagtttcactaaagccactataaaatagctaaagcaaatatcaacatcaatctttgctaattataactggaaaagcagggtcctagaggcaggtgatggaaagtggcaatataatgctaccaccataaggtgaggctatcacgcaactataatagttctaaattcctatgaaaaatataatcagttaaaattttttgaactccttactttctaaataagaaatggctgagaatatgaaaaaaatgccaaggaaaactcagtgagagaagacatggaaagaaatagaaaaggacagcttagcccaacatgcagaaagaaaaaaaaaagttaaaagaaaacaaaaacaaaccttggcacaggagaatgaggatagtgtattcaaagtcatcttctctgccctgaagaaagcactactggataaatatgacaatgtttccttattttgtaatcttgggtgaggaactcttttaatttgggcctagagtcttaggttttcatttgcattcctcagtgatgtctgtcgccaagttacctatagtaccacctatcaggaaataaaactccttagccccacattcgtctacgggaaatacagcaggaatacatgttatgagggatttgttttatttttccggtcagcaacagtcagtgcctcccttaggttggttgggtttgtttttctcaatatattacatcaagaaaatagaaacgaaaactgctgaacacagcaggacaagtgaaatacacctgaaaaccacttccaactgtttttatgccagcacttccaaaattctaggataaccccatatcttcctatactgctacaaaacatttcttaatatttttcatgataaagcttaatacatgtgtttgttagctaagttatataatatcaagcatggaaaagcaggtgggccctggcagatttccccttctttctacagccaatttctctatctatcaattgctgcaatctaaactgcctccctgttctactgtcagcttttctggagctattctatctcccagggagacaggtgtggctttgttctctaagtgcatgacactgggcgaatccagctcccctttcactagttcagttatggcaacattgcacttctttcatttatgtctttgcctttcagatatgtttgaccacactcctgtccagaagtgttcaccacatttctcgctctaataaagacatccgctcagtggcaactctggattcagggtttactagtgtaataaagaggcagcaatgtgtttcctcttttctagctttagatcagtcttgaggaggcatacaatagtgtacagcttttaaataccagttagaaaagaacactggctcaagaccgtctgggtcttggtctcattgtcaattagagcaatggtaaatggaatggagctggtgtcaaagagagggcaatatgcgacctaaaagcaaaacacacgtcataccatctatcatgaaatgctctgggttgtctgcatagctttgttttcctctcctttatgtctagtttatgcaaaatggagggtaactggcatacagatggggaggaaaagcctaaaaaggaaaacaagaaaaggtaaagtaggaagggctgaataatgctaagacttctcccataaaagaagtaagctttttttaattgagaaattttgtggataatgacagccctaaatcagctgaaatgttttagtgttcaaggtaaaatacgtatgtataaatatgtttgccaagtgtatacatggatataacatctttgtgtatatggatacaacattagatgtgtgtatataaatttatatcatgtgtatatttatctgtacttttattcatcccatgggaagtgtgtatccataaatattaagtaattatgtgttggcccctctccctcaactataaaattaaaatatcaattcaattatactatgaaaattcattaaatgctgttaatgtttatctcacttctaagaaataattttacatgaattaatatagtactgttaatatatttaaggatttttattattttgaaacctaaataggaattaaatatgaagctggatttaaataatttaattaaataaaattattaccatgaaagaataattataactaagcatttctatgccccagaggatcatttaacttttttcccctttatcaacttcaattatatgtttttatttttattcccatattgcagatagaaaaattgagtttagggtaaggcaaacattttctatcatgtgccatagcaatcatttttaatctctacttcacaatcttatttccaaaaataaggtggtaaaatttgacaggattttaaacaatttttgtagcctctcttcaagattgtatgaaaaaattctaaatatataaagattattgaatataaatgagtatacttaagggtattattttattaatgtactctaaaaatttctccttgtccattaaaaaatgttattttcttcttcttacttcctccccattttaagatccattttagactgtgttagagataaaaggtgtcaaagataagaaatgctcttgataacaggtactgaaaacctgtaacagagaagccctatgtcttgttgaaaatctcttatcatctcaaaccttcaagactcacccagtgttttggcacagctaaactgtgtctgggctgggtgcggtggttcacacctgtaatcccagcactttgggaggccgaggcaggcggatcacgaggtcaggaaatcgagaccatcctggccaacatggtgaaacctcgtctctactaaaaatacaaaaattagctgggtgtggtggcatgccgcatgcctgtaatcccagccatttgggaggctgaggcatgagaatcgcttgaacccatgaggcggaggttgcagtgagccgagatcgcgccactgctctccaacctgggcgacagtgagactcttgtctcaaaacaaacaaacaaacaaacaaacaaacaaacaaacaaactggtttactatgcagaaggagttgaaacttgctacctcttaacctttgaactccaccatctttttgacaattacaagggtctcagttccctgaagcactgattactataaaaagtacagtgctggtttctgagggatttttcctattgtcttattgtttcttttgttacacttcaacctcaattctaggtatattgtagttgtactaatcagacttaatctgcaatacaagtaagttattatggggaaggcagcatgttttaccaaagatcgtggatcgatttgtatttatacatatttcctcttctcatctgaaccattattggtttacatatatgattttggccctttttaggaactgttggccgatccatcatctcttacgattgggctctcttgttcttctgttcagcactctgattttccttggggaaaccctcccccacttttagttgatggtttctggtggtgccggttccacccctggctctgcgtggtggacatttgacccagacctggtcaaaaagagtatcagctgctcctggttatactaatcggttcaaggatgggcaaatcagaacagtgagactcaactgtgggtctttgggattacagcaaaaaagaatcttttttcccctgaacaaaagctagaagaaggtaaacctgaagatatttatggccacttacgggaaatcctgtctaagatgaatgctaacgcagaggaaaaccaagccaagatatggcaagaaactaaggtctgattgaattcttttagcccctgaagcagacatgtctgaaagtatgatttggccttccacagatacacatacaaaagtaagtaaaaaggaccatttaaacatcttggtgtaattcttacagattttgaaaaattttaaattcatccatcacacctggcccccatcagacataattagaatctctggcagtagggcctggaatctgcatttttagttattccctgagtgtttcaggtgatcagctaatttaaagacccattatgagttattgactaaaaattctcactcttctcgaacaccatcaacaggccatatggagtttacatactgcgctagaggcttcctagagagtagactataaaatagataaagtaggttaagggctacaattactctccttctgatagctgtgatggctctaccctttctcttctacagtcaggaaagagaagagactgcaaccatgtggtagaaactttaatgaaggaaggtcttctttcttcttctcaatggcctcctggtaaattaaaactgtctctaatccaatctgtgttctggcaagtgtgagacttaccttcctgctacctgtttgactaggatggtcagacggaatgactggataaaatttaatttgaaagagaacacccaagatcttaccaaattcaatttttctcatcatcttagaaaattcagataacctacatgggaggaactgaatttgactgttaggtcttagaatttagaacaaggggttattttagtgtcataatttcctagggtgtaaatgcagtgagtgggggtgtagatttccaaatctcagttgacttggttggtttctttacccagttacataaagcaagataaactacttcaaatttatttatttatttatttatttatttatttatttatttattcattcattcattctttcattcattcgagatggagtctcactctgtcacccaggctgtagtacaatggcacgatctcggctcactgaaacctctgcctcctgggttccagccattcttctgcctcggctcccatgaggagctaggattacaggcgtgtgccaccacacatggctacttttttgtatttttagtagagacggagtttcaccatgttggccaggctggtctcaaactcctgacctcaggtgatccgattgcctcggcctctcaaagtgctgggattacaggcatgagccaccatgcctggcctaactacttcaaatttatactccttgtctctgattggcttcccttagcactcttcagcgtacagtttttcagaaaggttgagataaacacaatattcatagatttcctgccttcacatctgtttaagggtggtttccaatctttgcagaagtgttcatctatgtcaattctaagggtagacaataggtccaatgtggccatcctgttaaaaagaggtgattatttattctccaaaattattgacctttttatatcactagacattctgagtgagtcttctccatgataattcaccagtcaaccatctcaggccaaaattttacctaacagcaggaggattgtaggcacaatattttaccattgactcctgcagcttttaggaaaattggccacaaacaatacgttttcagatagttcattctggaacttttcaagatgggcagaaattcattatagataagttgcacgaagtcctctgggcatccaatgattaatgatcctatagaacctgtccttctgtgttatcttgaattgggttttgtggaaaagttgtcttgatggacaagaattttcagtgagataaaaccagatgtgttctaccctcttttacaccatgtggcaacttctttttaacttgtaccttgatgacttgtcacttttgactgactggatgcaaagcaaaaggaaacaacagaaaaagtgtttcctaacatattgatgtcatggctttattgtcacaaaataggtgtgagcttaaaaaacaaatatctgactatttaatcagtattaaaaaatagctcgagattaatcattctaaaacccaaatgattatttttggcagatgctctgaagcactcaagttagttacagttaaccactctgaacaggatcttatcaccaaagcatagcaagttttggcgaaggactcacaggaagttataaggttagctgttcaatggttgctctaatgggaccttctttatgcctatggtagtgggagtttcataacaccttctttaacattttttgcaggctaaaataatcacagtcatgctctttggcatagaattttgaggtttgtgagaaaaaatcttgtcccattctcagcccatgtccatgtggaggcgaggtggcattttacagatttatgttttggttagacttctcaacttttaaaagagttgtcaactatattcccatctcagctgaggcttaaagcatggtctgtccctaattggcaacagaatatttgcactccaagtacttgtcaaaagaggataacgctgaacgcttgctgcccagtgcctatcaaaaatcagttgtgagaaattgtatttatggaaggttgcctgaaggacatacattcctttttagatcttctaaattgtatttttggatttagccaaaccatttgagagtaacatacttaaaccccatagctatgttacctcaatagttattgtgtccctgtgcctagcactgagataggcgcttttcatacttgagtaataatctttaaaataaccatgcaaggtaggggttaatatctcttttccagatcaggaaacactcccagcactgtcaaatagcttgctcaaggccacccagcaagtaaatggcattttacacaattcaaaccaagtctatctggctccaaatttcatcgtctgtatatagtgctagagttgctttgacggaactgcattttggtgttgcagcagcagcctctactgagggaagttaaatgaaagaattctgtgaaacacaaaactgtatttaactctggagattttgttcacattatacagtgtcagctttataaaggctcttgaataagagcttttgcggtcttagtactggaaatagttgggcttacactgagcaactaatgggcttaaaatagaaatatcaagaaaattgtgaatcatgtatctgatagggtttcccttcatcgaccttctgggaaacacagattcgacattttgatcttcccctgtctagtacttgagctctgcattttatgtgccaccttcagcactagaattaacgtattttttcctcctgttctctaaccatcagtgtgattcctttatttagacatgcaatttgtaatattgtatgtatatttgtaatatatttccattacttccatattttcccagtacaaataaaaagcctacacttattaagcatttagtatgtttcagaaactgtgctaaatggcattatactatacagttgtcccttggtatacaccagagattggttccaggaccaccctctgatacaaaaacctatacacactcaagtcctgcaattggccctgaggaaaccaggtacataaaaaaattggcccatcctatatgtgggcctcacatcccctggatactgtattttctatctgcatttgattgaaaaaaatccatatataagtgaacccttgcagttcaaacttatgttgtttgagggtgagctgcattttctttttagtaactgtgaattacgttataccattagcttgattttacagatgagtagcatgtggctcaaagaggtttaaatattaggttgctgcaaaagtaactgcagttttgccattaaattttttttgcatggttttcatatctgttaattaatttatttattatactttaagttctgggatacatgtgcagaacatgcaggtttgttacataggtatacatgttccatagcggtttgctccacccatcaacccatcatctacattaggtatttctcctaatactatccctctccttgtcccccaccctcaaacatgccctggtgtgtgatgttccctccctgtgcccatatgttctcattgttcaactcccacttatgagtgagaacatgcggtgtttggttttctgttcctgtgttagttcgctgagaatgatggtttccaacttcatccatgtccctgcaaagggcatgaactcattattttttatggctgcataatattccatggtgtatatgtgccacattttctttatccagtctaacattgatgggcatttgggttggttctaagtctttgctattgtgaatagtgctgcaataaacatacatgtgcatgtgtttttatagtagaatgatttataatccttagggtatatacccagtaatgagattgctgggtcaggtggtatttctagttctagatccttgaggaatcaccacactgtcttccacaacagttgaactaatttacactcccaacagtgtaaaagtgttcttatttctccacatcctctccagcatctgttgtttcctgaatttttaatgatcgccattctaactggcatgagatggtatctcactgtggttttgatttgcatttctctgatgaccagtgatgatgagctttttttcatatgtttgttggctgcataaatgtcttcttttgaaaagtgtctgttcatatccttcatccactttttgatggggttttttcttgtaaatttgtgtaggcttcttatagattctggatattagccctttgtcagatggatagattgcaaacttttctcccactctgtaggttgcctgttcactctgatgatagattcttttgctgtgcaggagctctatggtttaattagattccatttgtcaattttggcttttgttgacattgcttttggtgttttagtcctgaagtctttgcccatgcctgtgtcctgaatggtattgcctaggttttcttccagggtttttatggttttaggtcttacgtttaagtttttaatccatctcaagttaatttttgtataaggtgtaaggaagggtccagtttaagttttcagtatatggctagccagttttcccagcaccatttattaaatagagaatcctttccccactgcttttgtcaggtttgccaaagatcagatggttgtaaatgtgtggtgttatttctgaggactctgttctgttccattgatctatatatgtgttttggtaccagtaccatgccactttggttactgtagccttgtagtatagtttgaagtcaggtagcattatgcatccggctttgttctttttgcttaggattgtcttggctatatggggtctcttttgatttcatatgaaatttaaagtagttttttctaattctgtgaagaaagtcaatggtagcttgatgggaacaacattgaatctataaatcactttgggcagtatggtcattttcacaatattgattcttcctatccatgagcatggaatgttcttccatttgtttgtgttctctcttatttccttgagcagtggtttgtagttctccttggggaggtccttcacatcccttgtaagctgtattcctaggtatttgattctctttgtagcaattgtgaatgggagtttgctcatgatttggctctctgtttgtctattattggtgtataggaatgcttgtgatttttgcacattgattttttatcctgagactttgctgaagttgcttatcagctaaaggagtttttgggcagagacaacgaggtcttctaaatatacaatcatgtcatctgcaaacagaaatacttcgacttcttctcttcctatttgaatacgctttatttctctctcttgcctgattgccctggccagaacttccaatactatgttgaataggaatggtgagagagggcatccttgtcttgtgccggttttcaaagggaattcttccagcttttgcccattcaggatgatattggctgtgggtttctcataaatagctcttattattttgagatatgttgcatcaataccagtttattcaatgtttttagcatgaaggggtgttgaattttattgaaggccttttctccatttattgagctaatcatgtggtttttgtcattggttctgtttttgtgatggattacgtttattgatctgcatatgttgaaccagccttgcatcccagggatgaagctgacttggtagtggtggataagctttttaatgtgctgctggattcgttttgccagtattttactgaggattttcgcacctcaggaatattagcctgaaattttctttttttgttgtgtctctgccaggttttggtatcaggatgatgctggcctcataaaatgagtttgggaggagtccctctttttctattgcttggaatagtttcagaaggaatggttaccagctcctctttgtacctctggtagaattcagctgtgaatccatctggtcatgggctttttttggttggtaggctactaattactgcctcagtttcagaacttgttattggtctattcagggatgcaattacttcctggtttagtcttgggagggtgtatgtgtccaggaatttatccatttcttctagattttctagtttatttgcgtagaggtgtttatagtattctctgatggtagtttgtatttctgtgggatcagtggtgatattccctttatcattttttattgtgtctatttgattcttctctcttttcttctttattagtctggctagcagactatctattttgttaatcttttcaaaaaaccagcccctggatacactgattgttttgaagggtttttcatgtctctatctcctgcagttctgctctgatcttagttatttcttgtcttctgctaacttttgaatttgtttgttattgcttctctagttcttttaattgtgatgttagggtgtcaattctggatatttcccattttctcctgtgggcatttagtgccataaatttccctctaaacactgctttagctgtgtgcggaagattctggtatgttgtgtctttgttctcattggtttcaaagaacttatttatttctaccttaattttgttatttactcagtagtcactcaggagcaggttgttcaatttccatgtagttttgcagtttttgaatgagtttcttaatcctgagttctaatttgattgcactgtggtctgagggactgtttgttatgaattctgttcttttgcatttgctgaggagggttttgcttccaattatgtggtcaattttagaataagtgctatgtggtgctgagaagaatgtatattctgatgatttggggtggagagttctgtgggtgtctattaggtccacttggtccagagctgagttcaagtcctgaacatccctgttaattttctgtctcgttgatctgtctaatattgacagtggggtgttaaagtcttccactattattgtgtgggagtctaagtctctttgtaggtctctaagaacttactttatgaatctgggtgctcctgtattgggtgcatatatatatatacatacatacatatacatatatacacacacacacacacatttaggatagttagctcttcttattgcattgatccccttaccattatgtaatgccctactttgtcttttcgatctttgttagtttaacatctattttttttttttcaatttgagagcaggtcctgtttattaactgaccagcttagaaaaataatcatggtaggcaacttagatcattcttctaataagcctgttgatctggtcctccctgttgcatctccaccttctacaaaatgggtgctctgtttcttcattctggctcgtggagaagatactttgaaggatcacaggaagttatttgcttctgtgaagcattttccaacagtacagatctcatgaatcagatcctccatgcagatgatgccatatttaccaagagatcgagcaatcaaagcattatctgtccaagcaatttgcttcttattgattttgctataaccatgcttgtagattagttcatttactaactttagatttgggaacccccatgcaatatatggctttacaatcctcagcatgttaactgaagcctcttgagcttcacaaaggttccactgaggatttgatgaaggcaaagaagctgcaacagctttcagaccttttggctcacaccattgatacctctgatcctgatgacaaatgccaatttgggttcttcaggaacacagaagtggccagcttttcttgtcatcctcgccattcaaatttcagttctgtacatctgcctatattccttgtgatagtgcttcattttttcatagaagcttcctccttccctttcaaagcatcttttgggcaaacttctttctcaggctcttgatcttcagctctgcaaaattccttcactttttcttgagggtttctggcacagcaggaaccttctcttcttctcttatacacactccatggttccagctggaaaaagaggaagttgacacatccacttaaagtctgttttatcagagagtagggttgtgacccctgcttttttttttttttttttttttttttttttttttgcttttcatttgcttggtaaatcttcctccatccctttattttgagcctgtgtgtgtctttgcttttgagataagtctcctaaatacagcacactgatgggtcttgaatcttgatccaatttgccaatctgtgtcttttaattggggcatttagcctgttacatttaaggctaatattgttttgtgtgaatttgatcctgcattatgatgctagctggttattttgcccattagctgatacagtttccttatagtgtcaatgggctttacattttggtttgtttttgcagtggccggttctggtttttcctttccatatttagtgcttccttcaggagctcatgtaaggcagacctggtggtgacaaaatccctcagcatttgcttgtctgtaaaggattttatttcttcttcacttatgaagctaagtttggctggatatgaaattctggattgaaaattcttttctttaagagtgttgaatattggcccccactctcttctggcttgtagggcttctgcagagaggtccactgttagtctgataggcttacctttgtgggtaacccgatctttctctctggctgcccttaacattttttccttcatttcaaccttggtgaatctgacaattatgtgtcttggggttgctcttctcgaggagtatctttgtggtgttctttgtatttcctgaatttgaatattggcctgccttgctaggttggggaagttctcccaatatcccgaagtgtattttccaacttggttgcattttccatgtcaccttcaggtacaccaatcaaatgtaggtttggtcttttcacatagtcccatatttcttggaggctttgttcattccttttcattcttttttctctaatcttttcttcacttttttttcattaagttgatcttcaatctctgatatcctttcttctgcttgattggttttgggattgatacttgtgtatgcctcacgaagttcttgtggtgtgtttttcagctccgtcaggtcatttatgttcttctctaaactggtttttctagttagcaattcctctaaccttttatcaaggttcttagcctccttgcattgggttagaacatgctcctttagttcagaggagtttgttattacccaccttctgaagcctactattcgttaaactcattttccgttcagtttgttctcttgctggtgaggagttgtgatcctttggaggagaagaggcattctggtttttggaattttcagcctttttgcactggtttttcctcatcttcatggacttatctacctttggtctttgctgttggtgacttcggatggagtttttgcgtggtcatcctttttgttgatgttgatgctattgctttctatttgttagttttcttctaacagtcaggctcctcttctgcaggtctgctggagtttgctgggggtccaccctgtttgcctgggtatcaccagcagaggctgcagaacagcaaagattgctgcctgttccttcctctggaatcttcatcccagaggggcacctgccagatgccagctggagctctcctgtatgaggcgtctgtcgacctgtgatgggaggtgtctcccagtcaggaggcacgggggtcaaggacccacttaaggaagcagactgtcccttggcagagcttgagcgcattgctgggagatcctctcatctcttcagagctggcaggcaggaacattttaagtctgcttaagctgctcccacagtcgccccttcccccaggtgctctgacctggagaggtgtcagttttatctataagcccctgactagggctggtgcctttctttcaaagatgccctgcccagagaggaggaatctagagcggcagtctggctacagtagctttgctgagctgcggtgggctctgcccattccgaacttcctggcagctttgtttacactgtgaggggtactcaagcctcagcaatggcgggtgtccctccccatcactaagcttgagggtcccagatcgacttcagactgctgtgctggcagcaagaatttcaagccagtggatcttagcttactggtctccgtgggatccactgagcaagacaacttggcttcttggcttcagccccctttccaggggagtaaacagttctgtctctctggtgttccaggagacactggggtatgaaaaaaacaaacaaacaacaacaacaaaaaaaaaactcctgcagttagcacagtgtctgcccaaatggccgcctagttttgtgcttgaaacccagggccctggcggtgtaggcacctgagggaacctcctgatctgtgggttgtgaagaccacgggaaaagcatagtatctgggccagaatgcactgttcctcacggcatggtccctcatggcttcccttgactaggggagggagttccccaaccccttgtgcttcctgggtgaggcgacgccccaccctgcttcagctcgccctctgtgggcttcacccaccgtctaacaagtcccagtgagatgaaccgggtacctcatttgaaaatgtagaaatcacctgccttctgcgttggtctcgctgggagctgcagaccacagctgttcctattcggccatcttgcccagatatccgttttaaattttttaaaaggcaaaaccgcaattacttttgcaccaacctaataagatgctcacgatcacatagcagagccagtttcctggctgactctagaaccttggctcttaatcactatgcgtgtctctcttcagctccacatcatggtcagttaacggggacagataaacacaacaggatgggaatagaaggagacatgggggaaaggaaaaataaaagatgggaaaaagatgtcctaaaaggaagaaagggagcatgtaaaaatagatgagagaaaagtaaggtagagcaaagaaaggtaacagagaaaatgaaggatataggacagagatggaatgtgttcacagttctgcctcagaagtgtgtaatcttctgaactctcagaatgagtttttttcttgaaggttcagccctgagtattagcaacacacaactgccagctcttcactataaacttctatctctcttcttgtatcatccactgctttgcatgaatctatgctatgctgtctcgctattcatcctgctttgtgagtgagtagctcttaccatctcatggaaaatgcagccacactctttatagtatctaactcagcagaggcagcattcgggatgtttcatgttaattcccaagaaagagtctggtatttgtttcacttcaaatacattcttctctgttaccatctacagaggtaaacaaaagattaaaacaaacaaacaaaaccaaaaccaaactcctttatttttctggccacagaccaggaaaacatcaccttttagtattcttccacaggtaggagaaagggtgaatgttagaaactcactctcaagaagtacaactatttacatgggcttctatacatcacagtaagctatccctgacatttgtatttataattaagtatccaaaaatattaaaagtagcccttgcagtattagaagacaacttccctgcttttacttccaaatttaatatttatttttaaaaagtaacatttcttttctcatggaattttaggatcttctacagagtaagagatgacacaggttttaaaagttcacattgggaccattgaggtgtctatcaatttaccagctggaaatagctctgagatcctaatgtctgtcatactgatggtctttcatggaattatgctatataactgtgggtttctttaagtcctatttaattccagcatctccaatatgagaattcatatatctgactaagttccttatggaggaaatatataattgagagtgaacattcctcatgtttccacatgggggtgctacctcacggtcacgctcttctcagtcttcctcttgacagagatttctaaacacagacaagatgggtcatttcttaaatttcactgactcttcttaaactgagaggaaatatagaatggtgaataaacactgcatatagtctcaggtttagctccaattctaccacccagtaattggggcactttgggtgaactatggcccaaacaatcatgcaggattgttttgaaggtaatggatgtgcacatgccttgtaaatggtaaaacattaacaaattaaagataattagatccagatcctagtccatgtctagatataaaagactctgctgttagattatcagaagacatgatgctatagacgtctttaaagtgtaggctactgaagtgcagggtcaagaactcaacaccaatattagtaaaacatgccgcattgccaatagattggagactgagagttaagttgataagcagaaatgccaagaaaatttctaggtgctcagactgctctatgactacagaataaagtagttccaagttgatgacatcaagtcaaggctattcctgaaaaggtcaaaatgggcctatagattatgttctggtttatccaatcgtccatcactaggtctccaacaggaaccttcaaaccactgctatatgtttccaatttgcaacaaattataaaacacttgttttgtcttttggaactatacacaaataaaaatatgtttgcaaaagatttttttataagatccttgtgcagtttttaaactcccaaatgtaaatgctagaaataatttttgaatgtactttaaggacacactgcaaattttcttcttacagctgatagacacctaacattttagccattgagcacagtgttccatcttgtctccagggtccatttttaggagtcaaaggtgcttaaataagaatcctttgtgtaatgaaatttgctaagctttaatgagttttattttaaaagctcttttcaaattaaattcagcttaacatgtttaagaatgtaaatgttcacaattttatgggaacacaatatatacatatttctgaggcaaatatactattttaggctcttaagtttttaaggatcactaattctaggcatacacatcttctggtggcaaatatttagatatttagttcttgcaataacaataaaaaagatgagatgaaatctgttaacgctaataatattcaggctagagaggagggaaaaagataaattcaaaagaagaaacgcttctacggaatcctttactgatcaagtagcaacctaggacaagcttctttaatgaacctgctgatgcttgattagggtattaaaagatttttgaaaaatggggcaatcccaagggccctacagtttctgtggtatccttaattaattccactttgagttcattattcaacagctgctttaggaaaataaaaggtctgcatctctttacacaaatgtttgagagttactttataatgcattccctccttgcataagccattgttctaaactagattaagagaaaatacaatgagaagctacttccattgccaagggggttagaaaagttatccagttttacctgtactttcttcaatgtaagaaaagaaagttcccaggtaatcaccgcaccttccccaagaagacccaagctttcaaagcttcatttctacctaaggttatttttgctgggaaaatatgtctgtgatttctttgatcgacgatgtgaacatttatatctccctctataaattgttttgaaaacatgtatttggcttctttgactcatggtttccagcttatcctttgacttctctcagtcattttcacacaggttcctttctcttgctttgggctagctgaacacacacacacacacacacacacacacacacacacacttccctactccccttcagaatgacttcatgacaagtggtctggttgtgagcactaccttaaattccagctgccctgttggctcctgtacttacaaagtctgaatttattgtgggcccttgtagtgcaatttttgacacatcattaagctcccttttcattgggagcctaagggcatattcaggctcactgcgaagagtgcgcctaaataacggttaaaacacgtgtcatgagctgcaaggggcttgtttgccagcagggcaaacagttcactgtagctcaagcaataccctacaacagggtgggtagagataatgagataaccacacaccacaagtgagctgttcatctttgtcttcaagcatctaagaacacagttatctcagtaggatggtgcaccctggagagttataaatatctttcagaaaggtaaagaaaaacagtcaaagaaaacgcatctgaaaaaaataagcaaaagaacactggtggacaattttttaaagcaaaatttcagctataccagaacttattgaatcaggtcaataagttttgtgtgctttttttttggcattatgttttattttaattgtatgcagatttattctaatgttatgatgctaatcaacctgtgtagctataataaaataaaggcaatgtcaacacctcatcaactaatcacactgcttctttcattctggacactgtatcctccctacacaacaccgaagtactataaaaattatttatacaaataaactattatctaaagactgaaaaggcataataaattatgcgtaatatggcccaattatgtggtaatttctttgtttgaattatttgcatagttttaatgaaggggttgctagaaggtggaaccatttttatatttaatggaaaaaacaaatttgtttttaagaatgaaaacaaagataattagctcttaaattagaggcatactaatatatgcatgttcctaaattattaccagtattattactttgtgctatcaaaacttttctctctggagcgcagatattggctactcaagttatttttcccgtttctgttaaatgtattaatatcttgctgttcatcaagtgccaaaataaaggttaaaaaagttccctagattatctgcagaagaaaaattggggtgggtgatgacaactatgatctttcaagatgtagtttacgaatgcataataacttaagaaagtgagaaaaaaaatagatttatcaagaaaagagagaactagcctaaattcaacacagcaaatcagcaaatttcttcagggaaagacatcaaatttgaaaggcatcaatacttttctgctgtcaccaaactgttatttatgctcatgtaccagctggatttgtgtatgtgcgtgcataatctttttctcaccactgatgtcatcattaaagctgtgcaagaattttgatttcgctttgcacaatcttcaggggagacttggacattatggtgaaagtttgtgacaagtttgtaaaagtaagaaatgcaggctttaaggcagtgaaatgtcaccactgcaaaacagaggaagctttcccaagtgtgtattattttgtctgcccagtctgcattgaaggaaccacacagggcaattgcaaagaaataggtagttaaccacttttggtggggaaaaaaagatattcaacattacccatatatcactctacataactagctgtcccttttgaatattcaaacatattctagaatatcaagacacatatattttttacaatgtgcagaaagatacaagccactgtgcatctgattcccaaggcacaagctacaactgcgttttatcactgtaaaccttatctatgaggtttataaaggctttgagatactaagacttttaggattttttggttatgaaatttcaaagctgcaatgaattaattttcagacgaggaggaaataaccaggaacagtaggcagtggcaggccattatgagaaagagacatcatagcgcaattcaaaggccgccgattccagtcagagatctcagggtgcatgagtggcaatctggacagagtgtggagggtctaacccacaataacctatctcagaacaaaacttcattaggagacctggtaactggatttaatgataatgtgtcattataacattctctcttttttttttttttttttttttgagatggagttttactcttgttgcccaggctggagtgcaatggtgcaatccctgctcaatgcaactgcaacctccgcctcccaggttcagcaattctcctgcctcagcctcccgagtagctaggattacaagtgtgtgccaccacgcccagctagttttgtatttttagtagagatggggtttcaccatgttgatcagtcttgaactcctaacctcaagtgatccacccgcctcagcctcccaaaatgctgggattacacgcatgagccaccatgcctggccctataacgcattctcattcttagtttagttagcagttgatgaatgcttagatttaagggtttgagcattggggaagggattttgaaagggaaggtgattttaattattaactgattctctactatgatgttgattacctgatttttatgaagcatcttctaagagtagctcagttataaacccttttcttgcattttcttacttagttctcacaaaagcctgcaaagtagatacgagtttcaacattccgaaaaaggaggtaactgaaggtcaaggttggataacttatccaaagtgagaaatataacagaaaggaatgagttacaatagccagggtgtgatatggctctgagacagacagtggcaagtgacttaacgtctctgggctttgttgtcctcatctagaggactgttgtttgtcaagagtagagatgctatgtacagcaactcaatagtggctgattcataatacgtactcactaaaagggttgcttctggcagtgctatatccccatgacttctcatatccacatcttccttagcagagtcatttatatccgggcctgtcttacttcaaagctcttgccctctcaagagaattcttcaggccaggagcggtggctcacgcctgtaatcccggcactttgggagaccaaggcatgcagatcacgaggtcaggagatcgagaccaccctgactaacatggtgaaaccccgtctctactaaaaatacaaaaaattagccgggtgtggtggtgggcgcctgtagtcccagctactcgggaggctgaggcaggagaatggtgtgaacccgggaggcagagattgcagtgagctgagatggtgccactgcactccagcctgggcgacagagcgagactccatctcaaaacaaacaaacaaacaaacaaaaaattagccaggcatggtggcacgcacctatagtcccagctacttgggaggcggaggcagaaaaattgcttgaacccaggaggcggaggttgcagtgagccaagatcacaccactgcactccagcctgggcaacagagcaagactccgtctcaaaaaaaaaaaaaaaaaaaaaaaaaaaccaaagagagagagttctttaaactggattgtgggaagaagtgagtgaaaggataaacccatctgtaggtctgcactgtgtcactgagaagtgccaatggtatacaaaatgctaaccagtcctccagggcttactatacagctgggggagaaaacgcacacatagggccaatttaatacataaaacatgatacggtattgttaagcgacagaatgaatagtaaagacagacagcacttgaggagttgaggagttttcattgctgtatttcttcaccttcttcagtctcctgtgcttttctagttaccatggtggctgaaatcaacttagattctttataaagatacttggggttgagatttaatgctggaagatttatactaagaaattccctttccctagtgattgcatgatttcacagtctgagcctttgtcttgggaatagatttaaaaggcccacctgattgcccatagttttgtcctaagcagaaccttagtttcttgtataaaccacagctgataaaatttgcaatttcctatttacaacatcttcgcttttcttagacaaaagggcaagataagcaaggtaattattagatcctgctctgcagtttaaaaatcatggacttaaaaattatggggccatatgtgtcccaggaaagcagagaggttttaattgggaatatgttctgttatatagaggaccattagtaatgccaatcttagagtgttgtttgtttgtttttttcccttccctaaaagcaaatcttgttgaaatatctgacttttaatctctttccaggaagattctatgggtttgacagaagcaaaaatgagtcactctctcaggtagggcaagtagtagagcacagtggttaagaacacagggaggccctgtgcagtgactcacacctgtaatcccagcactttgggaggccaaggtgggaggatcacttgagaacacgagttccagaccagcctgggaaacatagcaagacctcatctctactaaaaataaaaaaacattagccagggcatggtggtgcacacctgtagtcccagctgctcgggaggctgaggtaggaggatcacttgagcccaggagattgaaactgcagtgagccatgatcataccactgcactccagcctgggcaatagtgtgacaccctgtctcaaacaaacaaaacaaaacaaaaatgacacagggaactagcatgtttggttaagaatctgagattcactacttcagagttatggatccctagacaaattacttcactcctctgccccttggtctcttgatctgtaaagtgaagataatagagtaactaccatatgagattgttattagagttaaatgagttactatttctagagtccttagaacaaagcctggtacatggtataagcccaacttaggttaaaagagttgagcttgcttgcacaaatctggagctagttttcttcaagtatctttcatgtcagagggatgaaaatgcaaatatctaaaatctgaagcacttgggtttcagggtggagatgagagacgggggcgctggttaattgacagtcatctcttaaagtagaataagccctactaaggctcccaggtcagattattcttcatgctcacataaggctaaagtattaatttatatatttaactacacttgccaggagtcagaaaagcagacattctgaggaactgctcttggacagaacttgtggcaatgatatttagacattacttcacataccactatttgatttaaagcagtgatctgttgactgggtcattggtaatgcacatcccttccattttttggaaatacacctgtttcttggatttgatttggctcttaattcaaacagaactccaagtgctctgaaactaaatcaacctaaaattatacatttatctagagttacatttaggccatatggtttaagttgtccaaatgtcacagaagcaacagcaacagccatcatcgtactttacacttacccagcatctttcctgccagaatattatgtaagttataaaagtttcattaaggcagaggtgttaaccctaattccaaaaggacagtcatttagctgctgtttcagtttagctctgcttcatagtgaattgatacataagagttacttgaagtcaatttaaattttcataataatattcttgtaactgaaaatgtctcaactgcaaattcctatgatatggaggacatgtgggagacatgtagaaccaataccttcctcttggatctccgagaagatgcaactaagttattaggctcactgcactagagtcagagaacaatactggaatgctatttccagaaactcccatacaatgcactggaaaagactgggcagaaagggcatctcagtacataccttaagtctttacccatttgaacttgaaattctctatcatattagtagatctgcttcttagcatccagcaccgtctagccagatacataggaagtgctccatagataaatgttgagtggacaaataaatgtattaaatgcatggttgtcctgttgcaagcataacattcagagagctttagagtatatattttgagtagatgtgagggattttggcatagaaaaggcaacaagatgatgctgggcaaggaggatgatgatcgggtagccaggggcagatgtggactgattagactgaagggatcctcagaggtcttggtgttaaaattctctaagcagtatagtgcgattaaagaccacattccattataattcttcccactattagtcccagaatatttaatgtctctgaaattgtctaagccagaatattgtgaatatctacgcttttttgctcattaatcaaccaaccaaccaatgaatgaactgatcaaccaggccatgtgctggaacacagagataaatactcccctcagataccatccctatggtcagtaagctcacagagaagtacaaaaggtcgaaattcaccttcagaaacatgtttcagtttttttccaatactggtacttttctatcaccgccaagttgaagctatctccactgaatatccacaaaattttataatcaactgtagccatgtgcttatgtatacatcacattactcccagattctgctttacctactcacccagagtaggaggtcattaagccaatatgtagtattttccctgctctcaagttttcacactggaatactaaaaaactccagggttgacacagcagtttgctgagggtatgcagagaaaaggctcaataaaatagaatttttttctcggtagtaattttaaaaagatataaaataaacatgaaaatggctcagaatagaatgtctaagtcacatatatttaaaaataatataaaagacttcaaaaataattcttgcccacagtggtccctctcaggctgggcccacccaaacctccctgggatgcacattctctcttctattgatgatgaagtatctgggaagcactgcaaagcaaacccaaacgatggatttgaagcctggctctggcacttcctaactgtgtgatctcaggcaaattttcttttagatctttgatttttctcttccatgaaatgctaaaataacagcaccttctttaaaagatgactataaagatcacatgatgacatttgcacactgcctagcatataatatatgctcaataaatattcatttgccttaattgaaagaaactaattcacaaatcaaattctagtactttcgataccctcagttcagtatttaattatgtcctctggtgataattagtgatctagagcaatgacctcaggcaaagcactggaaatacagttgcatgtgacaccacagaggatacagagccccgtcctttgaattaacctggaatcaccgtcaatgaatcccatatgctaaaactgggctgggttcaaagtgacactcatcttagactcagtgtagctggaaaaaaaaaatcctcctttcccccaactctcaagggaattcttggagccatctaagtaagtcaatggaagaaacggtaaagagaagaccttctttaggaatgcaacactgtattcatagaagaaacaggacaaaactgagaagactgagatatgcagagagaggaacagagagacgacaaacagcttctccttctctcttttctcattccttagttgcaatagtaggggcctgggaagatgggtatgagaaaggctttgtttagatcttccaagagaagagttcagaatgtgagaagagattttaaccgctgttgggatggcttgattgggacttttactctcctctgctgctctagatgtttcaaggttctcacccttttcatataacaccatttttttttctttatgtctagttttgggttgggagaggaaaagatctcacacttagtaatcaaagagctggatttatcagggcttaccacctatgtgttattgggcaagtgattcaatctcactggccttagttttcactcctaaaatggagttctaccatgagacacaagtactcttgtaagaatgaaatcatataatatttgcaatatagtctagacaacaatatctcctaatttctataaaggtggtgttgctatctggaatataagagatttgttttgaagctgcatctggatactaagcaagctgtttttgctgagcagctaggtttatttgaggtggattttggggtggggggaaggtgaggaagggaaattgttgatggaacataccacccttagtggccacttggccatttcatatagagcagctaaatacttggcacagagtaagtactcaatgtgggcagcatctttgacactggggtgccaaaggagatagaaaagcatagagctggctgcttggcatgtgaccgaggcttaaaggtgacgagtaggtgtgcccttcccttgtacttctagggttgccagcccagtccacccagggaacggaaacaggaatagaaaggcatatccccaggacagaaaggtgccactgaaaataaaacaatggtgttgccaagaaagtacttatgttgacaatctcggatacaaggatagcaaaggtaacttcagtcacaaatttatggtcaatcatgaagattggcatttcgattggaaaagttcttaggatataattttttccattaaagccagctgaaaaacaaagctgatttttctatgctgttgctacttaccatttcatagtggcacaactcccaccccaaacactgtggaattatattcagaatagatttgtttatcagttcttctaccctatccatttttcagcagctgattagtctccctgggatgtagacacatctctgatcaacagcagcttgactcccatcttcacatatgcatcccaatatccacattactcataataaatgtgcttatatatacatatatagatacatttttatgcatatatgttccccacattgtattcaaaaacacattctgaatggatgtatatatgcactcatatacattcaggaatccaactagattcccagaggggaatgtggaacacattgttaaaatgtctgtcatccatgtaagagaaacagaaatgagctgggcattaaatttgcatacagccccgagcacagaggttcctgtatgtgcaccgttctactgttcttgatgatgggcatatctgatagaaagattctgtcaggattagctcaggaaaaacacccccaaggagataatttgaagacatcctgagaatttgcctcagtacatgaaaataaacatgaaacccttagcactctctgcacattgaaaagttcccaccaacaccccaccacacaccaggggataatctactggagctaattaacacacagtcatacgcaacgctgttagaagtggttgccacttaggattgatttagttgctgcagtgcttaaaagagacttgagaaggtttttgtgtaaatgtgagaggaaagaagaggaaataaaagtgtaaaaacagctgcaaaattaaaaggtgctaaggtctttttttccccctgtagacattagggaaacttattgagagactattagtattccagcaaagaaagcttcttacttgattttatgtttccttccacatcaaaattacacacacacatactgggtctatagattgtgactatgaaaaagggcatgtttcacttcataagcaaacaagctcttctttaaatgctaacatatggattgtgtcatctaaaaaacaacaacaatcttttcttgtctatgtctcattttatttcatctttctgatttatttagattttcagcaaagttattaattagtaatatgtttggggaaaaaatcatcaaggaacaaagggccacaagcaattccttcctcttatctttgcaatatgataaagatagagcaaatccaactattttagaatgttcttcctcaaagtgaatgtgatgcatgctatcttatgaataaacaatatatctactaatcatgacagtaggatatcacaactgagtatataaagtggttttagcaacctgctttttattactgaaacatgatagaaataatatagaaaagaccattagtgaaaactttattaatcaggctttgtgaaaatttagagaagctgcaattgattttttgccctgataaaagggtttgctaaagaaaattataataacataaaaaggatttcaggggacagagtatttgctttggatgtgaaaactctcttattttaatgataccattaatattaaaaacaatgagaaaacattcttgattccaagtgattccacttggctatattatgctttccattggatgaaagataaagcttatatataaaaaattctatgaaatatattttttatcagtctagactggcctacaagataaaatttaacaaaaattcatcgacattgacaatttgctatacatacaaagccctctaccacatcctgagtagaattaacaaatgcaacctgttctccatcctttaaaggctcaaactcagaagggaagacagacacgttcacaaagaattagggaatggcaaacaagtacagcttgagaatcaactctgaacaactggtaatgggtacatagagtggttttttgaggattacaatcgtgtgtatgtgtataaacacatatgttgtgatcagtttacaatgtctgccacaagaaagggcatcagaggtgatgggatgtaggcgatttgtctgctaactctggcctagaagatggaatacatgggtgggataagaaaggagtgtacgtaagacacaaggttaggaagttaggttggggttagataataggctttccctcaaggttggttctaattagtgaggttttattttaaacatctttcaaaaaaacaatgaattgttaacaatgttttggaggccattagttgtgtctctttataagaattttagagtggtttatgtagaaaagaagagcactaacaaaatagtcaatactaaagctaaagacacaaaagttcagaagtgtcacataaatgcaagtaagagattgctttgaactggacacaatagtagagaagagttcatggggtctgggaatttgcaatttgggaccagtgcatctgaataaggagaattgactgatttattaggtagagagaaaggttgtgtttttgcaaaaataatgtagttttttgttttgtttttgctatgtctctaaatgttccagtagattagctggaagcagctgctcaggctgtagaatagacaccaagtaccaaaaaggactgtgaaaggacacccttggccgggtgcggtggctcatgcctgtaatctcaacactttgggaggcagaggcggatggatcacctgcggtcaggagttcttgaccagcctgactaacatggtgaaaccctgtctctactaaaaatacaaaacttagcagggtgtagtggcggatgcctgtaatcccagctacttgggaggctgaggcaggagaatcacttgaaggcagaggcaaaggttgcagtgagccgagatcgcgccattgcactccagcctgggcgacagagtgagactctgtctcaaaaaaaaaaaaaaaaaaaagaaaagaaaaagaaaaaaagaaaggcagccaccctcctcttatattttatttcagtgatgggaactgacaaggctttccattttcattctttaaaagaaggagttggagagttaaggaaatttacatttttttcaacaaacgtggacatttcatttgtattcattttattaatttacttctacagctacactcatccactctaagagtaataaaacctgtgagtgctcctttaagagcctgcttttctttctgggcttgtggaggtagagagtcatgcaggaggcaatgaaagagtaagaaggaatgaagggcatcaggatgtcagcctcaacggaacccagcagctccccaactgctggctgtaggaacacttttctgaacctcttgcactcacaagttttactttatattgatgattttctaaaaatagatcttcactatttctttcccttcctcccacaccaatttctggtttcttttttccatcttttgagactgtctccttctctttttttcttttccttccctctctttattctgtttttccttttccaatttgctatacattctttcctggaagaaacccagtaggccctctagtttgacttcacattagaataacctgagggcacaaaaacaaaaattgacaaatagaacttgattaaactaaagagcttctgcacaacaaaacaaactatcaacagaataaacagacaacgtacagaatggtagaaaatatttgcaaactatatatctgacaaaagatcgaatatccagaatctataaggaacttaaatatataagcaaaaagcaacctgtattagtccatattcatactgctatgaagatatacccaagactgggtagtttataaagaaaaagaggtttaatggactgaaagttccacactgctagggaggcctcacaatcatggtagaaggtgaaggaagagcaacgtcacatcttacgtggcagcaggcaaaagagcgtgtgcagagaaactgccctttataaaaccatcagatcttgtgacacttattcactatcacgaggacaccatgggaaaaccgggccccatgattcaattacttcccactgtctccaagacacgtggggattatgggagctacaatttaagatgagatttgtgtggggacacagcaaaaccatatcacaaccagattaaaaagtgggcaaaggacatgaacatttttttttgtttttttgtttgtttgtttttgagacagggtctcactctgtcacccaggctggagtgcaatggcatgatctcagctcactgcaacctccccttcctgggctcaaacaattctcccacctcagtctcttgagtagctgagattacaggtacaggtacgcaccaccatgcccagctaatttttgtatttttttgtagagacagggttttgctatgttgcccaggctgatctcaaactcctggggccaggtgaccaaccctccttggccttccaaagtgctggcatttcaggggtgagcaccacacccagctgcaaacagacactttttaaaagcatgtggccaagaagcatatgagaaaatgctcaacatcactaatcattagagaaatgcaaatcaaaaccacagtgagataccatctcacaccagtcagaatggctattactgaaaagtcaaaaaataacagatgctggttaggttgtggaggaaagggaatgcttatatactgctggtgggagtgtaaattagttcagctatcatggaaagcagtgtggcaattcctcaaagaacttaaaacagaattggctattcggcccagtaatcccactattgggtatatacccaaagaaatataaatcattctatcatagagacatatgcacatgtatgctcattgcagcactgtttacaatagcaaagacatggaatcaacctaaatgcccatcaacagtagactggataaagaaaatatagtacatacacagcatggaatactacgcatccatacaaagaatgagatcaggtcctctgaagcaacatggatggagctggaggccattatcctcagcaaactaacaaagaaacaaaaaaaacaagcaccacatgttctcacttgtaagtgggagctgaacaacaagaacacgtggacacagggagggaaacaacacacactggggcctatgtgaaaatggagaataggaggagcgaaaggatcagaaaaaatacctatcaggtgctatgcttactacctgggtaatggaattatctgtataccaaaaccctgtgacatgcagtttacctataataacaaacctacacgtcaccctaaacataaacgttttttaaaaaagaataacctgaagagagttggatttgagtcaccatgcctctgccctatccaagaccaattaaaccggaatcattgaggggcagacactgcattctctgtgtgtgtctctggtatgtgtgtgtctccgtacatgtgtgtctctgtgtgtgtctgtgtgtgtgtgtgtgtgtgtgtgtgtggtcttctaaagcacccttgataattcaaatgagcatccagtagagtgaacagtggttctcaaaatatgttccatggaccagcatcagcagcatcacttgaaagcttgttagaaatgcaaacaattcccattcccaccctacagcatcagaaaacttgggaagcagggcccagatttctgtgctcctaagagcattccaggtgattctgaatcatgctaaaatttgcgaacctatgtgttagacctctgacattttgttttctaataaaacagcatcagcatcacctagaaactttacccttctcctactgaattacactctgccttgtaacaggatccccaggtgatatgtatgtacatcaaaggctgagaagcactgttctaagaacttattcagagttccatgcgctctgccaagcagctggctcttacgttctgactaatcaatgcaacaattattcgtttctcagaagtggaacacatttattcttttagctgttaaaaaagagacaaagttgatcttcctatgcagtacctgctctaagtctttttctatacttctgtttctaagagtatttctacatctcccgagaaaatgaaaaaataaaaggtcaaatttccgatgttttacttagctctgagacgtatctatctcagttctctggaaatgggatctctgaggcttgacagagaacaaagatggattctttgccttttgtctgtctcccacacaaaagaagggatctggggagatgtaggagggggtaaaaatctttactgatcatattaagaagcagcaatctgtgtgtgtgtgtgtgtgtgtgtgtgtgtgtgtgtgtatatatatatatatatatatatgtatgttgggggtgtaaatttgagagagagggaaatatccccaccaaatcaagttcatcacccctcagtgtcaattcctgttgtgaggatgccccagatgtttctgtaacagaggaaactctgttacttcttacgattatctaaaactatgagaaccagtgtaatggcaaaagatcacaaacccacctgctcaagcacctgttttccactcttctgttttcatctgcaacttcagcgtcatttagctcagataagactgatctcttgagactgcaggtccttcacctgcttggtatcctcctaagccttggtttggggagggggtggtgagcaggtggagaggagggctgacagatgatctacatttgtagctaatagaaagaacattttcagagttgaaaagagcaaactaaaaaaataatgatctaaaactattcctgaatctgattataaccaacatgtaaatcagctacacttaataaaggaatatgtcattgagttttatcaccagaatgtcttgtaaaaataaatatctaaaatcaaatgtgtaacattaagaaataaagaagcgtctttccccattaaagttagctttcttgtcacagtgtctgccagactcttcaaaacctccaagtcactcaagttacttatttctgagctttccccttaccctacagccttgggggtcaccctccgagaaaatgccttctctatctaaccacttaagatgtgaatatttgttgtgagccagctgcagctttaataactactgatccatggaatcaaagcctacttactcctcacaaacaataagctcttcttgttcctgaaattgcactctgtaactttcacaggtattataagaagtaggcatgacgggttccaaatgcaataacagacataagttccttatgatgattgaattaatttcaaatttcagaaaagtaattagttgaagttttattgacaaaggtggttgctgatgacatacaatttcttgaactgtgggataatttctgcaaaataagatgcactgtattgctaatttattggcaataaataaaacactttattttacaattaaataatttatcttaatatttatttattgccaataaataatctgtcagtaaattagtaatacagtgcatcttattttgtagaaattatcccactgttcaagaaattgtatgtcaacacctgaaacttaaaatactaacaatttgaaatatgttgacatagttttgataaaaggttagttcctttccctcttattagtataatttaatataaaatatgatcttccatattaaaaaatacaatcattcagaaacaatttgttcaaaggattcctgaaataaacaaggctcaattttctaaaaatccagtgggttctttggtagcaaacgaatatatgcaggaatgggagtttataatttttttgaactccacaaaaatataatggaattagacactcatcggtgtgaattaaaatatattgataggattttagtgtaattaaaatctatttccttctttagtaacatatgattataataaaatataaactttttcataggtactttattaattggtatttcaatagtaataacacgttaatagaacaaaacagatactttattctggaagtgactattatttgggtgctaattagaccttttctagtaggactaatgaataaatatgtgccgtttatttcttctgcctaaaatgtttgtttaccattgtttaccatctaactcctattcatcctctagggcccagctcaagtgtctcctctcctctgtagcctgcctccatctctgtctcacagggggcaggtagtaagcaatttagcgtcccaatctagagcagtgcctggcagctgagtaggtacacggtcgatggggttaaaggaaagaatgaaggaacaaaagtggatcaaaattggacagatagccatgttaacaaaaagaggaccagctttctgaaatacatcaaaagttatagtcctaaaaacatgtactattttcaacccatgaattagaaataaaggtgctttttggtatggaacacaggctctgcaattgtttaatacaatgctgtcaataattccaaaaaactgctgcaaaaaaaagaaggaaattctttgccatttaaaaaatacataagcaatggcactttgcagtaattatttgaatataactagtcacaaaaacaatgctggtccttttggcttttaattattcttcacagaagtaagattaaataggtctaagctggcaaaggatccgagatggtaacagcatgacctcattgcatgtgagagggtaactgacttcagaagcacggcttttgtaatctttgctacataagtactaaaatgttattctctattttagaagatttgtggattaaaaaataaatccgaatggctgtatgagaaacaaagcattacatttcagaaagaggcctcatgattttcaagattccagggtatgcacccaaccgttctgcggtctcccacctatatggggtcacaatgcaaagtaaagtcacctctgagcaaaatcgtgaactttaaggcccaaaaactgcataagtaatcggtaggctacaaagatcacagaccatcatcaaagtctggaatttatgcaaataacactgcttacatttaacagatctgtaatggtgtaagcttttccactgcaagcgagtaaatggagagcttctgtggtgcaagattgctacctacaggctaaactgcagaatgacatacaagacaattagcatggagggggaaaacaggtaaacaattttatataatggcatgtaagttatttactgacaagcagctaagcccgggaacatgtaaagactgcacactgcacactgggacatggattgacagcttttgttttaaaactacaatctagtttcagagttttgcattgtttccctctttatcttttgaaggtttcttttctttctgaataatgtacattgcttttctgaaggggaaacgtttctctctcaataatgtattataatacctctaaatctctgcagattctccatataaattctacatagaactaatactgatcattttaattgtttttggtagagtgatcaatcacaaaatttggaattagtttccgtggtttgaacaaaccttgtgggggaagggtacagtgtatactacataatccctgactccacatagctttcaaaatttatttgttcagaactatctacattcaatatttagagtaatttagaggtaatatatttttaaactatttcttctttaagaaaatattgaatacttcagttcagaagcacagatactagtccatcttacaataaaggaatctgattttcactggcaaaaatacatcgaattaacactgaattctcactaatctataaaacagcccacattttatgaaatatgctgagtcagtttaaaaatgcagatctttaaaactataaggcaagttattagaaatgcattttcccttcaattataaagaaattccaactctaaagagagtaggtttcaaaactgaataatatattatggttaaaacacatcaacaatctgtcactccatatgcacaaataaacatatcccactatcactgcacatgccacaaatgaggccaacacaacatctgaaaaggtagagcaaattcttcttcacagtgttagagatgctaaatcacactggcaacatttttaaaggcatgcataaaggaaagttacccatctttaatattgctatttatacagtttaaacattctgtttgcctatctgataaagatgttccacacatccttaattttaaacacaatttagcacatgctcaggttgcataaggaaagaatactattcttctacttgattttcgttttgaataataaaccttttaattatatttttgatatatttagaagaatcttagatgaaattcagttaaagaggtcacacataacaaaatcgtcaaagaaaaggcatttattagaaataaatatgcgagtttattctgatttatagacaactgtacattgttcagcatttccctcaactgaagtatgaatttgaagcaattaggtgatgtaataaatgtgtgtaatagaatccatatgtttagaagtaggagtgaaggtattaacctacaggtgttttctttccctactattgcagtctcatgaagagtaaatgttttatatatggtgtttaattgtacatatcataatataattaggcaatgattaatgatcttaattttattttaattaaggaggtgatctttttcatagaaatggttctctataattaaattgttcagccaaaattttaagaaagattgaaaaaagtacaatataatttgtaaaagcagattcatagttgaaactttgaaaagcagattttaaagttttctgtgaaattaatatttaattcatctaaaaatacttttgttcccatatagttctgagtaaattatattgttacttttccaatggattcatattttgttcagtcagtaaaactgtgaacagaattagtgaaaatgtttagagtgtgtgagagaattattaattaagggtaaaaagttttttatattgccctcttaggcaacagagattttaaagaccttattattatttagctggggcaaataaattcatgtgtagcccttaattctacccatagcataattataaaccataacaaggggtaagaattttcctactgcattttagatgttttaggaacaaaatataaaactgaataagaaaaaaattgtattatagttggtggatacttatcctaaggctatctatcaaaatcaatgaaaattattgactgtgaaaaatagtgtcattattctgttggcgtaattttaatgctcatagcaaggtattgggaaaattgcccatatatgtaacaaaactatttttcttagcttgcagactatatttaacatttttaaaatgtatctatttttgttgttctcatgctaaatatgaacaattcctaaaactaaattcctattatcagtatgaattctagacctatcaggtctctttctagcaagggatgttacttttatctttgttacattctctgcaaaacttattggtaacatactttcagaaaatgccaggcaataaaccacactaaaataattttctttataaaagcttcgtgatctttggcattgttcactattttcaaagccataaaagaacagataacaaatatatgactcacaaattatcaattatgaaaaataatctggttcagaaagctgcagtaatgtaaaaagatggatcacttgtcacaaaccaataaaggctattgtttgtgaatccaatatttgattttatcatttatgttgggcaacttaaaatgatttttaaaccacattacttttgggaaaaaaaaattgttataaaggtgaacacgagggttgtgggtaggtagggcgggggagagaaaccagttgtaatctgtcatccttgaaacaatttatattcttacattgaattcagcctacaaatctaaatcacaaagacttggtcagcaaggatggatgcattagaaaggactctcctgtgttccagagaatggacagtggcaggaatgttagtatggctttgattttatcctttcttttcatgtgctattctgatggctgaaaatttgcagctatgatgtttcattatgcagacaaggttcaactgtgtgtttttaagccaagtgtggcttgttacacttcttaggcaggtagctgcttttgcttactttgtattgcatagagaaaggtgcaatgaggttacccagctcagaaaacccttctgacaaattctcatccaggttgtttcatatttatcatcttataatgaaggaagaggtacagttctcatcaagaaggacaccactgtgagtggctaggaacagaaatttcctacctggtgttatctgagggctactctactgctctacttgctctctgatatctcaattaaaaccttttacacctgcttgtacataagaacttggatgcctaaggaaatgagaaatactctgtccacaaggccagtgataaaatgtgcacatgctatttaggggtggccttattcccgcctctggataacagatatgatcatcagattatctagctgacagcctgaaagttgcagggacaggtgagtttcagtggacatgaaatgtggtagacacaggcagatggtggcagggaccatcatgcagatagtggaggtaatatcagaataaggacatgcccagacaggtgtctgggaggtggactggaggaagatgaagatgggatgggtttaaggatagaaaagtagtcacattctagagacacttcatctgttgcataatgggcctttaccatagattatttctccctccttactcagtaaagaaacactagacattatgaaataaacaaaagaaaggagagccccagggcctagttatatacgccaaaacacagtaagaaaaattaaatgttaaaacctggatcaacctctaacagcttgtttgaggtacgggtcatgaattttgcttgaggtggggatcatgaatgttcttggaaatattcctacttagagtctgacaagaagtgaaaatgaggttggggaatggaataattgagtaactattcaattatggcaactgctggctaatgaagacctattacaaccaagtttttaatagaaaatgtgctaattgactaggttggaacttagaacaagcatatggctaagatgtttgattacctagtctggttccatgtcagtgatcaactataacactgtaaaaatgagtgtttctatgacaattaccgagctcgctgactaaggagtaggtgaccaacttgagggatgagtttctccaataaataaataaaaatatatgacccattagtccccatactgtgtgatccggaggctcatcagggtaagtatgctttttctactcccttactcaaaacattcatcttactttcagcattggcaaagcttaaatcaaattcttatgcaaataatatttcataggatttattttttaattggaaagagtatataaagctatgaatctgattttctataaaagtgaaacaaatcaacatagtccgactaggtctaagcctagcattcaatctcatgtagagacttgaatcatttctgtggtttctggatggggcagtctccatgtcaaagcctacctagtaactttcaggagatgggtgtttcatcatccacaatttcagacagaaaaatgttcttttccaatgtcattctaaactaaaactctaaacaggtgtttgatactaaggatgtaaccaaaatattcccccttataacccgcaactctgataagacttccctcggaaatataatggttacatagcccttacatggctttaacaaacccctattttcttctttctgctccatacaatgtgcagtctatttgcacccattcaggactaaattacagataaagttacagcaaatttgttttctcaaaaaagcagtcagccctaatatcccttgagtaataaaggccttgtccttcattcagaactagaactggcataattttctccaagaaacaaactctacttcctgtgacaatgaacctgttcttaaaattctgaatgggatacagctcaatttgcaggtgttcaggtataaaggtcaaagggcatttgaccccccaactggcaattgttgctgtggtaggtaacttcagtctgctagttatatcattctattagataagctgccagagttttcagctctgaattaccgaggtaggctcaagtgaatcaataatttatacagatatatctcattcattctgatggtataaagatacatactaacagcctgctgcagccccggaacaaagccagaaagacattatttaagaagaaagagggaaaaggaaacctattatctatgtgaacaaaaccatgacgtaatcgtgacttaatggcttgttaatgttatttttcaactgctttaacaaacaccatgatgagataaacaagctctttgtgaatctcaataacgtttctctgatgaatgttaagacaacatttaaaactctcagattaattttaaaatagaatgatattttacataacaatataatataaaccaccggaaaaaattcacacacctaagaagtttccatgagctagcttcactaaatctctcaatattttattactgaatttcagtgtaaaattactttttaaaagatgagaatcaaatacatttaggaactgtacactaagaatattgttaatatagccttatgctgttaatcgttacctggggaaaattatatagtgttttatacactaacactatgacatttttattaactcataatccctgtgctaacagtggtgcattaaacaagtaataattaagagggcagcaaatattaaaaatgcctactctaaaattcttcaatcatgttaaagggaatcctctaacatttctcttctataaaggaaagcatttccaaaaacagtgtggttacgatataatcatcaatagacctagatcacttaaatcatatttccataatttctggttattgtccttgaggattaaggaaattcgccatctacaaacacaataaaaaaaatctcttagcagctttaattgtaaacattgactgtttcttgacatatctggaaatttatttgaggataaaatgcattagaagttggtctcttgccaagtttacctctttgagttcaaggctgggcttgtgcatggcatggacatgtgaactaattgcattcagacttggtttaggaagactgtgtaaaaaaaaaataattacagcagcaaacccgatgagaagggtgatagcaatcagaggtattactcaggtactttatacaggaaagatggataaattatcctttctcttattttctagggaaacaccttgggaaatacagcaaataacaaaagtcaaaaaggaaataaaagcatttctgagagaaaaagaaagtaagagcaagagagagactaatgttgtggcctctaccaaaagtccttaagcctttatatgcaacactctggggctgcctgctgcaaccagttaacatttctggcctttcaagaaaatataactagtcccttaaaagcagagagaggaaggagaaataatggaataacccatttctgacagtcaagagagaaaggagagagatgttcccacactgatctcattaagatgatgagaataatgagtgtgaatcttatgtatggatctcacagcagacagaggaggacataaatgtatcccccattcacccttttatgatgcctgatacaccacatttattctcagcttcatctgctactactgttgggggtttctcttacaatagtatagctttaacttcaagttttgctgctgaagtcatctgagtcagccactcaacacagctttattgagtgtgcatgaaaacgagggaagtcctcttaatggcaagtgaaatgcatcttgagcagaacagcctgagtttatttcctgtcactggctctggtaatggattaaaaatactgatgaatggcatttttccgtttataatctgttgtattttctagttccttaaacttaggtcatacattccagccaattagaaacagaacccaagtcttattaaatatgccttcagtgcctttggagagccatgcatttgtgacaaacactgatggaacattttttcttgtgaattatctcctattcttaaatccagtctagaatattatctaataataattttaagttaaatactttttcatactgatacaaactttgaaggactgtgtagttctcagaaacagaaacctatgttgttgtggccaaatattattcaagtctaaattatccacaggtccttctgcttaaggatgtcaaagcatttcatacagatgatttatctttcttcactccagtatctccaataacaataaaactgtgcaccaaatgtatagcaaactatacctcacataatttaaataacaaagtgggcaacaccttccaaattcaaatatcatctcaaaatatgcccaaattattatttcagtactgccactactttgtaaaggaatatgctgttccattatgttgtttaattttacgctggaataatttggatccatataattttaaaggcaatttagaaagacagcgatacaatgaagctgggtcaccagtttttctaagtaattcaaatacatacactttttcctggcatttatttagtctaatgaaaatttaggccacggacaggttcatcttagctaccatttaatcaatatagatcaatataggtagtttaagctgtttaagcaactcactgaaaatatatatttgaaacctgggaaatatattcttaatgagtcgacatttacttttgggaaaagcgtcatttatactacttggaggccaaatgatatttcttgtctaaaatatgccttacttaaacacacagtgaactcttcaagagttcgtgattaccatacacacatctctgcagtgttttgtggagctatagtgtgatgtgatttccactaatagaaaagttcatcaaaacataaggtacacatttattacttaaactgcaggaataacactaagcagggtgcatacagacttattatatcaagtcggcaattctagccttcccagatcaatacattccttaacaggaaataccaaggaccaggagtccaattttacactcttggaattctacaggacaatgtcagacacctggcttcccttaattaaggacaatttaacttacaaacttcacctttcttctcattgttgctgtctttgaagcttccattactagtcattgggggaaaaggagagttactatgttagtaagtcattttacctcttaacacttcagtctcctgtcctgtaaaataatctctaacctccattccagttgtaccattccatgacttcatctgcaccattaaaagcccacacaatctccaccttttaggctccttatctttgcattaggaaggtgcactatcctgaagctgggtttgggttagatgtgttctggcattccaaacaccaagccaggattccactgaatctactttctccatgtgatgtttccattctacagctagtaggctttgtacatgattctatgtcatgatctatgacattcccactgtggagaaatgtgttccaaggtctaagcatctgtcttaccaaacagacctctacattttgtttggaggtttggagtctatatgttaaacattccattttaactacatatcagccaagatttaagacagaaataaaactgtggtagaagtctgatactctgagaattaaaaaatgaaggaaaaagtgcacactcagttaagctagtagaacctaggttaaagggctctcttaaaataccagcctcttggttgaggcacgcaataggctcttgccatagaagaacaaaactctatttaaaaaaatttagctgagaagggcagtgggggacagggtagagccagaagttaacacatacaaaagtatagctagataggaggaatatgttttgtgttcaatacccgcatatggtgactataattagcaacaacttattgtatattttcaaataggtagaagattttgaatgttcccaacacaaagaaatgataaatgttcgaggtgctgcttatgctaattactctgattttatcattacacattgtatacatgtatggaaatatcacactatatgccataaatatgtacgattattttgtgttaattaaacataatgaaagcaaaacgaaaagaatttaaacaaaaccagatacatactgacactctttaagttttcaatgttgctgcctaactagaagaagaaaatgtagctatctgaacttctacatttatgaattacttttctgagtgctacccatcactctactaacatcacgtcaaaatataacacttctcgtatacaaccagtatattaatttgtggtaattaatgcactccttttaaccttggtgatctattattttaagttcaatcaaaaagattaattgactaaggggagtattgtttaatttgctgacattttatgacaacactggatgaaaaattcttgtttcgaacatttagagttgcctgaagcatgcttggcaggaactgtatagaatgatttaactatggaaaatgcattaagattatttatatatagctacatgggatataaaacataatatatttacatattattggtaaatgacaatagtaaaattttttttgacctatggtgaactgggtaacttgccatgcaaaacagccagtagaacaattatcttcactgttttaaatcactctcctattataaatcctttctcccttccccaacacttccaatgaagatctaataggtaacgaaacctaaggaaatatatgtttatatctctgacataatattcattaaaaatataaagagtaactattagttataaatacagtgcaatgtctggataaaacccatcaaaccctcataatgacagaagttatcttacttagtccaaattcatgtggacttctggacttctccaacagtgcacccttggaattgggacagagaagaaaaccctcatatgggtttgcataagagagaagataaaattcttcgatctctataaagccaaacaaacacctgtcctttaattggactataatatagttaataattttgcataaagatcacaaatgctctttctccagacaagttccgtatgggaataattcatatcatatgcgaactacagaaaatccaaactaaactttaccaccaagagtataaaagtaaatgtagttgaacttgtattaaccctcatttggagcatgcattcacagtggggtcaatgtgacatccaagggggtaaaaactggttcttgagctggggcgggggggaagcaacagaaatcttagatgtttgtggccctctaaagctcaatatcccctgagaaaatcttatcccttagtatttaatttctctcaagtgaaatttttctccttagggcagtgactatgaaaaaaaaaatatagagaaacactgatttaagatcaaataaaggccacactttgtctctaaaatattttattcctgtccttaaaatgagagctgactttgatttatcaaatccaaatatctatttgcactttgatatgctttctgtctttccttgcctcttagttttctctgattttctcttcgttatttcagctatttgagccaatagctgatgactactctgttattgatctctcagtgttaccacttgctgagtgttggacctctgtcatcacggcaaagtacaagatgcaccagagtcatcactcacagacccacctgtagcaaagcctgctgtgtctatcccaattctcactacaatttaaaatgtgataaatgatggcaagagaaggggcaaagtaaaatgggaacaacttccttaacatttcaggttagcttcttgcttggtaaattaacgaacacattcataattgtaacgaatatctgcacatctagtcaacacaggaaaattggacaacagaaagcattctgctcctatttcttaatttttacctgatagaacggggaatgaaaacacatggagagtgaacttaatgactaaagcatattaatgactgaatctctgttataatttacaacccttcagaagagttattattcctactttacaacattttactaacataaattatataattagatcatttatttaaactttttcctttgcaaagtactttatttcataatatgttgcaatggaatatggcttgccaatttgctcagcatgtctgtcctttacgattgaaatcacaattgcaaagtagaaaatccttcagaagacaagaacattggtttaggaatctgggaacaggtagtgagacatctctgattcattatttaataattttttgatccttagtcaactcagttgtaaaatattgaccatgtaacaatttttaaagggtcttataaaggtctggggggctgaaactaccagataagtaatgcaaggaggaagcttgaagtgaagtggggcagcatccatacagccaggaaaaacacaccgaggctttggtgtcctccaccacgccaacttttattgatagcaccattgaggcacatgagaaagctaattcttagattcaatatggtatcataattatgctggtgatatttgtaattttttgactatagcatagcataatagcactatacctgagaaaaaatgaaatcattttcttttcctcaaatcactcacagaagaaaagttttcaaaattatagcattctactactttccacgttacaggacaaaggcggaagagcagcgatcataggaaacatgagtttcctcatttcatgagaaaatgacctctacagggattaaattcttcttcttgtaaatatgaaataaaatctaggagaaatacgcctttcagagagtagcagaccctgtggcttatgtgattatctccctccaaagagcagaaagcccttttgctgacatctattaaaataaacaaaaaagggcattggcatcatttaaagagaatgaagcactgatttgagccaagtgttgcactgtggacttagcagatacaaaaacaaaacaaaaataacttcacaattaaataggcccacaaactgaactagagcctcactcctcaggaaagattacagaaaatatttggttctgttattatctggcttgctatatttcctaagattcagggttgattttagccaatagtgaccaaacctgaaacccagctcatttgtaccttatactctttgggggccttttatataattgcaggaatttatatgtaatgcactatgaaaggcaatgcttaggaaaacctaatttacaatttttcatgtaattttggacaatgtttgaaaaaaatttcttctccggagttgagataaattgggcgaaaatgtatattttgagtagcaatttgatgtactagcatgtccagatgaattgggtgcacaatctatttactgaaaagaaaattgtggtacgagaaacttctaagtgtcaatacttcttgactctgcaaaaggaagttagggcaaccttaaaaatatatatcttttaaatcagtgaaattttatataggttttcttcttcccttacttgcacatttgtgagaaaatgtttaacgtagcttctaaatctgtatagattaaattggaagtattgtttagtaagcttagtaggtgtgtatgtcagaggaaacatacatgaagaaagatgggcaaaaaggcttaggagtttatatttacaaaattttagggaaattcatgaatatgacagtaagaccaccaattgtagatcattttggctttgtacttgtttctctggttttcaggagtacttctcttttgctgttgtgtagaaagtaacaaaagttacatctagaacatttctaacgtttctgctagcgctaaaaaaaaattgtagcaataacaacaaaaactcttctataaaaatcatttgaaaattgccatagacttgaagcgtaatttcattgctgtggtagtactattgtctcttaaattttcagaatagatatttctgttataaacttaaagtgaccttcaatatgttcaatgtaattatcctacatttcattgtgccttaatgtgaatattaagacttaaactacaggtgatgtagacatgcctttgttttcacattgatacttcttcttaagcaattctccctttttgatccttgatcacgaaagacactttagatgtccttacggtttgtaataactttttaaaaatccatatgttgtttaatagcagcagactttctgcacgagaaggaagtacatgataagtgtactgtaggagcctattgtctttggtcattattacattcccattgcctctgcaactccagttcctcctcctttgctgtgcttcctccacttttttttttttaatcatttggctatacagagctgcctcatgtcattctttgcatacaacatctttgttttttctctcttctgcataatggcccagctttctgggagtaactgttgtcccgaatatgatcctttactaaaatagggattgaataaaggtggagcacaaattatctggaagcaaaggaaaactaggcatttcaaaaggacccagaaaaaaacaaataatgaaccagagtggcttcgatgaattgccatagaaggaattcttggttttgacacaaaaggaacacatgaataccaaggaaaacctagggagagaatctcagtaggaaacctgcctcgtaggctgctcaggacagagggctgaagccagtagccctccagatatgaacagaaagaaatgtattttatgactaacagttaaacattcaaacatgccgtttttggaacacaaggtactttgaggagttgacatcccttcataattcatgttcattgttcctctaagtaaaatatgtatctccctttagttattctgttaggaattgtactttaaaggcaagaggacatttttgataatgcacatcttaagatgtttcattaaagtaccaaatttaaattctacctttttgtgcactctgacatttttgtctggcattttcattaattttgcgacatacataaatgtagctgaaatgttaactgatcaatactttgtctctctcatgtagcactagcgctccgttccccaaggactacacagcagaacagaaattaaatgtgtaaaatatcaaatgttaatgttaaacacagcagcacttactgtataacgacagaaaaggctaaaacaattccaaatggacagatggtaccacaaattatctacaatcacatttaaagattaaagtttgtcctgtaaaataattctttgacgcacactgaagtgtgtccttttactgatagctcagttgtccaattatttttgtgctcattacagtgagaaatgacagtactgaaaagaaagagaaaatgtgcactctttcttcccccatgttgcacccactgacatccacaagaacacaaatgtctagtcaagagcctgatgaaaattaggcccaatttatgagacatttccatgtctacaatagatgattccccaagacgagcagtgccttctgcaccacacatgtctgtgttcattcttaggcagacaatattcacagtaaaattttaaaaccgaatgcattgcacacaaaataagcacacgcccagaaacgtatctgcttatattttatccatcaccttccagaccaatgcctgtctctaatatcatcagctggctttgactcttccctgtggcacagaggtagcgttaaggaagctggagctgtcctaagcctgcatttcttgtgctctctacttcaattgacatagggattaagaaaaaaaaaagattgttttttacttttatttcattattctacatttatttttggatagtaaagtagaaaagaaaagttaaaatagaatagaaaaaaggcacttaaacattataaagtttactgacttgggcctaaaaccaagccacataatgatagaaatgcctgtgctctgtgaggcagtggcatttataaaaaagtgggccaagtagaaccgatattatgataatagacccatgatccatcaacagggcatgatgggaacaatgtgtttgtaataatgggatactgctcacacccttctcctaatggaaagctgttcttttcaataaacagggctaaaatgtctctagttatacaatgaaatctttgaaacatttcatttttaaatatataacttaatatctacaagatgaataaatatcccaagtagtttttgttcagagctgctgtgatattaaaattacaaggtatatgtattttaaaagctcttttagaaaggaaataatatctgctgtgtggccttgggcaagctacttaacctttctgtgcctcagtttcttccttctgtatattggaaaactaacactatctacttcataaggttgttgggaatatgaaattcgctaatgcatgtaaaacagttccttgacacatagtaagtgcttaacaaatattagtggttgtttttgtcattattgtggaaggatatttttatattagaacttaatcagaggttagaatcaatgattgataaggaattatgaagtagtttagaatataaatggaaacgccaggaaaatttgctacaatagtactaagctatgtttatcatgatttaataactagcttccttagagcaaacccttatttatctggcatcattgaagaatgagtttctccacataagaaaaaatttcagattaactgattggttcatagattggtcaactgattctgtcagctatttatactgggagcttactaagtgctagatactgtgcagatgaagctggagtactaggctaaaaaggcagggttcccattcttatagaactcccagtgcaggtctaataaatgacatttgattttgttattagttgttttaatcacattcaacagaatgtgattcagagcttcttttttccagcgaaacacaggtaatattatgggttcttctccaaagtactcttactctgttttcacattgtagtttgtgttctcttttttcaccatccgtgtcagcaggccccttcccacctttactatgcctgattccctctttttttttttttttgcaagcctcttgcattcagcttgtgtttcacaggactgaatccatcagacactgactaccagctaagagaactattattacatttcttctccagtgaaatttgacccccttacagtcttacagtcaaatcactcaagtaatatcatgtaaatgtacctaagttgttcagaattccagtgcctgagttttttttttttagaatcaaaaggaaattgcaaaaaaaaggctgccatcttgaatttcattttacgcgagtgacctccagaagtcagaagtttatgaagacttacacaatacacgtaaatgctaaagtgttcaaaatgaatgttgctgaacaaataatacaattatatgcatttctggtcttttcaaattttacaaatagctgtgaggaatgattttggaaggagtgaatcaaaaatggcagcacgatctttacaggacaatttttttttgcatctgttatatgaccccataaaacctggaagtaatagtctaaaatagacatagaagctcagtatcattttttctcatcaatgtaaaagtacctcctggctagggaaaaatcagaataaagtttgcttaatagtaccaccatatatttattataagaaagagctacaaaaagaatactgagagagacagagagagagagattttttttctaaaacttaacgataatgacaattgctttctttagggagacaacaacacgtctatgggaagcaggctgcctaactttctggtaacttacaacacaaagggacgtagacactctttgttccatgtgctcagacattaatgaaagtcccatacaaggcctgagaggaagacagagctcaaagtactaaacagatgtgcatacactcatttgaatggtaatactaaaatgttgatttgttactataattaaggctcttcttgtaagcccccataataaagtcgtattctgctaaactggcaactataaggaagcataaggtactcatatttgaacaaacatgaaaataaaataaaggatttcaaaagaatgactctacttaaacttcaaactgaaatcctgaaaaagccaaaataatgtgagagaagaaaatcccagctaaagctcagagcaaagtattcttttggattttctagctctgccagttggtctcatcagaagtttttaaataatcaaagtaaaaggccacaagatgaacatattaaaggactctttggatctatcgaattctcacttgtgacttttaaaagctagaaatctcagaaataataaaacatctcttaaataggtcacatccacttccagttgaatcacatgttaaagcattaccaagtagcattggtagcattctactaccaatgattttcatatcttgaaaaaaattaactataggacagataaaatcaaattgagaatggtcgagattattactattattatttttcacatggaggacttttcttggctgtcctattggggtttggaattatgcaatatgtaaaattttactttttaactgtcacagagaaaatgatacattggctgagatgtcttgcgttccggaaatctgaggggggaaaatgtattcttagactcagaccttgtacaatccatcaggttcctgcccacggcaaatctgtccagtcaagtcttaaaataggagttttaaaatggccacatcaacataactgttactatagccacagaaacatgcagctatgattactgaatttaatgaataacaatgtaagtaatacagtatgatcataccacaaaagcagcgagactccttgggggtgaatcccaatcaaagcaactattaacgtagtatgcagcatttaccagcaccatgacacaacgtttcattctgataaagtttcttagtagcagctgtaaggaaaatgaaaatattattataatttgcaagactaaaaaccatcagatatactgcaaaattcttcaagcttattgtgacttaaaaaggattcagaaagttaataaagttacaagaaaataccaaacaatttggctcacaagttaaagaatttatttctgagaaagtggaaagaactgcctttttaactaaatacaatttttaaaataatgttaacatgtaggttggactacctttgctcacaagaaaaaaaaatttctaacagactaaaatttttttttgttacttacatactatgcacctttattaattttaaactcttaaaccttattgtggttttaagattgatcaaatggtttaatttcaagacatttcaaagtgaagttggaatgtttttatttagggtcttatagaaaaacctatccagaattgcttttttatagacaacaaaatgtcttcaccattttagtagaattcctcccattcttactatcatattatctatctatctatctatcttctatctatctatatctgtatctctctcacaataaatttaacctatattttctcattattttttcatagttttggaagtagggaaaaatatatggtaaccgagtgctttacaaaatttcttattaaaacgagtataggaaaattgatataattagaaattaaaatttaaaattaaggcatgactacaactgtaaaaaagaatagcccatgtataatttgatggttcgaaaaattaccacagctatattaataattagaataattatatgtctgcaagttaacattttgctactcccaatatacttcaacgctgatctgatattttaaggaagtagctatgtaaagtttactgaggtcatatggaaaaaatatatatatgggcaaatatacatacatgtatgtgcatgccagttttaacaagtggctaaaattgaaattccttgctggcaaagtagagtctatctcttagttttccttctttgcccctatcaccttacattaagaactacttttattacttttatgtataattgtggtgaaatgttatttacatttctacttagatattgcatttgtaactcacacacttcctttaaaccaccaaatactccattgttttgctggatttattaagagtaaaaatatatttaggcttctaatattacaaaaattattaaatatttcaaggcataaatatgttcagtaaacattttagctgtaacaaatacattttagtttagttctgtgaatcagatgtaaacgtttttaaaaggggtggtttagcactttttaaaaacttaatattaagcctaatttaaaattataagcaatagatatcacgctcaatttaaattcccttcatgatagaaaaatcatatttcctgattctaactttcttagctaaaaataataaaagtttacttctgaaagatcatagttaaaatctaattagcaggaaggtttcccttagaagatggagcctcctcgcatctggattagagggaagagcttatactgggctcgctttacacacacctgcatcatacctgtgggtggtctggacatatatttgtacctcagcttttggtgttctcatttacacattccatggcaatcaaattgcattttatgttcaaaatgatcattcttttgctaatgcatgaatacatatccattatatgcatcacctacagtatcccctttcctttctgaccacccccatccaatttattagtttggtattgtcctcgtttgatcttttaaagaaaggaaggaagaaagaatcagaaagaatgaaagaaagcgccattttcaataagtagatgatcaaaaattccagtcttcccccctccatacctttaaagtttatttgaatttacttagatgttttacagatataatcaggtcttcccagagggattaatcttttcttgctttttacctgtttagagagtctgttttcctcttcaatgtacttctgttctttgggtattaatgttcgtaagctggctttcacctatacatcaacatatgtgtctgttatggattaatatattacaaatgtttacaagtttttcacgcagttcaatttgcaataatttctaaagtttcaaagtcctggctgctgtgctcataaaatataaatgtatacagttgcacatgcatgcgcttccctttcttatgccggtagacagcggccagaacacaaccgcagcagcattcgccaactataacagaaagtgtgggtgtgccaggcagtggcagaagcgtattctccaggacacatgaaggtttagagaaaatgaggaatgacagaaattctctacaaatcaggaacaaaagctttcatgaaactgaactctttagcagtacaaaaaagccaaagttaagacttacagcattaaaaatcacatctatttcaagatagatgaccccctttgttggccctgtcagctgcttgtttttcaagacgtaggctttctgttcaccattttgaatctgcgggaaaaggacatgacagccgtctgtctcgcggtctctactgaatacactccctcagtgacctttgacccccagctgctgaaactgacagagaacccaaaacaactgtggcaattctgacaagtacctgttcattaccaggatcaagtctgtcaggaaaaattaactatcatgggattcaacatggccgtgaattgagtatgttaaaatttttagtgttcttattacagaccttggttgagaaatgacagacacagagctgagagttttcttttctttttttttttttccgtgagcaaaagcaacacagaacagtgtgtcaggtgaataaaacttacagacagcaatggtatagcaactttgcccagaaagtcagcacttcgatcccgatcttcatcataaactgtcacttcaagaactgaatggatatctttaatgttgctgcataataaatatatgtaagaaaaaaagatttcatcagtaggaaacaacaacaagaatagttttgaaaatttagatagctccagctgattttgtgtgtgtttgtaagcatgctatttgcatacacacatatacaaggtagcttggtatctgacagaatttcccataatgcacctaagtcaactatagtgatggttctattatctgtaactttaaacaccttgtaatttcaagttatcattttttaatgaaatataatttcccatctgaatgggcacagaataagttatttaaaaaatcaagaagtagcactggtggtttttagactttcccttcttctaattatcacaattcataccttcccattatccctacataaaacaccaccaggtttgatatcagcaaaagttacagtatattttatgtaattactcttttttataataataggacatctcctgtttgtttatagctctcactagatcatcgacgtagtttctgttagatttatagtaaaaattaacaagcacagaaaacagaatggagaaaatgtaacatatagttattgtaccaccctggaatttagaaattaagcagggttccattatgttccaaagacaacatatgttaataaacgactgcgtgagctcttcatatttttatttctggaaaataagtgcaaattgttgacagcatttattctttgatcaaactgtttaccaagaaaacatgaattaagagaaaacaataaagtgaatatattcattactgaaaaaattgcaaccatatgtgaggagaggctttatcagggcacaatcaattaatggctttgataataatcaaacctattcattcagttacgcattctggagaaaaacactctccgcaatcttcttaggagtacaagtctcctgaccaggcttttatctcttataaaaatgtggaattccttaaaaataaattggccagacagttaaagctgattagttaccggttcttaagcagagacataataaattgatgaagaatttcgcagtttttcatatacaaaaaaatagaattatgttagaaaactttaaagaagtacttctgtttggagaattttcctttgttcagagttcatttcaaaagccctgtttaaaaaaccgaacttaggagttactatagtgtagcattggcagcttttacagtgtatgactgaaaaggtttacaaactttctaaaacaaaaggaaaattaactcatagggtattttggtatctaggacaatacttaatattctcattgtgctaaaatgaaaagaaccaaaactaaagcatctgccgaattcgagactggattgtttgctgatttcagcaatggaacaaatagagctttgtcttccttggtgtcaatgcaattggaaagaatttcaatagaaagtataaaaggaagaagcggtatggtgattcagttaatggaagcaaaatccttagccaaatcatataaaaagcacagtttcaaaaaatgtctgtgaaaacaaagaaaaatgccataccctttcccccaggtttcactttcaggaaggtaggaggaaaattcattgttgttagcaaaggcaggccagatgcattgagttgtgaatcagttaagaataaacacacacattttttttaaaaccctcaaaaataaatcaaatttaacacaattttggattcagagcccaaagaaatgcctacttacaacgtgaagactttattccactcaggattgagatttttgtagacagtatgtgttagcagtctatcgttgttcagttctaccacacaaaatgggtcactttttcctacaagagatttttggtaaatatttttagtgtacatagcacccacagttcacagtgtcaagatcatgaccatatctcttttgcaaaaagttttatagtaaacaaaaaagtgaagtacaattttaaaaattaaaaaaagaaaccaccatcaaaatagagttagatgtaactggttgatgttagcaattgttatgattcatagcaatttagagcctgaaaaaagtaaaagagacaaaattatatagctggcacttcaatttgcaattttttaaagcaaaaataattctataaccggcaattatgatggagaatgtgatgcatgtccatccctaaatcagtttttatagaaatctgtaagagccgtttgaaaagttcagccccttcactctaaggcatatattttttcaactcatctgattcactattaacttgtaacagggatttctaatcaaatttattcaggaaaaactactatattgcaaaattataatattttaattggactaagattgagttactttcttctgagatatctatgacatcacaagaaggtaaattagaccctctgaggcagaaaaaaaatctaccatttgaaactaaacatcaacaaccaatatgcatgttaaagagcagtattttttttttttctattcactgaaaataaagggtttagaaattatcatctgtttataacaactctgtcctgccatactcaaatctcatcctttcggcaattacattttgtgaagtccttaatatttttgtaatgttatgccctgtattataagaacccataaagtcagaggctctatggggccagcattaatgatattagtgcagcatgtaatttgtttgataccttatacaaatgacaatgaaatcaatatttagacaaagctgtccagaggtcatatcttttaaactacaatattgatttagactacataagaggttaatgtgcatattattaactttaatgataaagaataattgttttaaatgcattgtgaattgtagtcacagtagtttacacttctgcaaaagcttaaatatcattgaagattttctattaaattttaatgggaaggaattcattagctatcagtgacagataagctatgtattcccatacagcagtgtatttactttccatattgcaattcttaaaatgagctgtacaaactttgactcacctttaatttattaactttatattaaaaaagagatttaatatgtgtgtgttagttcagtggccttatatgtcccaggataactgcataatttaacatcatggtagtcttctcaattttgggtcttgggaacaattttaaataaagaatagagaactggaagtcttaaaggtctggtgaaaattgtacttctggcttaggatctgtattatctttttttcctccaatcgtctttatcctcttgcctacatgttaccaccctcactttcaactcacacaccccatggaagatagtgttcaaaaaagaatattttgttcattaaaacacgtagcaataggttttatgtggcacatcaacaactttattttctcccacggaattcagatataagcataaacaggcagattcaaatagttttccaaatagagttaaatgtaagatactaggcaacacctttcaatataagcgtgccacatcttaggtaggtagtaggtcacacgcataggaaatgctgggtaatgttttgactgtcggttcaatcaactaacaaatatttattacttaccatgtagcaggcagtgttctatttgttggggaaacagcagtgaattaaacaattttttaaaaatccctgacttcatggagtttacattgaagaagaagacagacaagaaatacattttatagtatcttagaaggtgataaatactatgggaaaaaacaaagatgggaaaggtaaaagggagtgttggtatgtatatgcagtttttaaaagggctgcagagaaagtcgtgctaagacagtgacatgcaggcaaagaaatgaaggaggtgagtcttgggtgacccagaggaaccgacagtggaaagaccagagaagtggctgtgccaggcatttccaggaatatccaggaagccggtgtggctggaggaatgttctggggagattggacaggtggggggttggaggggtggtagtaggtgacacagacaggtctggagatagtggcaggtctctgaaaaaacttggctttaactctcattaatgggggaggttttgagggatttgatttgaggagtgacatgctctgatggctgctatttggaaaataaggtagagaaaggacaatggaggggtaggaagaagagttaggaggcaattgcaataatctaggtggtggaacgtggttagattctggatatattttgaagggaaaatcaacaggatttgcagatgtcaatatttaatcacctaatataccctcatattattatttgacgctgaaaaacaattcactgagcttagccaagtcagttcttttttttttttttccaaggagaataagcattcaacaaggtgctcagactagatatttctagaatctgacaaagaggaaagtttaggttaaggagaaagcaggcaattttatgtttacttttctattcatcttttccttttaaaaagttctctttttacagttatcattaatggatgctaacatcaggtctttccacactatgttatgtttgacttatttaggaagtatcctcctgtcactgcatgattcaagggcaattaaaaattaacagcaatttcaaccaaaatactagtaaatgtacaacatcaaattctgcaaacttaccactaaaaagcatggactatagttgtatttttaaaaagtgactacacatagttaatatgcttatctggtttgctaaataatcctttaaatgactggcttttcagacctaaattttacagctttgattatctgccacttaaacaaacaaaaccaatcagagaaatactagtgatggacctaaccattaattatctccttaattattccttcctttcatccttttatcattccatttaggccctctgataggctgctctgcttgctgggagtacctgggttgtggggttgattctaggatgaagttgatgtctctaaagtgcactatattctgcaaagttccagacagtggtataaagaagtcctctgtaatgtttttattcaataccgtgtggctagaagtgcaaagaatgaaggcagcatccaaagttgagggatattttgtttctgataatttttgagagcctaaatatatgagaacacagattatataatctatttttctctctctcactcatttttgtcacaagactaaagcagaccagtgggtatcaaatggctcttcctgaagccccattattttggctaaaaagagtcaatccctctccctagcaatgctagaaactggagaatttggtttggatagaaaatagaaatggtggcagtgctggttgagggcaggggctgtgggattgattgctttaaccaccatgacagctaggaaggaaatcagcgttccttgaggacacggcaattttccatgttgacaattttctagagagaaataggaatgctttttgaagcattcattacttatcgagtggctgctctgctcaccccagaattataagtatgattaagacatagtccagctctcaaggcatgcacagtttagaggacatgatagacatgtaaatacacaattatgaggcagagttgtaagggctgtaataaaggtaagtgaagggtgcaacaggagcaaggagaaggaggcatgctattctataactccagaacataaagagggaaaggaagcaaagacttttccagtggctatgactctggtgatctatggtgattgtacagctctatcacagtgcttttaaaagtgaaggataatgacataaaaagtaggctgacattttacgatgaggaatattttgcttaaatgtatttgtatattcctttaatagtctctataatacaaaaacctagatatgtgttacctaactactataaactagatacataaaaatattacatgaagactcatacttttatccataatctagttaaatactaagggctattttttcctatggatctttgtttttttttaaatctcccatgagaattaacacttgagagactcttttaccctaactcataaaacagaatctataacagaatttaaagcatatattctattgtcccaatccttttttgggggtgaaaagccatttctacaacaataaaacaaacatcagaattgtctccaatgggcgtcttttctggcaatcttcaaaacggcaccaaggattaaatggggtgcactgactggctaattctctctcactcttagtccttgctctttgaggtcacgacactgacatattgataaagaactgtgggaaagtctgtaccgcccctgctcacttgctacctgttttgtgggcaagtggatgacttcagtttgtacaaactactggtttgagcattaaagtgactcaaaagatactgaatgatattcttgctcccggaatatagagttaatcctgatccatcagtggtgggctttgtccagggtcattttgctgctgacaagtagcacagtttgctggatgtgatgtgttataaaaatgtgtgtgtatggggacccagtgaccacctctttgttgccatgtctgaaaacacagaaggctttcaatagcatggaaagcaattcatacccatgggggccttttattttgggcctaccttgtacaaattaagttctttcatttaattttctcagttgccacagtttgaaataactatattttaatcctttaaaaaatataatcaaggttgccatctatcccttatagaaactggaatttcaatcataacatataataatgttatagttgagggaattccatcgtgtccaccagaacagaaagcagcatatgttgaagacatcttccatcctccttttatcactggagatggggctttggccttatccttttccatcaactgacctaaacatattttaaacatctgattggtagaattatattaactcacactttaactaggtccccactgggtctgattctgggactgaataataataataagacttctttttttctcactgagtcatgaagcagatttcattatggcaagaaaattgacaccctagagttgtggctttcaacctactagatctaatacttttttttcatattgaagattttgtaatgtcctttttactatcctggaataaaactgactgacacacaatttcaaattttaatataataccagaactgtattataaaggaggactaaatagaaagttgtttacaataaaatcatacattgacttattcaacaaatatttattgagtgcttattatgtgccaggccatatgaacagaaaagggaaatgtgtctgctgtcttcaaatttacttatagtgggaatggaggagaaagagaataaataccgaacatggttactagatatattgtatgttagagagtgctacgtgttaattaaaaaaaacaggtaaaaatagagtaagaaaaggggtttggagagggtagaggaggggcactgcttatagatttaattggggtggtcagaatgggcctcattgagaaggtgaggtctgagcaaagaactgaagggggtaaaggagtagccaagtagaaaagtggagaaaagtagagaaacacttctggagaaaagtgatccaggtagagaaagagctagaccaaaagcctgctgtgcttgaggcctctgatactggggcagggtgtgcaatgggaaggttagtagaagatgtcagagaagtaatggggaataaggtaattaagtgccttggacaccatcttaaggtctttggtgtatactgtgtgaaatggcagccatttgcaaggcttgaatcaataatagtatgtatttcaggatgcaatctaggcttagacaatcatgaaacagattttaaacgtaaatcaatagctatatttaaatgcaggattaaattttcattatgtaaattttcattatgcaggacatttagcatccccaaccccagctaccaaacaccagtatgctccccagtcattatggcaactaaaattccctcaaaaatctccaaacacccactggggcaatactaccctcctcctaattgataatcattgtctaacagcaataattcttaaacattttgatcttaggaactcttaaaaattattgaggatctcaaacagtttttatgtgggctatatctatcaaaatgtacccatgttagaaatgaaaacattaaaaatatttattaattcactagaaataataaatccatgacctgttaacattggagtaatcaaagattatgtagcccttggaaaactccattgtacactcatgaaagaataagaataaaaaaggcaaataatatattagtattattatgaagatagttttggcttcagagatccctgaacgggtcttggggatccccagaggttcctgaaccacaccctgagacccaaagctaatggaaataggtaaagctcaatgtaaatatgaatttatttcccctgggatatagaactatctgcaaaagaatatttacagaattgtgtgtaactagatgcattcttgagtcttggaattgaaccatattgatatatgttgggaagctcaaaatttatgacagaagaataagaagggaaaggagacagatgagaaactggaaaagaaagaggaaggagactatgggacctataaaatgagaagaggccgtgagaaaattatgcctaagcttttaacagcttagataaattatggtaagaacatttaaatacttcattttcaattcatatttaatatagaaactatatgcaagtgattcgttacaagcttagaaacacaaaagttgtttggtctaaaatgagaataaaaatacattagaagttcctttgtttttgcaaggcttgttagatactttaggacttatagtaaatatatactcaattagaccttcctgcagaaaagcatgaggcttcagataagctttcctataagtaaactaattagctggagagaccttttgcagtgaaataacttttttatgcttaaaaaaattaagtcctctattaggtgattaaacattttaaatacatttttaaaaaccaattaaaggcaataactgaaaattgtcatctgttaagtctttgcctttagaataacgtctttgtctctttattcctcttttacaaaatatctcatccaggaatctgttatttatcttggtaactgctacagtatcttagaatctgaaggcttggaaataaatcttagaggtcaagttcaaaacttcatccagggcttgcatcatctctgcaaccaggtggtccttcaggctctgcttcgaaagttttagtaatgtggaaatcattacttctacaagaatctttggatctattttttgttggcaaatgtaatttgtggaaaatgtttcttcacgtcatgtataaaattatgtctctgtagctttttatctattctataatttgccttctgtagtaattagaaaatcttaatgaaatgataggcatgaagggagggtacagcatctatcacatagggaatatgtgatcaatgttcattatctgctgtcctctgctggacactgtggatggcttgctgagcatccattccaactatttgctagtgtctcttcctgatctatagaggatattaagcctaaagtgacatttctagattctcttgcagctagagatgtagatgtgatttaggttgcatgaatcagatgttcttgcctaagacttgatattagaattcaattaagtgagagcacgtggagttaattttactgctgcagactgcaagcaggggtcatgtatcagttgtcacagtgtcttctcaactcgttaatgtcaacaactccttggttctgccatgtggctttagtactaacctccagagactgaacttagagtctcttttcttaggcccttcctgccccccaaagattctgtgatttagttaatattttattataaatccccttctgattaaattttctagaaggaagtttgctctttggacctaaaccttggccattaaccctccttgctagctcttatctacattctcctcatgacaagcctttggataattgataaaagaaatcatatgttctcaagttcttcttttctccagtacaaatatgtcggtggcttttgtggaaagatctagatcagcatgcctgccctgccatttacaagctggtgtgtgtgtgtgtgttgatcgtggaagagttacctaacttctccatgcctcttcagttttccaaattataaagtgggaataacaatagtccctaataaggttgttgtgagattagtcatatatgataattcttgcaccaagctcaggttagtggctgacatgtgatcagggctcagtaaatgttagttgtcattattattgttattattgtcattccagcactattctcaattgacgtgattttaaaacgccagatataccagttgaaaatatattctggttagtcaatgtccttctttaaagagtattcacaaactggattcataccccagcatatttgatgagtccactctcaacatttcacctttattcaatgtaacagaactgatgtatgtataatttactctcatggagtttaaactcaactcaaatcctaaagtcttttctttattctctatggttaaagcaagatatcacagtttagtacccaggaaagactttggatttatactttttaatgttcatcttgttgaattaagcctattatttgtctgtagtataggattgtatacatatactggtctcacataaaatgaattaagtagccctcctagcaactttgataaggaagcagtcaattacctcctcaaagtaattagtaaacacattgaacagcttagaccaaggacagagccctgtaacccacttggcatccccagtgacatcaatcctttaataattactctttaggcttgactatttagtcattcacgagtccaactatactatcgtttaacccaagtatctctgtagtaagtttttttttttcaaaaaatctagttaaatctagatcctctctatttgtagcatttccttgatccgttgttctagaaaatacatcacttatttgcacaattatgttgcaatgtaacaaaatattttttaagtttaattttaaacaatgattctagcatcatgaaggtatttcttcaagcactgagtgaaatcctagagctagccctctgagccaaatcagcaatttgctatttctttactcaaaggatcattttgtaatctttgttctacagaacctgattaattattttatagtatttctctttccctcatttcccattgatagtgggaccaccactttctcagcccatagtccttcacctctagtgcatatcaaacccaattattaatctcttttgtcatcccacctattcttccagggcagtatcttctaaccatgtgacctgcatatgaatcacacatgatttctgtaattctctttaaaacactgtctcagattcaggcctcatcagcccttgtgctaaattatcattttcattcctctttttggagatatttgataacaactctttggttttagaagaacacttttcctataattagaatttggctaggttttaaaaatgcaattactaaagaaagtaagttttatttgtatgtaagatgtggtgacataaaagaaggaagaacaatgatttgctttctttccctgtgatatttttatttgtttaggctcattcttaaggaaaagatttatatagtattaatacatttatcatgtacatgtatataatattgttttctaaaccaggtatattaccgtgataagaacagcaggtgttgtatatttctgatgcattataaattggataaaatgtcttctcatggtacactatctgcttaaaagtcttctatgagcataattattaaaaagcaaatggaacattagcttatataatgggaataaagcatactttccttgaggaatgtcctatatattctgtgttaaagcttaggatttttgtttcaagcaatataattttcagatgttaagatagtaaagttaagaaactatgactatttgcacatcctctcttttatttggtagattattttatccctgataatataccaagatgaaggacttccactacattttatacagttctttgaatgaaattacgtagaacttaaaggatttatattttatcttcttccaacataaattttaaagaatgatggtaatatctaaggctgcatttatcagacatcgttgattttattaaatatgatgatgacaattaaaggcacatgctattaattcaaactgctacaatcctattttaaaaagcaacttagcaacttcttccaattgagcaattgttttctacagggcacttgaagtaacaactgcatatgtcttaagctatttgctagcgtaacccaccaaaagttaatttttttaaaaggacaatatcttgtctatgtcatgtatatgtgcttggtatttctccaactgtatataaaactttcaaagatcagacttgcctttttctgtacagctgccttttcattttctttctctgaatagacccataatgttcagggaaaatatcaagaataataaatccaaatctttgtataaaatataccttcatgacacactcaagctggaaatcacaggaaccaataaaaatgcaggcagcctcctgataatgaggtcagaaatacaaataaatttacttttaatgaagactggaggcacagtaatcaaagtgttaaaattcatttcatgcatatctcatttgcttcttagctgatatttaccacgcaattctgtgagaaagtagaggcctaagatgctccagataaatggctcaattaattgtacagaggtagacctctttgagctgagccagagctgtgagctctttattaaaagcactattctgtagcccataaccttgttccttgactcctctctggtttccaatttaaacaagtccccatgcggcctgctctaaagggctttgtctccctgtcattgttaagagagctgaggcatcctggaagtgtgaaatcagacctcatgagttgaacggttccccagggaacgccggactgcgcagaaggtcaaagtcatgggccggaccatctaaaagtgtctgatcgccggtctgtgacacagcaagttgggggtgggggctgggggggcgggagctagactgaagaggactgaaattgaacacatcttaattaaagcccacagacagcaaaacaaaatgttttctaggcagcctgtcaaatggggcttaaatttagctctgctaatgaatctgagctgctaactgttatttcttaagataataagactctcacggaagctgataaaaaaactgtagcatgtctttttctgctgttttgttacttaaatattttccaacaatgaagacagttttccaaaagaaaaacatgggaaaagtctatgcaaataaaggggtagtaaacatctctcttaataactagtaggtttccagactacggggctggcaagtcacaagtctttatgcatagccttgttttagaaaaagatacacttatttaatgggactatttcagtgacacattctattaattgtaaaattctctctctctccccctttttctcttcctctccctctattgtttcctgaaggagatggtgcattaatttgagagatcaattcacctggggtggagaagttttatattagtgtacctttcagtacagtgaaaaggtaggacatcttttgaagggtttcacagttctcccatgtcgctgtttctgaaactgagtggctggtctccctggggaagctatgacctcttccttaggagctcagaaaaaaaaaaaaaacagagagaaagagagagagaacccaggggaaaatgaaatgaaggggaggggcggaggagaagaactcttttctccttctcctcttagaacttgaaagaaccaataggccaggtctaaatactctgcaaagaaagcctcactcaatataggagacttggaatgttctgttgaggcaaaaattaggccctgctcaagggaaagaataatcataagctaaaaaagacatatgataatatgaactatttcctaccacccaaagaaaaaatattttcccgccacccaccccaccccaccccgctggcctttcctcacaacgtgtagagttttaaggaaaacttgatctagctgcagagagaatgttccccagtgaacgcggggccagacagtctctaggtcttgctttgatggtgtggagagacattaaccttttcactggttagttgaaaggtaagtaagttgtactgagaggtatttttcagtgactcaaattttttcccttacgaagaatttagctgaccaacttttcaaaccagagtgccactttctcaggctgtgaaaagctgcccacaatttgactgaaatttcaatccactcttgtgccttgctcaatgcatgtgtatgtgtgggagttgtaaattgaggccttaaccaccagagttaatctcttttttaaatctgtattaaccttaatgatttgaagtgcactgtccaacactgggctattgagaccgaagaaaaaactaccctcgactatcaacagtttattaggggcttaactgaagtgacctactgtagtagtgttcagctgaacaaggctataggctttttgtggaaagggaaagaattgagggtttcattaaaaagtaatttgtgctttatactcactcattcaaagagagtctcaattgctctttattcacacagagttaatacagtatcacaatgtttctcaatgaatgtgttgtaacaaaagaaaaattttacattttgaaagggaaaaattctttgtaactgtagtaagattgatggctacttaaaagactatagaatctttctttcctgtgctcatgtctaatgatggaatattataatttaacattttttgctgaaacaatgggagtttaactttatgttcagatcattaaaaatatcaaaaaaacagagccaagttgttcaaatatagatttgtctcgttagacttatttagaaaaagtgttctgaaatcaaccgtgtatcttacagtaacaggctcatttgtaccatgttagaaaatattcttgccttagcacagacagttaccagtgatttaaaaactcccctctacatcgacaaaattcctaaatggacgctaagttgaggatttgaagacagcgctagtcaattgcctcttttcaaactattgcctaataacttgtagaggctgactgttattatccactgagacgcacatcatatctttaaagttctttgaacaagtaaaagagaaagcagacaaagaacttacttgtgtcccaaatttaatgacaaagacaaggaagcatcaggatacatgtgtgcgtgtgtgtgtgtgtatatataaagtatccttttcaaaagtaaaaattatttttaaaattggtagtatattcagacatttctgactcaaatatatagtctttcaatttttgccaccatcacaaatgtcataaagaccacagaaggtccaagagtgagcaaggtcaaagactgaattatctttttgcccctgaatagttcaacatctctcttgttcaattcagagcacattagattataaggtcagcgtgaaatggggaatcattagatttatatctctaaaagtggaggaaaaaaatggagactctgttatttagtattccccaaattaatgttcattttatcaaatgaaaattatgtctcattgaatccccagggaaaaggctattgttattcacatcaatttacatagaaccattaggagagaaatatctctatttttttccagctttgagagaacatgtattttaacttccatagtggcacacaggccaactgggttaatctagtttgcatattcatgaagtttgaaaatcaatgacagcttctctccaaagaagacaaacttatacaattctatccaattatataatgggcaggtatctaagcttttgaaataaatggtacttgcatttttctaaaagaaatgattgtgccagattaatttgattataatcatactagaaagaaatttcataagtaggaacatgtatatacattttacattaattgttttatacaaggagccaaattagcatatatgcaaatattacaaactacccactctcccattttcaggtattcctgttttgaaaaaatatgtgacaactgttatcatcttcttggttacaaatgagttgataattacctttttaaaggaactgtaaactaatattttaaattttctcacacatggtcacttaataggcaaatattaaaatataaaaatattgcagttttggaacaaacatctgctatttttcatttgaaggcatgttaccttttaatttgcttttgattctgttgaatgaattaaagaagtgcacagtgatttcaggtccttggatggtagaaaaagcacatttcttcccttgaaataagtttgttacctcattaggattatctggctgaatgttcaaaatggtaagcatatttccagaatgataagttgatattttctttcagaaacagtgaaatttgcacaaatggtcaagccagtcctatttattgtctaacttgagatggataatttaaggaacagtataagcatcccccaaatccttatgaaattaaatcataaatgaatggtcacattgttataaattcaaaataatgatttaattctggaaattgatggaataattgccatcagcctgtttgttaatatgttacagaaatagtattatgcaaatcaggaagctttaagagacaaaactaatgtggacatttgtacagccttgtttcctactttaagaaatttcaaacaatctagagacttagtttagatccaaaattatctctgggatgtgccagggaatttgggtgactaatgagttggatcagcaacccaaatatcaagagttgataccaagttattgagtattatgcacctaaaattttcagcaaaatgtgcaacagatttcatgcatgtttgaattataagtgttgatgctatgagggaagctgattctgtaaagcattggttcaatacctggaaataacaatatctggaagacgtattcctactacattgattaaacttcgaagaaggcaacaattcaaaagtcattttgttttttagtgtttatttttaatacattaccctgcctttaaaaagcagagatactataaaaatcagggggttggcaaatatttctaagatcatccctgaatctttaaattatttattttgatgatccatcaggtgaaatgcaaagttgaattattaaatggtgtagaccttgtgtgctgcttgatctgagcaataggagaattgcatcatctcttaccagtgacgtcggcagccattaacccttccgctctgatgactttcacctggagaaatcccacatctttcaggttgtgaaatatcctcaatgggctctgaaagaccccaacatcagtattagaaaagggaggtcccaaggagtcttaaagagtgtgctgagaaaacattacattttttagtttatcttcagactctgggggtaagaagatcaacattaaactaactaatttttttttttactgttttcctcttggtgagttttggaaattgcatgtgctagctgaggattaaattacctaaacattgttttctcgtatttatttcaaaagacttatgcaattctacataagaacttaagtagttttacataagcaaaatacatacagtatcttttaaaataaatcaaattgatgactaaaaataaattcaggccgggagcagtggcttacacctgtaatcccagcactttgggaagctgaggtgggtggatcacaaggtcaggagttcaagaccagcttggccaagatgatgaaaccccatctctaccaaaaatacaaaaaaaattagccaggcgtggtggcgggcacctgtaatcccagctactctggaggctgaagcagagaattgcttgaacccgggaggcagaggttgcagtgagccaagatcgcgccactgcactccagcctgggtgacagggcaagactccaactcaaaaaaataaattcaaaatagtgagtaatttttcttaaatttatagttttatttgccattttagtatgtatagaatggaaacgttgatgctgcataaggggttcaaagggtcatttgtgtttcttcagtataaattacccttccaccctcatgaatgtacaccacacacacacacacacacacacacacacacacccctctatgtggataattgttgctatataagtagattttctgaaagaataaaaaaaacacatttaatcccataaataattatcaataaatgttgaacaataaattatggaatagatatgtctgcttcctttttcaatctcctctagccagcaaaccactccaagaaaaattttcatctgtagatataatggtttggagattagtggcttttttaaaatttatttttatttttatttttttagagacagggtctaactcaggttggagtgcagtagcatgataatagcttactgtaacttccaaatcctgggctcaagcattccttccacctcagcctcctgagtggctagaactaccggcatgtgcaaccatacttggttaacttaaaaaaaaattaaaattctgtagaaaaatgtcctgttatgttacccaggatagtctctgattcctggcctcaagtgatcctccagccttggctcccaaagtgttgggattacaggcatgaaccaccactttcagcctaattatcaatattaaatctcacattgttggatatataacactcttcagactttggggataagaagatcaacattaaactaattatttttttctactattttcctcttggtgagttttggaaattgcatgggttagatgaggattaaattacctaaagactattttctagtatttatttcaaaagactactgtagttctacataagtaaaagacatacacaatcttttacagtcaatcaaattgatgactaaaaataaattcaaaagtggaaatttttcttaaatttacagttttatttgctattttagtatgcacagaagtattgaaacttcaatagaaaaaacagatccaaatgataaaatctatttcacttcataaattaataatggtggtgttttataagtgtagcacttgaaggaattaaaagagggaaaccaatacaataattcagaagtctaattaatgggcacaaatactttgagagtaaaatgaaccaacagaatgctaatatgcatttgtttatttacacttcatagcatttttcttatgacacgatcagcacttctactctgtaaatcaaaggtacttctttttcataatttataaaatgtttcataaccagagaacgtaacatacttttgcattataaagttattaaaatgttactagagtaaaaagcattcccatcatcatattaataatgtgagaatactgacaagcaaaagcttactgcaatatgaactttatcagtcccgtatgaccagtaattgtttacactgaaactatgaccttcgtatattgagaggaggaaatgcggatacatgagtaatctcatagcctaactttttataagagtgtttagcatgaggattaactgttaatcttttattgtttttaaacagttgtttatcaccaaaaatctatttaaaatacccaggtgacaaggttcagtaaaaatgcacttctctctccatttaaattcctgtaaatgaagggtttcactgtgggggcgttagacaacagaatataattcagaggtttgtgggcacgttgtgttcctacagtaacagcaagtttggaaagtttcttatctcagagcttacacaatgttgtaaatcaggtaagtcttcgaccctaatgatggggaatagttttatcaaaaaaaggtttccgtgctttaattttcagaggcaatttaaatcaagttctattttgactaagacgaatataatcagtccttatgtctgagaatcctttcacattggtagcctcattccacagacatattgtcttcaggtgcttcggctctgatcctctgcttcccatttggagtggtaattattgtttgaaggtttcatttccccaagtcagctgacactccataatttattgcaaatttcaacggtttaggccagtgacacatcgattataataagaagtaaaaataaataaataaataaataaataaataaataaataaatatattggtttaaaaacataacttcatcaagaggtattcatcaagaggtattcctgccttgctatttacggttattttagaaggcctaaaaacccggatggcttctgaagccagaaatttccatagcagaggaatctatgatttgctgtgaatcctttcagccctcaatagatgggaaaagattgaaatgctctggagaggagtcctctttatttttttaatgaaaggctgtataatatattttctctatggctgcagcagctgtcagggagagcatctcagttcagctctattacgggagaggcaataccccatcctatggcatcgagatgctctgaggggccagagctgattgacagcttgtcaccgtgacgtcttattccatctctgttatggagaaaattaatgtcacaccaccagccttatgactcgctgtcatcttagaaccgctcaccttttatcaatgctctaaataacatttcaagcccatcgtctcacggtggacaatccggtcaagggacattaaatcagatgactgtgaaatgtcataataaaaatggaatgctaacaacttcttctctaaactagctcctctggtttttaaactgtgacaagggggagcaagggttcagcatacccgttctgaaaaggtcatacaattgctcttggtctactacccattactacccgccccctattgaccttccctcatttcctccccctaaaagaggaaaaaagaaaaatggaattagccatcttctcagaatgtggtgatcaaaaaatggctcacagagcgatgtttgtttaatttgtggggcttcaatccttagcaatgaacagctaaacaacagcaatggagggctttttttagggctgtttcatatcagagtgggggcaatttatttgcttccctgacagtgaccaatgtcaaattcctaaatttgacctcaacttttaaaaatacacatgttcttgcaggaaaatatagaaataattctccaaacaacctccattatatgtttctccaaaacaaatgatatttcagaaatgatatggcattcattcattcatttcatgatccttataataaaagggaaacacactgaaatcctaatccataggtctttgtccttttatggatatgagtaaatataacagatgtgctatgttgcatatagtggtttcgtagcaggtatgtctctagagggaggtataggcctctgcctgaaattcaaggctgaaaaaaagtatatttaaacatagttcatttttgaatatattgagcagaatacaatctgagaattaagtcaaacatccgcataatattttacattttattgaaaaaagacatggaaacaaatattcaaattctgaatggaaatggccaattgccattcagccatccagcaaaaagaaaaaaaattaataataggtggattacttctaattacttaggcagcagtatcccttaatatacgggataatatcaaaatattaatccatcaactatagtataatgcctagaagaatttttatattaatatactgattaattccattaaaattgttgtaattcatgaggctcacttctggtaacagaagaatatattttggtggataccacagtgtaaaataatcttcataactgcaattatatattagaagatgtcacacaatatcttaggctcttaggtggtttaaaaatatatactatttagccttgctaagtcacctctattaaactgtttatgataacaccattggtggatgagttgtacaagcattagcagacagctgattcagtggagatagccagaataaatttgctgaagcgcacatcctgctaatctgtttgaagaatattgtagagcattagtaccagcacttcatgttatctgcacagactgataaggtacatctttattaaattcagttattgaaaggatgtcagtcagcaaataggaatattttaaagtctaaaaaaaaagtggttctttgttagagcttggtttcatggctgagtgtctagaggagccttctaaacacctggcggcactgtacaatacaagctttgtcattttaagtggaaaagcttttttcccagcttcatgggtactaaggcatttactttttcaaaccttcattgagagagaatggtggagtaagagctcccctctctgttgattcaagaaaactacatggtgggaaatgtccagcgggaggatgctgggaaatagtaagatttggttgtgaatatttcagttaggtaaaatttgaagagggtagtcattttagtgattcactattccatactatcgttccacattcgatcaaaaagcagaagacttcctttaattctatttcacattcaattaaaaaaattaaaggaatgaagtgaggctttcctgagcagctgaaaataaaaatcattcctgtggatactctttagttaccagcgtactaattaacgtaagtaccattaactccatcgcaaacttggaaagacaaagacattttaattgcagctacaaagaatcaataaattaattttaaagtcacattgtataaacctggccttcctatatgggtagcatccctgcatgataaaatcactgagtagaatctcagaatccagaatttgctctggaagagaatctagagaagatcaagtctctagacatgggtgggtaatgcaaatacttcggcaaaggtctgtgtggcatttgttttcactcagctttttacttgtgccaattcttccaccagacaacttctcagaagtacttctgtccctccaggtaaattgtttacaacctgatctagtcacatgtgtctctggaaggaggagggttacatacgtacatatctctttaatatctcctctcgttccttctggtcctccagggagttgacagacaggtcagagatgctgactgtggctgatgctgtcagagtgaccagcagcaccaggtgtccctcaccctcttccagctgcaactccagcttgtgcgtctgttccctactgagggctgacaggtcgacctggcacctagagacaaatgttttgaatcagcaagtggctttttttttttttttgccatatcaaacagctgttcagagttctatgaaacataaatcaatagaaatattatttggaccattggaagaatacatctttcaagtcagctgactttcttcacaaaattcagaccctcattatcgtagggtctgtaactgtttatttcctgtaagatacaaaaaaatatgttaatctgaaattctattattacccactgtcacggtattcataaagtggtaaggacttcctatctctaggtggcctaaggaattaggtcactggggctttgcttatagaaaaaatgatgtgtgccatctagagagaccaactaccaaaattctgaatttttgtgttacctttaaaaaatggatgttttcccctcattcgtaaatgttattaagcagtgaatagaatatgtaccattgtgatgccatacattttacattttttaaaaccatgccaatatattcatagtactctgtataaaccgaaataaaaacatataaatctcctgaaaacataatagctcaagtgttaggcacctgagttgtgctaagaggggatttctaatgtggcagtgcctgctctgtatgccactctctcagagctaataccctgaaaacgcttttcataaaaatgtcagttgattttgaagagaaaggtaatatggtgaccacaaggctaataaacggagagaaaggtggcaggcatgagtgaaaggcatttaaaataggaaatagccaattataagaataaatgtggtaacctaccataaactgcgtggtcagagacagattaaattcttgctctttcttattcctcactctatttggtatttatggttttgcttttaaactaaactcctatggacagtgtttcaaagcttgtagttgagttcaaacatctctttagcaagagtgattgcagatattgaactgaagtccaatatttcaataggccttttatttttgcctactggttaatatgagggatgtctgggactagacacgaatgggaggaagaggaatattgatgtaagaaaggaaaacaataagcaatgccctggtcagtagcagaaagtccgtgtgtacttaaatgctaactcctgagaaattgagagattacagtctgtacaagtctggaaaacatcttcctgaagttagaatgtatgtcaaataactgcattccaaggtactctcatgctgtctcctcaaactctgaagggtgaaaaaacatatcacatcccttatctcatatttaaattttaattggaattaagttcttatcaataatacctggaacaaactgaggttaaaaattttcacagtggaaaacaaccattcaaacatattctctaatgaaaaaaaaggtattatctttagagatctttccagcacctgacacactgctgggcccatagtttgttgaatgcaaataactctggcttggatagggagtataatactagagaattgacgagagactataattcagacaatatttttggttgggtacagttggaaccaagaaaagtctttcactcacttttttttttcttttttttcccactcactttgatcatgcatttcccggtcccttccttttttatataatgctgcagcactaaaacgcattgatgtcttctgaaggattttcttctatgcccattaccactttgtactgatcatatagatgctggttcctcttaatttatattagtcattgcatttaatgctttacaggtggggaaactgctctcaagattatataaattaggctttgcaagctggcaattttcagatggaatctgattcacagatttgttgttttgcttgtgctaaaaaagttttgaatataaatatttttaaatacagggtaaatgtcctctgaattagttactgttccccatactggcctatttcacttaattacactaccttgctctagtaggcagaaggatttgtgattcttgcagtctccttaatttaccaatgagaaaactgagggccagggagggtacatgatggaggggagacatacagttagttattagcagagcccacctgaacctgggactctggaatccaggatctaggcttttctccaccactctatctttaagtaaccatgcatcccaggaagaagcactgttagcagtgcttctcaaagtgggtaatatctggacttttttttaaattttaattttttcgagaccaggtcttactctgttgcctaggctggagtgcagtggtgcgatcatgatcatggctcactgcagcattgacctcacaagcttgggtgattcttcccacttcagcctccaggtagctgggactacgggtgcgtgccaccaggcctggctaattttttttttttttttgtattttttgtagagatggggttttgtcatgttgcccaggctgctcttgaactcctgggctcaagcaatccacctggctcggcattctaaagtgctgaacaagccaccacacccagccctggactttttgagacagagtctcatactatcgcccaggctggagtgcagtggcgcgatctcaactcaccgtaacctctgtctcctgggttcaagcaattctcgtgcctcagcctcccaaataactgggattacaggtgcccaccaccatgctcagtggatttttcttttttcatatttttagtagagatagggtttcaccatgttgaccatgctagtctcaaactcctgacctcaaatgatccgcccaccttggcctcccaaagtgctgggattacaggcatgagccactgcacccagccgactttttcccccaaacttttattttaggttttggtgggcacatgtgcaggtttgtaatatacataaactctcctgtcacagggtcttgttgtacagattattttgtaacccaggtgctaagcctagtactcaatagttactttttctgatcttctccctcctcccaaactctgccctcaaggaggccccagtgtcgttcccctctttgtgcctggacttatttttaacagaaagaattatctcagtttccaagtatgaaaatatgttatttttatgctttaaaaatatatataaaccagagaagaaggctgtaagttattgttcttataagatgattaagaaaaatttataaattgaattttgaaactatgaaactaataaatttaaattaacaatataaatgtatagggaatattatgcttttctgtaacaattaaaatttcagtattgggtgtactcatagaaatagtttatctcaggtcctgtgctatattcagtgtttcagaattttgactttaataattccaatgtagagaatgcccattttcataaatatatcagccaagaaagtatttaatgacttcaaggttctttgtgctagttaaggttatttggatctcttatttatctaaatattctactcgagagtaagatgccattttaaatgaagtgtcacctgtaactaagcaaagttttcttgttggcttgaggataaacttaaagctttactgatgggtatcaaatcatattgttgctggcgttggctgaggaaaaagcatttgctaccccctcataacttttgaacaaatatgttcaaggatggaactcttccaacatagtctggtgcaatgtgaatacagtactaactgctatggggtagattcttctatatttggctcacctgtactgttatgtcctgaacaaagggaggtttcactactgtttgaatatagaagtaagaagtggtcatccaggtggttcaggataggtatacagtaatggttttatattgttaccaagataaaaatgcaaaatttaaaaagcatcaaaacaaatttatgaattccaaaaatatgttcacagatacatacacagagaaaagtcccgggtttgggagtcagattcccttggttctagacctcagtcttacattaattagtcatgtgacctctttcaagataacttatcctcttggatttcagttttctcatctgcagatgaactttaaattctcaaaccctcaaattccacaatttgttgtaactgtatgtttacatttgctgcatcttcctttctttgcaattccacaaatcaaaaagctaagagaacaaaattatcttataggcaatgaaatagtattcctcagatgtattgctaaaaaaacttgaatgttggtgtaagaaggcatctcatctcatctaatttcaaattgtattgcaaagagcagtagggtgtgccactatgggtggcagtgtgagaaaaaggggtatagactgactatcctctttggttcacagagcagctctcctgacatctgttttatactgatggttctatatgtgtggtttgaaaacttacatgacacagcttatatagctccctaggctctcctggagccatggtctcctgagtcctcagctgttcgctttgcctcagctgctcctttggctatgcctccccaaagggctgctcttcatcccaaacccatgaccaactgactgtgcttgggtcctcatgggtctcccacctagggctggctgatctttcactgtcccaaatgagctaggcactccccatttctgccaaggtgcatccaggcctagccgccatatacttttgagtttctggcttctaaagccacttctgcacttcgataggaagccacactgtgaagattgtatctggctcccagatcaactgccaaggaagctgcatgaaacaatgcagaagttatctccttgtagggtgaactgtgatcaatgtaataggagatgggaagacaatgtcccacacctcttccctttcacaaactgttccaaaacataattctccatatggcctgtgcacatgtggccatatggatgcacctgctaagcaaccagctatatctctgaaataccagaaacagtgaccaatccatgaatatatttccttgcatttcttcctagtattccctgcctcatgttctttctttctcactctcactgtctgggatggtacctcctaataaagcaccagcactcaatcattgcctcgtgctccatttttcttgagaaactggcttaaggcaaaaaccattgctacagtccaaccctctctgtatggatgtctacaacacaaacttgaccatgtccctccctggctttgcactatttacgagatatccttagctagtcaacagtaccctccatgacttaccatcagcttatgtgtcacttgctgatgcattctcacttacaacttatcattccagaagccttataatcctcccaacatccatgctagaacgcacctgtttctttatgtttggacaaggcatgccctcagcctgagatgatgtatctcatttttgcatggctaattttttaccaattctcattgaaataacttgcagctgtctttcttaatatcctgaaatgcctcaagggcaggaacaatatcttattctcagcacgtggcacaccaactggaacatagctggtgcactgtaagtattaaagtactatggacaaggaaatggaggctcaataatttatccttggtgacaatgcttgacagtggcagagccagtgctagtgtgtaatgtgctcattctaccacttctatattgtctcctagaaagtggtttgacttctccccaatactcatttcactcactcattaattaattctttcattaactattcattaagtgcttatgtctcaggtccttttagatttggagattcagccccttctaaaccttcaggtttctcagatccttacttcagaatgagcacagattctgtgttactttgaagaaagttatttggcatcagagtccatggctgggggttcagaaaacagaaattttaataaatcctgattattcattagtattgtgatattaagaaagtcacttaaactctttgtacttcagctttcctcatttattgaatggaaatttttaaaaaaatgccttctctttgcagagaattgtaagaacacaggaatcatggatgaaaaagtactttgaaaagttgaaagtgctatgtaaatgtattatctagttatactatcacatttgccttaatttgatatttgaaaattcaagtgatctgcatcaaattcaactcatcaattaatgaatcaacagaataacaagaacagactcaaatctaaaacagatttttgtattagtctgttctgacgctgctaataaagacacacccaacactgggtaatttatataggaaacaggtttaattgactcacagttccacacggctggggaggcctcacaatcatggcagaaggcgaatgaggagcaaagttatgccttctaaggtggcaggcaagagggcatgttcaggggaactcccctttataaaaccatcagatctcatgagtctaattcactatcacaagcacaccatgggaaagacccaccccatgattcaatcaccttccacccgggtccctcccacacaatggaaattatgggagctacagttcaagatgagatttgggtggggacacagagacaaaccaaatcaattttagagttactttccctcattctacaaatgcttcctagtattccctgactcatgttctttctctctcactcccactgtctgggatggtacctcagagagtgagaaaaataagacttagaaaaattaagtgatggcaagaacttgaaccatgtttcctgacttccatatcagagcttgaagttctctgcattaaaaaaaaaaaactatatacatttgaactatttaatcatgtgaaaggaatattcatcatctttatggggtgatgttatcctctaaaagttcaaggagaaaaatctcagtgttctgatcaccgtttttctcccctgcctttccatctgctgtctctgaaccagtgactcataacattcctttctagatgaaacagtcttgtgattagcaccctgggtgtgttcgtatgagtcccgtgggggtacagaaagtacatgttagaactatttgcaattattttttaacgtaaaaataagacagaaatgaagcctcatcagtctctaatacatgaacacaggtggctcatacatcacataggcctcaagtattttgagggaggcataggagcttcatggctaacacgaaggggtcaacagtggcaccctttggggctcactcgcctttcctgaattgcagttcatacatgccctattaagtggatttagagattatataatctaatttttaactaaactaatcctcacaaaatggacaattggctttaaaagatcccaccaaaggaactgtggatagaagataacactaattgaacaagcacaagtgaacagcaatgataaacaagaatctgccgagccgacacttctaccctacttgagctctatgtcagccacgatatagctcacaaagcagtggtactagaatcagatccggcaagagatctgccaaaacaatccaaaattatcaagaggaaatttatatctgctctctttaatatatacttctaagtatatattatgccttaaagtactaactaatgagattttgaagccatcatgattggcagaacattgaaacataaaacactcagaatgggaagacatgcctctatgagagggggttttaaaaagcacaattttacataatttttagcaaattgaataatacatgtatgaagctttttgagatttcttaatatatgagaactactttacatttgcataatataacatcttatattataaattgatataatatatgactctttgaaatgtttgcattaaaaagattcaatatgtagctgctgaagtgttttcaagttccatgactatgcagaagtttttactctatctctgacatcacaaaatgctaaatgctgttattgcctttctgttgttagaagttgtcactgttcaactctctctggggagattgatttacctgggtatacttctgcaaacttctataattccctattcattgacttgaaggtaaactacacactatacatacagcagtgtatggtaactgtctttgagaactttgccaattatttttaaaatattacaatgagtacagcctttctgagaaaatcttcagaagaacaaacagtaactcatgaaagaaaagggattaaaatcctaatatattttgtttaggttgagtttatgaaaaaccaagacgaaaatcaacgacaaactccattctttatttaaatattgcctatctccctaatgaactatttcactcaatcattagtaaaaaaaaatagtaaaatacaatgttttttttaaactctcttcagtttagaattttctgactagctgtccttgtgctttcagattaataatgcagtaggatttctcctgctcttatttatgtagaaagtaaaggaagcattgtagttttggtgtcacagataaaaaacattccaaatcagaatctatggagtgtcaaatgctcaaatgtattgactttcaacattaagaaaacattagtttggtttttatccaaagtcaaaggctattttcctcatttgccacatgaaacttgaacacacatttgtgttcatctaaacagttcacattctcttctcttcagcattagagagagccatagatttatttttatggctgtagattttgaaagcatttgttcttcacccagaacttaccaattcagaatatatttttcttatcatataccattaataagaatttcgttaaaattaagcccttgactcaagcgtacattggtagcatttagttgtcatgggtagcaccaaatgcctaggccctgagaacaatgcaacgaagtcagtagcaattcaccaacctaaaatatatgtaccccaaatcaacgccactttaaagataaacaagcatttggcacactaataaataatgctgtaaatcttgctatattggattgcaaataactccaactgaataaaattgcatgacacaggatttacttattctgcacattcataaaaacaacttgttccctgacagcactcattcttggcaatttaccacagctgtcagcagccaatttgttcagattactgctctgcataaaagtgtaacaatcatggggatttattagctgattatcgtaaagggggcagtccgtcttgcctgccaaaatgcaggtgatcagaaagttaaataattacatgcagattaacattatttcaccttcacttgaaatttgtagttcagtgacaggtaaaatttgttgttcaaacttgcaatatggtgtgcatcacctaagttagtttaccgagtacttggcattttactgagcactccatggctccaggacaacatgctgaatacaagagtgtgatgaaataagcatggactttagattgatctggatttgagcctcagatcaatcactccactggctgagcaacctcttaactgccctcagcctcactatttgcatctgcaaaattggtataatatgaaccacccctgctaccccagagtgtaaagctaatgtgtataatagggccctgcaggttgtaaagcattattattattgtttctttccatttatggtaaatttacttttgtgtaaagttttacaaccagacagctccgtagatatcatgatgatgaaaagttatagtaagtgtcttggtaaatgtatagcctacttttcccccaaatatggccatttattattactgaagtataaagattattcagacacttttatactttaactaattcattcttctcttttgcattatattcaattacctttccacagttacactgaaactttcttaccttcaactaagtcatgttgttctaattgcctttccattaatgcctggtgtcagatcagcatttgtctgacaaagagccataatttccagtgttaaatcaagcttcagggatttatattcaaacccaggaaatatttactgagtgcttggtgccagatacttgtttaggtatggagtatgttgcagtgaacaaaacactcaaaaaatccctgccctcgtggagcttacattctaatgagggaaaataaatgataacataaataagatgcatagtttgccatatggtggttgctttaatggagaaaaacagagcagaatagaggaatggaatgccaagaaaagcaggttcaattttaaataggcttggtatggacgcctccctgatgagacattggtgcacagatctaaagaagatgaagaagcaaggcaggtgagtggatccctgaagaaagttagatagagggaaaggtcctgaggtgggagggtgtctggtatgccttgaggaacagcaaagaggccagctggctgaaagtgaatgaaggacggggataggcagaatagcagaagttcatagtagacaagcaacaaggccagattgtgcaaagtcttataggccactgaagggactgtggctgtccctagattatgatgcaaaacaattaaaggatttggaacagaggagttaagttactttatttttgttttaaaaatattactctggctgctaattggaaacagactgttgtgggaggggaggtgtggaaggaagaacaggaggctgttgctactgtccatatgaaagctgatggtggctttgaccacaatgataatgatagagatgatgagcggtcgagaatcctcaatatgttttgaagaaaaattatcaggttgctgattgatttgatgagagtgagagaaagaaaggaatcaaacatggttccacgatttttggtgttagcaacaaacaagagaaggctgaaggaggagcagatgtgtgggactgaaggttagaagtttagctttgcacattctaaattggagaaatctattagactttcaaatagtgatatcaagtaggcagtgcaatataggaatctggaatgcagagaagagttatggagtggagctggactcttgtgaatcaatgaagtcaccatgggagccagtatagatgaagaagatgcccaaagagtgagctccgaggctttccagaactacaacatgaggggatgaggaaaaacctgcaaaggagacaagaaagagcatgcagtgaggtaagaaaaaaacaaggagcatgcggtgtcctggaaggcaagcgaaaaatgtgttttaaggtaaggaaggggtcagctaaatccagtactgctgctgggtcaggttagacgaaggttgaaaactggtcattgaattgaacaatgtggtgggcttgggggacattgacaggagtagttttggtggcttgttgggggcaaatgcctgactatattagttcaagtaagaatggaagtgggggctgggcgcagtggctcacacctgttaatcccagcactttgggaggccgaggatggtggattgcttgagctcaggtcttcaagaacagccttggcagcatggcaaaacgctgcctctaccaaaaatacaaaaattagccgggcatggtggtgcatgcttgtggtcccagctactcaggaggctgaggtgggaggatcgcttgagcccaggaggtggaggttgcagtgagccgaggtcgcaccactgcactccagcctgggcgacagatcgagaccctgtctcaaaaacaaaaacaagaatggaagtgggtaatgttcagtactaaaatagttttaactctttgacactccagatttgcaagtggctctttcattcatagccagtcttatttttattaaatataatgaaacaaactctgttattgagtttgcatttacaaaatatattttaaaaaatcattatatatgaccaaaaatggaaagtaaaatagacaattataaaccatagcataataaactagtctatatagataatgtaatccatacaaatgttctcaaatttgggactcagctcagacagtacccttaaaaaatgttactagccattgaaggaatagtattaccctccatggccaactttaaacttactcacaagcctccagcaaattcctagaatagtctctactttcaaaattaacagacacagaatgttgcagtgagagcttgcaaaaaaggacagatgattatgatgacagttttattactgttacttcaccctgaatactcaaatttaattggaaagtaagtcaattgtctttgaaactattctaggaattaagtaattctattataatctgtattatctccactgtttccatgcaagcttcaaataaataaagaaacacaacttgcctgatacttaggtataataacatgttgcttttcagcggcaagatgcttttaaagagcaatttaacaagcgtcaagttagagacctggaattttcagtgccatctggatatcaaaaagatttgaaatgatgatgcatcatagttatttcccttttctgcaaaaggcaaccttgctaatttaggagtgtgcagcatgtttctattgtccatctttcagtatctcaaaatctaacactcattcctttcattgtgtaaaccagtataaaccactactccagagctgtcttgtctatacctgtgctcatttcactctaaaacttttgggcttaaattgctctcataggcaattaagtttggtatatgaccgaaaatagacttctctttttcaagcttccacagatacctggaataatccctatgatcttctacccagcaatttgtactgttttctcaaaaattagccaaaatatgaaaaccctttagaaacaaagtgaagtgagatagttaggtccacctttctgtcaaccatgtctgcccttgaagaactcataatgttattaagtgaggaaaagaaaatgatcagtcccaattggcctgagaaattttcacagtttttaaattggaaaattcttaccaaaggaaaaaaatataaaagaacatctgtcattatacgaaaaaaaaaatagagagaagaagggatatgaaggaatgtaatgtatacctagaaatacaggtagccagaatatttacagcataatctccattattttaccaagataagagagtttgaatacaaagaaataaggttgaagtagcaagttacacatgcccatcattctgattatcttgtggtcaccaaatataactaatattattataaccaaagaaaatgaactaatcattcgaggaatagctacttagcaccttctcgaaagagctcatagcctattgagggagacagaatcttagatatataattataatgaaatgcatttaatgtattaacagatgtggtatatcccaaagagaacaagataaaactttaggaaaactctgaaaatagtgttttaattaagggaaaaaatgtgcaataaaggcctgtgctttaaaaaggcttgaaatgtaatgtagtattagattacggtggtgttttccaagctcactttacaagtaaaatagtaaaggctacctgaagctcatctttgacctctcactatataatcctatgaagaaaatgatatatatataactgcatcataaaaaaaatcaagagataaatatgttggattggattcctgttcttacttttctggagtataatttattttactcttagtatgtataaattttcttcaagctgtatgtttaaagacttggaatttcatgtaagctacagtgaggaaagaatttttttttaatttaaaaaattaacaaattcttcagtacaccacactttatttcaatattggcaggtttcaatgtgttttgctacaaagacacatatataactatcaaaaaatataaacataggctttaaattaagaaaacatatgattcaagtagtcactcaaaataaccttaactttgtgaaaaatgtcatgtaagcctcagaatactcctttctttactgtgctatcagattaacatggatctgcctcacttacatgcttcctacactaatacttgggaactctttacagatttatgaactccaaggagattacaagcattctctaccttgtagggcgttgtagaaaataatgcattttacggtgatagtatgctttatgaaaataaatattatcttagatcactttacagactatgaatatggtctttgttcctttatgtatcttatatcagatgaaattcctctttctcaactcccataactttgacatctggagaaaattcatggatatcaaattcagatagcctgtgtccatcaactggtcaaaaccgccacctactggtcagtttttgaatctatttttcagttcatccaagcattgccttaccatggtaaagtccctttcttcaaaacagtaaagatcatttacaataaccaggcttacagcaaatattcttttaataaaaatgctctaggagtgaaccaaaaattacaaattgcacaaacctgccaatgaaatcatcccttttcccagcatctttgtcccatgcagtgatatcaatgactcctcctctttcttcataaaggtgaaaatcaaattgttccctccactgaggattcaacgtttttggcataatctggaaaaaaaaatcataattgtcatattgctagcagctttttaaaaaaaacttcaacctgagacactaaatcaaacttttggtactatagtatctagaaaagcacgctgtgtgctatttgaaaaaaagattacagaaataatggaaataactcattagatctccagcatctttactgaatagtacatgaatggacctcaatggatgtgtcctgaaaatcacaagacattctttgattattttaaataacagataagatatataaattatatagaagaggtaataatctatgaaagaaatagctcactcggatactagcaatattttacataatcatagttaatgcattaagatataactcatagccagtcagtcatctcaaaataaaggagaatgaggattttcagagtttgtttttttcttacttgccatacacattggaatcctgacttgagtacatgaaaaacagacaatgaatttctgtgagagcaggagaaaaacgcaagtagcttttgggtagtcaggcaaacttttatcttagacttatagcactgatgtagtatctcatgttatagatggataagctgagacctagagtttaagtgacacacctacggtcagtatgttttagtatctagacactaactcaaagtctttgattaaagcttcgggactcttcccccaaaaccatatgccaaaaatgtctgtgaaataataaatgaatatatgagtatatatgtatgtatacatgtatatatgtatgagtatatacatatgtatatgcatgtatacatatatgtatgtgtgcatacatatatgtatatatacatatatgtgtatacatatatgtatgtatgtatatatacacatatgtggatatactctttgtgttgcatatacaagaaagatatctgaaatgtaattctgtaacttcaagtattcagataagtcatcctgtatggtagaatcaatgagcaaagtaacctatattgataggaatggaattttaaaattccattcaccattgggttaaacaacatttatatttgtttccttgttctttctttttagcaggaaggcatgcagtggccttttctctttttaatgtatggcagacagatcttcagatgtaaagtttgaaagcaatgaagtatgttatatgcaaaggtaatgcaaatgaatcacaatttttaaagttcataatctgaaattaatcagcgatagatcaaggaaagaaagagcaaagagagacacatgtccattgctgggtttcatatttcatacctaaagagcagaactataaaaataagtaatgtttttagcctaactagaacacggaaatggtgctaactaagaaaggagaagatagaagtggtcataggtacctatttttggaatcagtagctactttaatatatgttatatattatagctactttaatataagccccatggcagaaaaaaaatggcactgaatgaaggctatgataatttaaatgtcttataatcaggctcagatgaacttctgtggtattttggggtgtggtctgtctttacttatctggccttaaacagactaaattttcagttttcttttctaggattgccttccctatattatttccttcaggtcagaaataatgccttccctttctatgtggacactccaatcagcctgctagcaatactcactgcctgctaatgatgggctctctgatatttttaactaccttaagtactagtgaaaacttcctgggctggaagggacctaagcaggctgtttatcaaaaatctatagagattatgacactaaggtgaataaatgcccatcagaatggaatgtgatctttaatacaagacggatatgatcagttgtcctaagctgtctatgaataacatctgtaaaaactgaccaataaagaggacatagttcattacaacagagataagatgatatggtttggctctgtgtatccaccgaaatctcatgtcatattgtactccccacatgttggaggaggggcctagtgggagatgattgaatcatgggggcggacatcccccttgctgttcttatgatagtgaatgcattctcacaacatctggttgtttaaaagtgtgtggcacttcccttttcactctctctcgctctgccatagaaagacatgcttgattccactttgccttctgccatgattgtaagtttcctgaggcctcccagccatgcttcctgtacagcttgcagaactgggagtcagttaaacctcttttcttcataagttacccagtctgaggtagttctttatagaagtgtgagaatgaactaatacataagacatgtgccaaaaatatagttatgactactagacccttattcattattacttatattactaatattattgtttaatacattattactactactataattgatactatacgatatacttcttactactgttgttactcttcctcttctgctatttttgtttgctgagtgattatggacaaggcagtattctaagccctttaaatgcgtaacatatattcatttaatcttagtaaatttgttaggtaggcattattttaactctcatttttacagatgggaaaactaagatatggagagacaaagtaacttgttctaataaattttaaaatttgctatttgcattggtacaagtcaggttggataaagtgtataagagtaacatacaaagatttttatggcatgtaaaataatgctatttataatactgatattagcactagttgtaataatgttaaaagctacactcttgggaggccaaagtgggtggatcatcaggtcaggagatcgagaccatcctggctaacatggtgaaaccacgtctctactaaaaatacaaaaattagctgggcatggtggtatgcacctgtagtcccagctactcgggaggctgagagaggagaattgcttgaacccgggagtcggaggttgcagtgagccaagatcatgccactgcactccacactccagcctggtgacagagtgagactccatcaaaaaaaaaaaaaaaaaaaaaaaaaaaaaaaaaaaaaagccgcactctgagtactttatgtgccaggcatcaactatgtgttttctgggtggctgttattgttttaatccacagagctatgccaagggatagttccaactattattgctatgttgtagatgaagaaattgggacatagacaagtagtttatgggaggtcacctagtacataaatttaaaaatgctatacaattattggtcttgttttctgacatggtgttcaaaagagtttgttaagcatttaaaacattatctagtggtttcatctcctaaagcagggctattaaccaaccaatgccttccaaatattgacaggaacacaatagagacaaggttaccttgctcttgtacttctgatgcccaagccggaacttcacgtagggatcgctcaacccgttggaatccatggccttgaggtctctcccttcaatcaaggtgatgctgactattcctctccaaagatgcgattttctgtgtaggtctgataggcgtaaactttgggtctgaaacttttggcaaatgaaaattgagttaggttactgtgttttaaacccaaaaacctcattttggcgttaccttttctcctgttatgattcttcaaaaaataaaggatcggcaattataatttttttaactaaaaataattatgaattattaattaattataaaattaataaattatgaaattatcatttcatgataaattcgttgtgtaaaagagttgagtgttcaaaatacagtctagcttttcaattcttaagattacaagatgtagatacttcaagaatatcagagaatatttgcatgtgtgccaaataggcttatgccaaaatatgtatacaataaatgttagaaatatcaaaggcctcgttcatactgtggtatttaatttttaaactatttatggtgtttgaagatctctatgttataaatatattttacaggtggtttttaattgcaagattagttgcaagttctatccagatagtttaaaaacttctttcttgccacatttggagattattgagcttcagattgctaaaggacaatttaagttaccacaaaatagaaaacaaaatcaataagcccatctaagatgtcttgcttatacctaaaactttcatcacaaatatttaaaatgtttaaagttacccatgtgatttatattggcaagtatgtttctgaatttattttacattttagtatctgaatattttctttaatgacttttattattcttttttttttctttttagaaacagagtcttgctctgtcacccaggctggagtgcaggggtatggtcatagctcactgtaacctcaaactcctgggctcaagtgatcctcccaagtagctgggacaacaggcatgcaccactgcacccagctaatttttattttttatttttgtttgttttgtttttagagaaagggtcttgcttggttgaccaggctggagtgcagtggcatgatcatagctcactgcagctttgaactcctagctccaagtgatcctcctgcctcagcctcccaaagtgctgggattacaggcataagccaccacacctggcttagacttttattaaaatttgcaagtctactaaaaatggccacataatctctttaaactaaaaaggacataaaacaagccatagaaagtaactaaatgtgaaaacattttcaatctggattcagcatcaagcagtactgtaaaaatagtttctttcatattatcaaatgtgtttttcctactcacagtcatttcataaagaaattcaacattcctctcaacctcaaagtacacttctaaattacggattagcactactttctatctgatccgttctacgttaatgttacaaagttacagtctattttacgtaactctgcctcccactttgacttcctacctttttccataccagagcaacgccataggtatttttatcatcatcatcaaaagtcatgcatttcagagtgcttctattaggaaaatgaaaactacattcttcaaaagataatacttctaatatttgaacatttcaatgaaaatctttcaaaatcacattgcatattttcctgccttgttgaacacagcacattttgaactttgcctggtggctctgccctatgaatatcaacgcaggcttttgtctacatactcttcatccctgtgagcttcaagagcagcattcaaatgtgttctgaagtgtaatggagaattcatggagcacctgcaagttctgcagaactccatgcccacttcagctggagcccctctgctcctgtctgttctccatattggatttccacattggattttgttgaacagaggacttctcagatgaaagtaattgtttagaatttgttgcgcccagttatgcccaaggtctttgttttagttctaagatttcatgcaacttattattatataatccagctgtagattttggtgtatgactggtttaaccacttctgctgctgttgagactgcctctaacagcagactctagagaattgggttttaaactttggactggaaacttttttaaggaatatgagtagcaaagaaggaagcaaagaaaacaaatgttgtggcaagcaagaagaagtaattattttagcaaagatcaaggagctaatagctgccaacttatatagagctttagaatttaaaagtgtacatatctacattacaacatttggttcccacgaaaaccccatgaggtcagaaggcaaggcttcttagccccattttactgatggaactcagagtggttgtgctcataaatggtagatatatgactagaaccccaatatttctcatctttattcctgagcttccccaatacaagtgtttagggtggagattctctcataggttaaaaggtaagtatgattgaaacaaaatgtttccaaagggtactctccacttaagtggcaagcacatggctaattcatgaaattgtcttttacttttctattatatgaccacatgtgtttataatatttcagcttgttgaagaatatacttaatgccatttttctatgtgctctctagaagcagtcaaatagtagctgggtaaaagctagtttacacagtgtcttcaattagcaatgtgaagtaagtttctttaacagtgccatgtctaaaatagtgccttccttgcttgctcctcctttcattttgttttctggtttttttgtttgtttgtttttaacatgagaacatgaacttggcttacagagtgagggagagaaaagccattttcaccctgtaagtcaagttcatgttctcatgtaaagctcacaggaggagaaaagattccattttccattgggtcctttatgctttcacagaaataaaatgaacataatagagactttacctactgccattagttgctgtgaaatgcttttctataacccagaagaacatttccaaaacaacttggggagctaagtgggaggaaggagaacatttcttcataaaaacagggctaatgggtgtggtaattatggggacctgcacataaggctaagaagaagaaatttaaaaagtttcaaagatattctattcagatattttttaagtgatgttttcttcttcaataatttttgttcaaaatggtacttctctacaaagaaactccataattcaattgtagattttattgagcaactgcatagtcatgaaactgttaaatatttagtctatgcatgaagaagtgagacttgaaataaaattacaggtaaaggtaaaagatataaacataggctaccaacagcagaaaagataagcatgtaacataaataaatgttcactcacatcttcctagcaatttctggctatatgcttgggcatgtttctccctctctgggactcagttttcttatgtttgatttttctagactgtacttcagggccccaggtgtactaacaacacttttctgtgtgtatctacgggtggagggaggttgtgtgttcaggggcctacagagaaagaagtacactccataaacaatgaagatttagcttgctcaagatagtcatttattacttttacttattttcagaatcaaagttctggggagctcattgagggagtggggatgggcagaataccacggcaaaaagaaactttgcaaactatgaaattctgatgctctccaaggtaacttctgagtcacttgctgctctgtttaaaaagtttgcttcctctgtatagcaaatctctcaaatatgtggtccacagaccagtggcattgatgtcacctgggaactttttagaaactcaaatcctctgaccccatctagactaacagcatcagaaactctgggagtggagccaggcattctggtttaaccagcctgccaggtaattctgatacacactctagagtgaggattcttgctttgaaagttatgtggtgcatgcgcactggcttctctttgttctaataactattaatacaattgtagacattaacgtgaatattatttatgctatttaaagtccttttttagtcctgcttctaaatttactgattagggaagcatattggtctagatatttggagtatttaaaaagagaagtaggaccctactgaataattatgaaaagctgtgcttcttttcttcctttattattttttctcctaaatatatctaaataacacatatttattgaagtgttgctagtccaccaaaatcacttattgagcacctaaagggcaaggagtattaaacaaatccaaggtatcactcaataaaatttgcatattgcggctggtacttagttttctgaggtaatgctctcaactaggtccttgttgaattagaactcttcttgaggaggacaagaaaaaaggcaggaagaataaaaaggaaaaaaccaaccttgttcttcaaagcaaagaacaaaaccaaagcccttaaaaggaaggaataatctttgaacttgtaaggtagttgttctcaaattctagcagtcaatttactgaaattgcgtgattctctgagatgtgattcagttcttatggagtagagctgtatctgtatttcagtatgtgccccatgtgattctcatacatccaaagttttagatccactttcataaggagtattcatccaagttcataattaataaagaatatcaagacaccaggtaacaatacagatttcaaagtctgaagcaattagtccataacatgtatctttagtaagattttagaacaaatgagctggcaatgtaaagaaagtgttagttacattattccttgaaaaaaattaagattacaattccttttcatatctacaaaataggttagtatagggagtgggttttcagtacagtaagttggctctcagaaatcccagctcatgcaagctcagaaaaaaataaatgaactgaatggttgaacttacttgtacatttttgcaataaggattctgaagctctgctctgcagaagcccaggacaggaagagctggcctgccgcacgtctggatggaaatgaatgatcagagctgtacggggaagctttgtaccattctcaacccctcattttgatcagcagtttgaattactcttcagaaaacattatttgagaaaatttgtatttgcttctcaagtcactgtcagaaaatgtcttatagcacaatgaagataaatgtcaatgcaattctacatttccagccactattttctttagtagaatgatgctgcagtggtcaaggaaatgaagcccagagattatatggtaatagagcctaattaagtgatttcaggtttttgttaataggtgcatcagagaaaataactatagcaagagaaatcatggaaagaataattgtttccaagtctgctgcttcaaaatgtcagaatagtgataagctttcagaaaaataaatgtgacatgaataggcaaaaactaagatcatattaaccttgcatcccacatgtaaatcttttgcaatgattaaagaagtatctctaaactaatagggaaattttgtcccacatgacacctcccttttctgcctttgctacgaaaaagtaacccaaagatcccttcactaccaagaccaagagtagcaagagatggattaagaaagatatagctgaacaggaactcctggggggaaattatcatggtgggactgaaagtttatattacaggtcttctggagcagttaaagaaagtttcttaacaatagtattatgatgagattagagtgagtcatcagccttaataacatcaacagagaagactggattagggcagtcagaaaggtgggttaaatcacacggaaagaaaggaacatttattgtgcagctattacatgctgctgttttcgcactccagtgtttttcatgacaggaatcttattttaaggtaaataaactgaggcatagagaagataagtaccccactcaaagccaaatgactagagattggcaaggctgagatttgaatctagagttgctgagacctaatcaatgatttccacccccaacccatgtctccctttttttgacagagactaagaaattcatggtacaacaaaagaaattaattggtataggagttttcaaaatactttgcctgtcacttaggtgaaatgtatccttggttatagattatcgagaaaggctaatcgagggattagaggaagtaagagtaggcgggtggtaataaccctagcatatgttattcactttactctataataaattatagttcaatgtctaccagtaaggtggtgaagtcatagaatctagcatataaattggaagcatttctatattccagttttagtttaaaaagtttagtaattccatttcttgaaaaggtggatcactaaaaatgagatattttatttttctcgttgtgatttaaaaatggaaaattaaaaaaaatcgatttagacttaatatgatactaagggaacacagttaaaccaatccccttccctgataagtacaaataatccttggcttttgttatcctggattttattacctgtgtacaacctaatctttccaaatgagacccagacactgaaacggggagtgaaagacattgcttatgtgtttacaataagccatgtgtggaatcagctctttcttctattttcagcacagggtgcatgtgcttttatttaatcaaatgatccccgagacactacaaagaagagataatgacagcctagaatgactgttttgtgctgcaaagacgagtgtggagcaattagctcaatcccaggcaaaggcctgttctatcttttgcttttcctgctgagtttattccagcgaattgcacctggatgatgaagtccaacaagtgcatttgttctgccatccacccatcctctcaaagtaggattgcttttacagaaaactctcccagtgctttgtccagcgcagtctgaagtgtctcatcttataataaagctttgatcctttttttcttagaagatgatttactggcaccataatccttagcgaaattctgctggtttttaatccttaaactttcttttgtatttccattgcttcttgatacaatttatggtgccaggaagttctttatgtttacttaagatgttttaactatcctctctaactttaatcgtggtccaacaaaatttcaaagcttttactacgtttgttcgaaaatacatacaaatagaaaatcatcacatatattgtaatcgttttggcttgctgaaataatctacaaatttctagcaataatatgggaaaggaacaatagtcttgggcctgccttacagagacctgttttttttttttttttttgagactgttaattaaaagttacacctatttttgagtataaataacatcatacttaaaaatggagataattcctgaactcatcttgggtggatgttacctatggttgagttgtttagcgtgtaagtgcttcagcacaggattccattcttgttttaaaaagccaacaactcggcagggcgcggtggctcacgcctgtaatcccagcactttgggaggccgaggcgggcagatcacgaggtcaggagatcgagaccatcctggctaacacatgaaaccccgtctctactaacaatacaaaaaaatcagccaggcttggtggcgggcgcttgtagtcccagctactcgggaggctgaggtaggagaatggcgtgaacccgggaggcgaagcttatagtgagccaagaccgcgccactgcactccagcccgggcgacagagggagattccgtctcaaaataaataaataaataaataaataaataaataaataaataaataataaaaagtcaaaaactcttctccttaaccttcaatcttccttcagacacacttttgcttgacctgaccggaaggcggtactctgatataacttctaaattactttgtatttttctatgtactctcctttgcccattgtgacccttttcttgatttttatatgaagtatcttggcacgttccagacttttccacttaaaaaatatttaaatttctctttgattcactgcaatgttcttgtaaggtggtttgctcaattaactcttttatcagggtctgtaagtccactcagtggagataactaaaaagaaacttaagcatgctaaatatttgaacacactgcactaagttcccacctttaagtgggaagttagtctttaatacaatttttacttaatctgattcacataatttttattgttttcatgagaaacatggtaattgtcatatccatggcttaatattttttatcctaagatagtgttttgatgaataacaaatgttatgttttcagacaattagactatccctgtacacagtcttttcttccaggaaaattaagatacagcaagtagcactgatgttccagctgagcaagtttttactaggatgtagtttcattcagtgtaaatcagttgctatctcttggacacatgtattgatctgtataaatcttgataggaatttatttcaattcacatcctgcttaacccacaaagcacatgtatactcttcatgaaagattttatctacttagacattttgcatatctgaaaatgtccctgggtaacctcctttcatatacatctcctctaaaagctcatcagaataacaatattgcttgggtaaagagcagtgaggtcagttagttaccagagtgacctttgaatgtgactatggaagataatactcaaccaaagtagacttggtcactgattttctgattttgtaaatggcacatcagacacagcaatctcatggctcttaaacacatccatccattggtggctaacatagctgctgaagaaaagggtcaaataatgcaagaagaatttgaaagggtgtcaattaaaaataacaggctaaggaacagctttatttatacaaggtatttttattcatcataaactcaaagagggactctactgctgtaagttcttcaaaacatttatttgtatggcattcagagagagagaaatattgcctctgatcatgccatctgggtacctcaaggcaatgacatcagtgtgatgggccttactttcctcattggtaaaacagatgacccctaaaggttatgcctatatgactcaattcatttgtcaactcttcattgtcataggcccagagaagacattaccatcacaccgtggatacaagaaagtttgtttatttttaaacttgcacatttgttattctaggatcaaagagttcaagagattgagaaaggttattaaagaatatttggggatgaacacaaccaaatggaaagtactgataagaggaaaacttggaagtagcaaagaagatcttgagagagccacttgaaagggaaacacttgaaaaagtattaattatgaagttcgccctggtgacaaatcttcattcacaatgaccagtgtgcacatttgctgcacatagaacaaacttaacccagaacaccccccaaattctactctcaaagaagtgtgccatgtatattcccccccttttttttttgaaatggagttttgctctttttgcccaggctggtgtgcaatggcgcaatcgcagcccactacaacctcctcctcctgggttcaagcaattctcctgcctcagcctcctgagtagctgggattacatgcatgcgccaccatgcctggctaattttttgtatttagtagagacggggctttgccatgttagtcaggctggtctccaactcctgacctcaggtgatctgcccgcctcagcctcccaaagtgctgggattacaggcgtgagccaccaggcccggccagtgaaataatttttggataaagccattatccatttaaagtcatggaacaatttaaaagcactcatcctgtgtgttcctggacaatgcatgaacatataagaggaattattatttcagcaaagtacagagtaacttcagtgaaggcagccaaacagtagaaatgaaaagggtataattactaaaataagctcacaacaataaaaagctgcaaaaaaaaaaaaaaaaaaaaaaaagtgcatgtgcattcgagctggtaaggatgaataaatgtggcgtatacttgctcactggtcaatacatgacttaatctggtacctgcctttctacttaagagacactacaacaaatattaaaattctaaagaaaaaaggtagttttcaataatgaaaagtttgcgagttaagaaaggaaaatggacaagccctaagagtgtagcattttcattgtaatatctattgttacattaagcatataccaagtgtgaattttcaaagaaagaggaacattcttaaaggtaaagcagtaagtgcattagtaataaattgtgctgtgcataatgcagaattagagcagagaaaaaaatggatggtcattatgctttaatcatcaaagagtaagttaaattgcaatgacatttaaaacaaattatctgtgaatcatcattttgtctttatttaaatcaaaagagttgctgttttctaaattataggatttcttttcaaagaaagagcactgatcagtatatatctaggacagagttatagtatagatcactgtaacagaagtaaatatttttctcaagcagaaatggagcagaaaattctaatctcattttacaagagaggaaagaaagagccttcatggaccttccagatggcaccgttatattcctggagagtccctgggactctagcttctcagaatttggaataaacttggtttcataaaatgacttcaaagaaatatgttcaatttatgaagttcttaatttttacaagtgtagaaataaaagtgagttacctagatgacttagaagataataaagaaggcaaatgaatacctctatctggaagcctatcttaaaaaatgaaactcttagttgccatgtaactttcaaaattgctatccaaaaccaaaaatcaagaatattaacaaaaaggatttagacattaccctccaaaagagagacttcacagagaaataagatccaaccacttcattttctgaaagttcctagaaacaaacaaatatttagctacattttgagatgtttttgagaataattaatattgtaaatacaaacaaataaaatcaaagcaaataaaaaatcgaaaattatatatcctaaagatacttgggatatttagaaactgtaagttttcttcccttgagtaaattaaaatttttgtggtagtaaagtttagagaggattatttctgtaattttttaagagtccacttaccttttcattcttaagtattcattaatatattttagagtctgatggtttattatagaaagtagactgttcaagcatattttaatattttaaagtaaagcagatatttattccttttaacaaaacaattatgttaaccattgaacttcagagcatttttaaagaatgattgcagaagtcttatttataaacatgcacctagtcaaatttggtttacatttctacaaaaaattccaaattttataatacaattaacaaacatagtaagtgacttagttaactgaagttcgctgacaataattttaaaaaggaatgaatactgagagagttggctattggactaaaagcaatgcaatggattcaagtagaatagtttattacttaatcctcagacttttataaaggaaaccaattcaactttgggaaataaaaaaatagctatccatttttaaatagaatatctaaattacagtcttcccttaaatgttaaagctttgcattctgtctctaggtgtcagttatgataaagtttcaggaaactgatgacagtcatgggaaagcatcaatagttgacactgtgataaagaggaagcacttttgcaacttccttgattattctatgattttgtgtcagcaattaagattttggaggcgaggtgggaattttaatgatcaagatttaggactttggtttctcttttaaaatttgagaaataaaaatattagccacatttagatgcattgaagtccccaggctgtgcttttcatgccatgtttaattacttctgtcatccatcagctaaaatttatatttcattttacaacccctattctcatgtagatttaggcctttatttcagaggaaacaatttaattttcttgtggaccctgtgccatttacaacagaccagccaaagccttcctttcactagagtctaatgataataacaataacaacaaccacaaccacaataataaggcacctggcattacagaatgagtcctaaacagaagtggtgattgtattacggagaacaagaaaaacagcataaactattcatgaattccagagaaaacttatcttaaagcataattgtagatatttagttacgcttcagtcttcatcaagacaagaggctaagtgaggcaaagtgactgtttttttctggttttttttttgagacagagtcttgctctgtcgcccaggctggagtgcagtggcgcaatctcggctcactgcaagctccacctcccgggttcacgccattctcctgcctcagcctcccaagtagctgggactacaggtgcgcgccaccacacccggctaattatttgtattttttagtagagacggggtttcactgtgttagccagaatggtctcaatctcctgacctcgtgatccgcccgcctaggcctgccaaagtgctgggattacaggcgtgagccactgcgcccggccaaagtgacgttttaaaattgctaaaagtataaagtaccagcaaagggaaacagaacaaaaaacagaaatatcaattgataatgcaaaattattaaagttattctgaaagatgaattgttaaactgtttctaccaagatttctaatttataagagtagtaagatgcattgggaatatcttatttgtttctatttttgcctctaaaaatctaatacacactaagaaaatttctcctcaaagataaaaaaatctaattatgaatctaaatattaaccagattttagagtaaaaaatctagaaaagaaatgtttttttcacagggaaataaaattaaaggacagtttatttttttctaacaaatgcatataatgtgatttttttcagccttctacataaatcatagaaatctttaaagactttttcatcagatggaataacaattagacaacaagcttttattaaaagtgatattttaaaattagtcgtaatgtgtacagagctttaaacataacacatactattacaaactcaaaaccttcacaaattgatttgaaattgtgaagcctgatattcaaatctaagagtcaagtcagctagtattcctgattacaaaagcatgctttcataggaactcaatttcctttatcaatacaattttggccacttaagagattaaaaaataaataaatacacaaacaaatcatgtatataaactttcctggtcagattgcaatcactgttcatcaaaacaatggctcttggatgcttccatcctaacaataaagatgcctcatgatattgactaagcttatcaattgttacgttaaccagggctttggagccaggatcctgacaaaattataaatcgtttcactgtatacatttagggtcccttaagaccaacaaatctcctcccagttccactcaatttaataactaactgtctgtctatccatccatccattcattcacccttccatctatctttcttgttaaattaaaaggccatgtaatcgcacagcagcccttagttctgctatcctggaacccagttatattaggtctccccttttaatcggtccaggaagaatcctaagaaactggccgactcacttgataacacatgccaccaatgtgaaggccacccagcaaccacacaataaacatcctagacctgaaacacaagcattgtggaatccatcctctcactgagattacattttgtcccttcactttgtaccaactcatccagatctgctccagaagaacccacaacatttagaaaagccaacaagagtactcaaataaatgtaatgccattgtcacagcaaatccctgtagctatgaattacaatacataaaaattatattttatgcctttggggaaatattgtcaaaatagcaaggaaaaaccatctcaacataaaatttaattatggctccatgtattttgtggggctaatgaaatatctactgacattataatatctcttttaaataaacttactacaaatttcaggactttggttaggtggggtcaaaatatattctttgataatagaaatactcactgctatttaccatttgttcattgttgcattttggaatctcagaagtcttgcttatgaggttgattttataacatttccaaataatacagatttgggagtacagacaatggcaaagtaaaaatcttttaaaataattttatgtttacttcaaaaataccgagcatgtactttttttcaaagacatatgcgtaatgactagaaatatggcacctaagaaaagccattttggtcactcatagttgagaaagtctatgaccaagagttttcatttttgccgctttaaaaaaaattgcctatttattatcaggatataatttttttgtggaaagaacttgatagttgctaaataatgactttttttcatcatgtctagctgactgtgtgagatacttaaagatgtgttaatctgtttctccaccgttagttaaattaaagcacttagagtttttgctgatgcatttttaatgtgtcatccaaggtgtcaggtttaactactacgccctgcagacttacagagttgaaagtgttctctagtttaaattaacaatctccttgccaaaagtcttattaaaaattgcttcattcaaccaatgaataaagtgttttatagttcattaaaattatgctaagtggttataataaaatctttataaaaagatgtattattaaaaaaagatataagctgtcaagtaatagaagatatgataatcagacaccatcacagtagtctgtattatattattcaaaggatgaacttttctgaaagaaaaactattctaaactgttattgtcaaaaatatgaattgcaatgcgtatgtttttatatcatcacgataatatttgttatataattgaagtaatttattgaaagcacataagtttattattatctcacctttacccattggtaaattcattattctaggttaaaacacacacacacacacacacacacacacacacacgatgtaatgtaaaaccataactgcttattgtttgatagagccaattatttcattacatttttccatttttggcttggccccacaaaatgtattcacaaaatacacataaatcatctcttttgagttcatgaaactttcttgatgaataatttaaccttagaataaattatcagtgataagcttcttctaaagaataaaatattgcaataatccaaagcactaccatttctctgctaaaacacattttgtcacataagtgtaactctttgacctggataattcttctgttgcccaagtttaaggagacatcagcccctttcttcttaaaataacataattctataacagctgagtgtggggcagaattcaaaatgtgcgtaatagaaagtgtgcttgtggaaaaccagaatgagtcttttgaaggatggttctgtccctagaagaggcaatattatggaatttatacctatatacttgtttatatgccattcaaatataatgcatattttatacattcttctttttcagaggtaagtttagatgcatttttttcctatgtattactaagtggtaatacaattacccgccccccacctccaaaaagaaaaaataagttagtcctgaacagcaattaggatctccctgtcctcaagctggcgattcttcttttgatttcaatagttaaatacaaccccacattatgtgagtgccacaagtaataagatttccattgaaagagcctattattagcagaagtatggttacaaaaacaggtaaagaaatttcatcatagaaagtcaagatgatgaaaatgacgagtagatgcttaaggaacaggaaattccatgagctgattcacattgcagagcggggagacaggcgtatttaaaagaacaacaaccgagtcgatttagcctttcttcctctgtaggtacattatttctgaaagaaaccaagtaaaggaagaaaaactccatactggagagaatttctaacaacactggctatctttaagtctttgctacaaaatttacacttcttagattatctattcaccattgacactcaaagacaggctgcatgccaaagccctgccatgaagatgcgggagacctcattctgtaaatcaagattccaaagaagaaaatgatctgtgtttttatgaaaaatttacctttgaatttgaacatagttatatcatatatgaaatacccatatttaaatgtaatgcacataaaattacaccctatttccaaaaataaaaaacgaaaaatctgtactcagacaagaatttttaagaagattgaaatatttagaaaatgatgcattttcataaaacagtaacatagtaaaatctataaagctacacagtatagtcccttaccccttagtttcccaggaagcacaatttaccggaggaaaagattcagggagcagtttcaatgtagcagagtgtgtgaaggaaggtggactagctagtaattgaaatgtcaaactttcccccgattttggatttaacattgcgctcttgtaacactaatatagatgaatatggcaaatgttttagggcacagtaaaaaatctgaatgaattagcaggtgttcagtatgttctcacagaaaagaaaaatcaaatgagttaactgattttacttcacttagtattcaatatccccattaaatttttcaaagttgaaaatcccttaggctaaaacccaaaagcttatgttaacgctgtactaaatataatctgccaagtactcaaatgagtgctgttagacataggaattctgtatcttcagttggaagcttgaaaaatgcatccgttcgaatatataaatggattgctaataataaatataaactccaagaattttagatataaaacagtagaggatagatgtttattattcactttaaattttctgtatatggaacaaaaatatgttatatatttttacttaatttatgtttaaaattatatttacatttaaatatacatttaatataatttttaaagaagaattttttttttttttttttttttttgagacagagtctcactctgttgcccagactggagtgaaatggcatgatctctgctcactgcaacctctgcctccagggtttaagcgattctcctgcctcagcctccctagcagctgggattacaggcatgtgccactacgtctggctaatttttgtatttttagtagagatggggtttcaccatgttggccaggctggtctcgaactcctgacctcaagtaatccacccacctcgacctcccaaagtgctggggttacaggcatgagccactgtgcctggcagaatcttcatttctaatcttccttttatacaatagaatggattattcccattaattaatactaagtattatataatatcctgctctagcattacatgttaaatatatctgaaagaatattgttacatattgatgggttgtcatgttttttacacaaatatatccaattatatgaatttaaaaatatatacacttttaatataacaataactgtaaagtataactgtaaaggaaaaagtaatacaaatatgaacagtgcaaatatttcttcaaaacatcttgaaactttattttgattagtgaaaatcacagtgaacattaagttagaaatattcagcaaccttccttaataagcctttttcattttattaaaataataaaggtgatttttaatgggagccctgacttttttgtaagccaaattattctttggtcattaatgccattaatgccataggaattagggagaaaatgtacagtaagagacacttgttcaaacagattaagtcattaccataaatataaaaacattttgatatatattaattcacagtaataaaaatgacaaaattaaagaaaagcttaggtaaaagcatgattcaatcagaatggaaggaaaaagactgtcatgttccagggtctaaaaaaattagtcattattaaaaaggaatactgactctaagtagaaatttgagcagacaagatttttacaagtaaaatcgttttgatttatttcaaggtatattcatataaaaattgtttcatcttgatatcgatctgtgtccaacagtggcagcatcactgaacaaattaaacacttagtttatattttgcatatcttacaagttgaagaagagccagggcttagtaagttacaggaaccataaactcctctcactttatttcttaaagtgagaagagacaatggggaaaaattgttcttattgtatactataaagatgtaatgatacaggaatttctgagtttagaaagcctcatactcaattttctgtgaccccccaaaataaaataaattgtgcgaatctttcttctgtctggagttgtccctcccctagcctcatcattttattcctggctcagagcaattttctagaccctgttgcatatatagttgagaccagatgctgagaatgatgttgagaagtgaccagagaatagtgaaaggatgatttgaagctattgatcggtgtgatttctatttaaaaaacatcacatggttggcttaaatttatggggaaaagtaacaattgaatagtatgaaatctggtagcatactttgaagagatgagagagatctgggaaagcagatgatagttctgctcaacaagaaaagctgaaagatcacaagctaagaattaccttacttgatcttttccaactcttcctcattagcattgtctgtaaataaaataaagcattttcattatcttttcactcaagaacagaatagggcagccagttgttttttagcggaaacatttattagcccttgaaacagcgaacagttcctgcagcaattatacaacacaaaacttgtttgccacgcacacacaactagagaaacaactttaacattccagcagtctttctggtgagagttcatttgatttattcctttgtaaaaaaaaaaaaaaaaaaaaaaaaaggaacagtatcgggatgcctttattgactgaaaaaaaacacattgagtctcataatttccaatggctccttttggtggtggaggttgaggttgtacatgacttgaacaggtatataataatttttctcttcaaacacattcaaaatcttttgcttggatggcatcgtagaattgtctctgtttccagttaatctttaactacatcagggcctacaaatgctttcaattaaaaacaaatgctgcatactgtgatggctactagtgtattttcctgctaaacgtttagtgaaagcatatcctttaaattagttagcttgtgtcatactaagaaatatgtatggccaaaagttttaattaaggttctagagctttgtaatgcatccccaagatcactaatctcttgaataaactaaatcataaaagcccaacgaatttttttgttttctctcttcactttaaaaaatttctcaatgaacactgaagtattaaccttcctgattaacctctttcccctctctttgctttactattatgtttaaggcagatgaagtggagaataggaaatattcagggcaaggaatatagcttaaagtgcttgtgccatatttgtgtatcagggaaatgtactttaagaactgtatctctttcaggaggattcaccataaaaaagaaccatgtcagaaactattcatggattagaataacacaaaaatgaaaagatttttaatataagatgagggcaacctttaacctaaaccacaagaatgaatttagacattctagggtaaaaactaagactagcgtaacattttcaaagataattatatgttcctcttttatgttttcaaagataattatatgttcctccttaacaaagactgttaaatgttgaccaaaacataaaagaataatagatttcctaaggttacaatgattcctcatcacgcctacttttttttttaaagtcaggaaactgcaaagcactgttatcaaatactattatagaaatactttatgttttcaaagtactaaatgtccagttcattttgaagcaacaaatcccagcattgggttatagaggtggccatctagggggacatgtactaaatctttacttttgatgttacatgatttattatcatcagtatcatcatcatcatcaccaccaccatcacttcctccatcatcaccaaaaggcaactggaaaccaaatatttaagtggtataccatatttacaaaaactgccccataagagttggataataaacactcaactttctcaccaagcagagtttcaatggacaaagaatggtatatcctagagatgatattttgagtcaaatcaatcaagaactattaagatacataaaaagtacaatctacaattcatggtcacttatcatcattatctagcatctaagaattttataatataaaattccattatataagaaatgttatgctatgtaaaagggccttagaacattagaaagagtgaaatctcatggcaacactagccaatattacaaggattccacaaagtcacatcccctgactcacaaggaccacatacaattaaccttctatagtaaacaaaacataggaccagtatttgtcctgtctctcaaaatcagctttataagcaggctgcatggttttatttttcagattgagaaactgatacaataaaaagtcagtgattaccctaagtataaataggaaagatttagcagttatgagaacccattcactattttcctaattcagtatctaaagttctattactatatccagtaactctcaaaatgaccctagattttataacatttctgcctcttgagccaaatctactaccaaagcaatgggtttaagtatctcacttccaagtccctttttcttttaggtagttgagttaaggtcgattcaataaaactgaaaacagtagaaaaattaaaaagaaaatttaatatatatactattaataatgttttctttgctatctgtgagacatgttagagaagaaagattggggattgtgaaagatagaagatgaagcaaattatagaaaaataagatttatttttttgctctatgatcttaacttcagctgagaaacatatgaattaatttttgaaaggattattgcctgatattattatagtacaattcaaattcttcattagcagctcaacttccttgaagccagtaaaaggaatgaagtagcataaaaatatggcttgtgatagagctgcagaagtaattgtttttaaaagactccacgatctcaatccattttttaatttttatcttttgttgaagtgactttttaaggcgattatataactactgtacatataaagaaatcacagaattagatacaatagtaacatacatcttgtaaagcatacatatatcaactttttgtaggtagatatttcttcaaatgttggctgtgtaataattctgaagaatatcaaaactaatccaagataaagaagttttttttttttttttttactcatcaaaggccaactgagatcattcatatgtttctttgaattttctattttttagccttaggcaagcaatttgtaggtctaggttatttaagagagtgtgtaacacaaattaactcacttttatttcacaaattctccaatgaagaaagctgtggattgaactctgctagaaaaagagccagaaagaactcaaacacactatcagacaaattgccatatataggacacacatatatgcactacacacttttacaggttcaaaaataggacatgcaatcaaaacagaaatgacaattgtgccatgcaactcatcagcatgccctccatggaggttttggtttcttgtacacacaatgctggaaacttaaaatgtatatatatatatcttcacatctggaaatttttttttaaagactcaatcatgacctcaatggagaagattttgatatggcacctatgaaatacaaattgctgcaattagacattgaatattttagaggctttagtagattcagtaggctgataggtttttcaactcattcttcacttttactgatttctagaactggcaatccacacaaggagaaatcatcccaactgcataattcatggaacgtattgttactattaacagtgcataaaaaactcacaagatgactgttttagaaatcttaccactttgtaatgctaaggactctctacttccagttattcatttcttcctaccttgccagagcattttattcacattaatgttctatttcctatttgattgttaggatttatctgtaaaaggctcttgaaacacatctctttcattctccatttttaatacatataaaatatttagcaaagttttatcaacacaggcataagaataaacatgtggtttttgaactaacatcttcagtgctaaaagcttgaaataaattatttctgagttagtaatcaaagagaacagaactcctgtaattttgctctgtgagggtcaatgtaaaatttgcctttattcctttcttacataattctcattttctggggattgtgaagcattcagtaactgatttctggtttgctgcatttttagcttaaatttctctaaataaaatttgtttctgaataatttgtgaaagttcagcatgccatttttacagatgcagtatgctatgttttttagatatctaaaaatttaactttaagatacattggatctctgatttttaaccaagaaacttcaaatgtagcccagagaatttattaagctgatacttgacatgttacagaatgaagaaaatacagtgatgggtttataatttattgtcatcattcgaattccatgggaagagcaataaggcttgatttcaagcagattatcattaatatactaattttaagaacttacaaaagaaaattaaatcattatttaatcatgatttgatattgtttgtgacaacctcagggatttgaatattgaggtaagaaaaaaaaccatacaccctcccttggtcttttgaagtcatcataaggaagactttatgtattatatatatatatttccccttgtatcagtgataggacgtaggatggaggtgaggtgaactataggcatattttaggtacacaagtaacactgaagaaagcctggacttgagagaaggtgaactgagaaggagtttgtatggctgggacagaagttacagtgagggaacatacattgcttgttggagagccttaaagtttctcaccaggagtttcaatttaattagagaaatagccacaagtcactgaacacttagaagaagaatgaggaagttataaagcctggtataatgcttagtagatgatcaataagtattttgttttatacagatgcctacaaatggttcttattttgagtttcaaaacctaataaccagtgttggtaaatataagaaccagttctagagagcttaataaaatagttatagaactgcaatgtaggacaaacacagaagaaaagccaatttatatgtgtttttgggcattttcataatgtagagcatatgtttagaaacccagattcaaatctaggacatcagaatagctaggatactgaatcccagcagaatttccaatgggggaatctttctcccctccctcctttctcccctctcctctggccccacttgtttctctacaaccaagcccatgcctcagctattgattgtacccacgaggatgagccaagatagccacactggttacccttctctctgcctccttaggggtgagtgagatcaggacaggaagtacaaggatgttcaccagccagaggctggctctgaacagacttgatcactgtgccttttctaagccctggttgagccacttgcttctctgatgaagaaagaagccacaagagagtcaataacaggataggaggagagaagacgctatttccctcttaatgcagcaaagtgaatgcagtgctctctggaactttgaaagaagagggcatgaagtaaggtaatgaatgcaaaaaaactttttgagatgaaaaatacctttggaaggatttcttccaaaaaatctggggtagtcaaagggatttgagccaagaaaatagcatgaggatttcaggaggaactttttgtgttaagggtgaatgtggctgaagagatacgatgaagagaaaggaaaaggaggaaaagaagatgaagaaaaccatatttttgatgtataactgctttcatgtaacccacctactttcttctttatttgtgtttgataacttactaatgatcagctcccaggcactgtaatatttttagataatttttacattttaaaaataagtttgagcaaccatggagactgaaggatttttgcaaggattgttgaagaaaaaataatgttggaaactattttgcctgtgctgtcatatttctgtgtaatttagaacaactcagcagcttcatcgtaaggtctcctgatagtaacttgctccctcaaaccctcagtttgattttagagtatttaataaacatccctttaatgtaaaaattcagctgactatacattatcaaatcacccaaatcaccacatcgctgctatatcatcccaatctccaggaatattgcaagtttagatggtctgggaatacacaggatctcaggcacttaggtatcttgatttatgaagtgctgtccttcattaaaataacaaagaaccccagcataagaatattctatcaccaagtcttgttgatttttacctcctataggtaaacctaccagtttccctccatctctacctctgacagttctaatccaaacctccatcatctttcacctggatttttgccatggcctcctaattggtctccaggtatccattcttaccccttcaatatgttttctacaatgcagccacagaggtattttcaaaaggcaaacatgattctactgcttttgatttacagatctttcaatggctcccccacagtgttttggggaaagacccaaaccttaacatggtcaatgagttctacacagtctggacattgtccttccaccccagtgttgttatgcactctgatcacccacactgtctttgcttccaccttctctaaactccagtagttttttaattcttgaaatgcaacatggttcctcttgtcacatggcctttgtgtgtgttgtctcctctgctttaaacacctcctctctttcttgtttttgctttattaaggcctattttacacttcatatctcaggtcttatttggcttccttagagaatccttaacccctggctagtaaaaattttcctatatttgctctttcagcaatatgtacctctttttcacaacatttaaaacagttgtttccatcagtgactaattgattcctgggttctccactgggtctaagttctattgtatcctaagtgtctggcacaggaactggcttaaagtaggttctcggagaatactagaatcatttaaataaaacacaaaatgcacatttataattgattcttatgtatggattagccagctaggttatacttcctggcttgccctgagtgaaataatgtcttctgaagtagtgacttctaagatgacgggctttcatttctagatacttttttgtaaaaattgtttctcactcacccctctgcacaagggtgcatgtgcacacatacatacataattttaccaagctaagttctcacactaggtattattatctggcaattcttatttaaaaagaaaaatttcttcctcagtgaatgaagtatggatacttaacccaatttagcaaatattatatgtaaacgtatgtgttcatcattaaatttctaaaaaggagggagagaaatacttcttgaaagggtgaatttttcaatgagtttaaagtatttccaaatttgatgttgtaattcactatttttacctgcagtctaggggaaaacgccaacaatacctttccagcagacaatctataaccaactttaatcatgcattattttaggacagcaatacatacattgctgaaatagagtatttggacttgcctaaaaaattatgtctactactaaaatgtgttataatcagagctagttagagtagttcccaggcacatggaagcacattgagtccaataaataatctctggcaagttgtgacagaaagtacactagcaagcgtactgatgtgggtcaagactgatattttttaatgccacttcaactgtgggggagtaattaggtcctctgtgtcccttgtcagtttctcatagcagcatggtgtgcaaggacgtacagacagctagtgctgaaaaatgggtaatatcaacatgaaagcccatcaagaagatgaaaagtattcacttatcattcactaaacaaataccagaaagcagaaactctgttataatttcacctcattttctctgttatggtacacctgacaatacagtcaaaacagcagggtctggataccgtaatgtggaattccaagtattcaattcactaataaatgtatttcccaaatgaatactaatatttgcctataatatagcatgtctgaaattgagaaataaaataaaaattcaaatctatttcttatttacaacaagaggttctgatctggaggatgtaataggaaattagagttgaaaagatacagtaagcatgaatgagcaatacctaggatactcacagaaacaaagaacagggcatattttcataggcagcttctctttattatcatctctgggtccagagaaaggctcacaactttcaaacaagaaagagctcctactaggctgtgggggaacttaccacatccctggactctccttctttaggggtaaggatgactgagagcaaaatgattccaagatcatggtcaggataatgaggatctttcagagtaagggtcacatctgtgggcctgtgatagaaaatatttagattttgaacagtcattaaatgaataagccaaatatatttttattaatgctttattattttaagataaaaagtaattttgtcttcctttactttcttgggacaatttttgttattaaaatattatcagtgtattaagttatccaataaactgcgtgtagatctgaatacaccagatgaatttctgctttctaaacccatgaaggttccagaaagtggttgaaaaggtcaagactacaaccctattaagaagcctatcagtctcctttctatgctctctaaacccacagagagtagcgccatacatatacacaagtgtgtgtgtgtatacacatacacacacacacgcaaatatatatatatacatatatatgtatatatatatacacatatacatatatatgtgtatatatatacacatatacatacacacacatatacactaaatacacatatggggttacagtctgacttagttcattttcatgtaatgattacatacaaaaattaatagaaaaaacttcattacattttttaatgattacatgataaaaacataagaacatttacaactgccttatgatgtattattctttcagaggtacctcaatgtattacatagtataataacataaatatttatatggctacaattgttatcactttttctatacccagagactattgatttatatttagaataaaacagcatacacaaataggttattttaaaaagtagtaattagatgtttatgtggttttgaggagagggaattgctagtaaaatacataaaatatgttatgtagcaaaatacacaccaaatgctcatgtataaataatctcttttaatttttgaaattattccaaattgtcaccatttaaaattatttttcaccgatgatttatctttcataggaaacaagataaatttatgctttgggattaagtctagtcacttgatatccttatgcagaggtctaagagaaagtacctgtgaggtttacagaagaacagtacagtctattccagattgagctcagttttcatgataatagactccatgcaacaccacttagggcacttcctacagcggcagggaggtgtgagcctgtgctaggttataggctggaatgaaggacttacagaaaaagtacaggaaaggctgctcttttgtccagtctgaggcaacaatgactattggaagaccaataagccattgtgctcaaactaagttgattgtaatgcataagtgagttctacactttatatttctctagtcatctacatttacagaaatagaaagtagtgatctggctcattactctgctttcctgttttccatcatccctggggcatgatgtaacatgatcatccaaaacagccaggaattccttctccttaaaaccatcaaagaaggtttcacagttccctttgcaacctatttcagcatgcatgatcttttctaatggtatttttttattctataatacaaatcaattcttagttcctatgttgaaattcactttgaaaaatataagcccattattaggtgtaaggaatgattaatattagtaacaatagtaactttgcaactagggaagcaatgataagtagtgtaactgagcaaatacaaccaacctgcctccaccttaggagcattccttggtaatccggcaatggcaaaatcagattctaccatggctcgagtgacaagagagttgctgtttctgaagcaaagtgtacacactgcattttatatatagtagtccaattcttaataattatgactaacgtgcataatctttttttatgccccattaaaaccatatgggcaatatgaaaggaaggaatgtctcttttatctctcgattcctggtgcttagcacagtactggggaacagagcaagtaggtatccaagaagttttcggttgaaaagttgttgaatgaggtagtcagggaagatgctattatttccactgggtaagtgaggaagatggatttgagaaaggctgactagcaggaaggctcaccactataaatgacagaactagaccccagatcagctgacattttctgttacacaagcccactgcatgacaaggggtggtgatattacagcagttcaaaagttacctgtttaactccaattgtgtcagatccagaaaggctgagcccataaagtcatcctgtagtccaaaatcatagtcaaatacctgagatgccaaagagaaaaagccttgttataaatatctccaatataagctttatgtgataatgtcttggtcataaaatgttggttgtctatgtcaccaaaagcatactaatatttgtattttaaaataattgtttttgtactttggaatattagagtctcacgaaacacttaaagaaaactacattttattttttacttaatattactgatggattatatcaaacagaactttaagatagatgtaacataatcaaataaaatatagtaaatcttcaaaaatgtgggaaaaagcatagaattcaacaagtatgtctttcatattgggctatgattgatgagaatatgattccaatatcttcgtattttttaggccattaaagatacattttgtgatataggacaatgccactttaaacatacaaataagtaaaaagatactatgattaacctactttataaagttatactaaggttaagttaaaataaagttttattgtcacaaacaattactgggggataatactaatatacctaacaacataaaaactaaaatgaaaagaaaagaaagagataatgcgtttcttccttttatcaatactctatccagtatcttctctgtgttttgtgtggttcttattcactctatggtaagtaagacaatgtctctgacctcttggattgtacatggagggtctgggatggcctataaatacctaaatacagttcagttataagtgctatggagcaaataaatgtctaagaggtgtgtggggagctgctattttagatgaggagaccaggaactcctctctgaggaaggatatttgtgtagacacccaaataatgggaaggagtacgcatgctagcaagagcaagagccctccagctgaaggaaacggcaagcccaggagagggactgatgtgtttcacacatcagttgtgatcagcaagaaaccagtggggttgaagcaaatggagagagacagataatggaaggatgctggagggatagttcagagctagatcagttaggaccacttccaaaggatgctaagtaaatgggaactggctaacttccatccatctattaattttgtcactcattcattccctcagccaatattggctaagtacttattatgtgccaggcaatatgctaggaactgagtaaacagtggtaagcaaaaatgccattctcaacgcttacagtttagtgagggagacagacgttaaacaaggaagcacatagatgatatgtggttacaaattctgataagtgttttaaggaaaagaagagagaacgaagagaaagtaaggaagtaagtaaggaagatcagggaaaccgtttacgatggaaaaaaaaaacgctaccagatgaaatttagagctgtcacttcctgaccttttcaggtagaaaacatttgtattgaacactggagtaattgagcataaccagataaatctgctcttgaatggatgacctgggcctttggttgctccaggatgtgagaatccatgaagctgaatcaacagcccagcactcctatgctcaattcttggcacaacagttagaaagctcaaagcagagcattcctgaatcagttgctctttttttttctttttatttttttctctattacaggtgtacttcaatttaagaaaatttaatatgtaaaaaattgatacttaaataaaaagataaatactttgcattacaaaaggattcttagatttgaagagtcacatggggatttatttaagtaataagctcccttaatgccttttaaattattcaatttgcagtcatttgatttacatacaacctttcaagaatgcacttattgtagaaagctcagcactcctgcaataaatattctccttgatcaattacacttctgagctttagtcatctgctcagtggtatagcatatgcatgtactgcacatcttatgcaactgacatctctgtatttgcaagtggctgcagcagtgtatttcacaatatacaatttacaccaaaacattggagaaatttctcttgtggaatctcatctaatcatatcatccttaggcttaaaatcttgggggagaaaataggtggcatataatcagtgagatcacctgaggttcacccacacacatgaggttgagagctgtgaatccagtgaatttattagtgcagacagcccaactgggcgattcaacatccaacctcttttcactctcctagtgagagtctttcctattatcctaatgctagatgtctactttaactctcaattcctattaatctgcaaaggcataaacatgggaagaaaaggaaacactagaatccatgcattaatgaaattattagctatgctgtttggttccaagctctacacactatttgtcagagggagcattgctctaagtgagctttagaaatacagagcataggagagagataaaataggaaaaggtactcccactgcactaacaacaagcacagttcatgcttattaatgtttattcaatatttactaggcacaacctggttaacaaggtattgttgtttctatttttcagataatgaatccaaagctgaaaaaaacacatgttattttccccccaaatcctagggctaggaagacacgagattcaaatcttgttgtattgagtgtcataaacagagtgtgtttaaatttcacaaatatgtcttaggcacccactctaagagaagcactgagagttaaaacatgaatgatttagatgagatccttgctttcatgggtccttcccaccactagttggaaacattaggtaacaggtagaagttgcttgggacttggtaacaccttctgcattctcaagtgactttagaacaagaaatatttaatttaaaacaacaaattcaccttactgtttactaaaaatccattgggaagtgtatcagttaaaatgcttttgtttttgtttttaacacaaaattcaactcaactggcttcaatttctagctcaaatgactgcagaaatgtctataggtaattatggcttctgggaagttttaatttggcggttcaaattattcatgcacttattaattcatttatttgaaaaatatttggtgagcacccacaatgttccaagtactgttctaggcatttgaaatacagcagtgatcaaaacagtcaaagtctttgatttcttggagcttacatatggggtggggagagacagacaataaagaaatacatatgccaagtagcagtgataaatgttaaggagaagaatatttcagagtactggagtgatgggaactactatttatacatgatgttcagaaaggacaacgagagtgggaggtgtttccccatgatgggaaaagtgtgtttcataatgagggaataggaaagtgcaatccatgatgaggaaagtgtcttctgcaaggggggaagaggaagtggagaggcactgaggaaactggccaggggccagtgaggctgaaagtagtaagcaagagaagagtgctggaacattagttcaggcttaggccgtggggcctaccatcatattttaaagtctgggagaaggatccagagaggagactgagaaggaacagctactgagggagcaggaaaaccaggagagtggtatcctgaaaacaaactgaagaaagaatgttaagatggaggaagtagttaactgtatcaaaggtaaatgatacagcctaatcccatttctgcctctccagttctctatcagagcttcctcatcattactgcctcaatagctgccccaggatgctaatggcctgccaggacatccagagtggcatgcttctttactcaagtctagtggggaagcgtgagctgctttgtcccagcattcccagcaaagtactgaatccgttccagatgggccagctcatatcacatgcctatttattggccaaagatatggaagtggcttaatggctagcataggttgcctttatttttaaaggcaatggtgaagtcagtgtccatggaaccatatggatcttcaaagagaaaaattgggagcccatagaaaaggtaaaaagagatacacatttggaaaatcctcaactaatatccctaacagagaatccaaactagggttcttatgatggctccaggtgccatgatacttgcccctctagagctaaagctagttgacacccacctgtagctcagtcctggtcttggctttaggaaaactcctgatatgaatcagggagactttcaggatttctaattcaaggctttgtctcagcatcaagttacccttgccaaaggttctgcaccttacaaactgacatccctgatgctggcctatgtgttagttttgggatctcactcaggtcttgctttgaccacccacgtggacattcccttaaatccatgttcggcatccttctcccccagtgcttactgattgcatggagaaacatctctttcttatgttattcactctgaatattgttttcttcttgcctctattatgtagttgtctggctgagtagtatgtctgtatcctaggaaacttgtacctgggctagatggaacagcctcgtttatttcttcaacctctgtcttcactttgttttgaactttatttctgatctattcccctatttccagcatctctggaatctgcttttgttgcctaggcattttgcttgcctggtctctgtctacaaactgaaaatagctctatctcctccctgtgataccgtactctgatcttgcccagtccttgggttctaccttgacaccaagcaatatggttaatatccccataggatttttcccagccccagtattggggaaatggacaatggatgtacggataatttggcccttccatgtctaccctttcctattgcagttcactgtccgtgcctaattatgctctgaattatgacagggagtatctaattggcactcattcagtaatatgacatcgctccttagaattttctattgcattccttacatggtaatttctatgattgaattagtaataatatacttataatatctcatttttctatttcccacagaatatatgatagtatatccaatttcaaaataatctaaaaatattttagtgttagtttactaaatatatatatatatatatatatagagagagagagagagagagagagagagagagagagagagagagaaagagagacagggtccagggtctcactctgtcacccaggctggagtgcagtgacatgatcaaggtttgcactacaccttaaactactgggtttaagggatcctccaggctcaacctccctagagctgggaccacaggtgcatgccaccatgtctggctttaaaatttttttttttttttgtagagacagggtctccctaggttgcttgggctggtcttgaacctcctgagttcaagcgatcctctcacctcagcgccccaaagtgctgggattataggcatgagccactaataatatttgaaaccatattagagcttctttaaaggcctaacccatctcatgagatcatataatgtgatctaagatataagatcctacttagcaacagtgtccaagactcatttttatactaaggcagtttcagaataaccatcacattgtaaaagaatagttaaagccaaaaagtcatagaagtgacattgtaaaacaaacaaacaaaaacaaaacctaactatgaccttagcaattagccatctttagtggaaaccagaagctatcttacttaactgctaggtggacataaactaacccttaatctctgagtctcatgtacccatacaaaagagacgaaaacagttatttgtagggttagggttacatgagatgatattggtctggcatttagcactcttctcagtccatggtagtaaccattactatgatgaagatgtgattgcggatttcattttcccgagactcaataacttcccatattctttgcccacaatccaaaagcaagtatagtcatgcttttttgtttgttttgtttcattgctgattttttttgggtccaaaatagtggaaattcttgattcatgcatttaggaagtgtttttgaatcatgtgaaacaaaacatctgagataatacaaacatcttactatgaataccttggtttgggtgctctatggtttatggctggaaacgttattcccattccaactactcatttgtttccatttaaatgtccagaaaagtggctccctacttgtgccccagaataacctattgaggtgttttaaaaatacagaagcttggactctacttcagaggtcctgaatcagagtcttctctgattcaggtctgattcaggtcaagtgaaacttggacctctagattctttaaacctttatgaataactctcgtgtacaaccagggatgagaatcattgatatgtgacattttttaagtgtccttataagctaccgagaaataattttggacaggacagtaatatggtccttaacttaaacagagcttaaagtaacattttcaactttaactcttaagcttggatagaaatgaattatttaaggaaatgtccaattttttaaaatgaccatcttagaaacagtcatgtggtcccatacaattatttttctaatctatcaaaatggttctatttttcagaatagtgctcccaattaatactccaatctccaattcatgattaggccaaacaaataacaatttatataaatatattcccctttatgttacttttatctcttctactgtaattctggcattcactgtgaacctgggataatagtgtcagtgaaataacaatggagaatttgaattcaactgaaatgggtgtcaaatttatcctattatctaaggtgtgtgctggagcatcactctgaatacagggcagactaaagtggctcctgtctcaactaaaagcactgcattttaactcccagtttctattcttacattatatatagattttatagctaattctccaagccttgttctcacctgcacagaaaatgctcttttcattaaaattaaaagttacataaattccaaccaattgcaaagaatatttttattttgtgtagttttttttaatgacagttccaagatttttttaaaaaataaaatgtttttactagaaatagtacaagcacttcaacttgaatgcactttcataactttggctcagaactgaattttttttccttggtaatttttacactgatagaaatcagattacagggtactgatggacttctttttcctgtaattatagataggagggtcgtatacttaatgtgttctaactatgtagttcacagatgcattttcatactctcagtcactacagaattgattagtccctaagaaatcttttgggcaagattaataatctgttgtggaggatgtgggcatcatatcagaactgagtcactcaaacacacaggcctgcatagagacaataaaaatgatgcaatttttatgaaattctaataacttcaaatgttatttccaccaaggtaccttatttgattcttcccctaagatgaggcaaaaaatggaacacaaataatggaaaaaataaagcaaaaagttagagattttctttcaaaaaaagccctaggcattttacagaaaatgaaaatcaactgaaaaaaaataggaaagcatttagaaagtatatttaatacttttaaaatattataaagtattgtatataataaagtgacatcattttatatgtgtactagtatctcagagacttgtatgatttctatttaacttaattgtctttctcatatagaaatgtaaaaagtgacaatgtaaaaatgtaagtaaagtataaaaatatttaaaagtaactgtgtatcctcttctgtatggtagaagttaaattgtggctaggctacataatcttatatattgaaagttcaaagtgatttaaaaaaaacccaacaacctttgggcttgctttcttagtttctttactcatagtgtgtgattaaccaagccttctggcctgcatacagtgttgctgtcttcatttacagtttatgtacatttatagtatatgtatgtgtactgtatatatgcagactatatatatagagtatatgtatagatacatacatatatacacctatactgtatatttatacatatacatacatacatgtatattcttgctctcaagtcaagaccatttctgccacaatttaaaaaattttggccaggcgcggtggctcgtgcctgtaatcccagcactttgggaggccgaggagggcagatcacgagatcaggagatcgagaccatcccagctaacaaggtgaaactccttctctactaaaaaatacaaaaaattagctgggcaaggtggtgggcacctgcagtcccagctactcagaggcaggagaaaggcgtgaactcaggaggcggagcttgcagtgagccgagatcgtgccactgcactccagcctgggcgacagagcaagactctgtctcaaaaaaaaaaaaaaaaatgattttgtgtaaatttatggggtacaagtacagttgtgttacatgtgtagattgtgcatagcagtcaagtcaggactttcagggtatccatcatctgaataacatacattgcacccattaaggaatttttcatcatctagccccttgctaccccctcatccttccaactgtccagtgtttatcattccactgtctatgcccatgtgtgcacattatgtagctcccacttacaagtcagaacaccaccattctttttttgtgtacttcagttttttgtttatttctttttgagcctagtaagacattccttttgaaaaatgcatcttggcatttggatttctacatagatgaatacttattcttgagcacaaaagaataagaaaagcacctgaccaatatctaatataatttgaggaaattcatatgtaaccctttcaaagacaggacagtcacatggttctttcatggagtaatatcccactaagtagaagtaattaaaaataaacttctttcttctcatgatttttcacttcagcaacattaatgagatccaaacagcctgttgctgtccttattaatacctgctttctttcctgaccattttcttcatacctgccattgctctaactcatgtctcctgatctcccacctccccaccccagaaataatacttccttcacagcccacttgtcttttctttattcctttttcattgcctatctcagctctttattacaaagataattcctttttttctcatgtggatatttctttctctctagaagtgaggagcagggcagaaaaatctctgaccacaaaggtcttccctttcgtgggagaagggttggctacgcacactctcatattaacgttattgtgccatcccatattatgtagttaaagacagttcaaaaacgctatttaaggccgggcacggtggctcatgcctataatcccagcactttgggaggccgaggagcacagatcacttgaggccgggagttcaagaccagcctggccagcatggtgaaatgccatctctactaaaaatacaaaaaataactagacatggtggtgggtacctgtaatcccagctactgaggaggctgaggcaagggaatggcttgaaaccaagagatgaacgttgcagtgagccaagatcgtgccactgcactccagcctgggtgacagaatgagactttgtcgcaaaaaaaaaaaaaaaaaaaaaagctattgaattgattttctttagccagtgtccaatggagacaatttattatgcaagtgtgtgtctatttgccccataatgacttatagaaaattaactgtatccttatgtatacttatgagattctcttttcaaccttcttataagctaccctcttgtaatttcagtaacaacttgattatttcttgttcctttctgtggaggaaagaaacaactagaggtaatacaatgatgatatgaggggaagaagtatgcctagtgattgctgaaagatgagatttctggctcatgtgccagtagtaacaacttagggaaaagggtgggatgtgtgctgttgtggtaaaagtagaaaaaggtctggtcactgaatgaacagtcagagcctaggagcaaaaaagaatataagtacctagagatgtaaattaaagaaaagctgggcatgaaaataaaacaaggaatagggctcagaataggaactaggttgtaactcctcaagttcttctctttcttttaattacatcaaacgagaggaaagactccccacccccagccccccatttttggtaatctaatagagataggaatttttctcccccatcaccttcacccttctcatgctccaagtaaagcattttgcttgcagccagaaatggcagatcttaactaatacaatttttaaacagaaagactgggttctgtgtaagttctcctttctgttaacttatatggaaacttgttttcatatgctcccaaactgcactaaatcagttggcaataccaagcacaagggatacacttcataatccttctaaatgactggcaagagaactgtcctggagaagaatgcccctgctagctcctccttccctctatctcacttctatcatattatccatagattagagtggcgaagagcagaacacatctctggtgaaaactctcatcagacaaagaaacatgataaaacccagtaaacagggatttccacatcagtttctatcaggaaaaaacaaataaatggctcacctttatatacaatggctccctaagatgatcaaccagaatacaagctttttcttcccacacagggttgaggttcttgtgtattatcttacttctaaaaacttcttttcctccgattttaaacttcacatatggatcactcgtccctgttaaatagatagattgatccatgttaatcatgacttggtttggaagcaagagaaccactcttttgaaacaacaaaaagtatttaaaggaagaaaagttaaatgaaaattatctatgcagaaataagagttaagtgttttcttatgaattttttattatatattgaagtgataaataataataattattattacttcatcttctgatcttaatcgtgtaaccttgtcctggcagttaaaaacagtctattccagcaatcccgctagtggacatctacccaaaggaaaagaaatcattttatcaaaaagatacctgactcaaatgtttatcacagcacttttcacaatagcaaagacatggaatcaacagactattgggctaaaatgtgatatatatatatatcaaatgccatgatatatatattccatggcatatatatacatatatatatacaaatatatatatacatatatatatatacacaactatatatatgcatatatatacaaatatatatgcatatatatacaaatatatatatgcatatatatacaaatataatatatgcatatatatacaaatatatatgcatatatatacaaatatatatatgcatatatatacaaatatatatatgcatatatatacaaatatatatgcatatatatacaaatatatatatgcatatatatacaaatatatatgcatatatatacaaatatatatgtgcatatatatacatatatatgaatatatatacaaatatatatatgcatatatatacatatatatatgcatatatatacatatatatatatgcatatatatatatatatatatatgccatggaatactactcagccataagaaacagatcatgtctttagcagcaacatggatggaacaggaggccattactctaagtgaaatgactcagagaaagtaagtaaaaaactacatgttctcttttacaagtgggagctaaacaattggtacacatgaagacaaagaatggaaaaatagacactggagattccaaaaggtaggaggatgggagaggggtgaagaatgaaataccatctatttggtacaatgtatacgacttgggtgatgggtattctaaaagcccagactttaccactatgcaatacatccatgtaacacaactgcacttgtatccctaaatctattttttaaaaccacactctattgcatgttgaatgtgtaaatttaattaaagttataaatcatagagattaatctgatcttcctcttgatatcatctggtcaactataaaaagatgttgaataatcttcactgatttaaatagttttaacagcatatatacgctgctaaaattttatactagtctaatgggcttaggaaaagatgcgtgttaaagtgggcttcatttcatccttggtcccatattttttcttgctcagaagtttcaattttagaatgttaggaaggggtggaggtctcagagaaagacatcaggagaaaggggaacacatgtttaataagtgaattggattctttgtattatcccttgacacctcctaaactccctatgatgataaagaaaatcaaagttgattcccaggcaagatggccaaataggaacagctccagtctgcagcttccagtgagaccaatgcagaaggcgggtgatttctgcatttccaactgaggtacctggtacatctcagtgggactggttggacagtgggtgcagcccacagagggtgagcagaagcagggtggggcatcactgcctcacccaggaagtgcaagggttcggggaactccttcccctacccaaggaaagctgtgagggaccatgccgtgagggacagtgctctctggcccagatactatgcttttcccatggtcttcacaacccacagaccaggaaattcccttgggtgcctatgtcacaaggcctctggtttcaagcacaaaactgggcagtcatttgggcagacactgagctagctgtaggagtcttttttcgtaccccagtggtacctggaatgccagtgaaacagaactgttcactcccctggtaagggggctaaagccaggttgccgagtggtcttgctcagtggatcctacccccatggagcccagaaagctaagatccactggcttgaaattctcattgctagcatagcagtctgaagtcgacctgggaggcttgagcttggtagggagaggggcgtctgccattactgaggcttgagtaggcagttttcccctcacagtataaacaaagctgcagaaagttcagacagggcagagcctactgcagctcagcaaagccactgtagccagactgcctctctacattcctcctctctgggcagagcatctctggaagaaaggcagcagccacaatcaggagtttatagataaaactcccttctccctgggacagagcacctgggggaaggggtagctgtgggtacagcatcagcagacttaaaagttcctgcctgccagctctgaagagagcagcagatctcccagcacagaccttaagctctgctaagggacagtatgcctcctcaagtgggtccctgactcccatgcttcctgacagggagacacctcccagcaggggtcgacagacacctcacacaggagagttctggctggtatctggtgggtgcccctctgggatgaagcttccagaggaaggagcaggcagcaatctttgctgttctgcagcctctgctggtgatacccaggcaaacagtctggagttgaccccagcaaattccagttgaactgcagaagagggacctgactgttagaagaaaactaacaaacagaaaggaatagccatcaacatcaacaaaaaggatgaccgtggaaaactccatccaaaggtcaccaacagcaaagaccaaaggtagatgaatccacaaagatgaggaaaaaaacagcgcaaaaaggctgaaaattccaaaaaccagaatgcctcttctcctccaaaggatcacaactccttgccagcaagggaacaaaactggatggtgaatgagtttgatgaattgacagaagtaggcttcagaaggtagataataacaaacttctcagagctaaaggagcatgtggtaacccaatgcaaggaggctaaaagcctttataaaaggttagaggaactactaaatagaataaccagttcagagaagaacataaatgacctgatggagctgaaaaacacagcatgagaacttcgtgaagcatacacaaatatcaatagccaaactgatcaagtggaagaaaggatatcagagattgaagatcaacttaatgaaataaagtgtaaagacaagattacaaaaaaaaagaatgaaaaggaatgaacaaagcctccaagaaatatgggactctgtaaagagaccaaacctacgtttgattggtgtacctgaaagtgaaggggagaatggaaccaagttgaaaaatacacttcaggatatccaggagaacttccccaacctagcaagacaggccaacattcaaattcaggaaatacagaaaacaccacaaagatactcctcaagaagagccatcccaagacacataatcgtcagattcaccaaggttgaaatgaaagatgaaatgttaagggcagccagagagaaaggtctggctacccacaaagggaagcccatcagactaacagcagatctctctgcagaaattctacaagccagaagagactgggggccaatattcaacattcttaaagaaaggaatttccaactcagaatttcatatccagccaaattaagcttcataagtgaaggagaaataaaatcctttacagacaagcaaatgctgagagattttgtcaccaccaagcctgccttacaagagctcctgaaagaagtgctaaatatggaaaggaaaaactggtaccagcctccacaaaaacaaaccgagatgtaaagaccattgacaatatgaagaaactgcatcaactaatgggcgaaataaccagctagcatcaaaatgacaggatcaaattcacacataataatatttaccttaaatgtaaatgggctaaatgccccaattaaaaggcacagactagtaaattggataaagagtcaagacccaatggtgtattcaggagacccatctcacgtgcaaagacatgcacaggctcaaaacaaagggatggaggaagatttaccaagaaaatggaaagaaaaaaaagaaaaagcaggggttgcaatcctagcccctgataaaacagattttacaccaatgaagattaaaaaaaaagagaaagaagggaattacctaatggcaaagggatcaatgcaacaagaagagctaactatcctcaatatatatgcacccaatacaagagcacccagattcataaagtaagttcttagagacctacaaagagacttagactcccacacaataatagtgggagactttaacaccccactgtctatattagacagatcaacaagacagaaaattaacaaggatattcaggacttgaactcagctctggactaagtggacctaatagacatctacagaattctccaccccagatcaatagaatatacattcttctcagcaccacattacacttattctaaaatcgaccacataattggaagtaaaactgctcagctaatgcaaaagaacagaaattataacaaacagtctctcagaccacagtgcaatcaaattagaactcaggattaagaaactcactcaaaactgcacaactacatgaaaactgaacaacctgctcctgaatgacaaatgagtaaataacaaaattagggcagaaataaataagttctttgaaaccaatgagaacaaagacacaacataccagaacctttgggacacagctaaagcagtgtgtagagggaaatttatagtactaaatgcccacaagagaaagcaggaaaaatctaaaattgacgccctaacatcacaattaagagaactagagaagcaagagcaaacaaattcaaaagctagcagaagacaagaaataactaagatcagagcagaactgaaggagatagagacatgaaaaacccttaaaaaaatcaatgaatccaggacctggtttttgaaaagattaacaaaacagatagactgctagccaggataataaagaagaaaagagagaagaatcaaatagacgcaataaaaaatgataaaggcagtatcaccactgatatcccacagaaatagaaactaccatcagagaatactataaacacctctacacaaataaactagaaaatctagaagaaatggataaattcctggacacatacaccctcccaagactaaaccaggaggaagttgaatccctgaatagaccaataacaagttctgaaattgaggcagtaattagtagcctaccaaccaaaaaaacccatgaccagatggattcacagctgaattctaccagaggtacaaagaggagctggtaaccattccttctaaaactattccaaacaataggaaaagagggattcctccccaattcattttatgaggccagcatcatcctgataccaaaacctggcagagacacaacaaaaaaaggaaatgtcaggccaatctccctgatgaacattgatgtgaaaatcctcaataaaatactggcaaaccgaatccagcagcacattaaaaagcttatccaccacaatcaagtcggcttcatccctgggatgcaaggctggttcaacatatgcaaatcaataaatgtaatccatcacataaacagaaccattgaaaaaaactacatgattatctcaatagatgcagaaaaggccttcaataaaatccaacaccctttcatgctaaaaacactcaataaaccaggtattgatggaatgtatctcaaaataataagagatatttatgagaaacccacagccaatatcatactgaatgggcaaaagttggaagcattttatttgaaaacaagcacaagacaaggatgccctctctcaccactcctattcaatatagtattgaaagttccggccagggcaattaggcaagagagagaaataaaggtattcaaataggaaaagaggaagtcaaattatctctgtttgcagatgagatgattgcatatttagaaaaccccgttgtctcagcccaaaactccttaagctgatatgcaacttcagcaaagtctcaggatacaaagtcaatgtgcaaaaatcacaagcattcctatacaccagtaacagacaaacagagagccaaatcatgagtgaactcccattaacaattgctacaaagagaatacaatacctaggaatacaatttaaaagagatgtgaagggtgtcttcaaagagaactacaaaccactgctcaaggaaataagagaggtcacaaacaaatggaaaaacattccatgctcatgaataggaagaatcaatatcgtgaaaatggccatactgcccaaagtaatttatagattcaatgctattcccaccaagttaccattgactttcttcagagaattagaaaaaactactttaaattttatatggaaccaaaaaagagcctgtgtagccaagacaatcctaagcaaaaataacaaagctggatgcatcatgctacctgacttcaagctacactacaaggctacagtaaccaaaacagcatggtactgataccaaaacagacatatagaccaatggaacagaacagaggcctcagaaataacaccacacatctacaaccatctgatccttgagaaacctgacaaaaacaagcaatggggaaaggataccctatttaatacatggtgttgggaaaactggctagccatatgaagaaaactgaaactggaccccttccttacacattatacaaaaattaactcaggatggatgaaagatttaaacgtaagacctaaaattataaaaaccctagaagaaaacctaggcaataccattcaagacataggcatgggcaaagacttcatgactaaaacaccaaaagcaatgtcaacaaaagccaaaattgacaaatgagatctaattaaattaaggagcctctgcacagcaaaagaaactatcatcagagtgaacaggcaacctacagaatgggagaaaatttttgcaatctatccatctgacaaagggctaatatccagaatctacaaggaacttaaacaaatttaagagaaaaaaacaaccccatcaaaaagtgggcaaaggatatgaacagatacttttcaaaagaagacattgacgtggccaagaaacatatgaaaaaaagctcatcatcactggtcattagagaaatgtaatacaaattaaaaccccaatgacacaccatgtcacgaccgttagaatggcaatcattaaaaagtcaggaaacaacagatgctggagaggatgtggagaaataagaatgcttttacactgttggtgggagtgtaaattagttcaaccacaggggaagactgtgtggcaattcctcaagaatctagaactagaaataccatttgatccagcaatcctattactgggtatatacccaaaggattataaatcattctactataaagacacatgcacacgtatgtttactgcggcactcttcatggtagcaaagacttagaaccaacccaaatgtccatcaatgatagactggataaagaaaatgtggcagatatacacaatggaatactatgcagtcataaaaaagaatgagttcatgtcctttgtagggacatggaagaagctggaaaccatcattctcagcaagctaacacaggaacagaaaaccaaatagtgcatgttctcactcataagtgggagttgaacaatgagaacatatgggcacagggaagggaacatcacacactgggggctgttggggggtgggggacaaggggagggatagcattaggagaaacagctaatgtagatgacaggttgatgggtgcagcaaaccaccctatgttacctatgtaacaaatctgcacgttctgaacatgtatcccagagcttaaagtataatttaaaaaaaaagaaagaaaatcagaattgtccagtaagttgttcatggatacaaagctagcaagagatggagttaggattccaaccaaggctatttgactctaatgcctgcactatttctactacacctacaaaaaggaagggacttcacatatgtacaatatatatcataccatttctcatctttgtgtgaagctgatgaatgagaccaatcttgacctacagagtctctgctgctgttaaagatccctggagaaggtaacttagtgatggtccttaagtaaatcattccagtgtgtaacaatcttcaccacaagaaaataattctttatgaaaggcctgactcctttatgataaagtttgaccacattcttcttctttagtctacattgaagctacaattaataactatagtctatatgatttaaagaaaaaggtgagacttgtctattcacctccttagcccacttttcgatgtgatttttttcttgctaatttgtttgtgctcattgtagattctggatattagtcctttgccagatatataaattgtgaagattttctcccgctctgtgggttgacaattctcaaaggagatatacaaattaccaacaaacacatgaaaaaatggtcaacgtcactaataatcagggaaatgcaaatcaaaatcacagtgcaatgccaccttactcctgcgcaaatggctataataataataaaaaaaaagaaatagatgttggtgtggatggggtagaaagggaatgctcctatactgccggtgggagtataaactagtacaaccactatggaaaatggtgtggagattccttaaagaactaaaagtagaaggactatttaatccaacaatcccactacggggtatctgcccacaggaaaagatgtcattatacaaaaaacatacttgcacatgcatgtttaaggcaccacaatttgctatcgcagaaatgtggaaccaatccaaatggccatcaatcaacaagtggataaagaaattgatatatatatatcatatattgtatatattgtatttatatatcatatattgtagatatataacatatatattgtgtgtatgtatatacatgtgatggaatagtactcagccataaaaaggaatgaattaatggcatttgcagcaacctggatgggattggagactattattctaagtgaagtaactcaggaatggaaaaccaaatatcgtatgctctcactcataagtgggagctaagctatgaggatgcaaaggcataagaatgatacaatgaactttgggactcagggggaaaggctgggaaggcagtgggggataaaagactacacattgggtacagtgtacactgcttggacgatgcatcaaaatctcacaaatcatcacttaataacttactcatgtaaccaaataccatttgttccccaaaaacctatggaaataaaaaagaaatagatacataataaatctttaaacttgaaaaaaagaaaaatgtgaggtgggctctgaaaactggtgaaagctcactctgcttccaagttggcaccttgctgctgtgtcctcacatggcaaaaggtgaaaggacaaaaaggcctagctagttcccttgagcccttttgtaagggtgctaatcccattcatgaggacagaatgcttgtgactcaaacatcttctaaaggctctacctcttaaaactatcaaactgggtcttgggttccaacatatgaattttgatggggaggaaaacatacagtcaaactatagcactatccattcattgatagacatttagattgcttccatatcttggctattgtgaataatgctgcaatgaacatgggagtgcagatatcgctactagatcctgatttcattttctctggataaatacccagaaatgagattgctaggtaatattgtaattctatttttttttttttttgagaaacctccatactgttttccttaatggctgcaccaatttagattcccattaacagtgaacaagggtcatattttctccagatcctgtccaacacttgttttctttttttttttttaataatagccaccctaacaggtgtgatttgatacctcagtgtggttttcatttgcatttccctgatgattactgatgttgaggaccttttcttatgcttcctggctatttgtatgtcccctttggaaaaatctctattttggtcctttgccattttgttttggtaatcgagttatttgtttttctgttactgagttgtagtagttccttatatagtttagatgttagctccttattagaggtatgtttgcaaatattttctccccttccatagattgcttttttattttgttgattgtttcctttgctacacaaaagcttttcagtttgatgtattcccatgtacctatctttgctttcgttgcctgtgcttttggcatcatatcccaaaagtcattgccaagaccaatgtcaaggagcattttctctatctttccttccggtagtttttcattttcaggtcttacgtttaagtctttaatctattttgaattgatatttttatatagtataagggtcaaatttcattcttctgcactattcactgaagagactttcttttcctcattgtatgttgttggcatctttgtcaaaaattaattgactacatatgatggatttatttctgggctctgtattctgctttgttggcctatgtgtctgcttttatgctagcatcatactggttatactgtggcttttgatttttagcttcatatcactgtgatcaaaaaagatacttgatatgattttaatcttcctatacttcttaaaatttgttttgtggcctaacatatgatctaactggaggatattttgtgtgtgcttgagaatgatgtgctgctgaacagaatattccatatgtgactcttaggtccactgggtctagagtgtagtttaagattgatgtttccttattgattttctgtctagatgatctgttcattgctgagagtagggcattgaagtcccctactattattgtattgcagtctgcctctcccttcagatctattaatatttgccctatatttgtaggtgctccaattttgggtacatatatatttacaattgttatgtcctcttaatgaactgacacctttatcattacataattatcatctttcttttacagttttaaagtttgtcttgtctgatataagtacagatacgcttgctctcttttggtttccatttaaatagaatatctttttttataccattgctttcaatctatatgtgtccttaaaggtgaagtaagtctcttgtaggtggtatatagttgagtctttctcttttaatccattcagtcactctgtcttttgattggataatttaatccatttacattaaaggtaattattgataggtaagaccttattattgctcttttattaactgttttttagttgttttgtaaatcctttgctatagttatttttaataattttgtctttgaactttcataataaatttaaaaatgattatgcaccaccattatagtattagaataataactattggtcaaattctggatttgactatattcttatctttactaatgagttttatgctctcatgtttggctaagaagcatcctttcatttctgcttgaataactctctgaatcatttcttataatcgaggtttaggcgatgaacttgctcagcttctgtttgtctgagaaagtctatatctctccttcatttctgaaggaaagactttctgggtaaagtattcttggatgccatttttttctctttctgctggaaccagctggtgctagagtgggcctggagcctaggtctgtggggaagtcagatatccacttcactctcttttccttacaggagagctctgaacagaggagatctctctagtcctcacaccattctggtttggaaaatgattcaggtagagtgaaactgcccttccagccctttactgtgccttttcccattctgtactccactagtgtggtgtaacctttcacctggaatccagagctcagggaagtatttttgtgtgtgtggatggttttttttatcagtctttctgtgactggacaaggggtgtaatctcctattctgccatcttgctgatgttactcttcttagtctcaacaggtatttgttaaataagtaaatgaataagtgaatctgtgtacagagtactatcaaatacattcttgctatttgataaattcgtgcacatttatttcccttccaaaattcatgttgaaactaatcctcaatgtaacagtattaagaggcagtgattcggaagtgattaggccatgaggactctatcacgaatagaataataccttataaaaggatttgaggggatgttttccccttctgtctcttctgccacgtgaggacacaatgttttttcctttccagaggacccagcaacaaggcaatatctttgaagcagagaccaggcccttactggacaccaaaccggccggtgcttggacttccagcttccagaactatgagaaatctataactgtgtatttatagattactcagtcccaagtatttttttataccagcacaaacagattaaacaatcctcaaactgactttgagttggaaaaagcatatattattaatatcaatctacattgcaggtgaggaacaatctggaattttatgttacttgcccaaaatatcgtaacaattaagctaataagtgacaggaatggagggcatatttagactttcagactccaagcccaatgtttcttctattcaacagtttaggaatcccagacacccatatttttctttaactctaaaacagtggcatataactactgtgtgaaagtattaagcaattgttgcaatactacgtataataccactattgacaagtatttattctggtctataaagctctcatacttttgtttaatcaccactatctcagtgagtctactattgcctccattttatagatgagaaaaccaagaagggttaataacttgctccaagtcatacagttaataaggatgtggctggccggacgcggtggctcacgtctgtaatcccaacactttgggaagccgaggcaggggaatcacaaggtcaggagatcaagaccatcctggctaacacggtgaaaccccgtctctactaaaaatacaaaaaattaacaaggcgtggtggcgggcacctgtagtcccagctactcaggaggctgaggcaggagaatggcgtgaacctgggagacggaggttgcagtgagccgagactgtgccactgcgctccagcctgggcgacaaagcgagactctgtctcgaaaaaaaaaaaacaacaaaaccaaggatgtggcagggcccaaactcaatctcaaatctgagggctagttcagctagtgctttttcttgcacatgatcacaaagccttctcccatttcaaagtgttgttacaatgatctatttctttgttcccctcaaaactaggaatgatcattttacaaaaaacgcactcgcacaaaatctggccttattgggtttctctgcagttattggtagtacacaatgtcaacttcatttagtttggctattatgtaaaaatactgatacaacttttagtaatttagcacagaggcctatacactcagatgttaatctttttgagaagcattttgcttcttgctccctcccagaaacattttttctcaaccactgtgtaggttaagtgtcaaaatcccctgaaggttgggtagagatggttcctagaatcctgctgggtggtctgctgggtcttaatggtaccacttccattataaaagggaacttagatcactatagctaacatttattgaacacttattatatcagctatcacacaccacgtaacaagccaatgtgatgagttctattgttatcttgagttcacagctgaagaaactgcagcatgaaataagggagtaaattccccaaagtcatacaactaggctgctggaacctgaacttaactgctacactaggctgtctccaaacacaacacttctcatgctgggtgtcatatccctgatgacactgtaaatatccaatggcttgaagaagtaaaatgtcagctaacaagagtagattgaagagttaagttaaaattcaaggacagatttttcagtctgcaatagacacagagatgttcgagactggtgtcagagagagacagaggctgcttgttaggatctccaaaaacgtattatgatggcgcaatattttataaacgtgtggtcttggtcacagggtgacctggtttaaaagtggtaaatatgtcagcaaatttcattagcacaggaaaaacagatccaggcgaacaactcttggtagttcgtcatctaattttctctgctttgttttgacttcataggataaaatttgctacatttctctttccaaccatcacttagtggcttttaggtactgttattaaaatttcataattttaatagccaagtattaaaaagaaatttctaatcattttcaaattcttaacttaggggacttttagtgattgagagtccttaatatttcaagaccctcagcttgttgtgattccaacatgggtaactggagacattgttcttttaatttaggttcagtgaaagatttttaactaatgcactaatctatgtttgaaagtgtttttaccaagtatattttagcaagatattatctgatgacattaatagctattatttattttttaaaggagttatatggtcaagtatatttggaaaatactggtttagaagaaaattaaatagattccttttctgtagcctttaaataattgaacgttcactatgactttccaagaaggaggcttgacaggcatcacttactaagtttttttgactatgaggcctacttttcttgagtgcatcttttaggaccaacaatccttggatctctctttgggaaatgttacttccttatatttcattatagggaaattacacgttttcaagattatattattattgactttacagtggatttaaataattttattgtaatagaactcccaggaaatccaagtcactaatatgtggtatgtggttaatcttcaataaacatactatacaaaaaggatttagtttgttggttcgaaagactcaaaaaaatcaatagcttcatatgccagtgctgttttgttgcaatattgcataaaaccacaagatggcaatagtacttatcaaattaaagagaggcctgtggttctgctattgaaaccaaaggttagagcgccttgcagggcacactttgaagttcccaggcattttctggcagcatatgctttgttgttattatctggaccattactttcattgacatactttttatgacgataaatgaattgaaaacaagtcaaaaagtacgaaagatgaatctagaaagtattcgccctacagtaaaattcagattttgttattaatgtcatattcaagaacaacctttcacatattcattttgtcaggtagccttaactttagaatttgtttataaaaacattattttgtaattataaattccatggtctaaaagttctagactatcctagacctaggaaatatcaattttttctaaatgctggaataaaattcctttaaaaagaggaattggacggtttctataatgtttactcatgtagcaaaggagtacatgttcttaatgctatatttatttattttttacaaggcaggatactgatgggcacttcaacattctgtgtaatatttaaagccttttatgttatttaagacaacacaactaaacgtggtctgaatgtgtccatttttatgtagcaataaacacagcatacacaagatggcagcctatcttcccttaaactagtattaaagatatttaaaatgtaaatagctgtctattaatgatactcttgcttttcattctcagaataaataagcctcctggttaacaagtttaaatcagtctcattccaaacctagcacttaatgaaacagaaacagctactcacgttttgggaaatctacaactactcaataatgctaagtcttcatcgaaaacaatgccaaattgcaactcagtgtcacaagaagaaggaggaggaggaataagaaaaaagacaaaagaaaaaaagcagtgaacacatatattgtggggacagttaaaatttaagctggatctttctgaagataactgatcttcctacaaatatttaaagctagctacctttgctgtccaattgtaacagagggtatccttgtagaataaggtccttcacatttgagaggttgtaaaaatagtgacattcaaaacatcagtgatttaaaaatcttcaaaaagggtaccttatggatgtgttaaaataatttccataagctattctattccctcattttttgctggagacttgttatgccctaggatggaaatatttcataatgctaaataactaaatatattaaaatttaaatgcaagaggtttataatcacaggtggcttcatataataaaataaaagtaaaccaacattttttccataatgaacatgaatattccaatgaatttaaaatttctggtaagttaccatgatatagcacatagattaatttaaaataatagtatggtaaagtgtagcataggatggcactaggtatatttatttcctgaagagtagtagaaggcagttcaggtaacctttaggcttagttttctctcctaaatgcagagttgaagacatgcaagacgaaattattcatgttgtatcccaaatataacatgaataatttgggatacatatgtatggatgtatttgggatatacttattcatacaacttattcaaatttgggatatatatgtatggatgtatttgggatatacttattcatataacttattcaaattccctttcatatctgacataaacagcaggtggtatctaaatgcaattttctgataacttctggaagtttaggtaaacgaaaatatggattgctttaattttgaatgtaagttgtatattacttggtgacattgagcaactacaacaactatcctagatgtcattttttccaaagggccttactcctgtctcctccaggaattcgctctatgactggtaattgactcagtgactcagtagatacaatatatagtactattaattttttttaccgaaaggaaactatttttcctgagaattctgctgaaatatgctaccatgtttatatagccatcctaacaaaaaatcacatctaaaaaattaaacgttttttaaaagaactttaactttcctatttaaaaaatcagaatattttaaaaaatagaccctaaagtattacgcctcttcaatcctttttttttttcttggctatcccaatacttttctgaaattgtttccttgagtgtcaccaataacttttaaaaattcatcaatttcaacgggcttttcttcgttttcagcccttttcatctgtgggtcacactgggtattattaattgcaatgattctgggattttcttcttatttggattctgcagtcccagtactcctatagccaaagagttagttgtgtctattgtctacatgtctacaagaactatgatcttagaaaagtcacttaggctctgttgtatacagttttgtatccttaaaatgaggggatttcccaaatttctctgagggtctctgataagacctctcttgcatgtctttgacagagaataagccattccacataaatgaattttctaggaaactaaaaattaccacgtagaacaccaaaacctgtttcattaatatacttaaaggaattatttctaaaatttattaaatttttatcccttttaggtaaacaatgaatgcaatttaaaaaaaaatggggcagagcatcatttgttaagtgtgtctaggaaattatcatcaaggttctagcaagataaagttaaatatgtagaaaactagtgaaacttgagtagaagtgttttaatttctgaattcccaaactaattattgctaaaggtcaataatcagacagacatttcccactagtggatgcttctataatctgtttattctatatatgcacttcttttgctttatacctttcaattcagagttgttataaattcaataatggtattatttccattgctaaatatgccaaggaacaaaatgtagttcttaaaataaaacaagttaaaagtgatgtgaggtcgaaggagacttgagttccaaaatcaccacacagagagccatctgccaatcagaagcacctgccttggactcttatgtaggttaaaaataaacttctattacatttgagccattaaatattttgaggtccatttataatcacagttcattctactctaacaaattcctaagtcctgtggattctaattattaaatttccatttgcaacaaacctagcccaccagttcagcctagcccacctgacatctgttcttaagatctttgttcaattggtaaaacatctcttgaaatgatctctgccaccattgccccatcattccttatctagattatttagagccttctgcgtggtctctctgccttccttcaaacccatcctctaagtcctaatggaattctctccatcatatacaaatcaggccattttattcctcttggactacatttcagtccatattctgcacccacaagcactgctgtggggaacccaggccccagaactctggctcagcatcagtattcaaagcttctccttgttcaggagattttgcacaaacaggagtaaatttttatcatcttacactcttaccatggagactatggatcctaatttgtcttctgtggcaggttgaacccttaacagccattttccccctttcccttcactatcactgaatagagtctctgtgagttttagcggaatgcctggtcctcccttcagagaatatcttattctccaagcaacaggtgtggccatgtacccatgtccttcctggtaggatgtgagaataagtgacctatgcaacttctgggtcttatggtgaaaatggagcagttgctttagacaagagatggaaaccacacagtgatgagagcagaaccatatcatcagctctagatctttctggggttcatgtggaagaaaatataattttaaaaattatcagaaaagttgggtctcttgttaccagaagcttagtttgcatcctaaatcattctaattaagaaacaacttttcaaatagattttccttctagaaaagcatgtttcttaattagaatgattcatatgacttcacagagccaatcaattttgtgtgagtcccattcaattcagtttaataagactatgggggatgaaccagcttttcccatagcctggccattcttaggcaagggggtttctcatttacagaactgaaaggcaaagtccactaaatgaacaaaaaaaaaaccactgggttgaggagggagagaactaactttcttgagtatctactgtgtgccttgtgcttttaatacaatattttatttagttataactctagccctgtgagttgggttaaactagcacaaaggaggcatctaataaatgtttgtcaagcaaatgaataaattagtattctcagtattttacagatgagtaaactggttcagaaagattaggctgcttgacctggttacctaacttgtaagcagtggcagctctagaatccattacaagagctatttgattctagattccaaatttacttcattacactgtgatgcctaaccatcgtcatcttttccgatcaaccgacttgtcccgtctacctcaaactattatttttgggctcagcccttccataatctatctcctggttcccccatgagagacaagattgtatactagggaagccatggatctcaatcaatttggcaattattaattctgtgccattagcataacagagtattggttacacccactcagtgaatttgacggggaagatgagttatttagtgtcttttgtctccattagaccaaaaatagtatgaagacagagaccatttttgcatcccagaacctgccacaaagcaggtactcaagtgctcaataaatatttgttggcttgtatgaatgacatacattactgttaatatattacctttgctaagctaggcacttattcagaagcctaaaactgggtgtctttctgcaacaaataaaattgcttaatggtgctctatagaaaaatataattaaaaggtatgagattgcttagtatatttctgagggggatgaaaaggctcatgaccactccatctgtaatagagatggtttagtgtggtacagggtagttcacagttcgacctccaagttagaaagcctgggttccaatctctgctcctgcacttacaagctgtgtggacttgcacaagtagaagatgcacatagatagaaatggagacgattatagaacctccttaaggtcattgtgagggtttaattacataatacatatcaagtacttagcacagttcctcccacaaaataaacattcaataactattagcaatttttcttcatcttactcaacatgaagacaaagtaatataattacttaacaatctgaaaacttgactcaatataattaaatttaaataaagaactacaaacatattaaaatggttatcaaatctctgatttcatatgtggaatgatttatttcaattgagataacagttactaattatctatttttcctaatcatttaggaatacataaatagaacaagcacagtgtctcacacttgtaatccaatgctttgggaggccacggtgggagaatttcttcaggtcaggagtttgagaccagcctgggcaacaacagtaaaaccctgtatctacaaaatttttttaaaaaattagctgggcatggtggtatgcctgtagtcccagttacttgggacactgagacaggaggactgtttgagtctaggagttggtggctgcagtgagctctcattgtgccactgtactccagcctgggcaacagagcaagaccctatccctgaaaaataataatacataagtatacagcaaaaagtagtaattattattttcagaggattcattggctttgttaagtcaagagaaaaagcctataattaattacaaatattatataaataaacctaagtatcaaaaaagtgccattaaaataaccagatcctatagaatatatgcatgaaaaaaatgattatgaccctaaaaaaaaccaaaaaaatctccttatcagctaaaaccataagtaataacaatacaaatagttgcacgacttttgtagattaattactatcattaactggaataatttcaagcaattatattacaatgtgattaaaatacatcacaaatgaccatggtaatgaaataatacatttcttagactattcatatattcactttgagaaaaaaggcaagccaatggtcttctatttgtctccatgcttctagtcttccttatttcaattcattctccaaaatcttacgattgtttttctgttattcccttgcttttaattcttcatttctttctcagtgattttagaatggatcagggaaggtgtccaagcagcagtgaagcttgaataaatactgaaagaagactggccatggtggggtaggacactcaagacaaagggaaaggggtgaagaggggcacagcatgtgttatggactgaatgtttatacccccgcaactccctgccaaattcgtaggctgaaactctagtcttcaatgtgatggtatttggaagtaaagacttcaggaggcgattaggtttggataaggtcatgaggatggtgccctcctgatgggattagtgcccttataagacaaagaagagacacgggagctctctctttctccatgcactgaggaaaggccttctgagcacacagcaggaaggtggctgtctacaagccaggaggcaggtcctcaccaggaacccaatctgctggcaccttgatcttagacttcccaggctttagaactgtgagaaataaatgtctgttgtttaagccacccagtctacagtatttcgttataacagcccaagcaaagatggcatatcatacaaaattttctttgttaatttctgcagactcatctctcaacagacatcccatctatagaatatttgcaccatctcaaagtcacagcctctctccaataactgtgcctctcttcacccctttccctctctcttgagtgtcctactccaccatggccagtcttcttttagtatttattcaagcttcactgctgcttggacgccttccctgatctactcatggacattattaggcctttttcttacactcccaaacattctttgccatagcacttgtcacattgaggccttgctgtttatttctgatccctgatgtctagcacaactcctgggtcatcgagaaatctttgttgactgaaaacacatgtataactgaaggaaggaatatgtatcatcgcataataacaacacaacctaatgaggtaaccagtacttaagttgcacaccctttatgtcccactcccttattccctactcttatccactatgatactaagtacttaatctgaaatatgtaaagcttaatatcacaagagtactgtgctaccacttctacaacagtaagcatttgccatttctacttccccaagctatggtgattggcattcactgtaattcctaaaaatggtcagcctgtcctcgctttagccaacatggcaaaaccctgtctctactaaaaatacaaaaattatccaggtgtagtggcgggcacctgtaatcccagctactagggaggctgaggcaggagaattgcttgaatcagggaggtggaggttgcagtgaccaagatcacgccaatgcactccattctgggcttcacagcaagactccatctcaaaaaataaatatataaataaataataaaagtacttttagacaatctaattttagtagcaatcttctaagagttttttatttgattgattgattgattgatttcaatttcttcagagcaaccaactagaaaccagaccagaataaaggtgtttggatatacttgtgacatatctctcaatatctaataaatagatatagcaaacatacagtaaaaacattcttattttttccacaagatatttagaaggaaggtttttcttatgtgtatagagaagttatggttgagattgttacccctcactgatgtgtgtttcctcttcttcctggccatgtagcacaactgtattttctctaacaaactaaaaagagaagaaaattacctcataataaaggccagatgtgaaaatcccatagctaatatcatactcaatggtgagaaactgaaagacttttttctaagataaggaacacgatgcccactctcaccacttccattcaacataggactagaagtcctatccagaggaattggacaagaaaaggaaataaaagctatccaaatctgaaaaggagaagtaaaattggccctgtttgcagatgatgtcatcttacacataaaaaacagaagattccacaacaaactgttagaataaataagcaagtcaagtaacattgcaggatacaaaatcaacatacaaaatcaattgcatttttatacactaacaatgaactatctgaaaaggaaatgaagaaaaagaattgtgtctacattatccctcaaaataataaaatacttagaaataagctcaactaagaaggtaaaagacttgtacactgaaaactataaaatgttaatgaaagaaattaaagaagacactaataaatgaaaagtcatcttgtgttcatgaattgaaaaatggaatattgttaaaatgtacatactacccaaagcaatctatagattcaatgaaatctctatcaaattccaatgatattttttacagaaatagaaaaaaaaaaccctaaaattcatatggaaccacagatgaccccgaatagtcaaaaaaaatcttgagaaagaaaaacaaagctggaggcatcatacttcctgattcaaaatatattacaaagctacagtaattaaaacagcatggtactgtgaaaaagacagacatatagtccaaggaacagaatgaaaatcaatccatgcctgtatggtaaactgaccttcaacaagggtgccaggaatacaaaatagggaaaggatagtcttcaacgaatagcttttgaaaactgtatattcacatgcagaataatgaaactggactcttatcttaccccatatacataaatcaatacaaatggattaaaaacttaaatataagtcatgaaactataaaacagggaaaaaccttcatgacattagttttgtcaatgattgcgtgagtatgacaccaaaagcacaggaaacaaaagtaaaaccaggcaaatgggactagaggaaatatctgcaaatcatatatcagataaggggttagtttccaatatataaggaatttctacaacacaatagcaaaaaaacctaataatctgattttaaaactgggctaagtctggaatagacatttctccaaagaagacatacaaatggccaacaggtatatgaaaagatgctgttaccaaacatcaggggaatgaaaatcaaaaatacaatgagacatcacctgacacctggtaggaaaactatcaacacgtgttggtgaggatgtgaagaaatctgaacccttgtacactgttggtgggaatgcaaaatggtgcagttactgtggaaaacaatatggagatttctaaaaaaaaataaaaatagagctaccatatgatttagcaatctgactttttagtatttatctaaaagaactgaaatcaggatcttaaagagaaataagcactcccatattcattgcaacactatttacaataaccaagacatagaagcaacctaaatgttcatcaatgaatgcatgcataaaaagaagatgtggtatatatatataatggaatattattcagactgaaaaaagaaggaaatcctgcaatatgtgacaacatggatgaaacttgaagacattatgctatataccagccacagaaggacaaatactgcatgatttcacttacatcagatatctaaaatagtcaaactcattgaatcagaaagtagaatggtggatgccaagggctggtagtaggggtggggaatggggtgtttccagtcaatgggcataaagtctcaattacacaagatgaatacgtttttgagatctgctgtacaacattgctcctatattaatattgtactatatgcctaaaaatgtgttaagagtgtagatctcatgttaagtgttcttaccacaataaaataaatttttttaaaaaaccaagatcattgggtgtgatcattggcacacagaagcctactgcctactgagtttttgagagaaagaacttagctgtttgagatccctgacattaccctagtaggaagcaggatatgaaagatgtacaatccccaaggagagcaagctccttcacacccatttcagacatggccatagaggacaatgaataagaaatagatccccaaattaaggggccagttgccacggagaacaacaaacaagaggattcttcccagacagaaaagttctaatcaaacaattttcctactctccaggttaagaggccttcatctggcctctttatggacatggggatttcagaatttatactgacaagtaacttgtgccccccatgatttctaccattgtatgttggatgtgtatagggagactgtaggcagattcttagttccgagggctacaaggaaccacattcagacctgacagagaatatccttttattcagagatcctgaacttagagctgtatacggtgatcagatgggactttgactgtttctcttggagaagagtgaatgtcttctatatgcaggaagagtgaaacatatttggtgaccagaggtagagtatagccaagaatgctactgcttggcaatatgagctatagcttccggcctcctttaaaattaggagtggtcaattggctgcattctggtcaactgaatataaatgcaaaaggtaatgtgtgccaattttaagcctggcctataaaaatcttcccatgtgggattcttactctactctgtcaaccacaggctttgaggaccaaaagggagatagtaacactagatagaaaaaaaacactaggggcccgtgatgactgtgtggagcagaactagagccccaccctccaacacggacacatattaaaccataataagagcaagaaaaacagcttttcttaggttaaatcattgatatatcgggtttatctgtttagttatatatcttaacaaatacaaaatttaaaccacaacaaatcatgattatattgtttggtgctaataataaggaaaatgtaagatttaaggcccttaaagaaaggactccactgacatttagttttaaaaaataccttaaaaattcaacttgtgaaatatcaagtgatcaacagtttactccaataatgatgctttataagaattagtactaaacatatagttttaggaacttttaataaaattacccttaccattttgttggaatttagtgacatttaaaacagtactcccagatatattttagataaatcatttataatcttttaattgttttccccctactttaacaacagcagcaaagcaaaacaaagtcatattatgcaaatgattcatcttcccactttccaatgccttcccgtcacaactaagtgatgaatgaataatcttatagaaacaaaaagtcttagcattggaagagacttcgtccagtctttcattaatacaaaaattctagttacaaacccagtaacatatgacacatgatcatatagacggaatgtagaggcagcttgaatgcttccagcacagcactggaattcaatgaaatattgaatttccttttgaaattcaatatttgttgaaaacatatgttatgtgatatagtatattttgattttggacaggtatgtcataaaatgtatgtttaaagagctaatcttcctcatctgaatctttagagctttaaggaaatggctagtccttatttcatagacaccctttccaagcatgtgtagtcctaaagacattgtcactggcacgattctatatttgaggtcattaaaaaaaagatacaataagctgatcttcttatccatgttcttcaatgagagaagttttaaagggtatgcttccacagatgagcaactaaaagtttttttcgttttaaaatacaggtttaaaggaaatgattacagttgccaccatctccttgattattaattaaaggcttttcttcaattatcatattattccatatagtcaatggttatataagttttataagtaaaaaagataagcaaagcaaaatgttaacacctaccatgtaactaaaatacttgaggaacaatgaaaaaaaaaccttcaccccttatgctaaaaacagttaataagtgtttaatgtgacaagtgacttcaaaacttgcaattatcctgctaaagcatggcgtcactgatagagacaaagacggcagatatagtatagtggtaggtggtgtgggtccctgttcttatcttcaacacagtattcccttcaactctctggcagggtgtgggaaaagtccgaggtttccactggtaagtttaataaaagatgtagaaccaatctaagttatacacttcccaagggacacactctttttatgccttctgtcttttctgttaaacttgctacttttccaatgccattaacatcctattactttgttaaggaagacagggctcttgcatattacaagatttgtgctagctctcagagtgaataaattctcctgctagtatgattttcctttcctgaaatacactcacacattcaacaatatttactggatgtcaacatgtgttaggtgctgtggattcggcagtgcataaaacaacatctctactctcaaggagtctccctccattctagtggaggaagacaggcagtgagccaatatatgagcatacagtgtgctgtgtggtgatcagagcatggaacaacagagagttgggtaaaggcgtggtggtcagagggtttgctattttggatgaggtgtggagagaaagcctcacctataaggacacatttgaaaagggacttgaaacaatgaaggaggtttccaggcagagaaagcagcaagtgcagaggccctgaagaattctaacattgctggagctagtggcctagaaagtgaatgaaaggagatgaaatcagagctgagtggggcaacagatcatgtggggctctgtaggcccttagaaagggtttggggtttttcttcaagtaaattaaaataagagagcaaatgaataatcaggaaaaaatgttttaaggttgccttgtctgatgtcaagttatcgttctttgatcagggaatatacctataacagaaaaacagaatgtacttaaagggccaatcataaaagggcaagtacattgttttcttaagttactcaaagtaattactaagttttaagactagctggcctgaaatattttgacaaatttaacctaaaggttaatgatacatacaaaatgagtatggatttttacatttcttatctttatgtctacactatatcctttaaaatttagattttaagttatatacaatataatcaaatataaaatatttccagaatctattccgactcctgtcaatgtcaatgttatcttgtttatcttggtactgatacaataacaacaaatgaaatttggcaacattcagcactaaaatatatttaaggcaatgacacacttatggtgtatcgagcacataatgagatagccatcatttcaagctggtggtaaatgtctttcctgctgtggtaggcagaattctaaaatgtacccccaagatttcttatactgactgaatatgatgaaatttcattcatgtctatgattatgttacttatatggcaaaagggattttgctgatgtaattaaggttactaataagttgactttgagttcatcaaaagaaagatggtcacgcacctgtaatcccagcactttgggaggccaagatgggcagatcacctgaagtcaggagttcaagaccagcctggccaacagggcaaaactctgtatttactaaaaatacaaaaattaactgggcatggtggtgcatgcctgtagtcccagctactcaggaggctgaggtgggagaattgcatgaacctgggaggaagaggctgcagtgagccaagatcgtgccactgtactctacctgggggacagagcacacttcatcaaaaaaaaaaaaaaaaaaaaaaaaaaaaagatggtcagggtggacctaattttatcccattttctttaagagcagagagttttctctacttgatagcataaacaaaaatcagatttgaagaataagggggatttaacatgctactgctgtcttgaaaatgaagggggacacatgtaaagtaccttggactgtcccctagaaggtgaaagcaactcctggctggcagacagcaagaaaacagactaatagccacgagaaattgaattctgccaataccaggaatgtgcttggacaggtactctgagctccaggtgagagctcagcctagctgacaccttaattttggtcttgtaatacttaagcagagaacctaactataccatgcacagatttctcacctacctaaactgtgagctattaaatggttgttgttttaagcttgcggaaattagttacaaagcaatagaaaactaataacttaccttgaagactatatttatggtgtagttagaggaataaaaaagtagctgaaagtcttttattaggtgtaactaagttttctttcttataaatggtatcagtgtattggctagaggcctaagctgccataacaaagagatccaaaaaatatagtggcttggtcaggcatggtggctcatgcctgtaatcctaacactttgggaggccaaggcaagatgatctcttgagcttagaagttcacaaccagcctgggtgacacactgagatcctatctttatctgtctgtctgtctgtctgtctgtcaatctatctatctatctatctatctatctattggtttcaactagaaagtaattcatttcttttttgcaaaaccatacatggctgggtatcccaatgcaatagaacaattacatgcttttcaatttatgccttccgacctatagcccttgcaaggatggctgataaatgtcagccgaagctgagcaaccttgtggccatctaaaacatgagagctctatgatggaagaaggggcaaatggatatttttggacaactggcagtctctaacaatccagcagtgctcaggacattttgtactgcattatgaatattgaattgctcaaattgttatgactttattccatggaagtgagtcaaatatctgcttcatcagcactcccccagattagtcctaaatctatttttagactctagatctagagcaaaaatgagtaattcctcttctatgaagcaatcttctaaatatttgaatcagatgtcagtatcctccataagtttccagacttattactctcccatctgtctcccattcttctctattaaccatccctcactaccttaaatgctctggactaatttttgcttgttaagacatttttaaaaatatagccattatcaagaacacactcctcagtgaaaggctcttggctaggaatttgagttggcaaagaaaacaaaggagtatttaaggtaaagaactgaatcagcttctgtttgcaggaacaaatgaacatggtatacgtttaggaaatctatgaaaaccacactggctgaagcggaaaatttgatttagggattaatgagagataaaactattcaatagcgcatatgaactcagttaacagagagtcttgaacgccagactgatgaaatttgatgttataataataacataaaaaggaggaatgtaggtggtgagttgaaatctacaatttaaactacaaataccttcttttaagcatggatgacaaaaaagtaaaacaatggacacatgaccttagaaaataatcatcttttaaagctgatagatggcttttcttctctcataaggttatagccttaagtacaaatacattgtcatgatatgcaaaacttcaagtatgaatacactttatatttaatataaaggtaaatcacctaagaacacattcgataagtattcaacaaaataatatgaatattaagtataaaatatttgacattttctttactcaaaaagagagcacttgctaataaactttatagaagatgattaaatcacacatcaatgtccttttacatccaatttaatatgagttctgatgtaaataaaatatccaaggcattttaagtactatacaaaaatgtatgcaaatgtgtgataaaactaattaaaatatctcagtggtagcattattccctacttataaatctccaagtccttccagcatcagggagcaagtactcgagaaaagattttgaccatggtgattttacaaaagccatcatcttcagaaatggtgagaacctgtgataacaggcaccagaaaacttcatgagtgataaatgcccccaagtactttctttggagacaggccagtaagataatttaattgttaatatgttacattaaaatcactcagtgttgttaataattgaatacaaatgctaccttaattgggacaaatgatttgaagccccagtcattcgttatttaaattttcattttgcttgaaataagatctattttttattttctcttctgtttaaatttttacacctacaatgtctatatggaagtgcagtatagcgatcaaaggccttgtcgaaagaactggtaacaacactgccaccattaaattatcacagatctatgaatactgccagttctgaagatcttcacttaaaaaacagattccaaacccaagtcctactctctaatttttcaacaatttgtgattatgacaaagttacttcataactcttaaaatatgtgaagtgggcctggcttttatacaccaggccttttggctagagtaaaattttaaaagtctgaaaagtaaaaatgcaacagaaatgcaggagattcaaaacatatagagactaagtgaaaaacatagttgctgccattctgcagagctcacagtgtgtgtctattacactgtttaattattaaacagccatggaaggaatggataaagatggtataaatggcttgtctgtataatctgacatcgagttgattgttttggttcacttatggttggtagaaaagttttatttcttttaaagtgagcttttcttacttttaaaattatgtaagtgggaatgcatgcctgttttctccattatagttgtttgtgattgacatatggacatagatgtaataaagtagaaaaatatgaaaatactaaagctctaagggagggcaatcatccatttgtccaaaaaatgctttgctactaaaagcatttgaaaagcattgtttcccaagttattcctaattgtattgtgaaggtctgtcaacctctaataaaaatcatgaaaatggctgcaaaagtaaataaataaataaatgcaggaggtaactatcattgttattacgtgtttctttttttcctcatacaactggaaggatattctgatctttatttcttaaatctttggctaattatttctctcctgtcttctgtatgtcaaagcaatgtatacccactggtttgtgtaatcctggacctctgctaaatttcagtcctcttttcataatctgttttactaagaatgtactacaaggactttgattcccaaacaaccagtagttcaaacttcaaaacaccctatccctgtgcttaggtccatttgtttttgtgttttttgctttgagacagagtctcactctgtcacccaggctggagtgcagtggcacaatcttggctcaccacaacctctgcctcctgagttcaagtgattctactgcctcagccacccgagtagctgggacgacaggcatgtgccaccatgcctggctaatttttgtattttttagtagagattggatttcctcatgttggccaggctggtcttgaactcctgatctcaagtgatccaaccgcctcggcctcccaaagtgctgggattacaggtgtgagccaccgcgtcgggcctaggtccatttgtgtttgttatttttattaaaatggttaacatgtccagtcctcccttggtatcctcaagggactggtttcaggatccacatgcacatgcttggatgctcaagcccctaatataaaatggtgtagtatttgcatacaacctacatgcatcctctgtatacttcaaatcatctctagattacttacaatgccaaatacaatgtaaaggctatgtgaatatttgttacattgtgttttttatttgcatttttttattgtattgttatttacctttttttcaaatattttcaacccccagttggttgaatcctcggctatagaattgcagatgggaaaggctaactgtgttgcatgcttactataggctaggcattgttcttaccactttgcatgtcttaactcagtaagtcttcataataattttatactatatttgatagctataataattaacatgattgccacctatattattataagcatggggctttgcagggtactgtggtacagagctccaggtgtgcagggtgcttcctagaatcaccaatgtgctggatgtcacagagactagatgctaagcaaatgctcgtggaattgattatctaacatttttactttttatgcctttctgtgttccttcttacattccagatgttctgcagagttttcatgacctctgttgaatatcaactctgggaaagtcaatatttacggagttttaaaagggagtacaaatcaaaagtaaaagacagcttcagttggcacaagaaaaaatacttcatgggtaaaagagtacaaaagaggaccattaaggatggagtaatgtaggcttcaccttgaggcttcctcaagatagtcaccagcaccactggcatgacctgaacacacaatgtaatgtatgtacatagaaaataatatcttcacttcatcacttttttagggggcagtgtgggcagtgtactacttttaataagtaaaatgcatgatttgatgaaaacttgataagtgaatcctctaaataaattatcatttggagagctttttaatgttcagtgtggttttacacaaagagtttgtgcgcttattctgtttgccttggactttcacatgtaattacatctcatcatcaaagtgtatgaaaattagaaagctgaaataaacttattttttctctgtgaccatcatataaatggatcctcttgccacagtcactccatgcattacgaataggttctatggaagcagaatgatcacattcaaatttcagcaatgatgtcttccaaggctagtgatatgtctttatttctatatttctatttacttactttaacattgtttcactataaattgattaaagcagtcttttccaagctaaagcatatttactcttcatgaatactatactaaaagcacttagggtttatattaatatttattctttaggaagagagatgtctttaaagaatacctttacgttaacagatatttaggcttttttttttctgagctgatttacaaagcttcacagaatagcagtgtattttttctgagtcatttcaatcttccctaatatctccatttccatttagaaatgtgacagttgatcctattgtattcaaagactgctacctcaggaattaatgaatatatttttcaaatgctaatgtttcagtgaaatgaaagtgttcttcagcattctgttcattggatgctataaaaatgatttttggaagtaggttttcgaaaacaacttggcatttaataattccctgtgtgtgtttttttttttttttttttggtacttcaccttctagccttattaagggaagctatttaagatttggttaggtccagtggctcaaagagtgtctcctaacattgtattagtctgttctcatgacgctataaaagacatacccgagactggggaatttataaagaaatgagttttaattgactcgactcacagttccacatggctggggaggtctcagataacttacaattatggcagaaggcacctcttcacagggtggcaggagagagagaatgagagtccagcagagggggaagccccttctaaaactatcagatcttgcgagaactaactcatatcatgagaactggatgggggaaaccacccccatgattcaactatctccacctgctccctcccatgacaagtggggattatgggaactataattcaagatgaggtttgggtggggacatagccaaaccatatcaaagagtattttcatttttttaaaaaaacaaaattatttttaatttgtagagatgggatgttgctgtgttgcccaggctggtctctaacttctggcctcaagcaatcctcccacctcagcttcccaaagtgcttggattacaggtgtgagccatcgtgcctttcttctgagagtattttctagaggaattgtaatagcgggacaatctggaagaaaagacaaagaaggtcccttttgtctttaacttagaccctacattagttgctattgtgatataacagattaccacaaatgtagtggcttaaacaacattcatttattgtctcacagtttctgtaggtcaggcttggcttaaatgctcagtctcacaggaagagacaaaataagaaatgtatatttggtctttgctcctagttcctggcacagagcttttaaaatccttgtaatttcttgagcgatagaagcatcttttgttacaatatttagttttagtccccagtctgacacaaaagcttctaagacctttggaatctctggagtggtaagtgtctctttttgtgtgtgaatgagatgactggtggctggggtctctagatggcttcaggatgaggctggttgctagaggaaccaaacaggtgattagagggttagaactttcaaccccatcccttgacctctggggaagggtgaggggatccagattgagatcaatcaccaatggccagtggcttaatcaaccatgcctacataatgaaacctccatagagaccctaaacaacagagtttggagagcttctgggttggtgaacacactgatgtgctggaaggtgtcacagccagagagggcatggatgctccatgtcccttcctacatactttgttctgtgctcacttctatttggctgtttctgagttgtatcctttataataaaccagtaacagcatgtaaactgtttttctgagttctgtgaacctttctagtgaattactgaacccaaaaaggggacggtacaatctcctgatttgtagctggttggtcaaaagtatgggtggcctagacttgggattggcatctgaagcgggggcaatcatgtggagctgagccctccaccatgggctgtgttaacactgggtaattagcgttgaaattgaatttaatcactggacacacagatggtgttcacagagaattggagaatcacttggtgtggaaatcccacacatttggtgtcagaagtgctgtaagtatagaaaaagagttttccatttagctgcaatcaagccatcagctagactgagttctcatctggaccctgggatcttggcccaggctcattcaggttatggcagaattcagttctttacggttgtagaactgaggcctttagctgccagagatcattcttctccattggcaattcacagcctggatgtttgcctcttcaaggccagcaagagggtcacgctagctcaaggagggctccagtcccttttaaagaactcacttgattaagaccaccaaagatcatctcccttttgattaactcaaaattgattaagaacatttattacatttgcaaaattagcacaatcacaagagtgatattccattatatcacagattctatccactctgaaggggagggaattatacaaagacatggatcattagaggtcattttagaattcttattccacaagtcttaaatccagccttatttagctgaattattacatccaattttccagacctcaaaacaggttctccagtcagaggttcaaggcacagataaatcacagaaattctgaggccctcctggttatgaccagccctctttccacagagaattcccatatcacttttcctactagatttcttacagttgtgctggacttactaaaagaggtgtgcaatgctttctcttcacaagcccctgccattcacctaaaagcacaatatctaattgtagatcagaagcataggagaaaaattgcctcacaattttaaatctataaatcatcagtgtttgtaccattgagcaatggtaaatctacaatgcttttgtctttcccaatgacattttaaagataattccttattttcttgtgaaaagttaaaatataatcttgttcaattttctgcattactgatactgtgccttaatgtatttcaggagcaatgatgttctatttgagatgtgctatcttgtcaccgtattgattttttggtgcatgtgatggagtaaaaaggaatatctattgacttctgctaagacattgttcataacattaaatatttttgctttccaacattattgaatcagagcagtgaaactgaaatcagtaaaaattaatttccaataattttaaatactctgaaatactaactgttttctctagctttttcttgccctcttgaaaaccgataatgatttctgtttggaattttatttcagtgatctcagagtacaattctgaaatgattaacagaagattagtgtgacatttaagaagaaaacagcagcttcatgctttaaagagtttacgcctgtaatcccagcactttgggaggctgaggcgggtggatcacctgatgtcaggagtttgagaccagcctggccatcatggtgaaacctcgtctctactaaaaatacaaaaaaaattagccaggcatggtggcgggcgcctgtaatcccagctactagggaagctgaggcaggagaatcgcttgaacccaggaggtggaagttgcagtgagccgagatcacaccattgcactccagcctgggaaacaagagtgaaactccatctcaaaaaaaaataaaaataaataaataaacaaacaaatacatgaatgaatgtatgggaaatatcctcaacatcagaaaaacagttgctttttaaaactctcaacaaaatcctactatttttcccatgtgaggcagatgggctgttgtgttggagtgatacaaaggcatacaatgagtaggctgttaacagcagtcacttggtaggacaaaaactgtggtgcatcactgtagcatacagccagaggaattcttaaaagacaaaactacaatgccgcgtgccagagcccattggaatatataatactcactaaaaataatggaaaagaaaacaaatccttgcagttctcatttgggaatattcactaacttcaccaataacgttttagttaatatgatgctaagtataataatgttgaggatgatgatgatgatgatgatgatgatgaaaacagattatcagaggacttactttatgcctttttctaaaaccttatgtgtagaatcccatctactctttagaacaagtgtaggaggcagatgcttttgttatccccattttgaagcttattcagtgacttagttctggtctgacaccagacctgtgctgtagcaaatgctgtgggtagccagccatatcctgtctgcactctcagttctcctacacagtatctccaattccaatctcaagctcctacgactttatgcagccacaggagtgcgtttggcccatgcataggccaggccacaggtacaatgtctttgggagtagggcttaacagatggcaaatgggaattgctaaataaatacccatctttttggttcctcagtgggacttgctgagaactctacacttgtcccagaggtcccagaggccctcttaattcaccctgtgttggcccccatcccttccccatctcaaccttccttttatctgccttagcactgctttccggaattgtctctcaaagaaagacaaattcctgtctcagagtatgcttctgaagaactcaacttaaaaacatggtcttttcttctatgacagactgctaataaaatatcatttaaaagaaattaactgaagtttgagaatttttaaacttgattatgcttttgggaaaagccatttattttagttattcttataacttacactcacagaatttctttaataaagaacaaagctttgttcattctttttcaattcaactaggatttattttcagataactttttttcaatacgtagtaagttcccaaaacactagaagttttagaaaaagttaaacatacaatgtttgtagtcattgcctttgagtacattttgacataaaactagaatcctttaaaatactaaacaactcagcagtctacactttaaaaatgtttagagggataaattgatcattcttcaactatgaagaaaatttcacttcaggtcataattacggagcatctacacgtattcacagtggacaaaatctatgcaatacagaagtgtaaaacaacacctggaacataataaatgatgaactcatgctgtaaagataatgtctctttttttcccaggactattttctcttcatagagccatgactttacatttcaaagggttgcaaagacctaggaaccttcccttattttcccaagagatgatttgtttatattagaaaaactaaatctttttctctctctcaagatgggatgaggggctgctgtgcaacagcttttacagaaactctaaatggcatagttttggggctcctctccagcaatccaacccactgtaaatgcagctgccatctgttctcattgcatccctccacagggggagagtacagatggggaactgaaccgtaaataatgtctggcctctgatctagaaactttgtgtttgcttttaggatgaaataaagaaatgtaggcattaaaaacttatcaataaaatgttcttgggagtgaatctttaaattggcctgcaaagggccttttcacttgcaaacaagattgcaatagatttcagacacatgctcaataactaaattgactaaacggttttttccccacaattctgggaagacccattgaaattctctgcttcataggaactaccaaagtcaagcagatgtcaacctttcgattaaggaacaacacaagaacacgcaagattctgtcctcctaagagcagctatgaccaacaaactaccagacttttcaaagacatggcaatttgagctcaggttcagagctccctatgtcaaagtctatgaccatttgaactggctcttattctgtggtttatggtatcttgtcatctaaccgtaggccttagagaaatgaaattggcctgaaggcctgagtgaggctggagggacaatttagtatacaaaggacatcaggagctccaggaagaagagccagagagtttcacgggtatctagagagtgtcttaaatctgaggaattctgtggtctgtgttttgtatttgaggaattccatatagctgtgttactagagtgtgatcaaaactcttaggaaaatagcctacggtgagtaaataatcctttactgagatcttttggctacatttgtagtttgtcctaggaagcttttttaacatacagtttgtggtcatagtttcatttatttacctatgtgttaaaattgtatatagtaattggtgtggcagttttctgtttgtctgcctgtgactgcaagtgattatctgtagtgtgtgtatgttgaggggtgtgatggttaatactgagtgtcgacttgatttgattgaaggatgaaaagtattgttcctgggtgtgtctgtgagggtgttgccaaaggagattaacatttgagtcagtggactgcaaaaggcagacccgccctccatctgggtgggcacaatctaatcagctgccagcagggctagaataaaagcaggcagaagaatgtggaaggactggtctgggtaagtcttctggcctacatctttctcccatgctggatgcttcctgaccttgaacatcagactccaagttcttcagcttttagactcttggatctacaccagtgttttgccaggggcccttgggcctttggccacagactgaagactgcactatcggcttcctacttttgaggttttgggactaggactggcttccttgctcctcagcttgcagacggcctattgtgggacttcaccttgtgattgtgtgagtcaattctcctacgaaactccccttcatatatacatctatcctattagttctgtccctctagagaacgctgactaagacggggggcagtgagattctttagatatcttttacatccgtggttctcaaacttcaacatgcatcagaatcacatagaaggtttcttaaaacacagattcgtgggtctcatttccagagtttatgattcagtaggtctgggatggggcccaagaattcacaagtgtgggtaccaaactttgagaatcacttctctatatctacaactaccccttttcttagtgcttttctaaaaattaagggtgactatgcatgttataagaacatcgtgttaaatgagtaagtccactttaaaaataaaaggagaggaaagaatctgattgctaatttcaccaagaacttgaaaagaaagtgagactctccttgcagagtgaattgaagacatagctgtaattctaaaaagacagaacaaacaattgagcaagatgactttcttttctggggaaagagttatccctaaacaatgttaagatagaacttttctttttgacaaattacctttgctttcctcccaagggaaatcagcaaaattgtatagtctctcaaatggaatagagctcatattttgattggtttttgagattaatagatgcataaaaatttagaataaggacttgcaaaagctccccacccccacacaaatggaagtaaaaaatgctcaaaagggaatgatagagttctagttaataggtgtctcagttactaagataaggtgaagaacaaaagatatgctaacagcctgcccttaagaaacctttttgtctcaagactttaaatcaagacttaaaggtgttaatattacttggcaaataaatgttaaataattataaaattattctttttggttcacttaattaagtattcaatatttctgatcacagaaaacagttgagcaacttaaattgttttgttaaattggcttaaaagacagttaaatgttttctctgcctatatcactgagtgggatataatatttaaagcaaacatttacttcatgtaaatcaaatttattttctgaaaggaggcctaattaactgaaaaaatttgtatacatgtcttatagaacatgtacgtgattacactgaaagttatcctcattacactaaaaattaaagaccgtgtggatgtaaacttgaatgtaagtaaatcgaattagaataagtcatgcctttgttttgaaaaatgtggttgttgtcaacttcaggcaatgctgcatgctatttcattaggattccttgagtaaaattttaggatactatagccatttcccattatccatgggggattggctctaggatgccccgtggataccaaaatacatggatgcccaagtccctgatagaaaatggtgttgtatttgcatatatcctacacgcatcctcttagactttgaatcctctctggattacttataatatccaatacaatgtaaatgctaagtaaatcattgttatactgtattgtttatggtataatggcaagaaaaattgtacatgttcagtagagatgcaaccaaccatattttattctgaatattttcagtccaaggttggttgaatccatggacatgggagggccgactgcatgtttctctgatgagttttgatattaacagtagttgtattgctttgtcatgccaatataaattacaattccatgatccataattcacttgagacatggatattttatgaccatggtcaattatttaaaaaaataagcaaacagaaagaataatacaggtttgatatgttgagacaaactaaaattgctaaactatttattgttttaccttgtcaacattgtatccctggctaacagaggagatggactatctatggctaagataagactctcaagagaaaatgagctaaggtactcgatcaccacagagcagtttattttttatgccaattttaggtttgtagcaaaattgaatgggaagtacagaaagttccatgtacttcctgcccccacacttgcatagcctccctagtgttaatatcccaaaaactcgtgcttcaacatgctgagagacctttaaagctgcctcagaatcaaaatccctctaaccttgtcttatttcccctgacaagtgtaggaaagagctctttctggaattctttatcttactgacaaaaatttcttccaaaagaaatgcaatttttcttaaacccctttcctaggaacatcagataaccatgaaagcttaaccatggaaaaagagaagagactgggagtcatcaccatggctagactgacttttcatttattcttctgagaacagctcagggagattactcaaacatctggcctctctttgagttcatattctgtacaactcacgtgtacacacgtgcatgtagtaaatgtgttatgctttccccttgtccacctgtttttattgttttgggcatgtcagtcatgactctttataatggggaagggagggattaccctctttctgcccctgtactacctatcaacatccctcatcaaatggtacatttgttatcatcaatggacctacgctgatacatcattatcaaccaaagtacacagttcacagtagaggtaactgagcagtttttatttatgtattttttcaatacataaatgtgtttaccagataaacacattcaaattacaagggtaaaatcaatgcagtaaaaactgtgtctcatgcttcttaaaattaattacatttaatctaaaatttatcatttatcattatttcatatacatgtatgtatatttaaaatacacacatactgagataacttaaaattattttttaaagaagcttatgtattataaatgactggtagttcagtagaaaatggtcactgagtatggagtttgttctcaatgcaaggcagtaaaaattttatttgctttttgcatagatgagaaaggttttgtcttatgcaaactgaaaatatattcttaaaagggtgtatttttatgctttgttttggtattttatgttgactttggatattttatgaccatggtcaattatttaaaaaaataagcaaacaggaagaataatacaggtttgatatgttgagacaaactaaaattgctaaactatttattgttttaccttgtcaacattgtatccctggctaacagaggagatggactatctatggctaagataagactctcaagagaaaatcgagtagccacagcagagaaaaggatttggtcatggactcctgcattgttaactactataaggtctgttaagtgccataaggttttcttcctgcagttaggcagaaacccattctaggaaacacagaccaactgattctggtagaccgcctgacaatatccctttttatatgctcttcacactttattctgagccagagcaaacagtccagtggctcttccccaaagtgtgaagacattgggggtcttgccaacagcactgactgggcaggagactggccttacaaacattctttgctgataagcagctagagactctaagctggttctagtcagattgcagagactgtgcacaaaatctctttgtgccctatagtttactttttgacgtacagggccaaattccactgcattttaatgttaaaacccctccccaaagtgatcatggaatgtaagttacatacatgttaactcactgagtgagtgcttgactttctccataaatattcgtagacattgcccaaacctgatgaatacgcacataagatgggaaggcttaaatgccactgtttccttcccttcggcagaggcagagcgtttgctttccgtttccctggaagccacatttctctcatctgcaggttgttagttggaaagttaaagttttgtccctcttccttcctccagggatctcacagtcatttgttaaccacctccgttatagttgccataaagtattgttactttggttaatacatactttgtatactttatattatccaatttcagacaataggtaactaaatccctaagaatatttcttcctataggcaaaatacataaaaatccaggaacacataaaatttcctttatgcttatttcatgaaggaacatatccttgaggaagtcttaatatggaaaaccatgaatgcaagctaattaacgtcaggtaaatttaaggacaatgtctctaataaatgcaactgagagatgcacttttaaaatgggttaagcataaaactgtcctttgttaatagatgctaaattaaattacacttagtttaaatcaaattcttctataatcaaatcttattaaaaaaataacgttggcaaagtctatgcacatgatgaagaaaatgggatgtgtattgattgcccttgtctattaactgctgagaacagtgtcagatattatagacagaacttttgtgggtccttttatttttcatggcaatacagttatttgcaaaggctcaattaaaattgatcctcttttccacttcagcataattaaacaaagaaaatttgtcatcataataatggaagaaataacacttttaaaagtaatattacttaggtgtgatatgactctatttcatagtggaaacatcattctcagaatctctttaagaaattggagcagtacctggtctatggcttaaggagtcccagacttacatttggtaaagtatcacctcctggtaaatttggggaatcttgaagaaaggaatccccccacacacatagtgttatagataaacactggagaagagccactggaccctttgctctgattcagaataaagtgtgaagaccatatacaaagctttctgggacagtgaagcagtcttggactcatttacaaagtctccagatagaaattaactctcaggatttagtacaatcatgcaccacataatgacattttggtcaccgatggactgcatatatgatggtggtcccacaagattatcatggacctgaaaaattcttatcacttagtgatgttgcagtatcctaatgtcatagtgcaatgcattacacacatatttgtggcaaactgatgtaaagctacggtgctgccagttacataaaagactagcacatacagttatgtacaaaacataatacttgaaaatgataacaactaggttactggtttttgtatttatgatactatactatttattgttattttagagtgtattccttctatttattaaaaaaaaagttaactgcaaaacagtctcaggcaggtccttcaggaggtattccaaaagaaggcattattatcataggagatgacagctccatacatgttactgcttctgaaaactttccaatgggacaagatgtggaggtcaaagacactgctattgatgattctgatcctgtaggccttggctaatgtgtgtgtttgtgtctttgcttttaacaaaaaagtctaaaatgttaaaaatatttaaaaaagaaaaaagttgatggaataaggatataaaggtaaaatatttttctatagctgtataatatgtttgtgttttcagctgttatgacaagactcaaaaaattctaaaaattaaatattttataagttaaaaaagattacaatgagcaaagatttattattaaagacagaaaaaaatgtttaaaataaatttagtgtagcctaagtgtacagtgtgtatcacctacagtaaagtcctaggtctccacatctactcactgactcacccagagcaacttgcaatcctacaagcaccattcatggtaaatgccctatacaggttgatattgtttggctttttgtgtccactgaaatctcactttcaactgtaatcccataatccccacaaatcatggaagggtgggagataactgaatcatgtcggcagtttcctccatgctgttctcacgatagtgagtgagttctcaccacacctgatggttttatatgcatctggcatttctcctgctggcactcattttctctcctgccaccctgcaaagaggcaccttgtgccatgattgtacgtttcctgaagcctccccagccatgtggaactgtgagtcaattaaacctcttttctttataaattacccagtgtcgggtatttcttcatagcagcatgaaaacagactaatacagtaaattggtaccaggaggagtggggcgctgctgtaaagataccaaaaaatgtggaagtgactttggaactcggtaatcagcagaggctggaacagtttggagggctccgaagaagacaggaaaatgtggggaagtttagaaccgcctgaagacttggagggctcagaagacaggaagatgaggaaacctttggaacttcctagagacttgctgaatggctttgaccaaaatgctgatagtaatatggacaatgatgtcgaggctgaggtggtctcagatggaaatgaggagctttctgggaaccagcataaaggtgactcttgctatgctttagcaaagagactggcagcattttgcccctgcccttgagatctgtggaattttgaacttgagagagatgatttagggtatctggcagaagaaatttctaagcggcaaactgttcaagagaaagcagagcataaaagtttggaaaatttgcagcctgatgatgccatagaaaagaaaaaatcatttttggggggagaaattcaagcctcctgcagaaatctgcagaagtaacgaggagccaaatgttaatcacgaagacaatggggaaatgtcgacagggcatgtcaaaaaccttcatgacagcccctcccaccacaggctcagaggcctaggaggcaaaaattatttcatgggctggacccagggctcccctgctctatgcagccttgggacatggtaccctgtgtcccagctgcttcagtaccagctgtggctacaaggggccaaggtacagcttgggccattgcttcagaaggtgcaagtcccaagcttccatttatggtgttgagcctgtgggtgcacagaagtcaagaattgacgtttgagaacctccacctagatttcagaggatgtatggaaatacctgaatgtccaggcagaagtttgctgcaggggtagagtcttcctggagaacctctgctagggcagtgtggaagggaaatgcggggttggagcctcgacacagagtcctcactggggcactgcctagtggagctatgagaagagggtcaccgtcctccagatcccagaatggtagatccacccacagcttgcactgtatgcctggaaaagccacagacactcgatgccagcctgtgaaagcaaccaggatggggctagtatcctgaaaagccacagggccagagctgcccaaggctgtgggagcccacctcttgcatcagtgtgactcagatgtgagacatggagtcaaaggagatcatttgggaacattaagatttaacgactgccctattggattttggacttgtatggggcctgtagccaattcgttttggccaatttctcccatttggaacgggagtatttcacccaatgcctgtaaccccattgtatctaagaattaactaacttgcttttgattttacaggctcataggcagaagggacttgccttgtctcagataagactttggacttggacttttgggttaatgctggaatgagttaagactttgggagactgttggaagggaatgattatattttgaaatgtgaggacatgagatttgggagggaccaagggtggaataatatggtttggctttgtgtccccacccaaatctcatcttgaaatgtaatcccataatccccacatgtcatgggagggaactggtggaagttaattgaatcatgggggcagcttcccccatgctgttcttgtgatagtgagttcttatgacatctgatggttttataagcatctgacatttcccctgctggcattcattttctcgcctgccatcctgtgaagaggtaccttctgccataattgtaagtttcctgaggcctccccagccatgcagaactgtgagttaattaaacctcttttctttataaattacccagtcttgggtatttcttatagcaacatgagaatggactatacacagatgtaccattttttatcttttatatcatatttctactgtaccttttctatgttgtaacaggtttagatatacaaatacttgcaattgtgttacaattgcctacagtattaactgcagtcacatgctgtacaggatagtagcctaagagcaatgggctatagcatatagctttggtggtaggctatatcatttcagtttgtgtaagtacaccctgtgatgttcacgcaacaataaaatcacctattaacatatttctcataatgtatccctgtcattaagcaatgcatgaccaaaacttatgtctctagttttatgaacatgcaacaaggaagtctttgggtgtcaatgagtgatattgttttgcatctatgtaaataaaacagtaaaagaagaagagaatacagtaggtcctcactcaacatcatgtgaagacatgcttgcttcccctttaccttctgccatgactgtgagtttcctgaagcttccccagaagcagaagcatgtataggctgcagaccacgagctgattaaacctcttttatttataaattacccagtctcaggtatgtctttatagcagtgtgacagtggactaatccagaaaattggtaccagagaagtggggcattgctataacaatacctgaaaatgtggcagcagctatggaactgggcaatgggcacaggttggaacagttttgagggctcagaagaagacaggaacatgaggaaaagtttggaacctcctagagacatgtaaaattgtgaccaaatgctgatagtgacaagaacagtgaagtccaggctgaggaggtctcagatgaaggtgagaaactcatttggaactagagtaaaggtcactcttgctgtgctttaccaaagagactggtggcattgcgtttctgctctatatatctgtggaattctgaacttgagagagataatttagggtatctggctgaagaaatttttaagtagcaagcattcaagatgtggcctggctgcttctaagagtgtacactcatatgcatgtgcaaagagattatctgaaactgaaacttatatttaaaagggaagcagggcatacaagtttggaaaatttgcagcctagccatgtggtaggaaagaaaaatccattttctggggaagaattcaagcccgctgtagaaatttgcataagaggagctgaatgttaattgctgacaatggaagaaaatacctccaaggcatttcagacgtctttgtggcagcccctcccatcacaggccaggaggcctaggagagaaaaatggtttagggggccagacccagggccctgcttctctgtgccacctcaggacatggcaccctgcgtcctagctgctccagctccagctatgctaaaaggccccagatatgtctcaggctgctgctacagagagttcaagccaaaaaccttggcagctttcatgtgatgttaaacctctaggtgcacagagggcaacagttgaggcttgggagcctctgcctagatttcagagaatgtatggaaacacctggatgtccaggcagaagcccactgcaaaagcagagtccccatggagaacctctactagggtagggcagagagaaaatatgaggttggagcccccacacagagtccccattggggcactgcctaatggagctgtgaggagagggcaaccagactccagaaaggtagacctatcaacagcttgcaacatgttcctggaaaagccgcaggcactcaacaccaactggtgaaaaccactgcggggtctgtaccctgaagagccacaggggcagagctgcccaaggtcttgggagcccatcccttgcatcagtcttccctggatgtgagacatggtgtcaaaggagatcattttggagctttaagatttaatgactgccctgctgggtttcagaatttcttgggtcctgtagctcttttatttggccaatttttccctttttttaatgggagcatttacccaatgtctgtaaactcattgtatcttggaagtaactaacttgttttttattttacaggctcataggcagaagggacttgccttgtttcagatgagactttggacttggacttttgagttaatgctgtaatgagttaagactttggggtactgttgggaagacatgattgtgttttaaaatgtgagaaggacatgagatttgggaggggccagggggtggaatattatggtttggctctgtgtccccaccccaatctcatgtcaaattgtaattcccagtgttgaaggagggagctggtgggtggcgactgaatcatgggggcagactttccctttgctgttctcatgatagagttctcaagagatctagttgtttgaaagggtgtggcactttccccacttctcttgctctcttgctggacagatgaatatgtgcctgcttccccttcaccttctaccatgactgtaaatttcctgaggcctcctcagaaagagaaccctgtatagcctgcagaaccatgagccaatggaacctcttttctttctttatttttttttttttttaccaagtctcaggtagttctttatagcagtgtgggaacatattaatataacatacatttaaggaagattaataaaacaagtaagataattatttgcccaattattccagttcaggaggctggagcccatccctgcagctcagggcacaaggcaggaaccagccctgggcaagacactatctcattgcaggttgtgctcacacacccccactctcacaaagactgagacaagtttcatttaacatgcacatctttgggatgtgggaggaaaccatagcacccagagagaaaacctagggagacatggggagaatgtgcaaactccacacagacagtggcctggctgggaatagattattctttttctcatcaatgtagtaacaaaacaaatttgaacaaaatgatgttatttgaggacccgctatatatgtattattcagaagcttttatatatgtatatacacacacatacacacatacacataaacacatatacatatatatgtatgtgtatatatatgtatatatatgtatgtatatgtatatatatgtgtgtatgtgtatgggtgtatttgtatatatatatatgtatattagaagcttaagatcatagactatatgaaataactatcattaaaactaagttactgtgaattaatttttaaaaaatttcccaatggcaaaacactgtttaaagaaataacattagaatgcatggaaataattgtgtctgtactgggtaaaacaaggctatacctgattcccaccaactgtaggaaatgcaaaaagtgattgactagcaacatgttcaattcatgattttagcacaaaaacacaacatgacaggccttttcttgatcaagatagctcattaaaggctgcataaatcaaaggaagggactgccaacaaaactttctgaaacctgctcagagacaaaactttctctgatgatacaagttgcattttcctcctgggaaaaaaggatcaaccataatgcttaatcttctgatgaactttaatgaaatttattctaggaagcatcagtatattccacgtctctgaaactggagcccttttgagagtaaaatggggtactattaacaattatgtcagtcaacaggtaaaaaaacacaactgcttccagaaaaactgggatatatggctgtattagtctgttctcatgctgctaataaagacacacccaagactaggtaatttataaaggaaagaagtgtaattgactcatagttccgcatggctggaaacttacaatcatggtggaaggggaagcaaacacctccttcttcacatggtggcaggaagaggagaatgagaaaaaggggggaaaagccccttatataaccatcagatcttatgagcactcactatcatgagaacagcatgagggtaatcgcccccacaattcaattacctcccactgggtccctcccgcgacacaggattatgggaactacaattcaagatgagatttgggtggggacacagtcaaatgatatcactgtccatcctatcctaaagaaaattcccaaggattgaaaacgaagaggaacctgaatagcaaaccgtgagcacatgtggtaaggtggcagctgctcgtatgaccaattttgttaggatcagagaatatatatgcaaatgccaaccatcatacctgatgcataatacatactagaaatattactatgccttcctcaatcagagaataactctctctgagctttcataaattacattctaaggataaaattgctgacaggccctctaacttggaaaagactttgtttacacttaaaacacagaatatgtttcagttttatcaaattgaattgcttttttaaaaatgtcctacaatttatttttctcagatctggctgccttatatctggtagaagttctcaattagtgagacttcagtacactgtgaaaaaagtgaaacttcactgggggtaaacttctaaaacctttcccattccccaggcttttacattcttattccaccttgaaaatattgttctcacaacacttgcaaacttttctttagcaataacacatcagactcacagagtagacttgaagagtttcagagtggagtgaatgagattctctaaatctactcaacacaggatttttttaacgctattataaatagaatcacaataaacaggttcattttgttacccagtgtaatgcctacatgacgtagcctgaatttctaccctgcctaaactttgcttatctttaagaaacagaacgcctgtgataaaaagtttcctttgtaactaggcaagctgagactagttagaaccaaggtagccattgaacaacttcaaaaagacctcaagcttcattataacctcatttccatgctaaataatgctcccatcagcacaatgacaattaccatgacaatgaccagaagaagccataaaatgacaaaaaaagaaggccgcccatttctggaagacatgcctattcttccccttgcttttaatgtccaaccccttcattggagaaaccctatatcttaaccccctcaccccttaccaattgagaaatcaatttgtgggctatgctctcacttctcaatttcatggtcattgaataaagaatgcactgcttgacactcacttccagtttcatgtattgagttcatcacagggggcagggaaataccccatcttttgggagactggctttgtcagtcattttgttgatcatttaaattagttcctagtacatgaagaaaaggaattgtttcctgtagtgtgttaacttgggtcctcccaaaagatatgtccaaatcctaacccctagtcactatgaacataaccttacttggaaatgggatctttgaagatgtaattaagttaaagatcttgatgagatcatcctggatttagagtggggcctaaatctaatgactggtgtccttaaaagagaaaggaaagggcgatataaggcacagagacacacagggtaaggccatacaaagatggagtcagagattacagtgatgcatctataagccaagaaatgcttgcagccaccagaagttgaaagtgtcaagaattctcccagatgggcacagtggcttacacttgtagtcttagatactgggaaggcttggtgggaggattccatgaacccaggagtctgaggctgcaatgagctatgatcatatcactgcactccagcctgggtgaccctgtctctgagagtgagggtaagagtgagagtgagagagggagaaagagagagagagagagagagagagagagagagagagagagagagagagagagaagcattgggagggaatgctgccttaccacatcttgattgttggagtcctggtttgagataataactgttttgttgttttaagcctccaagtttggaataatttgctaaggcagctcaaggaaactactatatccgccatgacccaaatttcaagaaatcaaatgatagaaaatggctattaccagatatatttacacagattgctcttaaattttttaacaatacagatagccatgtcaaaacattatattcaaaatctgatagattataatatagatgtctctgccaaaaggtatagttcctaaaaacccaacctaatgaaaatataaatgattttaaaaatagtaactgtacatcacaatttcatagggctgccagataaagtgacactaaattaaatttcaaataaatgataaaaaatttactatatgtatgccccagttattatatgatacatattcatatatatgaatatatataaaagatatatataaaagataatacattatttatctgaaatttaaatttaactaggcatcatgtatttttattcgctaaatctggaactttccaattgcagcagggaaattgtgtatcttactcaaagtcacatagctaacaaaatgtgaaagctgactttgaacttatgtgtgtcagactaccaaagatcacgtactttctaattcattatgctgcttaaagcaaagacaataaaactcagaaaaaggcagtagcacttcaagaagccatctggttgttgtttctggaaaataggtgtagaaatggaagaatgatgggcagctctggctgctgagccacttcagtgcccgttacgtagaaatgagattctggagaagtccaaaccacattctagtgaatgtggctgtggtggaaattagtttttcccttccactgttctgtgcaagggtgatatgagacatagggggcataaccattttgattttgctgggtagtaggtgagggcatccttgtcacacattgatgagttcaattttcattaattctaatagttatacaagtgttttctctacattcatctttttccaaccaccacatggtttccaggcatcatcaggcttaaaaccttaatagttatttttttttgagtcccttcatccaattgatctcgagtcctatcagacattcctctgaaccatctactatatattactttccttctctatttccacacccataattccggttcaagctctcaacattatattctacatgactgcagtgcttcctagcttttcttctcatttcaagctatccatctccatctaattatcctaccaattatatgtatataaattcgcaaatctcaagtgacataatactatctatctaatcgaatgtttaacatatctgttattcatagatgggtcaaagataaatatttaatcaatccttaactcaggttgttttatctatttaaatatctcttcttatttttatctttacccaataaaaatttcgctaatgccaggcaagtaagtacactagtgaagctggattggagttggcattttaaacacttctggatgttcttcattcccacaaagtaatattttctgtcccttttttaaagtacatggctctctcattccactgaaagttgtttttgtattttttggcggagaagtctgcagtgaataatttgatactataagaaaatcaatggcacacacacagtgagacccagactcaaaattgtggaggcacagggaatggtgaaacaagagtaaacacacactgtccaaaaggtaggggctacttagctaggataactgatgtcatatgttgccagagtttgcctgatgttttctcatgattacattgaggctttgcactttgacaagaatgccacagaaatgacgtgctgttttcagtgcatcctgtcagggagttcgtgatgtctgcatgtcttctcagttctgactttgaccacctggttaaggtggtgtcctccatgtttccccattgtgaagtttctatttttctctttgtaattcttacacagctcatggagaaatacttcgaaatgctgcaaaattctatttcacatcataactgtacacatataattttagcatctattgatgatattttgcctactattgttactggggtgtttgttaaaaggtgactttctatttcaattctcccttccacgtttttttattggaattctaccataagaaatgcttataccttctcctccacttatttcttcaattatttatcagctcaaagatatttatcttattctatgggttttactccatcattaccattgatatggtttggctctgtgtccctacccaaatctcatgttgaattgtaatccctaatgttggggggagggacctggtgggaggtgactcgatcacgggggcagtttcctccatgctgttctcatgatatcgagtgaattctcaccagatctgatggtttaaaagtgtgtggcacttcctccctcactctctctctctccagccaggacatgaagaagatgcttgattccccttctgccatggttgtaagtttcctgaggccttctagtcatgcttcctgttaagcctgtggaactgtaagttaattaaacctcttttcttcctaagttacccagtctcaggtaattgtttataacagtgtgagaatggactaatacaaccattatttattttttgctgaaattgtcccagctttggtcattaaatgttcctttaagttggctcctatgtgattttgacattttgccatcaatgtttgggcactcccttactttctggcactgcaaaaatgatccaggctcatattatactttccctgtcccaggcctgaaataaaccatttctccaggagccttgattacttttattggggaaattgtattgagaaaccaatacgtggccaaatgtattcattgctactttgtcattatacctttgttactgcttccaggccctctcagcagacagattaggaaatatacacacacacctatctccatacatttttatttctagatatctgtatatatattaataaaaatcattagatcatactgacacctgtttagcaccacagggttcattctagactgcctactttctatatttgtaactatctccaacaatgagaatcatgactgtcattgtctataatatatttactaatttgcttgttcctggtatatcattaagtagtttcagaatcaataatcatggcctggagtacatacatttatgtatagttctttttatctggagttttatagtatacgcatacctcatttcattgcactttgtttgattgcgcttccaagggtttctgttttctgtttttgttttcaaatcgaaggtttatggcaacactaccttgatcaagtctatcagcaccatttttcaaacagcatatgctcacttcatgtctctgtcaccttttggtaatttctgcaacatttcaagcttcttcattattattatacctgtgtgatgatctgtgattagtgatctttgacattactattgtaattgttttgagggaggccccatgaactgtgctcacaggagactgagaaattaatcagtgaatgttgtgtgtgttctgactgctccaccgaccagctgttatccatctctctccttctcctcaggcctccctattacctgagacacaacattaccgaaattaggcccatcaataaccctacaatggactctaagtattcaagtgaaaggaagagtcacatgtctttcactttaaatcaaaagctagaaatgattaaacttagtgacaatggcatgtcaaaaggagagacaggctgaaagctaggcctcttgctccaaacaggtagccaagttatgaatgcaaaggaaaagatctagaagggcatttaaaacactactgcagtgaacacatgaataagaaagccacccagcctcactgctgatatagagaaagtgggtggtctggatagaagatcaaactagccacaacgttcccttaaaccaaagcctaatccagaacaaagtccctaactctcttcaattctatgaacagagatgagggagctgcagaagaaaagttggaagctagcagagattggttcctgaggtttaaggaaagaagccatctctatgacatgaaagagcaaggagctgccacaagttattcagaaaacccagcaagataattgatgacggttgctacactaaacaacagattttcaatgtagatgaaacagccttctattggaagaagatgccatcgagaactttcatagctaaagaggagaagtcaatgcgtggcttcaaagcttcaaagaacaagctgactctcatgttaggggctaatgcagctggtgaccttaagttgatgccaatgctcatttaccattttgaaaatcctagggcccttaagaactatgctaaatctactctgcctgtgccctataaatgaagccaaaaagcctggatgacagcatatctatttatagcatggtttgctaaatatttagtaggcccaatgttgtgacttatggctcagaagaaaaataatccttttaaaatattactgcttattggcaatgcatctagtcaccggagagttctgatgaagatgtacaaggagataagtattgttttcagtcctgttaacacaacatccattctgcagcccatcgatcaaggagtaatttctactttcaaggcttataatttaagaatacattctgtaaggctatagctgctatatgtagttcctctgatagatctggacaaagcaaattgcaaaccttctggaaaggagtcatcattctagatgccataaagaacatttcttggctgggtgcagtgtctcatgcttgtatcctcagcaacttgggagtccaaagggggaagatcacttgaaaccaggagttcaagaccagcctgggcaacatagtgagaccacatctctaccaaaaaaaagaaaaaaaatagccgggcatggcgacacaaacttgtagtcctagctactcattaggctgaggcgagagggtgcatgagttcaggagttggaggttacggtatgtttgtgctactgcactccagcctaggcaacagagtaataccatgtctctaaaacaacaacaacaacaaaaaatccatgatttatgagaggaggtcaaaatttcaacattaacatgggtttggaagaagttgattttaacccttatggatgacttgagggtttgaggggttcaagacttcagtggaggaagtaactgtagatgtggtgaaaataccaagagaactacaattagaagtggagcctgatgataatgactgaattgctgcaatctcatgataaaatgtgaacaaatgaagagctgtttcttatgaatgagcagagaaagtggtttcttgagaacgaatcttctcatggtgaagatgctgtgaacactgttgaaatgtttgatatttaccagtttttacttaacaattgaatctattatttgtacagttcctagccataaaatactccagtattatattaaattatttttctctattttattcctttagacaaaagatttacaatagttcattgacttagttgataaagcaacagcagggtctgagatgactgactccaattttgaaagatgctctactgtgggtaaagtactatcaaacagcatctcatgctacagataaaccttttgtgaaaggaagagtaaatcaatgtggcaaacttcattgttgtgtaattttatgaaattgccacagccactccaaccttcaacaaccaccaccctaatcagtcagcagccatcaacatcgaggcaagaccctccaacagcaaaaagattatcattcacagaaggctcagatgattgttagcattttttttagcaataaagtatttttaaaattaaggtacatacatttttagacatgcttttttatgaataatgctattcacacttaatagactacagtatggtatatattataacttttatatgcactgggaaatacaaaaatttgtgtgacttgctttattgtgatattttctttattgtggtggtctggaaccgaacctgcaatagctccaaaataggcctgtatgtataattcaaataccctttttcatagctacttcggttagtggttttatttcttatccccttagatgagattattgttatgggttcctcccacatcctggttgattttaattatttatctattttggggtgctaaaatattgtcatagttaaagactttaaattaattaagaaaattgactcagataaatgccatttcctcttcatcccttttaccccattcccatctcccattcttgccatctgttatttacctacattctgtatgttaccgatttcattagtttctagcttttgatttctgtatttcttttggtagaaatgagaagacaacacacaaattcttatgtatttctttcttacatagaacgttgcatattgttgatactcttttgtacttcgcttatgtgaacttcacaacacatcctatacatttttccatatcaatttctagagattttcattatttatttttacagctccatagtattccgccatgtagatatgccatagtttattcaaccactcccctatttatgggtatttagattattgcctatattttataattataaacaatgctacaataaattattgtatatatatgcatttcaaattgctgggggcatatgtaggactaaaattttgatcttctgttgccaagtccaattctgttttagattgaatgatataactgagagtactttgaaaactaaaaaaagttgtatacgctgtaaatatagcaaaataatactttgttatttgcattattttctttatctaatttgtgtcttctttggaaacaggcagttcaattcaataaacatgtgtccttagctactaaaccagacagttattttgaaaacgtctcctatctttttaaattctaatattatcaatcacatatttcctcactaagaatgtctttttaaactttttttaatgttttgtagagacaagctctcactgtgttgccaggctggtctcaagctcctggcctcaagtaatcctcccatgtcggcctcccaaaatgctgggattacaggaatgagccaccacacccagacaagaatgtttgatatttgctagtttttacttaacaattgaatctaatatttgcacagttcctagtcaaacaatactctagtattatattaaattatttttctctattttattcctttagatataggagacaaattaaaattgcagccctaatctggttccttctattccctaaatatgacgtcaaatagggtaggaggaacaaaacaggatcctatggtgccagaagcactctcagggttgtctgacaatgagttagcaaggcctggggactctccttcctcctggcaggaggagttacatccaaactcagcctcctttggaattgggggctctcagggccctcaacgtatccacctcctgcagcgctcatattcaaaatgtgcaaaggatgctatacagcctatctggggtctattcttggtcctgcctctatcctgggttcaagaaatccctcatgtggcctatcctcgttcatcaagagattgcattgggatttggaatccgggaacttaagagtatttgccttatcttatccttcgtcatgccctacaaaatgtgtttaatccaccatgagactactgccagatctgaccaggcctcaaaagatcacttcttaggaatctctgaagttttggagagatattagtcctgggtcctgcaatgtgagcagattcaactgagcaaatgtatatagcaaaaagaatttcaggtctaccaaaaggtaagttctgacatggcttcaaatatatgcctcacttatgtaaccaattatgtcagtaattacatatgatatagagtctaatttgtcagcagtttgatagggactttgctgtctgggttgagaataagtcagagttttggaacttgcatcaaaacgtcttccaccatggtcacaggagtcaagtaatgtgtcaaactgtgtctttgaattcaagcttctaaaaattatattctagttaattttttataactcaggcaatcacgtggaaaacaaagtttgtcataaacacataaaaaagcttctaggtgatattgctcttatgctcttacctcctcgatctcgagcagctaaactttgaccccttcttaatgtaatgtccagctggtacattccgggatcagccaaggggacttctgcattactggttccagcagtgtttattattttctggaaaacacgaaatataaaaaatattaaatttattatctctgttctattttctctaaagggggaccatatatagcttaacccaaattataagaattagtcaataaaataaataatcttctgatttcatacagtctcataatcactcagttctctgaaggttttgaaatttatgaaattctttagactcaaaaacatggcagttacagaaatgtcctgttttaattcagattatggataacaaatggaatataaaaacatttcccatggaagtctccacacaattcaactaagaaatatgaacatagaaatactgtctgaagtgaaaacataatcaatgatgagtggagaataagagtgcaagagcagttgagttctacctaactggaaattaaaattaaaatgattgattcaggtgactgctgactcatttatctgtgcagaacagctcatacctatgaattaagcacttctgcttcagccccaacataaaatttaattatatagaaataaattcacctagcattttggcaatatttgcaagaaatatattctcgatggggctaaatttctagtgctgttttctatggaataaaagtacatcagctattcctagatctaaaaatgtttgtgagcctgcctctatagaatttatttttagcaacaatatactcttaataatttactaggcatcgaattacaagaggaataatgatattaaaacaacacaaatgaaacatgtagtaaaaattcttgaggtcatattttgtagtctctgccactctatacaataggaaagcttttctttgtgtgtttgggattaatttaaattcttataatttttttttctgattcaaaaggaaatgtccttttgtctcagaatatgcatggatgaggtaaaataacagacaacagtcttttaattccataattcacataaaatgaaacaataaagcagcatttaaacaatctttacggtatataattcacataccctacatttgttcgttaaagcagcattttttttttttgaggttttaagaccaaggcaaatagctttgctgttggagcaattattagttaaaacaagaggcagcacagctttgattgacaacctgaactcactgtctctcctctggtaacaataaaaaagaattcactccaccttctcatgatatccttgtttctataaatgattcctcagtcactcagcctagaaatcgctgagccatctttgacttcttcatttgattcccacccacatccaaatagttgtcaaatccccccactccatctctgtatgacatctcccaattgtctttttctttcaattcctattaccactcatttggatcaggccttcaaacaacaaaggagtaaaaagtaaagtgattgtcttgctcttcccttacccatctgattgtggccaccaatgacaacaatttgggaaatatttttcacacttttaaaagtcttatgcaaacataaacacatacatataggtttggttttttgtggttgggctttcagttttcactagttttaaacaaagatagtattctattttgtctattatcaacaatttctagaaaaacatcatgggcacttttctagtcaatacatacagatctttctctttcaaatgttctaactttattgagccataattgacaaaattgtatgattttatgatatacaacatgatgattcaatatacatacgttttgtacattgattaccacaatcaagttagttaacacatctttcacctcacttgtttacccttttgttttgttttgtggtgaggacattgaagcgaatttcaagtatacaattcagtactgttaaccatagtcaccacgctgtgtattggatcccctgaacttactcatcttacagctgaaagtctgtactctttggccaacatctcctcttttccttccacgcccccacccctagtaaccacttttttttctgagacacaatattttttcccagtgtaggaatagcataatttcttccattattttcctattgatggacatttgtgttagtttctttgtttgccacagaggactggtgctttcatttctcttgaaaaagtttacagaatgaatttttccaaaaggttttccaaaaggtttacataattcacgcttctatcaaaagtgtacaagagtgcctattttccacaccttagtcagtctaggatgttactaattgttctaatttttttcaagtttagggcacaaaacatgttatcttccttcagcacatatttccagaactatgggtgaggagtcttgaaaccagtgtaaaggacaagagcgtgacagctgttcactaagccatacagaagattccaacttggaaagaaaggaagccaatcaagattttctaaacaacttttcaaagaacagtgtatacgtgggtctaattaataagcaagatttaaattcagacccagcaaactttgttgaggtccaattgtgtttcaagcttttcattaggttcttttatacacattgtttccaaataaacaaatctattcataaatattaagcttatataggttttctacttcgtaaaaaatggaataaaatctgcaggaaaaggagaattttctacatgccctgcatcttcctctactgttttgacaggtattctaaagccagaaaaatttgaaggctcagacagctgtatattctgtagtcttcattgctatgttcagtgcttcttgaagtttagcatgcatagaatttgtagagtatcaggttttatattttcaaatatgtattatactttatgtgcaggttaaggaatttccaaagataattttaactacactagatttttcacttctgcagtttcagaatttaacatttagttaagacataacttctccggacttatatttatttgctgtagtcatttcctcttctacaaacttctaatttatatcctttgttctcttttctgctgtgttgttagtcttttttaaaatggcatatagaacagtttctctaccaaatctattgcaaatatttcctcccagtgtcatcttgtttctttgatctttgtagatggtatatgtggtcatatagaaactattaagcagttaaagctgtccttttttcccctctaatgacttctgtatttcttatcttgcctgataatgttttccatatcatggcaatatgtattgattctcatatattttaaaattccttttataatttttaagttttatgtatcttctaatcatgtgaaatatattttaagtgtactgcgtgaaataggaacctatgtgttttcttagttctcacctggaattgtaacactgcccattaaataagccctttttccctttataatacattaagttcccatatacagttggatctgtttctgaagtccccatgatctgcttacttctgtgtcaatactataccatgtgattacaatgactttaaattctaatatttgttagaatatgtagctcccttctttcttgtttttcaaaagcttcttgattattatcgcatttgtattcttcctgatgaagccaaaatagcttgctggtttagctgagccagaccatctaggttcgaatcctgccacttactaattgtgtgagcttgagaaattacataactgatttttgcttccattttcttacctgtaaagtgggactaaactaatactactacctccttgtcaggttgtgagcattaacgcatataagatgttaaaatattgcctggctggtttgttatttactactgggtgaaaaaataaaaaataaaaacaaatagtgcttggcacatagtaagcactcaataaatgttagctattgtcagtttccaaaaatgaaacaaaaagtacaaaattttgatttgaactgcattgagtttctagattaacaggaataatttataatttcatgatattaagtattttcctttaaggaaaatagaactttccatcatttcaggttctgttgtatgcccttcaatacaatcttatttttcttctttcgtctctatctagcttaatttattcttgggtattttatgggttttgtttctattgtaaaaggaataattcttttccatttccattctgataaggttatttctagtataatggacaaatattattttgtatactgactttatattctgtcacttttcaagtcatattttgggttgtctgtgtatagaaatcatattgtctgtatataatgcctttttgactcttattttctaatacttcaattatttatttttaaatcttattgtgttatcttctaaagactgtgaaaaatggtgaaaacagtgaacatttctgaattagatttgattataatgtgcatgccttttagtatttcacaatttaacatgatgtttatgaagcttaggctttttcttctcttaatttacttgtgctttaaaaaaagcactgctgaattttatcaatagattttcagcatatgttaataagatcatacagaatttttggttgatagatttttgtaacattgaatcatcttcatatttccagagtagactctacttggcactgtgaatttgttcactctaatgtacaatcatgattatgttcaaaaccatctatcatatgtcagcatacttgagtatacccgtacttcttaggaaggcactcatagctcccatgatatattaggttggtgcaaaagcaattgtggtttctaccattactttcaatgcaattacttttgcaccaacctaactgaagcctatcattataaactgagccttcacttctcttccacaaattctggatcatttttccttaacagaatagaacttacactttaaaaacttgtatcttcgtccttcactcttgaccagggctgccttcccttcttgtttcccgtgtctttctacccagtcttcaaggaccatttcactagcactttatatctttattttccattaccacattctatctcaaatgtcatatttgtcattttaaattatgaacctttaaaatcatggaatagagtatttaagcttcaaattgaaaatgaattatgctagaggctacaaggatagaaagatatctttacgagcacctgatccagctgagtagaaacatcaatgggaatctaaataaagttggcgaatccatgggcagtttgttctctctcttctcctacactcatgtaatgcatccaatctgctttggcaccctgtttgaggaacccaggtatacccttagaatccttctcaatacagtgctctaggcagccattaccaactgataaaaattagcacttaaaatgaaaccctgtccattcaggagctataataaaagactgactgtaatatactgaaggtatgaagtcattgggagagaaggacagtggatcaattatgatgggagaagactctcaggaggcctcataaagataaccatggagcagggtctgaaaatatgtgcaggactttgacaagtgaagatttggaaggagggagcatcagaaaaaatcaacatgagcccgatggtaagcaatcatcaaaaagcgcatcactagattgtatgagaaataaggtggaaaggaagactgatatacagtgaggcccagctaaggaggtttcactctgtgggcaacatgaaaccatcacaggcttttgaagacagaaacaatagaaccaggctccagtgaacacacacttactgccttacatgttttatgctctgggccaaatgcttagatttcagcaatgagcaaaaccctggccttttccctctgtaagagggatgagagtagagaaatcccatggttctagaaattatttaaaaggatttacaactgttcagtttaagtcacaagagcttgatctgaccagtggtaacaaaaacaaaagatggatttgagagtttgaagagattctatcaactgaatttgccaactgacaagatgtgggaaacagtgggtgagtcacacagaagtttgagctgcgctcctgggaggatggtgacacccacggtagacagcagaaatgagaggagaagcaactccaggccaccactctgtcagctccagggatcgcccaactccataaaagaacatcaagaactttagtggatctagagagacatctcctttcaggcccactatagtggttccaagaagaaaatcagcaggctgattatggagggatgctagaaataaatgtgtatttctttattgtaaagtatctttaaaaaagtgttcatgaagcttccaaacataaagatatcttaggaaatatgtatctgaagtgctaggctcacatatattaaaagctctaaaacaaacttggttcacctctgaaattttaaatatcctgaatgatatatctaagttgtctgctcttgtggtctgctttttgtaaccaagaaaatggcactttcacagaatttagcagttataagaagttaatgatctgtgcagttatttttagtgccttcgtctattttggacactagttccttgttggatgtatgacttgcaaatattttgtcctaatctacggatggtcttttccctgttaattgttttctttgttgtgcagaagcttttcaatttgatgcaatcccatttgtctatttttgcttttgttgcctctgcttttggggtcttatcaaagaaatcacttccaagaccaatgtcacagagctttccttgatttttttcttctggtagttttacaatttcaggtcttatgcttaagtctttaatccattttgagttgatttttgtataaagagtgagataagagtctaaaaacgatatggcatatcaataaatgtggctcaccatattcaaagaatcaaggccaaaaaccaccttataatctcaatggatatatgaaaagcatttgacaaaattcaacattcttttgtgataaaagctctcaacaaattagttatataaggactgtttctcaacacagtaaacaccatatatgacaagtccatagctaacatcatgctcaacactgaaaatttgaaggcttttcctctaagatcagaaacaagacaaggatacccactttcaacacccctattcaacgtagtactagaagtcctagccaaggcaattaggcaagagaaagaaatgaaaggcattcaaatacacacacacacacacacacacacacacacccctaaatgccatcccaaactgttagaattgataatggaattcattaaagttgcaggagacaaaatcaacttacaaaaaccagtggtatttccatatgccaacaacaaactatctgaaaaagaaattaagaaaacaatcctatttacaatatcataaaaaatacttaggagtaggttaatcaagaaggtgaaagatctgtgtattaaaaactatagaacattgatgggagatattgaagatgacacacaagaaaggaaggattgtacatattcatggattaggagaattagtattgttaaaatgtccatactaatcaatgggatctacagattcaatgcaatctctatcataatttcaatgacgttattcacagaaatagaataaataatctaaaatttgtatgaagtcatagacaaccctgaatgaccaaagccatcttcagtgaaaagaacgaagctagaggcatcacactatcagatttcaaaatcgattacaaagtgataataatcaaaacaacgaggtactgacataaaaatagacatactaacaaatgaaataaaacaaagagcccagaaataaactgatacatttatgatcaattgagttttgatagaggtgtcaagaatacacaatggggaaagtacagtctctttaataaatggagttggaaaaactatatatccacctgcagacaatgaaaaaagctcaaaattgaaaattcagagttctaggcacagtttgaaaattaagaagtttctatggtaatactcaaaagtttgggggctaaagccaaaaatcagatgcaaagtacaaagttttaagttgcagattataacacaggataaattcacagccttatcaggtcacttacaggaaagtcagaaaaaatcatggaagagtagttaataacaagagcattcacatcttctatctcagcaagccaccatttttgcagaaggccttcttgtcttgcttgaactggagtcattaccatacatggtgatgccaaatttccttatgctcaactcctccttccctcattttagatagactagtggctctggctggacttcaggaatctgagggtaggacccagcctgataatcaatttttcttttcccaacagcccctcaagtaatttcaatatgcagactagcttgatccttgtgccagttatagaagcaagtctttgtgaaaactatgcacaaagattctccagacttttcttatagatatcatgaaacacctgagtaatatgtgtgggaatcaacagaagggtcccagtgactttaggctctgctgcttgggaggtctttttatataaataaagagagcttccaccagaagatataaaggtgctggtaaaatcgaagtcgggaatgcctcctgacctttttgaaattttcattacaggaaaaaataaagggtttactctgttagctggcatgattgattcttttaatttttaattttaatttttaatttttgtgggtacatagtatatatgtatttatgggtttcatgagatattttgatacagacatgcaatgcattataatttcatcaggttaaatgggatactcatcacctcaagcatttaccctttgcgttacatacaatccaattatatacctttagtactttaaaatgtacaattaaattattttttactacagtcaccctgttgtgctggcaaattctagatcttattcattctttctaactactttttgtacccattaaccctccgctcttcccctcaacccccaactacccttcccactctctggtaaccatccttctactctctatctccattgttttaatttttagctcccacaagtaagtgagaccatgcaaagtttgtctttctgtgcccggcttatttcgcttaacaaaatgatctccaattccctccattttgttgcaaatcacagaatctcattcttattatcaattaaaaagcaggaggtttattgtagcactgtacagtgggggaggggtatgcctggcttctagggaatttcctggtgtgctcttagtattaccatgccaagtggattgtagattggttacattattccataaatgtttcatacactcaggccatgatcactgcagatctaactttgtctgtcaataaagcccacttaaagttaaaacttcgtgacagatattcaattttcgacttttaaaatttagcaatgttgtcaaagatatcattgaagatttctacttagtcatgaccagtttctacttagtcatctcttctactttctatgacactgaaaacatgtgtacagtctatgacactgaaaacctgtacagtgaaatatccattaagtggaaatcaaagctttttaaaacctaattttcaaaaacagaattcaaaagccacagagatattcaaagttcaatgaagctcaagtatctgtcaaggaaacactatgattatctggaagtcaattgattaagtgactttaaagaccttacacagaatgggaaaaattatggcaaataatgggtgcaccccactacgtatgtcagccgtggtgtctaatttacagccgcaatggaaagaaaagcttatgcttggttccaagtaaatgtaaatcccttgccccttgctcatagctgattagacatgagctgggtgtctaaactaagggcagacagtgagcaggctggctggtgccaggttgttatttagcagagagcattagtaggcaaagatgattagaatgaatttcagagagaagaaaaagttaacagtagctgctaagctgaagagtcataataaagaagctggagaggccagaaggccacgtgtaacctcaagtcaggaaacagatgctataattagcagaagtatggggtggaaaactacatatagtagagggtggagtgtgacattgtaacagggcatacagacacagaccaagcaaccaaagcacagtaatgacaatattggacaggagagtgaagatctatgagctcccactgctgaaagcctgaagtacgtctgggagctgagggtccactgctccgtactcttgaatgtctgtgtggttcctgctgaccttcttacctcttctggccttctttgagacagcttcaatgagtccttggcccttacaacagaatataatacgaaaagaacgagaccgagcaaaataagccaaggatcaagagagcaaccagttaacacaggaaatccatgagtgtcagaatacagtaatatagggaaagtgagctgcagagagaggctgcagacagaaatcacttcatgcatccaccttcttcctccacagttctgtgtgatgctcatgcacagcacccctgagggactagctcaccactcaaaggccaaataaggtcaatgctctgcagctactaagtaaggaaaaacttcatgttttttaaaatgaatatttcaacaagaattgggagaaaatctatggttaggatggccatgtaactgatcattcaaaataggatactttggagagtgaaagggagtgctattaataatgatacggtagaaacaggtagaaacaaaactgtcccaggtaaactagaatgcatggttataatggtaagttagccttcagattaccagaaagcagaaaaggccaatcctctggtcataacaaagctttactatactttgtttttgaactgaactacaaccctaggtttaattctggggttttggtttcctggtggtccaaactaaacaaaatgggccaataaatactcagacccaataaatggcaacatttattgctgtttaaaaaagtatgaaattcagtgctcccagaatgtcttttctgggactcccacaacactgattactcacccgtggattgtctgctaaattgactgctctgtgtggcattgcttcattatcactaataacctttccgcctacacatacagtatataaaataacctgagccaaagcaaataaaattctcttttcttaagccttatgtagatggaccactctctttttaaattagaccatgtaaacagactttgtgttgcaagatacaaattttgttgaagaaagcacaggtgagatagcaattatttaacttcagccaaaaatactatcctgtctgatatttgttttctaatctttaaaataggtaatagatatctcataaacactgttctgattatgagataaaatatgtaggccgggcacggtggctcacgcctgtaatcccagcactttgggagaccaaggcgggcgatcgtgaggtcaggagttcgagaccagcctgaccaacatggtgaaacccagtctctactaaaaatacaaaaattagccaggtgtggtggtgcgtgcctgtaatcccaggtatacgggagactgaggcaggagaattttgatcccggaggccgaggttgtagggagcagagatcaggccactgcactacagcctgggtgacagagcgagactccatctcaaaaaaaaaaaaaaatgtaaaagtgtttgtaactgtaagaaattgttcaaatataagtggttatttagatgcaggtgatgaggagatctattataagatagaggaaatattacaggagtcagagcacaaagacatggacacaaagcctagttatggtattaaattgctgtgaggcatagggaaagattttgagctctagaagcctcattttctatttctttaaaaaaagtccttgtgaattttctttccttttctcaagatagctgaccagagacattggatgctagttctcctcagaaagattaaagtgactgtgaatagacaagttctaaatgggaaagtgagggaagagagccaggacctcttggagaatccatgggaagaagctggggcacaaacaaggaaagcagcaagaatccggcatagattgactcccaaagaactcagaccccatggaaagacttggtgagagcacttctctctcctctcacctctctgacaatctccggacagccagactgttggggaacccctctgaccttgtgactcagggcaatgctatctgtggtgatttgggaacttcctggagacagagaacttggtggccggtttgcacgagtatggttgcactcccctcaggtttgaaattaggtatcaggtgccatactgattgtacacttgtggtgccactgccttgcatgtggtttctctgcccttgagttactccaccaccaaatcccccacaaatatacaccacaacctgctctgacattggcaagcacagcttacacaaagagcagggtccaactcccactccctacacagaacggcagcgttctagcaagggaggacagataagttgcagagttgcctgatctggccggggaagaggttctcgcctgagcccattttggtggtagccctcagaggggtatatccatggcctgtacctgcactgcagtggggaaccaaaggacaaagtctttgtgaaccggaagtcatgaaccctgcaacagggaagtgatagagaagcagatcacatacctgttggctcaagatgaggagctgatgcatgctccaccactttcccccaagacttcagtgtaccacaacacaatctcttcctgccaataccccttcagggtgggtgtttccactcaacatcagcctacctaagatcaagtcagctcctattcttaactgctatatactggactgaagcctgagctgcaccacccaacacaaaacctgctaccagagggcttagtgctagtccatgagataagcttcctgaaactccacactctcagccccacaggaggtcatatgttggctcatgcatccaatacaccagtacaacaagcagcatctgagaaagccacagcatagaagctatatacaacccaagagacacatccagagccttagccctctgcaagtatccagaaaataagtcaactgattatatgcaacatgcaccacagtcataccctcaagggaaaaatgatatttttaaaaaagtctcatagaaatgatggcgaattcaaaaataagaagcagatgagaaggaatcagcacaaaaaactccagcagtacaaaaagccacaatgtcttgatacttttaaaggactactctcactctctagcaatggatcctaaccaaattaaatagtttgaaaaaacagataaagaactcaaaatataggttgcaaggaaactcagtgatatccaatagaaagcagatatccaacacaaagaagccagaaaaacaattcaggatatgaaagacaagatagctacattaaaaaaaaaatagaactccagaatagaaaagttcactaaaaacatgctttaacaatagactaaccaagcaaaagaatgaatttcagagtttgaagatcagtctttcaaattatctgagtcagacaaaaatttaaaaaaaattaaaaaatgaacaaagctttcaagaaatatgagattatgtaaagcaaacaaatctatgatttaatggcagtctgagagaaaaaaaaagtaggaactcagaaaacttatttcagggactagttcaagaaaattttcctaatcttgctagtgaggtcaacatccagatacaggaaactcagagaacacctgcaaaacactatacaagataaccacccccaagacatagagtcgtctgattttccaaggtcaacatgaaagaaaaaaaaatcttaaaggaagatagacaaaacagccaaattacctataaaggaaatcccatcaaactaacagtggacttctcagcagaaaccttacaagccagaagagattggaggcatgcttttagctttctttaagagaaaaatgccagccaagaatttcacgtcctcctaaaaaaattaagtttcataaacaaaggagaaataaagtcttttccagatgagcaaacactaagggaattcatcaccacaagactggtcctacaagaaatggtcaaggagttctaaccatggaaagaaagaatgttatatgctatcataaaaacacagttaagtacaaggctcggctaacaatactatgacgggaacaaaatctcatatattaacattaaccttgaacataaacagcctaaatgctccactaaaaagacatagagtggcaaacgggacaacagcaacaaagatccaattttttgttgccttcaagagcacatctcatgtggaatgacatccgcaggctcaaagtaaagggaaaatgaaggatctagcacacaaatggaaaacaataaagaactgtggttgctattcttgtatcagataaaacagagtttaaatcaacaacagtaaaaaggacaaataagggcattatgtaatgataaaagattcctccaacaagaagacttacctatcctgaatatatatgcactcaatgttggagcacccagacttacaaaacaaatactgctagacctaagaaaagagataaccagccatacaataatagtagggggcttcaacactctactgacagcactagatagatcattgaggcagacaactaacaaagaaactctggacttaaattggacttttgaccaaatggacctaccagacatctacagaataatccacccaacaaccacaggatatacattctcatctgtgcatggaacattttctaaaattgaccacatgcttcgtcataaagcaagtcccaataaattcaaaataactgaaatcatataaagcatcttctgggaccacagtggaattaaattagaaataaatatcaagaggaactctcaaaaccatacaagtacacggaaactaaaaagtcttgtttccgaagaactttgggtaaacaacaaagttaagatggaaataaaaaaaatttttgacacaaataaaaatagagagaaaacatacccgaacctctggaatacagcaaaagcagtggtaagaggaaagtttgtagtaataaatgcctacatcagaaagatacaaaggtccccaattaacaacctaacatgacacccaaaacaagcaaaacaagaacaaaccaaacctaaagttagcagaagaaaagaaataacaaaggttagagcagaactaaatgaaatttagagcaaaaaaattatgcaaaggatcaacaaaatgaacagttgtttcttcaaaaggataaacagaattgatagaccagcagctagattaaccaagaaaaaaagagagaaggttcaaataagcacaatatcaaatgaccagggtgacattacaactgaaactacaaaagatcaaaaggaatacaaaagttcctcagagactattatgaacatctccatgcacacaaattagaaaatgcagaggaaacagataatttcctggaaacacgcaaccttccaagactgaaccaggaagatattgaaatcccttacaaaacaatgagtaatgaaatataatcagtaataaaaaatctaccaaccaaataaaagccctcaattctaccagatgctcaaagaagagctgataccagttttactaaaactattccataaaattgagtaggaggtatttctatctaattcattctataaaaccagtgtcatcctgataccaaaatctgacagggacacaacaacaacaataaaaactacaggtcaatagccctaatgaacatagacacaaaaactgtcaacaaaatactagcaagccaaatccagcagcaccacaaaaggtaattcatcacaatccatttgggttttatttctgggatgcaaagatgatttccacatacacgaatcaataagtgtgatgcaccacataaacagaataagaacaaaaaccatatgattatctcagtagaagcagaaaaagcacgtcataaaatccaacattttttcatgataaaaactctcaacaaaccaggcattgaggaaacatatctcaaaataacaaaacaaatttatgacaaacccatagctaacatcacactgaatgggcacagttagaagcatttcccctacaaactggaacaagacagatgtccactcttaccacttctattcaacataggagtcctagccagagcaatcaggcaacagaaagaaacaaaaagtatccaagtaggaaaaaaaggaagccaaattatctctattcactgacaacgtgatccaatagctagaaagccctaaagattctggcaaaaggttcctagacctgataaatgaattcagtgaagtttcaggatagaagatcaatgtacacaagtcagtagcatttctatacaccaataatgttcaagctgggaacaaaagtaagaactcaatcccatttacaatagccacacacaaaaaatcaaaatacctaggaatacatttaaccaaagaggtaaaagatctctacaaggagaattacaaaacactgttgaaagaagtcacagatgacataaatgaatggaaaaacattccatgctcatgacttggaagaatcaatatcattaaaatgaccatactgcccaaagcaatctatagattcatcacaattcctatcaaattaccaatgtcatttttcatggaattagaaaaaaaaattctaaaatgtatatggaaccaaaaaagagcctgaatatccaaagcaatcctaagcaaaaagaacaaagctggaagtatcacattacatgacttccaactatactacaaggctataataaccaaagcagcacggcactgctacaaaaataaacacatagatcaatggaacagaatagagaacccagaaataaagccacacacccacaaccaactgatcttcaaaaaattcaacaaaaataagcaatggggaaagaacactctatttgataaatagtgctgggaaaactggctagccacatacagaagaatgaaactggacccttatctctcatcatatataaaaatttattcaagatggattaaagacttaaatggaaaacctcaaactagaaaaatcctagaagaaaccctaggaaaaactgttctggatattgacttatgcaaataatttaaggtgaagacttcaaaagcaaatgcaacaaaaacaaaaatagacaaatgggacttaagctaaagagcttctgtacggcaaaagaaacagtcaacagagtagacagacaacctatggaatgggagaaaatatttgcaatttatgcatccaacaaaagactaatatccagaatctataaggaactttaaaaaatcaacaagaaaaatataaataactccattaaaaagtgggcaaaagacatgaacagatacttctcaaaggaagatatacaagtgaccaataaccatttgaaaaatgctcaacatcactaatcatcaaagaaatgcaaattaaaatcacaataagatgccatctcacaccagtcagaatgactattattaaaaggtcaaaaaataacagatgttggcaaagacgtggagaaaagggaacactcatacactgttggtgggaatataaattagtacaatctctacggaaaatagcatggaaatttctcaaagaactaaaaataaagcttccatttgacctaacaatcttactactggccatctacccgaaggaaaaataaattatatatttaaaaaaacctgcatttatatgtttatcacagcactgtttacaatagcaaaggcatggaatcaacctaagtgtccatcagcagtgaattggataaggaaaatgtgtacatatattacatggaatactgtgcagccataaaaagaatgaaaccatgttctttgcagcaacacggatgcagctagaggcaattatcttaagtgaactaatgaagaaacagaaaaccacataccacatgttctcacttataagtgggagcaatataatagctacacatggtcatataggtgggaacaacagacaacaggaactccaaaaatatgtaggaagaaagaggagtgagggctgaaaaactacttattgggtactatgttcactatttgggtgataggttcactagaagcccaaacaccagtattatacaatacaatcatgtaacaaacctgcatatgtacctcttgaatgtgtaattaaaaaatatatatatacttgtgaaaatttaaagaaataatgtaattgaaagtgtttataaaagagttgagtgatttacaaagtaggttcttcctgcttttttcaaatcatatattatgcatatagtactgctaatgttcattaatggttaatcagacattagaaagaagataacagattatgcttgggttaacttgtaggcttttagtactcttgtattacttaatgactgttatctttcctatttcaccaaaatagtatttattggacctgagaacaagacagattttatttgtattaactcatctgaccttttgtctttttgtgagttcccaaacatactgtttctccccaaagaaattcaaatgtcatgaaaaagtgcatagctaccagtgagtaaaacaactctcagagggatagtcttgtcagaaataggcatactgcactaacttgttagttgctgttaccttccttgccataaatgcttctgttaacaaatgtttcaatagatcaagaccagtcgtatttccaaaatttgggcaacatatatgggaaaacattttatttaatacttgaatttttgagattataacaatttcaaagagggaagctcgtgtagcagatgctttgcttgatgctaaacatttgggattttgctgaagaatccttctactgcttctatggatttacgtctacaaaacaggcaaccacagatcctcaacagctcttatgaaaccgaaacaaagaagcctctgtattagacttaagcacatagctctacttctcttggaataactctatagtgttcccctttttccccgcggattacaaattgctttgtatctgagtttcctcgtcagaaccctaatctttatttcaaaggtaacttcaggaaaacccaaagaaccaaaggaatattttagtgtttctatcacatatcaactttttaaatgtcatatcaatcctacccataaaattaattaggtatctttaaaaagaatgtgaaaaatatctagatagaatgaatgtactacttcttttattccaacacttgattttctttggagaaaaccatggggattatagtttttctgaataggaaattagcaaatcttagaaatcaatttccaacctcgcacactccttcccatattcaaggttaccctacccttatccagaatttcattctttcactcactcactcactcattttttaatcccatattggatacccagcacaaattaatattacagaaaacacagaaagatgtttggatacattctttgccttcaaagactatcatagagacagttttgcatgtgacatttaaatgccaacatggaaaaacatgacaacaggagtttcatggcagtaaatcagaagtcctccacctccttcaacctgcctcttctttttgttctgaatttgggtttgaagcatcttttggaatgatcatacacctagactagaaaacccaacaattacacctggacccccagggcgtagccatcaagtcctgtcaattatattctggaaatatttctttaactgttcactgagtcatttaaaatggttcttatggagtatttcgaatgatgtgggcaaatgcttaggaaaaagcaacgaggtgaaaagtaggatgcaaaactgcatacataatattaaccaggttaaatctacctatgcattgccaaaaagacaggaaggaaatataacaacatgttaacgtgagctattatataacaaggaaattaagggcaattttattttcttcctactttttagaagttttccaattttctgtagatgtgtagtatatattggtctaataatgtagagacttaaaaataaaaaataacatggccaggtgcagtggctaacgtctgtaatcccagcactttgagaggccaaggcaggtggatcacttgatgtcaggagtttgagatcggcctggcaaacacagtgaaaccccatctctactaacaatacagaaaattagctgggcacagtggcaggcacctataatcccagctactcgggaggctgaggctgagggagaatcgcgtgaacccatgaggcggaggttgcagtgagcagagttcacgccattgcacttttgggcaacaagagtgaaactctgtctcaaaaaaacaaaaacaaaaacaaaacaacaacaaccaccaccacctacttattctctgctgtttctatcctttgatgactgtgttaaagatactatggaatagagtttcagaaacttgctttgattctacaaataccatcatatggggcatagcatgtcaatgtgccattctcatttacatatgagtttaaaacaaaactcacgtgtattttatcctttcaaacattcgaacaatctcatggtcacaggtgcacagctgtggatggagtaggatctcatacactcagttgtgcgaatagcaagttattccttccaggtataactaaaacatgaacatggaattaatcatggagcctggcacaaagtatccttcagtgaatattgtgatttattttcattgtttaccatttttgtaaattctggttggagaagttattaaaaagttttcaagaaacaaaataaatagcatagtattggattacaacccaaagaataaaatatatatccatgataatataccaatataaataaataatttgaatgcataaataagtaaacaggggataacagacaaatctatagtgcagaagaattcagaataattggtgtagatgctcctcctcaaggagagagagcaccactccccatcctcaagtgtgggctgtgtgtaatgatttccttcaacagagttcagtggatggagagggaaagagtaaccagagaaacctgacaaactacatcatggaaggcatattagtgataaatgagcctaactctcttcaccatcccttttccctcccccatttcacagatgaaaaaactgaaggtgatgtatttaagggacacatttatgcagtgtttacgtttaaccaaaataattctttagtactgctgataaaacctttttaattccaggtagctctgagaaagatgtggtcaccagtgaccacacattaggctataagtcatgaggcttgagattttcttccaacaccttcgtaaaactaactttactgcctcaagcaaataacttaccctcttcgaccctcaattcctcatctgtagtaaaggaggctgatctataatacttccacatttccttcttgctttcaaaagaaaagaaagcaggttctggtagtttttttttttctcttcaaatccatcactcagtagcttgggttctcacccttaaaaatggggataaaaatagcacatacctaacagaatttttgtgaagattaaacagaataatacatgtgaaacacttagtatcctatggtaaaaataaaatatttagaccttgcctttgtactttcaaaatgatagtctaattatagataagaacctaaatttgattgttcaaaaaacagattagtatctaattgagactttaagacacgttcataaaggaagtgctttaaaggagaaaagttctggacagttgttggaagtggttttcagggataaatattgacatttcttcatttttgcagctctttagaactcttcatccattaactgaaatgctctcacctgagtgcaagtgtgtgcgaaaagtgtgtcattaattattcatacttacagtgggggaagggggttgtgggctgaggcataaataataatgattaaagaaggccaacaaatcaaaaatacatttgtaactccttttgaaatatgcttttatgcttgtttgtgagatttaaaattctaaaatatctgtaccacaggatgagaattttatttactcagtaaacaagtctgtgatagagaaaggtgtctcacaagggttttccatacataaataaaatctattgaattaataaatgtgaaagcaggatctgctatagataaaatgtaagtcccagaaattatcaaaagttgacgtaggagctaagcaaatacaatgcaaaaaaatgcttagcttattcagttaactgatattgtttaagtattccaaagacattgctagaacaaagtgaacaggagtttatgagtcttctcagtaccgtttgcaaaaaaaaaaaaaaaaaaaaaaaagaaagatctaaactgccaaaacttgaggactatcacacgagtagataacactaggtgtcactgctaattttttaaaacttcctcataacagcattaaactgctactataagattgtcaaatgtttcttagtaaccagtattcactctgggagcttcatctaattaattacagaaaaatatacaattcatcttggcatgtgaggtcccccctgcctgctgaaattgttctgcttctaacaaattttaaagaaggctgggcatgatggctcatgcctgtaatcctggcactttggaaggccgtggcaggcagatcacctgaggtcaggagtttgagacaagcctggccaacatggtgaaaccctgtctctactaaatatacaaaaaaattagccaggcatggtggttcacacttgtaattccagctacttgggagactgagacaccagaatcgcttgaacctgagaggcggaaggttgcagcaagctgagatggtgctactgcactccagccttggcgacatagtatgtatgactctgtctcaaaaaaaaaaaaaaagaaagaaattttaaagaagattttttgggctaagtgctccctgagcccatccaagggcacagattaacttccggataactgcctgggaagtaaacagccctcttgacagtgcctggataaaatgaacaaggtggtaacacaccttcctatccatgtgtttctacctttccatgtccaaacagaccccagtttcctcttcataactgatgtggttgtgaggaagctgacttgccccctagctcgaggggtggaaaacagcacaaagatcaagccaatctaaccccctggccacagtgactgattcagggttgggtatgtgacctaagctctttcaatcagggtaaatcttgggacttggttgagaatgctggaacacaagggctcaatctttcctcctgggtgagaatgagaaaacatgtaggtaggtagctgtgggagttggcagccatcttgggtttaagaatggggtaatttagaaggctaataatagtggaggctgggtggagagacagaagtacactagattcttgtgacttttggttgagctattgagttagcctctggattttctggttataggatccaatagattccctttataatttaagtcagttcgagtttttttttgttacttgcaacccaaagcaacccaattatgaaatagctaacactgatggaacacaaattttgtctgaattgtttcacacaacaaacctaagaaataattatgcttatcatactacttttacagatgtggaaactgaagattagagaggttgtataacttccttcagctgggaaacagtgaaatgagattcaaactattctgtctaatgccaaaagcccatgctctgaaaaaaaaaaaaaaaaaaaagaaaaaacaaaaagaaagtaaattaggtacctgaaactatatggtaattttaacttgtcagccctaattatataatttcacttagctataagttcatatcaaaaagaaagggttgattgtagttaaggaaaaagtactttaaacgtttaatatcaaaagtttttaaacacacatcgatctagaacctttctcatgagaaagatacatttccctgtgttgtattacttacttcaagtaatttggagggcattttttggcttctaatcaaatgtctttggtgtaatcaactaaaactaattagctggatagtattttaggatacaggccttgttcaacatatataaaactctggggtttataattagtaaatagaatatagtcatacatactgcctttatatcagttaatgtaatatggaaataatatatagctttctccatcccagaagttgtaggaaaaatattccccaaggaagtagcatattttaattgtaaaaatgttttgttattccaaagattaacatacacttcttcattttacaggagaatattattcatttcttttattgaagcttgtttccaactccgcatccttcaactgaatctgccccgtttctcagtgtgagttgaaaagacagaactctgcctgtgagctcagcatctcactttctacagaaattcaagttcaaagtgcaaaagtctgaagactttggatcttgttttctcaaacttactgcttcatcactgaaatgttagaccagctgcttttgctggttcagtgtagtcgtttgaaaagtccccagttatgtataattggcatattcacacacattttaatagccagtggcctgtttttccaatgccggtaaggaagtatttatttatacaaccaaagcaaatagtattaggcatatttaccgggcaaatgaatgtattaggttacagtgaagtgagtgtcaagtacacactttaaagagggtgcaaacacttggcaatttaaactgctctatatgaaaccatcaggactgagcaataaacatgctaccagaaaacagcggaagatgcagaaagttattgtctttttgtcatggtttatggatagtgataagcaagcaaaacaacggcgttaacaaaccaatagcctgatacatcatcttcttaaaaaccagtgcttacacatatagttgggaatgtcatgtgcagaattcccagtaatgtttatatcagggtgtcatttctttgaaatacatgcattggctgcatactctaaacaatatacaaaagtaaagtgaaaagtaagattttcagtcttgcattcaaatgccagtgcttgtctccaaaggtaaccaccattaacaggcacatacccttttacagaatgtacagctataggaatgaacatacggtatacactgtcaatcaccttgcctttctcatttagtaacaccttggtgatcttctgatgtcaatacattcagctctacctcaaactgtctaaaagacacttagtattctattgaatgtatatatctaccataatttatttaatctgattttcattacatttagatttctagtccccccaccccttttatactattataaacaatgtggcaaggaattttgtcttatgtagatcttggtgtacatttctgtatctaatgagtaaattctaatcactaaatttgctaggccaaaggattctatgttttcaattttgagagatcttgtcaaatcaccaatcttccaaaaatatcccaccagcttacattcctacggacagtgagtgagtttcccatacagctgccaagaacatattatcagatatttataataagtcagtcttccacagagggtcacatttaacaatgcatagttcaaaatctaaacaagaaattttattatttgcatttctaaaacattttagaatttagtccaatttataatctggtattaacacttctcaaaattgcctttctctccctccaaaactccttttgcactgatcctctcatatgttaacccttactaagcagtacttcccactaagaccagggctgtcctctagctcagccagcaaggtttcctctttcttgaagcccatgtgacttcctccctaaccccaccctgactcccaatcccctgattatatcattctgcttagccttttttccttctcttttctgctgcagttgtagagaagagggagaaatggagcatgaaaatattgcaaatccagggtgaggagtcatgaaaactcacacctttaacattgttgatttgctttccatataaattttaaaacatttgccattctgatggaataaaacagatgccttaattactagtgagactgtctttcctgtctatttgccattaatctgtatttcccgtgaactgcctgggcatattctcaactcatttttattttatgttaagcaatttttaagtggttagtacgtgccctttgtaaattaatgggattagtaaaggctgcattctaaagggcttggcctacggggatggagcaggaaccagagagtatagctttggagtgcttctgacaggcattctctccatttccagctctgcctgctaagcactgtatgctcacacaccagcttttcatggaatgtctttttgcaggagcaaattagctagatttttttctgtgcaataaaatttagtgttctcaaaaaaagaagaatgtggtgtaggagtatggacttcctatccttctctgcacatgggtgagatggttctgggccctacagggaaaacaacccatccaagtactttgttgtccttgttgagggtgtatgtcatggaatgaagttctaggaggacctcctcagaagttaagtccacagaaagggactctagagagaggagaatggaagaagcaatggaacgaatttcttttcacctataaaatccagctggcattctgccatgtgctgccacaggaaaaaagcaggacaagtgtcctggctttttctctctttctggcaggcagcagaggaagagcagttctgctcaacagaacagagggcactgacttttttctctaaatgttgcccatttcccacgatgtgatcttcagtccttttgctcatttatcttcacacttagcccctgtagatcaattgagtagatcaatttccagagctttaggtagcacctgttctctaggtctgggatgcttctctctgcttacttgacctttctacttggatgtctcagaggcaacttaaattcaacatgtccagatctaatctcttcttttgcccccacatctgtttccactttgacctccctctgtcctttaacccaggcaaagcattccccagccattcagttgctcagcaccatcttcctcttcctttccccctcaaccttctcatgagacccatcagaagtgtacccttcaactacacttgcaaaacgtgtcttcactctgtcctctttttcccatacccatccccagaccccctagtccgagcccccgtcatccctaacgtgaatcagggcagcagacttctaagtgatgatcctccttttgctcttattcctcttaaattcagtctcccacaagcagctgaagtgatcgtcaagcatcaaaatgactacgtcaatctcctgcctaaaactttttagtgaacttccatacactgaaaactccctactgtagctcacaaagccctacacaatctgtatcaccaacttctccaatttcacctccagctaccttccccctcactacactagccacatcagccttgtgtgagtttcttgaatgtgctaaactcttgtccactaggaactttatacttttatctggaagcttcttacccaggctattggcaggactagctccttctcatcctggagctctcagctcatgttacctcctccaagaagccttccctcatgcccatctaaagagttcttcattagtttattctttaccacagcaacctgctgtttccttatcacagtttggaaataccatatttataagttgacttggttttaatgaattttatgtctgtgtggtacaacctggtaacttctgcttttagactagtgcttggcacaaagatagtcaataaacatttgctgactgactgacttgctgaataaatgaatgaagaacagttcctagagtcgatgaaagctagaggcctacggcttagagagacgaaaacatagtttaagaagggaacaaaagcctaggcaattggtgaagtgtctcagaatttagtgaacttgaatcatgtcagtcaatataatcagtgaaaggggtctggcgtcagtggttatgtgtgagccaaagggagtcaaaagctatggtgaccttatcattggatacggaatttgtacttagtatgcaaacatataccaaacatgtgatatatggttacatcataatttctgacatttaaagttctcaaaataacctcaagataagagtgctccttctgtatttcagaaatagtttactacagtagataagaatatcactctgtagccagactgcttgagtttgaatcctggctctgatattttcttagaaagtgggaaagtggctgaacctcttcatacctcagctttcccttctgtgaaatggagataataatgggtcatgcttcattgggctctgagaatttaatgagttcataattgaaagtgcttataacagtgtcaaggacttactataacactatagaaatgttagctaagagtgctatatttccagaaatgccaggaaactttgcattgtgagccgatgaactctgagaacatgcttcccagcaatccagtactccatggatccaaccacatgagagaactcatgaaaatttgtacagatagagatgccataatttcattgctattattaccttaaaaagaattcatttgagaggctaattagccacacatacaagcctttagaaaatacacagaaaccttgaacaaagctatggtcaactaaatgaatgtgaaatctgtatcagctctaacagctaatttcacaatttgactgccttgcaatacctctagagatagagctcttagaaataaatgtttctattaacttttatttggatgttacttcattatgctaatagtctccctattgatcaactctattcttcatttttgtcaagactcaaagagaactggtaaaacattcaaggactaaaaattaaatgaatacgagcaccagcataagtactacttctacctcaccattttcacctttcaacatcaagttctcagtgttttacagaataattaagagttcgccagacagagtcactaggagaagacttcctaaccattattagcctaataacctctcatcctgatccttcctctccctgcagttagttacacgctactccataccatatcgacacccacctctatacttgtctgactgtattttaactcttgaccacacgtatctgtttaccctattagactgtgaattcctagaggccagggccatgacagactcatctttgctgataccctgatgaggctctatcaaattgatttgaagttcatgaaagactacgttcatgttaaatatttggcatctaatgtagtatttcaaacagcattcctattggaaggtaagctctttgaaagcaatgatttttaactgtttggttcactcctccatggatctagaacaatgtctgacatggtgagcactctacaaatattgagtgaatagaggatatcttataacctaaagtgctatttacagttcttgtatcataacaggcctgaggatgaatcagaggttgcaacaagcacatgaaagtagatgatgtccttgaagaccgtttgctttcccatgtactctagtctctactttgtctactttgtctacatagagcctctaccactatggccttagtgacatctgttcatcctagtgtcttacgtcatcctggttaagtggaccacggagcactgagcaggcaccatggcacagactcatgctgctccctggctgaatgtttctcatggccaatttattctttgaaagtcaagtcctgggaagagatttttgctccctaagcccttaattggtaatacatggtgtgtcatgactgcctgaccactactgaattatgtcagtgcactaataaaaataatgaactttagtaatattgttcttttaataaaaactagtgggtctgtttgactcaataatttaaaactagttttaaataataaagaagatgaaaggccattattatcatgtcctcctagcatatgaacattcacaggtaaatcctatgaagttaaaaaatggtggcattttagtagtctaatgcctagctaaggtatttatttcattatttctaaggaaaatgaattctgagtaccaaacagcccacctattcatctcttcttcccctttctcccaccctctacctctattttccatccatctacacacccacccactcaccattagagtttctatagcgatccttatactgggctagggaatagatattcaaacatggattaagaggtggctcctacccactagctaactcataaatttggtacatacattgtttcatggaatgtaataaggtgttaagtagaaaagttattaaatcagataatacatccaaaggaatcatttgatgattattgcatttaagatatgttaagtacaaggagctagatatacttgtgtttgaataacacaaactgactaacgtaactgctgcataattgcttttactctctaacatgttaggcaaaggaatataatttgttgctttttaaaaattagattatttaggagtcagaatgtaatttactgatgtctttttaatcttttttagccattagttgaaactgctaccataaaataaaaatggcaaggaaaatgcataacatatggcttatataaaattgttacaagagaagtgtatttttgactgacttaatattttaccagaacttgcaccccatggaaggagagaaacagaggattataatgtcaatttgtcactgggattaatttcataaagaatttatgcccactgttgtcctgctgagaatacaaaataatcatgaaatgttgttacagaacctagttaaaatgttacttatctcccctgaggaaagatgagaagctactaaaatggataaatcttgtcagaaggtaacagttcacccttgtccaaaacacatactaatttcccacttattaagcaactaaaggacaccaaagaaatactcaggaataagaagcccaagtaccaaacttgctggtctgtagacttgaagcacatgggtgttccatggctgtttgctcaatgcctggaagactcgattctgagtttccttggctgagaagaatatttattaaaacaagttagaataactaatagagttctagaatttgattcatcatcagtcaggggcaggggatttggagagaggaaggaagtgacaaaagatcaatgccaccatcttcctccttgtagaaaagaaaggggaagtcaaattttatagcaaagagctcttgatgcttcagtgcttcaatttacttccaaagaactccattctagccattggaaaagagtcaaaaagttgtactaatggaaagcttttgtgtatattgagagatattggatactaaaaggcactggcagtaaagcttcccactttctggcattattttgatctcatgcttctactttatttaatggcgtcatctttaattaaagaagaattatgcttctgaattccccagagtcttactttcctcaccaaactgaagtgtgaggagcccacagtgctgactctaaacatcatcttctttgtctgcaaaacaaaaaatgccagcaaggcacttctgggtttcgcacttcccgttaaattttataacatttgcctcccaaggaacaacactctcattcaaggaaaacaacctcctagtctggtgccaaaagtctttggagaaggcctgaattaccgcccaccgttaagagcaaagtttgttcaagcagatgcctcacatgaacaaatcaaaattcagaatatcataaagactaaaacattatgctaaaatagttcaaataagtgaagtaccaccacatgggaaaatgaaagaacaaaatcgcatcctgaggcactgaaactaaaacgtctataaactaaaaaagtctaaaatgcaaaataatcataatgaaaggacctgacacccaggaaagtgatcatctgttgcatacttaaatagtttaccctggtaaaaagaaattattctctcacttagccctctatatagtttgacaatttgttaataattatctaatgatcacatcctttaccatgatgcgcagacatagtattttcaaattcatcaaaccagcactgtagtgctaggaccaggtagaacaaaagaactggaaagaatctacttcccttatctcacctgaaaatgggcaagttagcttagccatggctgccagtctaaaatagctccgtatcacctgtcttctctcttaagtcacatagatcaaaacccaattaaatatgttctaaaaatactcaagatcaaaattaacatttgactaacaccttcactgttatctctttaggccctcagggagattggtgggcaggtaggaccccagctgatgtgttaggtgacctctacccccgttaggcaaccacctagataatgtggcagtcctcacaccaccaaagaaacatctgggaaacatgtcccatagcttagggttaactagggttaaattcttcttttacagctgaagacataagtgacatgatatcaaggtaggtgctacagattcagaaaattaaaaaaaaaaattaaaccacagaatatccagtgaaatttggatttttgaatttcagataaataaaatacaattccataaataaaacgtttttgtgtaagcatttcctgataatacttggaaaatatctttactaaaaagaatatttgttgtttatttgaaattataacttagctgggattcctgtatttttatctgacaatctgaaaaaaatcttcctttcatctttatctgcctggatggggctgtggggatgagagtagaaatgaagccatcggacatcaccagtcacattcagatgtttcacacttgcttgttgggggcactgctaaattcacttctggtagcagcagcctgggtgtataatgcaattttaacccaggtatcatagcttctcattactctggcccaagccatgcttccttttgacagcacaaagaaccaggatcttcccataaagttgccaaattcatgcctgctaatatttgaccttctggcctaagaccttggcagagatgctttgctatgagttaaattatatctcacaaaaaaccagtgtggaagttctaattcctagtactgtagcatgtgatgtttttggaaacagtgttgttgtatatgtaattagttaagatgaggtcatcctagggtaggatgggcccctaattcaacatgactagtatcctaataagaagggaaaacttggacatgaggacaaacatacacacagggagagtaccacgtgtaggttggagttacactgccacaagccaagggactaccagaagctaggacagaagcctgggacagatccttccttggtgccttcagaaggagcatagccctgcagacactttgagctgagacttccagcttccaaactgtgagccaataaatttctgctgtttaaaccactcagttcatggtatgctgttagggcagccctagaaaactgatatatacaacaagtcagcattgtctttattcttaaaagttatttattttaacttttattcttgttataagaactgggctctaggctaattattttggccaaagcctgccttgtaccccagtcttagccaattccatcccaggcccgaagctctgcacctactcagtattccatatgcccaaagaatgaagtcccatagaacccccaatcattaagacactacagactaactcataaatccagatacccagagtgggtccctagtggtcacccagatctgtgacagtgattctgtctacctgctgagatgatcacctaccaggggaacactctgctggcattccttcaattaccaagacttcctccttaggttataggaagtttgacctctccaaatttctgttctttccgtgaagggtctctgagctcttgttctctgccatctcttatacttgaccaagtgttttgtacttttaagtagaaatataataaaatatatatttgagatatactatgccactgcacattattttaaaagtacaaattgaaagaatgagaaatgatgagatcatgtcctttgcagcaacatagatggagctggaggccattattctaagcaaactaatacaggaacaaaaaaacaaacacaacatgttctcacttataagtgggagctaaacattgagtacacaggacacaaagaaggcaacaacagacaccaggacctacttaaggtggagggtggaggaaggaaaggatggaaaaactacccatccagtactatgcttattactggggtcacaaaataatctgtacaccaaacccccgtgacacacaattcatctatatgataaacctgcccatgtacacctgtacctaaaagttaaaaaacaaaaaaagaatacaaaatgagctgcaagagggtatcctaaaagcaaagcaattgcttgtaatattaagataagttttatctgaaattttgggcaagtaggtagtttattttctaagtcagtcttaggaagttttgaaataggattcaccgctttctgggtaagtcttaatatagagttagattaattctaaacaatttaaacaggtatttctcaaaatgtggtccactaaaccgtcttcatcagcctgttaccatggcaatgtcctgggatccactttagagctagtgaatcattcagactcttgggggataagacccaggaatttgctcaaaaagacttttatgcttattatactgagagttgatataatttaaagtgttttggtggcaatttaactggaattcctgtattttatctggcaatctttatttcctagggatgtaaggctaaaactccaagtactctcctgccactccctttctacatttttacaagtttgatttgtgttttccagtttcccaatagctcctatgttaaaatttacagttgccatcctatagcctttcaaagagccccatgcctctgattgcagcaggggagtgagggagccacagactgaaggactgtggccctggttggtaggaggtggtatccagggataaaattagtaataaacaaaggaagctttcaacttgtttgcttaagggctccaggttaaacctatgatcctgggctataattttaatgtgtgttttctaaacgtttaaatttcattaagcttgttttaaaaaataagactggggtagccgtccagttaaacctgaattttagtactagaagaaaatcctggagcttttcctcaattctggccgttcaacatttaaatgaaaagaaattaatatctcaacagggaaaagcactttatacccctttaccttggaaagttactacagcaaagtaaaatgtggcaaagaaatactctcaatactaaaataagtctgtttgttattcaaaaagcaattaatctatttttggcacaaaatgatacactggtaaatgttccatatttttacatgaaaatcaaggaaataaaacatactttggagaagtacagacggaagcttgaagtgacaattatttccagatattaccaaaagcatatgaagcatgagctcttttcatgggttttaaataagcatatctccacccccacttaaatcagaatgacaagctgctcagtcctataaaatcatgcactccaaagtagacataactcaaggtatcatggggtttatgaatgtgctgttcatatgtgaatataaaactatggctaaacacaggccatgagcttcgggattcttttttggatagcggggaggagtgtgagcactgccacctacagcctctaattgctgctacttcaagcttaatacgcacaggaatcacctggagatccagttaaactacagattgagattccacgactattgagagaccacgattgcaggctattgacagaccgcaatttgagaagcaaagctccaatctatattatttgtgttagaaagaaaatgaggaaaggagaaaccgaaggaaactcaaaaagaaggaaagcaatgttttcttttgtttcctttcctgacctaccaggtaccaagcagtaggtgaggggctctgactcaaaaattacaacacaatcctttaaaagtgacgttgtggccaaatgcgacctccacaactcagaagacagtcaagaattcacaaaatgttggaagctgaaaagcagaaccttgaagggaagatagaaggaatgtattatgtaataagattgaatttaaggcttaaaaggctattaggcagtggatacaaatcatgtgtcttctacatccacgattaaatgtcccaaacttgccgtatcataagattaaccttgggcttttggtaaaaaagtatccaggttccacactgagctgctcagtgaacccaggttattcacacaattcttcttatctatgacttcggaaaatactgggtttttattctgttttgcttttagggatttcaaatgtttaaagcttgaagtgatcttattctgctccaatatgcccaaggaatacaacacaatagaatagaagagaaccgtgagggcccacagcccgagacctgtccaagattacccggttactgtagtagtggagccaagactagcttcatttctctagaggtcaaatgcaatacatcgtatctataaaactaaatagaatcattttgaagcagagaacaggaatcaggaagattaccttcttcaaaaattttaaagagataaactatgattcaatttagcaatcattagctattctgtgcaaggcattgtattaggacctgcagaagacataaaaatggacgaattaaaaatctctccagttctgagatgtctgaggactgagtatcacccacttgacaaatacaatcaagatgctagaacccacagtggttccccttccaccccttacagaatgattcctggatcagactcatttttgatgttccatgctttacaggagcagaggtcccccctacaacacacaccagtcagtaactataaactgaatccccaccatgtgaaaaagaccataatgggtattaatgtgaaaaaataaagagaagttatagaccatcagaaagctggccatctacttgggcttaacagacaaaaagggaaaaatatgaatccacagtgttttttgttgttattgtttgtttgtttgttttttgaaacagtcttgctctgttgcccaggctggagtgcagtggtgcaatctcaggatctcagctcactgcaacctccgcctcccaagatcaagcgattctcctgcctcagcctcccgagtagctgggaccacaggtatacgccaccacacctggctaatttttgtatttttagtagaaaaatacatggtttcgctatgttggccacgctggtctcaaactcctggtctcaagtgatcacctgcctcagcggctataatacacaagctggagctataatatttctttcttttggtgtatcttaatgggtagttcactaccaataaagtaatcatggttgctcagatgggttctttgctattggtttggaaaattaagttttccaatggagtgtttcctattttgtggatctttttaactgtatttactggatcctccctttttgtagttcctcttccgagctaatcaagattattaccaatccttattttctatagaatatatacaggcatttatttattctttacacattcagctacctaaaacattcttgatgactccaagaatattgaagattgggaaaaatatttaatagtattactaataattgacatctgttgaatacttactatgtgccaggcacttttctaagcatttaaaaaatattaactgatttaatctttataaacagctctagaaagagactgagacaaggagaggttaagcaacatgtccaagcccacgtaattagtaagtttgtgcttcagctcagacaatccaactaaaagtgcatttcacagctagtagtagtctattaagcttttgcatgctcctaagaagtaatgtggtgtgatagaaagggctgtctttggagtctaatggatgtagattcagatcttgcctgtgttgcatactagctatatccccctgggtacaggcttaatatcattaggcctcagtttcctcacctgtaaagtaggatcaataatatctactgggcagggttttggagataattagaagcaatgtgtgaaaaaaaatattaaaacaatacctggcttataagcaatgaataaacattagttagctaccatgatcgtctataataaaaatcaatattttgacttgacttaaggctagtatgctatacatgtacttttaatgcaatataaattatgcaagataaaaataagaaacttctatgtatctgtccacacatgcacactatgtaattcagagtacatatttgacaccaatcaaaatataaaagtattatgcaacaaaagagtagaagcaaattatacatgacttggaatactttataaaattgtgaatgtaatgagttctttgttggcttgaatttccacacatttaatattctaactagaggaaattattagctcttaatacatccacttgaagagtgcttatacttaaaatatcattaatacatctttcacaattctcccattgtaggcatatcttgctaacatgaaactttatatagacagggtgggtagaaatatgcttaagaaacaggtgctgggtaatcagatcacggtagttaagcttttagtggttttgaaattatatttcacaggttgcttatctacctaagatttacaagtatataatctaggtaaaatgtatgctatctgaatgacattttaaaacataaaacaatggatacaatgatattctgacttaaatgaattatcaaggattaattcatactatagatgtaattttcaccttatcttagtatttaggctattaacttcttaatagtgagtgggatgtgcagaaactgatcttttgctctctgagtctctactaagtgtatttctgcattgtttgtggaatagcggactcactgagtattccagtaccattattgtggtccatattttgtgtcctgctttgacggtaataattcctatcttagtgatgttactctcgtcagttctctgggggaagtaccactttctaaattcccccatagtcttgctcctggattttcctgaaaaagaatgaactccttcatcccaatacacacacacacacaaacacacgcaaatacatacgtatttctaagaattgatctctcaaatagtgagtatgaaaagaaagttagagaaatatgtagtatgatttcatttatataaataaaaatacactatgttttgcttatagatatatacatattcatataagattaaaaggggattgaaaaataccagcttcacagccatagagtctttaattttatctatattctattttcaggggaaaaataagactagaagcaaatatcataaaatagtaacattaattatagagaatggaaacagaggtgtatgttaaactttatgttttctgtactttaaaaaaatcataaaaatattaacataactaccatccaaagtagcaaaattatgtcacagaaatgactggatgtaaaaacctttaaatgggcagtacaagccattttgagaaaaaaagttctttttattttgaaaattcttatttttcctgcagtgtaatgcagtgggaaaatgaatcatttggaatcataaaggccagtaaatataattttttgtttttatgaattagtattagatacactttactttccatattagatataatttactaaaaaatttaacatctgattatagtacacacaagccacttagcaaataagaaaggcattcagccgaaattcattcatctcaagattattttaaaatacttaaatagtgactaagattgcctcttagaagacaataattctcttttattcagcaaatagcttccaaacttcctgataatttgggacaggaatagtctccctttataagctcacccccagctttaccttggtaaatacctttagatggcatttcgtacccagatttttccgagagcagtcaatgcagtgacaaatgcagctctctgagctctgtttcatgtatttcctcttttcaacctcagtggatcaccaatgatccgcaaaatgtcaaaccggaagaatgggggttaatggtggacatgatgagacctagataagcatcctctgaacaacatttactctccgtctccatttcatagaacttattccaacaactgaagccttatttataataaaagactaactttatttccattaattgggcctattttaattaaattacaacaacaacaacaacaaaaaacctaaccaggcttctcaagataatcagtgctctgactgaaatccttttcaactcaggaatttttacagccttattgctattcatattctaatgggataaaatagctgatgcttcggctcgttgctcttagtctattaacacccttcccaataattcaaatacataaattatttatgattgattcttggaacaaagctagaatttaatgtgatattacaatgttaaagaagaaatactgcagaagaatacattcctgcttttgtgtaaactgttgcatagatgtttaaaacataaaacatttaaatggattcacattattgcacttttgctaatcccatgagtcaaaaccagaattatgaggaagaattctaatatgcaggaaaaagagtgaagaaataagtgaattccagtcctgggtctgtaccacacaccttacgacctttggcaactcaatctttctggactctttcttcaatgaaacaatgcttctaagccctccattgcctactttccagaactgttacggggttcaaatgaaacgctgtatgggaaatcattttggaaattgttaagccttctacaaacttaaactataccacttcaacatagaattaaatgaaaaaataaatggaagaggtatggataaaggtgtccatggagggaaaattgtgagaattttctcttcccttcctgtgcctttcattattgtagatcttcctgctacacaggacaattttttccttttacctcactgaagggataattgcaaacagggttttcaggggacaaaaagagcgatgatatgctctagggtttgacattctctttttaaagatccacaattccttgactccagagctgggtctactcaacaatgcctccagctcccatctcagatcctgtgtccaggaccacccttttcacccaggcccagggacttagaagctcttgccattctagtgacaagcatatacatgcaagaattgagttaagactatcctcttaaccaccattcaacccagcaatcccattcctgggtatattccccaaaagaaaacaaatctttctactataatgatatatgcacttgtaggtccatcacagtgctattcacaatagcaaagacacagaatcaacctaggtgcctatcaatggtggattggataaggaaaatgtggcatatatatatatatatacactataaaacagaaagtaatcatgtcctttgcagcaacatggatgcagctggtggccattatcctaagtgaattaatccaggaacaaaaaaccaagtattgcatgttgtcacttgtaaattggagctaaactgtgggtactcagtgacataaagatcgtagcagcaatagaaacgggactactagagtggggagagaggaaggagagcaaaggttgaaaaactaactattggatattatgctcactacctaggtaatgggattatttgtactcaaatctcagcattatgcaatatacccaagtaataaacctgcacatgcacccctgaatctaacatgaaagttgaaaaaaaaatgaaggaaaaacaggtcaaatacaaaaaaaagactatcctctgaaatgtacgtagaaatctcagttgagtcagtttcatacccttagttatatcttagaaaccttatcttcccaagatcagaaataagaggagaagagtagagaggagaggagaagaaaaagaaaatgtgcagggtggtgacagtggtcatgggatgggtgagggaaggagaagcataagtaggatactttctatctctaggcagctttctttcatcactgagtaaaacccctcacactttctcaaaaggaactatgttttctaaggcaagggaaaagggaacttgagatgctgttctagtccataaacccaggatggagagaaacccaataagaagcaagaaattaaggtaatggaatgggaaagtaggcagctcagccccaagggtctttggtgggacagaaaagagacattcaaggagtcattttggaaataagtgtttttcgaaggtcacagatcccaagcctggggctattctttgcttatacctcacgtgccctctagctctctggtctctttagtatgatagtctctagagccatgagcacactcttctcatctctgagatgagatctctgcctctttgggacagctactccaggtacctggagctagaggggaacataatctgtgctacaggggaagtgaagaaaggaagcacctggctctgtgttagcagggctgttctggcattctgggtgactagcttctgtagagctgttagaacccggcacacttttgaaaatcagtgggttaaacaggatatgggcttccctaggaagctggccatcattcataaaattattcatgttggaagatgcatcccaacttctagtaaacaccttgcagagcataatttacttctaaacttgagaagatgaaaaaagtttttttaaaaaaggccacttttgcagatataccaaagaaaggagtaatatgaatctttttcctttctgtaataactaaaaaattatcatcgtctgttgctagtttatgagtctatctaaattgactttgttccactcagaattttagatgacatattaaaacagaatttaaagaagaatctggccgggcacggtggctcacgcctgtaatcccagcactttgggaggctgaggtgggtggatcacctgaggttaggagtttgagaacagcctggccaatatggcaaaaccctgtctctactaaaaatacaaaaattagccaagcgtggtggtgcacacctgtaatcccagctactcaggaggctgaggcaggagaaaatcgcttcaacctggaaggcagaggttgtagtgggcagagagcatgccactccacaaaaaaaaaaaaaagaaaagaaaagaaaagaaaataatgaagaatctgtcctcaaatgtacattttttttttttttttttgcattcttaattcccagcatgaagccatgaagccattaggcctttgttggtccttctcagcatctggcaatgccctgtggttgtgatggggacatgctggtcatgggagatgcattgacatgagtataacctatgactctatgacatctttctttttctcttttatgccaaatacagacaaagaaaagacttaaggaaccaaataaacacacagagggaataactactagcaaaagagataaataagggaaaaacataataattgaaaaaggagttattaaaaatggagtaagtttccagagtcatattagtaaaaagattgtctttatacatgtttttttttgttttcaatgtactttcatatcaattttcacaaaccccttaagggtttttttttttttttttttttttttttttttttttttttttttttgagacggagtctcgctctgtctcccaggctggagtgcagtggcgggatctcggctcactgcaagctccgcctcccgggttcacgccattctcctgcctcagcctccaaagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggattacaggcgtgagccaccgcgcccggccaagggttgtttttaataactaatatttattatgtctttgtggaaggcactgtgttaagtgcttcacattcactgactcatctgaaactcatgacagcaccaggatgcagttttatggtgatcactgctcaatacataaggacactgagtcacaggcatatatgcctcaggttaaagagctacaagtgaagggttagggcctgggctttgattacaggctgactctggagcctgtgtacttcttcactgtactaaccctgttttctgaggaagaacttgagattcagagaggtaatggttcttatccaagctagtagttagcaacttcaaacttaaaaatggaaagcaaagcaattggtagaaatgaaatttgaattcaagaattatttccattactttgatcaatgaatgggatttggtcatagtattgattcaacactatttaattctttacaataactgagtttttttagcctctgatgtctttatagaatcaaaactttactcaggcaagatttaagagaatctatgtgcattctttatattttctattgaaagatgtgtattttggtaaaaaagaattagatgctgggaaaacccatcacatttaatgccttgaagtattatggcttatttcaccccaaactttattctaactctcaactcttggtgtctgtatctctattttttttggttcaagcagcatgaagtccagttgaggctataaggaaaagagctttataattccctccctgcattaagcttcagcttcctttatagatgtgaaaatcagacaggcagcacaataagattaagaggatggtattttgaacgcattccagagtcccctcagcatgggattggggcaaaggaactgaacagtccccacatatccttctggtatctgcattatttaatttcagtgattacaaccctccaagccagaacaatcacccacattcaataggcacacagaaatacattccaaggtgtactgcaaatgatggcgattatccagacaatgttttcttatgattgctgggtccaggaactgatctctgttttattgtttttttgttttttttgttgttttgttttttttgaaatagggtcttgctctgtggctcaggctggactgcagtggcatgatcatagctcactgcagcttctacctccctgggctcaagagatcctcctacctcagccacccaagtagctgagactataagcatgtgccacctcgcccagctaattttttattttttgtagagatagggtctccctatgttgcccaggctggtctggaactcctgtgttcaagcgatcctcccgcctcggcctcccaaagtgctggggatacagatgtgagccactgctctcaggcagaaactgatcttttaaaattaaactttctctgaataatttttaaaacaaatttccccaacactgatagagaaattagctctcctacagatgaaaaaagaaggcatgtttacatggtgatcttgtggaatgtgactgtgccggggaaagccaaaccttccaacctcaaacaccagaactcagggatcttttaattttaatttccatttctagttccccttcattgtactatgtctctctcctgtgaaatgtttctattacagtaaacaaatccatggtggtgacgtgactattttcttaaagaacatgtaagctgcagaattctctccttcttagccaaagccaaaatgttacacgttaacacagaagctaattccaggatttgccttactttttgagatagctcacaaggaaacatttatttaatctgcatttttaaaaagaagatagaaaaggattgtttgatgcaggatgttcactacagcacactctttattcagacagggtcttattctatcatctaggctggagggcagtggtgcattctcggctcactgcagctttaacctccctggatgcgagagatccttctgcctcagccacctcagtagctgggactacaggcatgcagcaccacacctggctaatttttgtatttttttgtagagatgaggttttgccatgttgcctaggctggtcattttttatattttttattatagaatatttacccctagagtcctctaaagtgtaatccacaaaagttgttacctcagcccaattataacaagtcaaataactccacacccatcctattctccttatctccatcttccagtgggaggcagggagatagaattacaaggaacactgtgtgatgacaatgaaagcttactgtgggatcaaattatgtaaacacctgctttagcactaaatgcacgaatagttcatatccaaactataattcgtgtcttaaagtctagctattggaaaattataggctcccaagaactgtttatacaagtacatgctttagggttgacagacaatccattagaaacgaattgataatcaagcacaactaatggcaaaagtttatgtaagaacagctgcaactgacaactacaatctaaaccaaactaaaaattaaaatggacactaatgatacaccaataaccaccctcaatccagaaatccgtggagactctttctctgtgtgctcatgtatacagtaggagctatgcagtgctgccagttgtggtgtgacagctggacttcttgggagtctactaattttgcatactcacaatctggtgacatggtaactttatttacaaatacccaattttagtaacccttaataactcacttagtaggatactattaatagtaaatatcccatttgtagacataaaaatgaaatgtctatatagttacaagttatttggctctaaggacaacaataatctaatagtattttggatgagttctcagtccatgaggatatttgaggtccaccagaggtgcagtggactctactcagagaaattctggggtacactcactgataaaggcccataggtgtaccagtataacatgtaagaatgggatatggatgatccatagaagttccctttgatgtagaattgaccattaaccaaaccaacagaccacttggaagaaaatgatattttacagagttaataaagtattcaataattttccaaactgatttagatgttgatgaagctgcatataaccacttcaaaaatgatttggcaggtgccatttaaatagctgacctatgaagagttctattttttccaccctgatccaactgatcttgtgtaacaaccctggacattatatcatgtttctgctaaaaattcaatgcttctgcattttgtacaaaaaaagataaattttgccaattcatttaaaatttatataactgaacatacatctgaaaataataactattaaaactatttcaagaataattagaaaacttgaacactactaaaattattattaattaattaattattaagaactgttatcagtagttaaaatcttcctacacctaagaaatcatttcaaaattatacaaattattatgtagcataaaaatttatcattaattctttaaggccaataattgaatatcaaaatttgacatgaagattgcaagaaaagaaaaaaaaactggcaaatctcaatcacaaatatatatgtaaatattccaaacaaaatgttagcaaactaaatccagaaacatatataaatgataaaacagtatgaccaatatgggtttattccatgtattaaaatatgggttaccgttagaaaatcaattaatgtaactcatcaattagtagattaaaggcaaaatttatatgattatctgaaaagatatagggaaaacatttgatagaattcaatactcattaattttaagaaaatctagcaaggcagggatagacgagaactctcttaatccgataaaagcaattaacaaatatttgtattttatggtaaagcattaaaagcttttcctttgagattgagaaaagaacaggatacctactatcatcacttcaattcaatatttttctagaggttttaaccacagtatggataaaatacaaaatacatgtttcaataaatgatgctgggaaattgagtatccacacgcagaagaatgaaactagaccccaatttctcagcatatacaaaaatcaactgaaaatggattaaagtcttaaatgtaagactggaaattccaaactactagaagacaacataagaaaaatgcttttttatatcggtgtgggcaagtgttttttggataagacctcaaaagcacaagcaacaaaagcaaaaataaagaaatgggattacatcaaactaaaaagctctgcacaacaatgcaaacatcaacagagtgaacaatctactgaacgggagaaaatgtttacaaagtatataactaacaagggattaatatccagaatgtagaaggaactcaaacagcttagtaacaagaaaccaaataatcaaacttaaaaatgacaaagacctgaatagatcttcctgaaaagacatagaaatgatcaacaagtatatgaaaaaatgctcaacaccactaaacatcaagggaatgtgaatcaaaattacaataagatcatctcacttcagttagaatggctattaccaaaaagacaagagataactagtgttggcaaggatgtgaagaaatgagaacccatacacactgttgatgggaatgtaaattagcacagccattagagaaaacagtacagaggttcctcaaaaaattaaaaacagaactattatatgatccagcaatctcactactgggtatatatccaaaggaaatgaaatcagtgtgtcaaagggatatctgtttattgcagtactatttacaatcgccaagacatgaaatcaacctaagtgtccgtcaacagataaacttataaagaaaatttaatatatatacatacataatggaatacttttcagttataaaaaagaatgaaatcctgtcatttgtgacaagatggacaaacctggagggcattatattaagtaaaataagtcagacacagaaaaacaaatattgcatgatctcacttatgtgtggaatctaaaaagttgatcccatagaaagtgcagtggggaccgggggcggagcggggatggttttgaaatgaaactgttccacctcagatcatcaggcattagatgctcgtaaataatgtgcgatctagatccctcacatgcgcagttcacaatagggttcgcacttctatgagaatctacggccgctgttgatctgacaggaggcggagcttaggggtaattctctctcactgaccattcacctcttgctgtgctgccccgttcctgagagaccatggaccggtaccaatccaaggcctgggatgggggactcttgaagtagagaggagaatagtggttaccagatgctggggaggggtgggagtggggggatcggaagaggctggttaatggatacaaagttatacacagctggaataacttctggaattctattgcacagcagggtgagtataattaacaataatgtatcatatatttcaaaatatcgaaaggaggggattttgaatgttctcaccacaaagaagtgacaaatatttggggttatgcattagctaattaccctgatttgatcattacacaatgcatacatgtattgaaacctcacattctatcacgtaaatgtgtgtaatgattatgtgtcaaaaataaaatacaacatgaaaataaatgatttagaaatgaaaaaattggcattattcatagattgtctctatagaaaatccaaagggatttacaactaatatattaaaagaataaatagaaaaatacaatttctaaacagaaataaactaagatacatttactattaacctacaaaatatacttatatttttaaatattttaaatatatattttgttaggacatacttcaatgtttttaaaattagtttaattgatgaataataattgtatgtatttatgggatacacagtgatgttttgatctacatatacactgtggaaagattcagtcaaactaagctttccatcacctcactaacctatcttttttgtggtgagaatattaaaaatttattcctttgacaatttggaaatatacaatacattattattaatgtcactatgcagtgcaatagatcactacaacttattcctcctaactgaaaatttgtacttttcatcaacatcgaccctttccccatccctctggcaccctcctctcagtctctggtaaccacttttccactctctgtcaaacaatctatttcttaaactaaatttgaaatataaatcattaaattaacttgatctttcaacaaggtcgttcttttttgataaagaaagagaggcaattattctattctattaaatttatcattatcctatttaaatcaagttaaaattaatactttattcagcaagaatagaaaatgaaccaagacacatttgactccaaatttctcaagggcaagataatgtcttgggtagggttttctctaagaaatatccaatgagagaaaatagatttgattcacagaggagaaagagagagacagagagaagagaggagacagagaaagagagtcagagttggtggggtatgaagatatgttaatagaagggtaaaatacttaattccaacagacagtaaacataggaatctgatcacaattatttttaaaaaggaaatgaaaacaaaacaaaaccaaaacccagggacagtctagtctaatacgtcaacttcctcagaggcagatgacagatgtgaagataccttgcagctttatgggttaattttctatagtgtctaacactctgggacacttggggaacagtaaatgttttaagctgtcaaggacctgattggccgggatctgttttctacttagttcacttccatttcctttgctgttcccagtagctttctccatgtcggtttgcattactatggttttcacaattcggtcaaaaaataaagcttttatgcctaattaaacaccgagctaacacactttgtcagtcatttccactttgaaacttacgtttactgcatttagtctgtcctttccaatcttaccatacagggtctgccaaagaaattataaaaattttacgtaatattgtacctagggacattatttaatatcaatagtagttttttatagctaaaagcgaattaggcttagttccaggggaagattgtgagcaggtatctttttttttttttttttcctttcctgagagaagctgtgaaacaacagaacagcctgtgctacatacgtaattaaaacagatgttctcaatcttaatttttatagctaattatgacagccaaagaaatgtgcttgtcttttgtagagccacatattttctctcaaatgtgccctatttttctcctcacccactatgactgctcagaaacaaagggtggggtgatggtgagttacaatgcagctgcaaggactgtcaaattattggtaagtcagggagtggaaacagtgatgagtgaaattgaccataaactatctacatagcataaacatttgtacgtactcctaactttgcagatgacagttttcattggggtctttcatgacagaagccaagtttattgtatcaaacataataaagtaattcaaacataataaagtaactgcttacaagcacctttcctttgtcaacccagcctttgggagcatagcattttttttttttttcagaataacatacagtgtacagaaatatgctacattttgatgacacaggccaggtgacttacccgcaagggtgcagaatctgatatgcttgtctatgtatgtgtgtgaaaatagaaagcatacaagtataacgaaggcacccgttctcagagcacactcttctttgagctccttgtccttaggctcacagggatgtcaagttggggtgcttcagacacaaaaacaaatgacccttctgcccttttttttttttttttgagacaaagtcttgctttgtcgcccaggctggagtgcagtggtgcaatctctgctcactgcaagctctgcctcccgggttcaagctattctcctgcctcagcctcctgagtagctgggactacaggcacccactaccacgcccggctattttttttatttttatttttagtagagatggggtttcaccgtgttagccaggatggtcttgatctcctgaccttgtgatccacccacctcagcctcccaaagtgctgggattacaagcgagagccatcgtgcccggccgaccctccctttctgtaagtgctgccagcagcttggaaattacaaactttagaaaccacaataggggaagaactatcttcctgtttgtggtggagtctggaattttcccgcccttgtcaaggcactctgttgtgttgttatctaggttctctccttacccatctatcagcaccaggtccatggaaggcctactaggccaaagtcccaggccacatctgcagtcaggctaccctgagcccagcttgcctctcaccctctgaggaaggagcaggagctgcagtgttgctgctggcagtgtccctgctttctgcagcctcagcactgctgagtgcaacaccttgcacttgagtgcaacacctgctccagcctcctctagttctcttcttgtcaacggggttccaattctgcagtacagattgggggatacctttagggacctccaaacctctcagcttccacagccactctgattccttcataattgctctcaacactctgagaactgtttcaaacccagtccattaaaaaccattctgtatgctggcccagttcctctcagcaaagcccagtgtggtctgatccaaatccaagcactactcctgtctgctctgccttgggaagttgccctgtactgccttggcccagagagcaacactcaggaactcagcaactacctaccagactttggccatgtgtgagactggggcagactgtctagagagaggagtacaaaggcagtcccagctgcggcttggtgaattcatcccgcagtagttccatagcctaagagggattgcagaggtaggaacaacaaagtttaagaagcagataaagctcattctgatcttaactagggactatgtgggaggggctgacttggttaaggtggttgggagagttgggagaagagtctggcatctctcagtggggaggtggcaatgtattggttcaagggaagttccgtgggattagggtaccatgggatgaacctgttcccaagatgaggaggcaggaaatcagagccaagccaaatggactggaacaaaggggaagcgagaggaagggtgttcatccctggagagaaatgttgaacaaagcacatctgagcagcaattcacatacagagcatacttgtgaaggctaactgtgaaggctaaccaggaaggctgtagccacagggatcctcagctaacctgggcatacctatgacaccagatccggagcctgaggcagcacgtgcagcccaagagcgtctgtctgaggtacccgctggcttcgtagtcactgattaggagacaggctggatcagaatcttctggagaattttggtgctgccagatgctgtgctgggtactttacatacattttctctaatcctcacaaactttcaaacagcggggaaacaaaaagtaactctacatatccttggtctcagcttaaaagtcactttctcacagaggacttctctgagcctataaatataagttaacttccccttttattctctatataatattctacttttactgatgtccctcagtatagcttataatttgatatgagtgatattcatgatgatttgttaacaaacattgtgtccatttctcctccatagtttctgggggcacaagctcttaaaaatatttctgtatccctgaatgcaagtggggaaatgcagtgaaataaccagtgtattgcatgtaaacatagagatgttgtagattgaaagtttcactctgtgaaactgtggccactgcacagactaatgtatctaagaaccagaatggcactcatactcacatgaatgagattgtcttaaatacaacttaccactgactagatttttgttaaaatctggcaatcatatgctagaggtgagtgatatattttacttctctgctaggcttccaagtaaacaacaggtagaaatatatacatgtaaaagtccatctagaggaattttaatagatccatgagaaaaataaattttcctttagagtaaacaagtttagctgtgatgtacaggtttcttaactattagatttctcagattctaatatgaaacaatgccaattttcctgtgtgtgtgtgtgtgtgtgtgtgtgtgtgtgattggaggtttgttggcaaattgatgctaaagcatatttggctttggttctggaagaaccaatgtaccccacctcctatccagagagtttgacaagctgctcctgtattccagtaaaatcaggatcaagaagcattctgttggttctggagtacagtaagtcctaccctcttaaccctaattggataaacactaaacaaaacaaattacataaggctgggggaatataaacaagagcaaacaagagcttgtaaagactccaataaatcactctacttgtaacattcaccctacatagtacaagctttttcaatttttgccaaagactgtctcacatgaattgatggctctacagacattacactagtgttggcttgaattatgatcatgtgaaaaaggcttgtgcattgatcatgtgaaaatattgcagcacaaaggggccaatattatactctgcatctagacctatggttactagctccaaagaagatgttttcattctcatgttaggaggaggaaactaaagcccatagatgtcaaataatattctcaaagtcacaatatatgtttggagctagattcaacctcaactgttctagctccaaatttggactctgcttagcaactatttttttttttttttttttttttgagatggagtctcgctctgtcgcccaggctggagtgcaatggcgagatctcggctcactgcaagctctgcctcccgggttcacgcctttctcctgcctcagcctcccgattagctgggactacaggtgccggccaccatacctggctaattttttgtatttttagtagagatgaggtttcaccgtgttagccaggatggtctcgatctcctgacctcgtgatccgttcgccttggcctcccaaagtgcgcttagcaactattttcactggagatatggaggacctctttctcaagccctgtgccacatggtccactttgctccttgttacagctcatcacactagcccatggtcacaatgaagcttgcaaggccttctttcagcagcccagctatcctgaacagctgattgttctcttttttagggagttagtcttaattttttgtcagtcttgggcataggagagacggcgtccacattgtggcacttgccaaagctatcctttggttagcagaatctcagcttcctcacctcattagatttctctcatccagactcatggctcaacttctctttgctgctgaggcttggctaggatcctttggcttaagactaagggtacccattcattgctgcattttgtgactgctctccctcgacactgtcccccaccatctcctcaaccttactgagtatggagtggggaagtaactgactgcaccctgactagactcccagcatagggtgttctgtgagttcacctacaaagatctgttgttcacctatatctttccaagtggttatgcccatactcaaaaggtttccccaagatatggaagaagatgacagtgctaggaggtgggagcacactggatatgctacaaaaaggtaaagttgagagggaagggcaggaatatggaacacacaggagctcaggtgcctcccttcagtgtttcctggttgataccctggttgttggcatcatcagaccctctccttgaagcattcttggtgccccaggttttcttaacttggagtgtgtgttagaattacctgggcttttcttaaaatttatactcttgctcatgcctgtaatcccagcactttgggaggccgaggcgggtgaatcacgaggtcaggagttcaagaccaggctggccaacatagtgaaaccccgtctctactgaaaatacaaaaaaaaatttggccgggcgtggtggcgggtgcctataatcccagctactcaggaggctgaggcagaagaatcgcttgaacctgggaggtggaggttgcagtgagcagagatggtgccactgcactccagcctgggcgacagagtgagactccgtctcaagaaaaaaaagaaaaaaaattacactcttgggctctacccatgacctaatgattcagaatctctcaggcgtaggcctgggtacatgtagtttgagcaagattccctggtgaatctgctataccatgcagttgaagagtcactatcccgtaaggtgaaggccaagccccttagcaccatccacttgaaggtgtagaggactgagcactttgaagtgctgttgcttgggtgtggccacccaacttctggaggggccactaagagagatggctggcaactcctagggcattactactttgatgacaaaggtataattaatagttatagagtattgtttagtaatcaattgtcatttgttttgctaaatgatttggataggtgtatacatttttgctaatacaataatttgtatttatgaagtttgaacacgcatttatttttaggatctggaaagttggagcgggtgaagtataaccaatcttaggtgtgcacaagtggttaaatgtggacctatctgtgtgattacaagtatatgtgcagtgccaagtgaataaaaatgaaggcagactttcaggtatgcggaaaagcttctaggtagaatctatggttctacgtagggcgtaaaatatgtccttccaaaaaatatggctcaaaaaaatgtttcgtggccacaaggaaattaggtcaagcttaaattgatttatgctgtgcacaattaacattttaataagcaggaaaattgaatgcagaatttaaatactaaattcagatagggatgatcctgttgactgatgttgtaaaaagattgcagaggtacatgacagcaaccccatgcccagcttggctctgtcgggagctggctgtataattttggaaaagtcatttaatttgcctgtggcagaatattttttatttgcaaaatgagagggttgagctagttgatctctaaggcaccttgtactatcaacattttgtaaatatgaattatacactattcaggtaaagaaagagatcatggacattttacagctggtacaacactttgaactgctttgactcattgaactgaacttttaaaatcaaatgggtactttacatacattttctctaatcctcacaaactttcaaacagcagggaaaccaaaagtaactctacatatccttggtctcagcttaaaagtcactttctcacagaggacttctctgagcctataaatataagttaacttccccttttattctctctataatgatgtttggtttttagttaacttatcaaagtgatgtttggtttttagttaaccttctccttaattttggtttataaaacttcaattaaaattgtaaaatgtaaaaataatctctcacgaaaacttgcaaaaataatagatacaatgaggaagaggtcagaatataatgggaagaatattttaatgcagcaaatatagttttcagtccttaatttctgaaaaaaaattaatgtctgatatataaaaaaacacctagatggagacgctgctctttgttttaaagctcctgccatgtggtctaaaacttgtgtatatttttaccttatttagttatatttgatcagataattttacgtaaaagttttatctttgtttctaccccttagaaaacttgaaacaataactttcttaacactttctctcagaagtgactattcccattatcagtggcttcctagtggtaatctggatacttgtggaattgttatatagctttcaaaaactcttgaatattcatatgctgtgttatttttcaataatttaaaaccagtaataaggctacagagacttcctctgtctggtgtattaatgattctttgcagctatttacacatttaaagtacagtagtccccttgtcctcaggaaatatgttagaacacccccagtggacgcctgaaacagtggattgtactgaaccctatatatgctatttttttctatacatatatacctatgataaagtttaacttatcaattaggcacagtaagagataacagtaacaataataaaatagaaaattataatgatatattatgataaaagttatatgaatgtggcctctctctctgtctctcaaaatatcatacagtaccatgggtaactgaaaccttgaaaagcaaaactgtagataaaggggtaatgactactgtacacatttgccatgaacattcatttgtttacattaagcatagcatttttcaaactccaggtatgagcttagtgaaaattttccaggtggattaaacttagaagtaattgtttcagaattgatttcaagattcacaggaaccattaagctgaaaaaggaaaaaaaaaaaaaaaaaggaatccctatcttaaaatagttcaaagactgctgggaaatatgagaacgagtccttcattgacgaatgttgaaactgagtctcagactgcagttacatggagttaaggtttccagtgggccagggtaatgctgtccactgattgctgacttagaacacgctatttctaagcgagggaaatcaccaccagaaaacagtgagccacagaaatcaaatgtatttcaaataacacaacgcatctgtacataaaggaatagaatgtcctcaaaccgtgaaaatatgctattttgtttaggggtgggggaaaaatctatacgataattggtttttttcttttttctttttgtttttaatgactcctttgggtcaaagccaaatgtgtaattaccccagtacagttgtttccattgtttaaaacttttcaccctatttagttgtgcttgatcaagtatttttacaggaaaatattttctgtattccctccccgccttgtaaacttgaaacaataacatcttaataccatctctgaaacttgcagaatttcctaactcaagcctttagtcaccttccttattttggaaatgatcactcacaattgactaattgtgccaaataaattttgattcccagactcttagtttgagttctctaatgaaatattgtggggaagaaagctcccattccaaaatgaaaagagatgctatatacttttgtaaacaagcatttaaaaatgatcttaagagtacctttcttttttgatattctgccatgactgtttcttctgcatcttggttattttcttcataataaattataaaatagtcaaagtttaacaattctcattaatttaggtgttcaaatttattttgaccttttaattttatcccacctctatctgtctctttttttctctgcatatgaataatgtgtgtaaatatatatgtatatatctgcacacatttagcttttgaatcaaggaagtaagcaattatggttcattatatatactttttttttttttgagacggagtcccactctgtcgcccaggctggagtgcagtggcgcaatctcggctcactgcaagctccacttcctgggttcacgccattctcctgcctcagcctgccgagtagctgggactacaggcgctcgccaccacgcccagctaattgtttgtatttttagtagagacaggttttcactgtgttagccaagatggtctcgatctcctgacctcgtgatccgcccacctcggcctcccaaagtgctgggattacaggcgtgagccactgcgcctggccagttcgttatatataattttaaaaactaacatgaaataggaggaaaggcttgtggcaagaaatggcttatagctatgttcattccacattgaaaactatcagacaagaaaatatgagatgaatttaggaaaactctttcacatctcatacatcattcctctgggcccacattctctagtctggtcccaatccagtgtcaggtacatgagtcatgactcaacagatatgggaacaccttcatttatccctatcatccatctatccatccatccatccatccatccatccatccatcttgtttgcaagacccgaggaaacatgaaggtttgaaagttacccaagaatttcaaagataatttgtggagtctctggggaaagcaaatcaaaatggacctagttgtataacagacctaaacttctccattctacaattcgttcaatgtgctccttcccaaatgatgactttcaccaggaaatgtttagggaatgaacagaaaaaaggcagacattacattaatcttctatcaaaacacaaaattccctaaagctttcctgggactgtatcagataactaaatatagactgaaaattgtttctgccccacctgcacatcaaaaacaacaacaaaaaagggaaatcttgttgtatcaccaaagactatgatcacctaggagagctctcagttatgtatgctcattccagacatattttgcgttaataaaagcccccatcttatgtaaattcacgaacaacttcagcatatttctggttcataaaggcctgggtttcactaagaataagaatgttgcagtcattaaaatgattaaatgtagtaacattaaaaagacgtattttcctctctgtagtactttatagcagtcatttcaaattactaagaccaaaggattctaacagaaggtggcacagaatgtaattaagcatcttggttctgcagcctacctaggttcaattctggtcattctactactaattgtgtgatgtcaggaataactcatttaatttccttgtacttcagtgtctccatcataaaaaggaaataataataataataatagaacccatacctaataaagttgctgtaagaaaaacagatagttcataaatagttattatacagtctgatttaaatgctaggcattattattattttcatcttggagagaaatccctgtagagtgagatttggaacttgatttgttatatttcagtatgctgtaaattgccgcgaataaatactactaatcctatcccactagtgaaatgactcaagcaaagggagactaaatgactaatttgagtatctcaactaaattaagatggaattaaaacccaacaaaccatctccatagctttcctacttgggtttatctcaggggggataagcattacaaatctcagcacttataacaacagactctcctggtgagttcaaaatgcttcatctaccttaatgttcacaggatcactaacatatactaagcacctatgggaagtatgggactgtcatctagcattacagtgtttccaaactctgtagatagaaaaacaaaatcaaaagaagacaagggcttcattgtcacctccaaaactagaggttttctctgatattacaaagaagtgttgattcttcccactgcactcctatagcccagggttttgtcacatagaccacatgctatctcactgcatttatatttagcaaaaattttaaaagatatatgcctattaattccatctgtttaccttcatctcttaatggtcatatagctgatttgtatagttcttggaatcaaagcaaacatgaactttattacaaagcagagctaggatttattcataagatagcatgatgataaattccacttatctcttgaaactatacattgcagcacaggatatgaagatagcatacacttttcatatttaataaaaaatattttatattttttattaaaataaatggtgatcatgttttgaatttttagaaggaataacttttattaatatcaccagcacaagaaaacttttaattaattgtcttctaaatcttaagagttaagaggttttaaagcgaagttttgttttcaaatctatcatgttcactggtatagtaggacataagtcattaactcctctaattgtgaaaagtcatcttttttctcttctcatagcctaaaaaagagtacagttatataaatataaaatagcagatcaattctaacagaaagggttggaagttcattggttgtttacatttttcttttctctttttcaaagataagctttggaggaatctctttttgctaaccactttcaacaaatacagtgtatcaaaacaatctaccacaccacctccaattttgaaagatacaaaatctacccctgtcctttaggcatgtgtacttttatggctcacttcccagagtaaggatttggacatttgtgctgtggcaatggctaagaaattgcaaaagtcagatgttacattttgataatcattccacaaatccatgctccatcaaactagaccaaaaaacctgcaaaggaagcagtattctccaatttggaatacagtattctccaatttaaaatactgccttcaaatatgtttggaagttgaaataatgaaacaatctccaagcatgatagtaagtcaattaagaagtacgaaagtattcataatgccaaccgttagcagacacatttttgaaaacctcaagtcgttaatatcttactaattcagttatagctctcgaaatcaaattaaccttttctagctgaaaggaatttaaaggccttaaatatgagtatgcaaagttctgtggatacccaataccactttaaacactgatttgatgttattgcttcaaccaatatgaagccaagacaacattcctgtgtcacccaacctttgaattagctttaagcaagcttaaagaatttgaaaaataaacctctcattcattctctatccacaggtttctctagccatgcaatttgtatgactgcctccaacagcaagtgagaaagtaggcagtgataaacaaactcatacaattttaaaacaaacagaataatcagaagtttctaagtatgctagtctttcacttaaatagaaagccaaatatgaaaggtccagaggctttcactaattttccactttaaattttctaataattactaagactactttttatttcaattgaaaaatataatgattgagctataattattcaaagataatcatataaatctgatatatgtttcacctttaactgagatcagagggtagcaaaagaaatataagaaactaagaacctggtaactactaaatccttcaagaaaacaaaacaaaacaaaaaaaacaaaccaatataaagctaccacaatgtttccatttctcaggcactatatttttcataaaaaatgatcataaaaggaatatcaatgtattacactatgtatctcacaagtaggttatactgtaaattaaaaattatctgtattagaatctcaaatgcaaccttcaataccccgtgagaaggcatttttctaaggaacaatcatatacctaaactgccacattaatttaaggctaccacaatccagtgagtaaaccaaaatgttacttaccttattacaaataaatggcaaattgcaggcacttttcagcttgcagctgtctagcatagttgattagaaatgaacaaaacatctttcactccagtgagagaactgcatatttagacttgctttcttcactgaataccggcaaaagaggctgttcacctccaagtgatagcaacagccctgcacggagcacttgctgctctgcacagcagcgacttggaatgaaagtaagaagaacccgtgatgtttaaataacgtagctttagattcacaggatatgactcaactctcaaaccagtaagggaagagtttcccattgcaaaactgttagtacagattacataacaaacatcatatctggggttctaaaatactcacattaaatactaaaaacttcacctgctaaatcaaacatgcagtgttagtagtcaacctcttcctcatggcaaaagccacaacaggaaatgagaataacaacactgcacaaagaaaactattctgcttgttctctgcagtgaattaatttaatgttattaaggatgtgagaacttgccaacatctcccagaaagacatctaaaaaaaaaaggaacactaaagtcactaacattcccatcggtataaaaacaatgtgtagaaaaaaattccattttaacatgcaagaagtggcatgctttacaacacaatagaatctccttcactaagtagagaatggaaatagatcttcgtgctttgctgttgctgtttcccacagaaatcctttcctacgctgtcattaccttgtgcttctagctctgcctacctcaccaactcagggtccccttttatctgttctgtgagcccttctaaaggaacatgactaatgatacaactcctctagtaaatgtggcaattttacatgctttctccaccacatgttatcccttaacactgagctgtattaagcttgatcaaatattgaattattatatttagatacctcagtcaataaatatagacatagatgcttggagaaaagtctactacataaattcacttgccatcagcctcatcaaggaaaaaaagctgaaaaagcccatgttaataacagtaagtaggctgaaactaactagaacagggctgttaaatagacatataaggtgaagcatatatgtaatttaaaatattttagtagtcacattaaaaaagtaaagaaacattaattttagtaatggttaccctagtatgtctaaaacatcatcatttcaatatgtaatcataataaaattattaaatattttatcattttggtactagtgttggagatctagtgtatgttttgcacttgtgtgacatttccacttgagctagctatatgcaagtgttcaatagccacacatggctagtggctaccatattgaatagcataggcctagggttcaaggctcattttcagtcttcaggtggtggttcaaatattctcttttcagaacatttaggaaggtcttccctgactacctcccctgaagtaaccttctccaattactttctatcggatgatcttttttatttcctttatagtacatcacagtttgaaatgttcttctttattcatttgtttacctatttatagtctgtggtctctaacaagaatgtaagaaacccgagggcaggaattttctttcaggaggctattgacatggtcatcaatacatagcagaatttaatcaaaaaattatttaataaatgaataaaatatggatttttttgttatggtttggcaaataatataaaattaagaaatgtgtttctcatatcactgaatttccagcaaatacactgggcaacactttcttgaattgagaaattgtccactttttagaatattaatgatcttccatgtataacatgtttcattctcatatgcaatgctatgaaacaacatacttatttcattactctagcaaatacttagaacactttaatcccagtgatgtaaatttggacactattaggatgtctatttatctcctatttacaaaaacataaaatcaatgcatactatgcacagagctacaacgcaggggtcaaggatgggcatgtgacccacgctggtctagtaagcatgccaacctctccacttttgctaacattgagaaagaggttaagtttgtagaatgttaagagtagaactgttggttgttgtatctgctaccacattgtctaaaagtggtggtctaaaacttgtctaaaagaggttgcctaaaaatgaggctgatgaagagaaaaacaaagccaaatacgtgaaaggcagattcctgataatactactgtaattaccagatactgttatgcattaagtcacatttgccctctactgcaatgatgaatatactggaatgttcactggagaattacagtagtcaaaacaggaaaccatgtaaggaaccataaacggtggaagcgttaaataaataatgggttaatcatactaaggaatactacctagttattttcttttaaagaatcaggttatctagatgcactgagatgcatagctccctaaaagatgttaagcagaaataacatattgcagaaaaatatattatcccagttatgagtatatacattttttatatgcatattcacagaaaagggcccagaaaactgcacaccaactgtggacacgtggttaggtctgggaaagggatctgaaggaagtgatgggggacaaagagagatcaatgttttgctcagtttattacctcctgcataaatcttgtaaaataaaaatgaattaatgtattctttaggtaatttgaaaagaacatgttacatttaaaaaaaattttaatattttttatttccatattttggtacattgtactcactctaagtggactactctcctttattattttttaaaacaatgtaatggaaatgatgatgctcttttctgtcccactctccattctttaccagccccaattttttaatgaatactccagtttttcagtctggttaaagtgaatgccaaagacagaaaagagaaaaagaaagggcagagagagacagagagaggaagctgcattagaatctccaatgtaccttctaaaactggccaaggtctttgggtgttttttttttttttcctcttggcctcctgcaagcaattttattggctttataaaatacagcttggatttattcaactgcaaatatatcaacagtccaatgtttataataatatgctttacattaatttagtcttggatcagagtaaacaaacttgtttattaacatctcattgaaacatttcaggcttctgaattgggcataacaattgctttcctaattaactcaaaatctaaaccttttgttgctttttttggcttgctctagtcttcaaaatcttcacattatcttaggtatgctcatcacatctcctgcttttgtattcccttagatttccacagtttcaacccctttttaaaaatgacacagctgaaggtgcttagagtctgaagcaagagtaagggctgtttgacttttagtatgactaatgaggatctgaatttatacagtgttgacaaactgatgtctgtttggctctattttattctctaagcccactgatcctagtaacttaaacctcctactctgttgacaccctccttccattctccttgcctctatttaaaattatgccaaatttgattctgattttctggaagaagtaaaccattatattaatagacacatctgaagcctccatatgtctttacctatcccattacctatcccatcccttcttctctctccaaaagtaaacgccctcctgagttggcttatatcattactgtatatcttttataatactttttattagatatgcacatatccataacaagtacaacatattatataacataatatccataaacaagatattaatttgcatgctttaagctttatacaaatataatagtgtatagatcctttaaatttttttttttttgcttagcattatcttcttaagatttacatgtggttctgcttagtttattcattttaactgctgtacagcattgcaatttatgtatccactctcctattaatggacatttaagttggttctaatttattgctattatcaaactattataattcttgtacatgtgcatgtatttgtttaaagatgaatacctaggaatggaatcgtggggtcatacgatatgcacaccttcacctttactaggtatttccaaactgcatcccaacaaaactaggctagtttacaattcaaccaacagtgtataagaatttttgtcacaccaaactcttgtaaacgatctccagagatccacgatgctgaaataccaagagtcttgatctttttgttttttgtttttgattggtatgaagtctcaatgttttaatttggatttccctgattactaccaaagttgagtattttaccttattattggcctttttttctattgtgttatttgccttttcctgagaaatatttaggaggtctttatatattattgttctattcctttgtcaattatgagagttatagatatcactcttctgtgtatttttttactattgtttataatgtcctttgctgttttttatttaatttgtggtttaatttaaaaatttatttttttctgttatttacctgtaattgagtcaaaaatataaaaattaaatgttctttggtcatttttcatgaagcattaccaacaataatgttagattgcatatctaaaggggaactgagaaaaatttctatttcttctgagtagttcaattaatccttacagggtatcggctatgtacccccgtacagtattagaggtttcaaacatgaaggagaccatagagtcaatacatacacatttacagactaattgaagaaaaatacttggaggcagactgatgatgatgatgatgatgaaatggagaagtaaccatgtgccagaggttgtgctgaggcattatttaattttacagtagtgtaataagatggagtaaatgttagtgtaagaaatacatacaaaatcctgtggatagaatatgttataaccttgcatcccaaagatcattcaagatataaagtggtcaaatttgaggtagtatgaacctgtgagatatagtaagaccttgaactgacatttctatcttctcaagtcaatctattttcccaaaccaataactcagagattaaccttcatttatttagaatattaataagaattaaagtgggaacaagttattcatttgaagaaaaaaatgcttttttggaagacaagttcattttttacaatcaatgatccaatcacataatgatattttctccatttattagagatggtgaaaatttaaaaagcctatagttcttaggaatcctaacaaatggtgcatataccttcctatatctgattattaatttataacatcaaagttaaaataaactcttgttccttaaagaaacctcatggtaagtacatttgcaaacaatgcatccaaatgtatctcttttgtaaatacagatgttcacgtttctctcactgaaggttatatctgtagctctacaaaaagttcataaaatgagagggcttaatattcttcagccaggaggacgaaagggctcctgatctagaaatagagaagcgtggccagcagcgtcacacatttcctgaggcagattaagggtatcccacttccttgaggctatgaggtttacacttcagccttcatatcactgtaaccctctaggacttgcaaaccaagatgtgtttcccctgcttaggggtgacagtaaatttgaaaatgagaaaataagactgcatctaagaattaaactttgaaataaatatatagcaggccagcacatagatagataaaggcaacttcaattgtcagaaggatgcaaactcaaatgcctgaaggcacacacattaccagtaggtaatgctgatcagcgtcttggacctggcagagaccacagtgaactgaatgaaggcagcactcaagcttcctttaaaggagacagtctctgctcagctccagatggttgaccagatgtgggaaggggctagatctctggattttttcaagaaaggctacagctctgggttgttacatgaatattcctgatgtttaaatcttagcctctacacaatatgagacaaacaaaagcttttaaaggccagaagtgtcccatggacagtccgtctcagaccaggaagtaggcaaaaagcagccttggaagtaagcacaggcagtagccactgaaacactggggtagggtgctagaggctggtggccttcccttttgtggctctgcctctctcatttcattatacccatgggtctgagaacagcttgcccttctgattccatgctcatcaagctgctttctgacacaaatatgggatcctgtctggcatgtctttagggagaccttgcttaaaacttgagggagttgaggagcaactcagcagctaggtctctccttataaattaataaactgacagccgggttagcgatttgctccccatgtagtctgcctacaggagcaaaatgcgctgggtgggaagatgagccgcccatcttcagctgtttcacttctcattctaaatggaaacattggcattctgatctcacacattagttgtaagagtttcattaatatgagtccagttctggaggacagatgtgctctgaagctgctgacaagtgtggtttctgggcccacggggctttgggccagaccacagacagtgggaaaatccctaacacaaggccaacctgcaaggcccgttgggatcttaagtaattgatctaacttctcacttactctcactctaaccccgtggccattcatttcaaagcatccttacccaggtctctagatgtccagaaatgaccttgaaatatgaagttaagaattgaagatacgccttaaggaaaagggcagagaactcacagcaactaaaaaatatgtttgtaatcattggcaccatggagcagcactctgctctgtgcttgccatagaccatcccacttaatcctcacagaaactctgtgaagcaggtactactcggagcaattattctattttacaaactgatgcttacggaggtgaagtaatttgaccatatgtacccagctaacaagtagcggagttgggattagaacctgcatcctcaaacactacgacttgttttgtgtaaatggtactttatttcactatttttacaccaaacatgcattttgcattactatttgctagatactgttctaactactttaccaacattaactcatgtattcctcataataagcctgtgaaataacactacaatttgccccattctgataaggaaactgaggcaaagaaaggttaagcaacttgcccaggattatacaaccaggaggggacataatcaggattcaaactccatcatttgggctccagagtacgcattatcagtccctgtgaaactccgcacaatgttcccaaggaagagttgataaagattccaattttaaataatttcagtgctattgtaggcacgatttttcaggaggatggatggcaacccaaggaaaagaaatcatttatgtcatatcattcctctttattatataccaattagaaaaactgcaattcttctggatttaagaactacagagcaagtaaccaccataaaatactataggtctggagatagttattcttaggcgatacatctgaggagggtgacaaattttagtttgcatctttttttcccctcactgttgcaggggaaatgaaaggagacttttttatttctgcatttataaatcctaggaggtaaacattggaatacttttgagaaatctgaaatgaagcacatattccagagtttaatttgaaagtcattttctcctggaaacaaagcaagtttaatttcagaatcaaaatgcactgaacataaagaagtagatgtggatacctcctactttgaaccaaactttcagttaaacttaaaatggaacttttggatccataaattgtcaacttttattaagaataatactttggaattgattgggtaaaaataacaccttatgactcatattttaaatgtgaagcgaagttttctatttaaatagtgaggaaaggccttcagtggtttctatactacttaaagaatccagtgtagacccttccagccagggtctaaaaagttaacttaaacctgaatccagagggtctctctttttaagtccttaatctgctgttttgttcccctccagtttaatgtagttcatgaactctttccagaaactgccatcctgagagatacagcatgttgcagaactagctcacaaactgtcaccatgaaaaataatacctataatacttcccttctttcagcctctcttctccacaaacagtccaatcatttttgctcaacacaatttgtatagtctggttatcaaaatgtagcttagtgccctagtgatgtgactttcctggtctcattgttgattgaattctcgacacagccccacactcaggcctctccccagggccccatctggttccatcttcaggtctcttctcattctttcttgctgctcctttcattcctctccacatcatgaaacaattttagggattgttaagcaaatgtctgaggcaatattgcatggcagttaagagagcatgttttaaaatcggacaacctaggcataaattatgtctctgtcagttacctactgtgtttgttattaccatcaacattgtatgtttaattttgaatcacttaacgttgaggtgagaaataaagcatagtttttaaaatttgtaaataaaaattagttagctttctttttggccaatacttcaattaaaaaaaattggtgctaattctgtcagcaaatcaattagctatttcattttatgcacactcttgaatatctgtgagctgatccttctcaatcttgttttcttctcctgccgcttaaatgctgctgctccagaggaatcagtcctcggtccttggctttttttgctagagagaagaggtcccagacttcacaaggcagagcaggtatgcagtgcacagatacacgtggagttgtgcggcacacaggcaatcacatgaccattagaagggcactgacgttgctcctctctactcatcgctgctacttggtattgcaggaccagattttctaattttcaagaccatgtaaaatacttagtttaaaaaatattgccataatgctttggctgtccagattcaacctgaaaaacccaacctaggatgacatctgctttatattctcacaaaataatcttatccaggtccatgacactcatcactatccctagtcagagtgctcccacatctctgtctttagcccatatctgagctctcacctgtatatattaacaaagtcattgagccctctgcacaagacactgggacaccaaagatgactgatatactaggttggtgcaaaagtgatggcaaaaaacgcaattacttttgcaccaacctaatacaaatgtagcccctgcccacaaggggtttacagtctatcaatcaaattacttcgtagacacctccatctggagatgctcctggtacctcaaactaacactgccatcccattccacaccttccccccaaccccaaacctactcaccctggtgtctccctccttatttctacagaaggctgtcacccaaaccagagacagaaaattcatccagaaaccctctcttactgctaagagccaattgttctccgaggctttccccttcaatgccctgtccacctctcattcccaggcatgactttccatcctttataatacttctctactcataattcattgcaggaactactgcaattaccctttgtggcaatttttgaaacatatttgaaatttttatgacattcctttcctcaagaggtgggatctatgtcttctctccccttgaaactcagatgacttttgtgactgttttaaccaataaagtatgacagaggtgatgccatgtgacttctgaggctagaacataaaaggttgtgcagctacccccttgctcagtggaacagtctctcttaaagcctttagatgccctgactgcctgggggctgccttgctgtgaggaagcccaactagccctgagaccacaagaagagagggaggagtctggacagtcctgagctttcacagtttgtcccacaactgtttcaactctaacatctatctgactgcaacgacatgaaggacattgaccagaatcttccaagcaaacctttcacacattcctgactcacaagattttgaataaaataaaatggtagttttaagctgctaggtttcagctaatttgttacataacaatagtagccagtacagaagtggggtttaccataacagaaacctgaaatatatgtcattaagactgagacaggcagtaagtggaggctgaaaggcccacaaggaaagtcttatgagaagaagttggtagaaattagttaaaggcttcaagaagctgtcagcaaaggctcaaagggaagtgagaaaaatgttgctggaagttaaagaaaggggtctcttattatgtagaagcagaacatttcacaaaactatcatttctgataatgtggaaattagaaatacacctaatgaatttggtgatctagctaaggagatattcatgtggttttatggttttttttgttgttgttgttttattttgttttgtttagctgcctataataaaatgcaagaggaaagagatgagctaaagaaaaaactgttaaaatataaataagttagaacttgctgggttaaaaaacaacaactaaaagaaactgtttcttattctcagcctctctaaacagcaagtaattcccaacttaagaaaacacttggagatatagccagaggttaacagataccaaatccagctagataggaggaatacgttctagtattctgtagtactacgttctagtattctgtagtactacagggtgactaaaattagcaacaatttattgtatatttgcaaatagctagaatcatggattttgaatgttcccaacacaaagaaatgatgaatgtttgaggtgacggatatgttaattgccctgatttgatcattacacattgtatagatgtatcaaaatatcacactgtactccataaacatatacaattattatgagtcaattaaaattaataatgaaagaaaaagaaaaaaagaaagaaaaagaaaaggtgaaagaaagaacactgtgaatataccattttcaaaaataataaataaaaagaaaggctttaggccaaataacaatccaggttgaaataatatcctttactaaagtttcagaaaaatctaaggcagtggctcctcaaatttttttaggcagacagtggacctctaagaatcttaggagtatgcttcacaaattctctccataaaactggtcttccaggtatcttaaggatgttatcttaagacacctcatagggagctgaaagtaaagaagcacttaccttgagaatatctatggtttggattcatagaaaacccacaaactatttgagataattgttttgctataagaaacaccaatttggagtaaaatagatgggaacactacaaaattaaaagtgggctttggacacgtagcattctatgggcagtaaaaagtctgattaggctatttagttgcaaaggtcgttgtttggttattgttgttgttttttaatggaagacaaaggctgactcaaagggccaaacactgagagtggaaccaagagctgaaaaaagacaattcctagcagtaggattacaccctaatgaagaaactggcaacatgaacttcctgcatttcatgactgctaagggccagtgattgctgtgtgcctcctgttttcctccttttaagtgagtgggtctacagcagtttacctttgcctgttgtgccactgaaatttaggtatgtcgggggagggggcagataacttgtttcttcacttcacagttcctcagattaaggagctgtacccaaattactgcatttgaggagtctaaacttcatttggaccttagatgatactatgtttcaagcagatgtttagatttgagggtcttgggggagaggataaatatatttttcatgtaagaagaatttgagtttagctgcatggtaattcacaaaagattgcatttttccaaagaaagggagtcctcaaaatctcttttgttccacatgctgttctcacaatgtgacattcctcccatcagcaggtgaggactaagtgccttccctctgaatctagacaggattgtgactatagcaaaagtgaggctatgtgatttctgagactaggtcacaaaagctggcacagcatttctctcattcccttgagggcttgcactgagaatccagctgccataccacaaggaaacccaagcaagctcatggagaggtctacgtggagaaaaatctaggcccccaggctacagccaagctgagctccaggccaatggccagcaccacttttcaggtgtttgaacaaatcttgagcatggatcctcaagcccccagttgagtgatgctgtgcagagcagagattagctgcccttgtcaagccctgcctgacgtgaagattgaggtacaaaataaatgactgatgtgacttaagccactaagctttggataatacgttatgcagcaataggtaactggagtacctttttaatgctttcctttcctactgtcttctatttctcctcattccctctgaattttttagaagataaaactgatcaggtcatgtccaagatctttctctttttttccatttggatctctatcactcaactgtaagcaccttgaggtcatgaatgatttctaaacattttagtagcattaaaaatttattgaataaatcaactgctaaatattttgttcctggaactgtaataggatctataatggaatcttgactcataagatgtaaattctgtgaaaatgaataagcaaattaacaatactgcttttttccctttaggaatctaagagaaaaaaattttaaataactcattcattttcagatgttaaaaggattttcacttacaaattgagagatgtccttgaagaaaacacctttgactaaggaaatatggtgtgaaattcaccacacatttcttcataagcggataacatactgtcttgcctaaactttaataatctgattttgataaataccaaactataaataaaaacatagttctgctttatcacatgaaagcataaaataacaagcaattctcatttatcctgagtatactattagctattataatttctgagaatttcaagattttctgttaatataccagattttttttctgaatattcctttattctttctgtagtatacaaacactcctaaatgcctcctataataaattcatggtatttgcacattttttgttttgcttcctagtgattacttctgcccaaggcaagctattttttcttttatttgttatgttagatttttttttttttttttttttttttttttttttttgagacggagtctcgctctgtcgcccaggctggagtgcagtggcgcgatctaggctcactgcaagctctgcctcccgggttcacgccattctcctgcctcagcctcccgagtagctgggactacaggcgcccgctaccacgcccggctaattttttgtatttttagtagagacggggtttcaccatgttagccaggatggtctcgatctcctgacctcgtgatccacccgcctcggcctcccaaagtgctgggattacaggcgtgagccaccgcgcccggccttatgttagatttttataacaactatttcctccaaggagtttaaggtgcttagtaaacagagggcattttttatggtttgctttaatgaacatcttcaatgcattgcaatagcaaagaagtgaacaacaaccaagttggaaggaagagatcacagggtaaagaacagagcagcagggtcagaagtcaataggggttggtttatttgcagagcagcaagaactcaggggattacaaaaataactgcatccaaaccacgctcaagtttacggtgctacctttacgaaaagaaggtgttctggtcttttcctttttaagttgatttcaggaaccctggttccaggctacactgattctttcagtcacttatatttgtgtcaagataactgattaaaaattgaatagtagtccctgctctttgtaccttatgttgaatttgggcaaagtgaatgcctgaagcagactgaagtacatgactcaatttgaccttcactacatctaaacccatcaaagaaacgaactgatacataggacgaaggagtaggcggtgaccgtgtatttgaaatgaggggaggcccagaaggcagtgaaaaaaggccagtggtttcctggccctgagggggaaacgagacctccaaggagatggctggcatgttattattagggagatgggagttccacactctgaatggagactcagagttagaactaagctaacgcaatgacaatgaaaaaatgtgatactaatgacataagtgattttgtaggcatagactcattcagaagtgccaaattcagccaaacaatatttgaaaagcgcacaccaattccacctgtgccacataagagtactcaatatatccactgtggagactgacttcttgagagaaatttttgatggtggtggataaaaagcatttcaacagcctccttaagaggatattaatgaccccattatatttggtgcacaaagctctaaataaccatttcgtcctcaggcagacaaaacagagtttttaattgcttgttctgtttgagacactgacatattcacaaaaggaataaacctcttataaccaatacagcttcagttggtaaggacagagagacttccttagagtctctaaggaagagtgattataggctacctaccttctacttggctgagtcttaaaagtagtgaaaaaatgggaagggatagagtgcatgtgaagcaagagagaaaagcaagagaaaggggaaagcaaagagtcgcttcaaaatttgcttgagaaaatgggtctgtttgaaaagatgtgccataaatggaagaagctctaattcgtgcagtattcttagagcacaaaagcttttagcatcttacagagctacatgaaacaaatgggagctgaaccttacgaacaaaaactaccataaaaggcctgaaatgccttttatgcctgaaagggcaggattttaactgagaagttttctcatgaatattaaatggggccaagagaggaaataagttaaattttcaaaatagctcccaagccatcaatgaatagtctatcattctgaaatatatattatatatcacattgttctaaatagcttagacgggagccccagctacacaattttgtgtgattccattatgtctttgcattttcatgatgtttaaatacattactcactgtagttgttcaaacacagagattcctattctatcatgaaagtgaatcaatattttttataactttttcccctgattatatcagcaatgcctatttgtatatattaaatttttaaaaatatagataagaaaataaatactgcctatgatatcaattctaaaaataatcaatgttaatgtattcatgttcttaaatagagcaaaaacaagcctataaacaaataaataatattaagcactaaaaatactatgaaaaaaataagataggttaatgtgataatgagggagtgacacatgaggacagagaatagcttgggctaggatagaagggcgggtcactttgacaaggtgtcctgattaatgagaaagaagcggatatggcgagaaccaggggaagattgtaagattgattcaggaacataaactaacacatgcaagggccttgggataggaaagacctggtacagaagagacagaaagaaggccagtgtggccagagcactgagaaaggaggctggagaggtgggcaggagcttaatcacctagggtcttggaaacaccttcaatgcactgcaagagcaaataatttggatttcattttgttggtttccatcatgggaagtttctcatctcttttagaaagaacttctgtctacagcttagatcactggagacaagagtgaatgcgagcccacctgtcaagagcttgttccgggaatccaggtagcctggatgaaggtgtggtaagattcaggatgtattttgggtaaaggtgatctaataatagatagatcaaagcacgaagaaaagaaaaagatccagcatgattcttaggtttttggtccaacaactggggtcatggtagttgtatttactcagtaatgaaatgtcatagctaaagttccttttttcacacagtaagaaatacattattaaaatgttttccatttttggttagctactaaggacctcagagatacaattagctttgagtaataataattagtaccagaagtttctgacatatttttctctattcaactcaatgatttctgatctttcaacgtgtttttgtttacttaagttcctgtttcatagatcaacggtaagtttagttttaaaataatataataaatgaagataaatatattcccaaccaagcaaccctagatcctgagactgaaccatatttacacatatgagtcaccttcatttcttctcttgttacaggtgagttggatactttgcctattttttagtgtgtgtatgttgtggggtaggggtgagctgtttttcccaatgatttaaacaaacttctttttatagaaagaatattaacccttaatctgtatgcaatcttgatgtgtcatttgtctttcaattttgttttagtgttttctgatatacataaagtatttaatttttacacaacttatcaataatcaatgtacaaaaatcacaagcattcttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgattttcttcacagaattggaaaaaactactttaaagttcatatggaaccaaaaaagagcccacattgccaagtcaatcctaagccaaaagaacaaagctggaggcatcacactacctgacttcaaactataccacaaggctacagtaaccaaaacagcatggtactggtaccaaaacagagatatagattaatggaacagaacagagccctcagaaataacgccgcatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaatccataaaaaccctagaagaaaacctaggcattaccatacaggacataggcacgggcaaggacttcatgtctaaaacaccaaaagcaatggcaacaaaagacaaaattgacaaatgggatctaatgaaactaaagagcttctgcacagcaaaagaaactaccatcagagtgaacaggcaacccacaaaatgggagaaaattttcgcaacctactcatctgacaaagggctaatagccagaatctgcaatgaactcaaacaaatttacaagaaaaaaacaaacaaccccatcaaaaagtgggcgaaggacatgaacagacatttctcaaaagaagatatttatgcagccaaaaaacacatgaaaaaatgctcgccatcactggccatcagagaaatacaaatcaaaaccacaatgagatatcatctcacaccagttagaatggcaatcattaaaaagtcaggaaacaacaggtgctggaaaggatgtggagaaataggaacacttttacactgttggtgggactgtaaactagttcgaccattgtggaagtcagtgcggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaataccatgcagtcataaaaaatgatgagttcatgtcctttgtagggacatggatgaaattggaaatcatcattctcagtaaactatcgcaagaacaaaaaaccaaacaccgcatattctcactcataggtgggaactgaacaatgagaacacgtggacacaggaaggggaacatcacactctggggactgttgtggggtggggggaggggggagggatagcattgggagatatacctaatgctagatgacgagttagtgggtgcagcgcaccagcatggctcatgtatacatatgtaactaacctgcacattgtgcacatgtaccctaaaacttaaagtataataataaaaaaaaattaaaaaaaaatatttgcttcatgatattttgttgtgcttttagtgctatatcagctaaatatttacctacatttactttttcagcccatctgagagtaaatcagtcattcagaaaatgaggttttcatgggattggatcctagggacttggtcctcttcttatagctgcattatttttaaaaatctcaaaaatcaataaaaaaataagttaactgttaaggaaatgaaaatacaagtcacaaaccacaagaaaatatttgtaagtcatctatatgataagaatttgtataaagaatactgtatatctttttaaaaatcccaaaactcaagaataactgcattatccctgacacttctgtttttgagtgctctgtttcaggattttcacagctgacacccctgagaggccacagcacctagcaccccttaactagtgatgttgtaatttgattgctacatatcccagcgatgatatcatcaaatcaattcaaaatatcaaattcactcagtaggggtgaaagcaaaacaaaaccaactaagcaataagaagaccaaggactaaaactgaatacaaattcaaacaaaacaaactaacagtttatcaaatagttcacatagagaaaatatttattccaattatttcccccaaaaggaaccagggattcctaaataaatgtctgactccaggtctgttgcagggaaaacacaagacaagtttgaacgttttatgccagtgacaatgtcatgacttacgctgtaagaatacaagatccagcctgagcaggctctaattagaaagaaagtaaaaaaaaaaccaaacaaactatgactctatattgctgtttgatggaataagacaaggggagttagaggaaagttcttttttgcaaaagaatttcagctagtaagcacagagggaatgacagaatccacattttaaaaaattaaaatataaacaaaagattcctacccaataaagttgtacaaacagaaaaaacctcaaaatttgtacatcctgaaacaaaaccatctttttttcaaaataggtaatatttcctgttgagatacagaataacatacagggaagaaaacatcttgtttcctgttggttccattgagtgaagagcaatacagagtatgtacatagagcctctactcttagccaaagtaacaattttcatgtatttactttcggtagttggtgccatcaacctaacgtggattctgaaccagaaccagaagtgtgagtgattcactgcctgccccaccaatactccagtcaatcaatcaggtggggcctggctgtgtgtggcaggcagtatgtgtgcccagggaaagggggctgcaggcacatgttcacctggcagacagaaagaacgtagagagtcactccaacactgcattagttagtgatcccactctttctgcagtttccagggttcctgtgtggaatgccttctgctggtcacaggttcaatggagagaatgaaatgaagaacctgaattattcacaaacaggctaaatagttaaactaaggaaactcctttcaaagacaaaataaagagcttcagtgctttccaatatccaggtgattgatgaaaaacatagctgttctttgcaaccttacaagtaatactgtatttcatccactagatcagatgctctcctagggcaaggtctgtgtttttttcctcaccacttgtggtaaattgtgaatgtagccacaatttatcatattaatttttctgtattacatataaagcaacgtgtctttgcagctcctcatgttaagaggtggaatttactttccctccccttgaatggaggctgggcttgtggcttgccttgaatgataggactcatcaaaagtaatactgtgctagttccaagcagaggcctcaagaggttgttaatgctcttgaaaacttgcctatgtgaaccagctgagcaagccagctggaggatggtaagccacttcaatcaggacaagcagctgaggccactccagtccagccagtctcagctgacccaaagctcactgcggctgcatgagtgagccaggccaacagcagaagaaaaacccagctcactccagacacagtgccaacctgcaggactatgagctatatcaatggctgttgttttaagccacaaagttgaagggtggtttgttattcagcaaaagctaacagacacaccattatccctagtgattaccacagtaccaggcatttagaagttgcacgtcggaagttggaattgaggaataaactaacccatctcatataatgcccaaatgtggggcagttctgtgctaaatactaggatacagagatatcaaagaacccagggactagcagaagagacaattaggtggtatttatacaaggtattgtaacaatccatgattacagtatgttcagaatagtgtgagggatacccaggacccagattaagggtagggatcacaggaagccccttaaggaggtgatacattagctaagacttctcagaaatgggcaaaagtaactagatgaagtggcaatgtgtaggtaagtgtgcacttattaacaaactgcttgggaaactggaaccggagtaagacaggggaagatgattaacttttagtggttgctctactcaccagctatgcaaagctcagcaataaccacttctctaagtcttagtttccttagcaaaataggatgggaatagtactcaactcagggagttgctctgaggactaaataaaataatctatgtaaagtgttagcataatgccatcatttaatatatacttaacaaagactgttattattgttttattaatatttattatttattattatattattattgtcttgttaccataagcacatatgtatttgaatttaaaagcatttcaacaaagtagaaaataaagcctaatcagaaatcaatgaacatcacaaatatatacgtaagctttggaaagaagtaaattctttacctgaatttttatattctgtgcttctgtaataaatgaaattatatattttttttaaagtggagaaaaaggtttccaggcagaaacagcaagtataaagatagggtggtgaacaactgtatggcatatatgggagactgcaaatgccaattctgaccaaaatatgatgtgcaagggataggactgtgatagatgaggcagagaaaatagcagagccacatcataaaggacctcatatataaagcaaagagtttggagtttatctaaaagtcagtgaggagccattgctacctctcatttggaattaatgtatgtagcaattttcttggaaagcaatcaaaatgtacagttgctttttaagtaggggtgagatgacatcatttcacctactgcactttattcaacaattttcgagtgcctttcgatcagcatgtctccaatgtaggggattccaagtaataaaatccaggtgctctcaaacagtttccatgctggtgggtaaaatggccttgaaagcaaattgctacaactcaatatggtacactgtaacagggaaaagaaagaagttctatgagcacaatggcttgaagttcaaattgtgggagacggggagaagcaggagggttgcagacaaaggttaaacgtgtaagatttgggggtgtactgaacaaaattatgaccccagtgcctgtccattcctgtgatttccagtttctctctcttacgcattcccacaactctccatcatatcagagtaccattactatccctgcatctacagcctgtgattgccaacaggaatgccttacgtatcaattatgaaagaaataatacaattacttattctataacctgagcccaacagaattaaatcataagcacggcatatttagacttaccccccctcccaagtttcagaagtgaaatttagcaacttttccttattactaatgggacctgaacttaaaatagctgtctaaacgcagttaacaaactatacagctcagcaataatctaagttggttattttgaacctttgtggttttcattttcctaagtttgaggttttattcaatgtcaggtcatacattagaaactttgttatgatttaccccataaaatttgaatttttggaaaaagggaaatccacagtaaaaatctgaaaaagcaaaagccaacatgaaaaatgtctaagtaatgcttttgttattttatgggttactatacctagtttagcaggcatgattactgaccacctctccaatccataggcataagcaatgacgatagatggtggcacataggacccttcttgccagggacccttgcctatggatccatattttaaagctttatatttgtgttcttctacaatacaatgtgcatttttattatgtttactgttttaaatttagctgcaataccaaagtctactgcaagaacatatattaatatatactaaatagtattatgaaatttctcataacaaaagacagttttcagcacttatcaaatttctgactccattgggaactacaaagccatcatcttcaacactgagtgacccttccttacttttctaaagcctttctcctcaactgcacatttaaatggctgggactataggtgacattgatataaaataatgtttctttggatgactgaaattccctaagttcttcctttatcattatctgttctgtaaaaaattatttatttctacatatttgtgtgccccatttaatgctactccaagtggtgctgaacaagtttcctaaaagtaggcctataacaatccatagcatgctgtatatattttgtgtaattctcatactcaggatagtgccaatgaaggaaagctactttagcagctctgagccagttagtaaactgtagagctgggattgaacccagccagtctagctccagaaaacttatatttgcaagtacatcttatatttgcaaatgaaggggaataaagggaagtgcactgttcaggtttcaaggtgtttgacatgactctagagcaagtttcagcttctacttggcctgacctcatgaacctaacagtatcttgtaaggagactccagaatagtgttaacttagaaactaaatttttcatggaattggggtcattattagggactcatttatctatcttctcctggggaaattccagtactagaaaactattcccaagaatcagtttacacatgggcacttgtaacccataggagtacattttaaaagggtcctaggaacttttgccaagtcccctagggacttgggcttggatgcagggaagaggatatcacatctctgtaccatctctatattccaggagactcctcttgagaggaatggaacatgcagagaaggttggagccctaggaatactgctgaggggaagtccaggaattgtcccttattagagcttcattaggagtagcaggaggaaatgttacactaaacaaaacctgtgctaggaggtatccattccagcaagacttgtctttaaaagaaaaggaattcagtcccaaatgggcacaccatccaggaaaaatatgatgattaagccttttaatattccctactccaaggattgagaatacatctttttctcaccatgtgttataggtttcgaggctcagaaactccaagtggagactttacctattactgagttcctaaaaacatcaagtctaccaggaccaaagatcccaaggaaaggaggttaatcttgtttcaaacttatggtatgttctgtgtctgtgctctgatgccagcagctgccattccttattttgtaacatttccctgacatggtgatcatctgctggtatctttctggggaaccatcacaccacattcttaagcatgtgatttggatagagctgatcacagatgggccatcgcagaatacacttttgtcttgcacaaagtgatggtttcaggcatgacaaggtcacctcaggccactgatactaaacggttcagaccaagacttgtgctgaagctatttgcagagacccttctgttccagaaaaggctagctgacagggcaacagaagtctggagctgctggtggtcgtctttgctggcacatgcagggagcccactactcagaggagagcagaccccagagcagaaagagaaagggagaagtacaatgttctgatgacactggggagacccttggatcctgttgagtctgaagccatgtttatctctggaatatctcagatacttgagtcaacaaattcctgttttgttcaggctggtttgtactggtcattctatcacctgaaaaccaaataatcctgactaatttgcctgtatttccattcgcttcaattcaacaaacatgaattgaagacctactgagggccaggcactgcactaggttctggggctgcatgtatgaataaagcatagttgctgacctcctgggagtaaacctgcaatttaggggatctctaaaggttagcaggccacatgctgttttgaaagcatggttcacagatgtctgcgttgactccatctaactgatccagaacagtcattttaaagggcaaggaaatggagtaatacccaattggtaaacatgcttagagaacataaaactggcagtatatttttacaagctaataagtgaagaataaaattatctttgagaagctattcaatgagaatcagaatcttatctaaaattagtattctagagcacaataataaatactttattcaaagcctactgtactgaaaataacaatgtagaaaaataaactcatactaaatttagttgagtgttaattatgatagagataaacaaatgaatccagagacagcatgaaacttgggtacataataatttaggagttcatttaaatagttttgtattttaaataatttattttgatgtcattaatcactactcattttcaatccgaaaatatatgaggaaacagattacctttccaaatggaaatagatgtacttagttcacataatgaatcgggtactctgggggacatagtactgaaatgcttcagggcatttgcttttaataaatgaaaagttgcatggcaacacccttcataaaactagatgagtcaaaaaagagacatttcccaaagatgtcatattagtattattcaccatttataaataaagtaacattttattataaaagttttttaaagcagatcatactacaaagataaaataagaattagcatataacttttatggaaataaatctgacaggaatgccaaggttaagaggtacagcaagcctaagtaaagctaaaaagtaaataaagttctgcctcagcctccacttttctgagtctctcagtttttaaataccattcctcaggtgccatgtgtccacaaatattaatctataaagttctacgaattctaaaagtattcctttctttttgtccaagtattggccattcatacttctgaagcagagaggaatgatatgctggtgtataggggaaaagctatttcctttagttgggataaagctatgaaaacttcaattgtttttcaagtttggatttccttctatgtttttattttaagttccaggatacatgtccaggatgtgcaggtttgttacataggtaaacgtctgccatggtggtttgctgcacctatcaacccatcacctaggtattaagcccagcagtctcaccattctgaagcactatgacatggctgtatcaaaagtgaacttggggtttagtttccaataatgtggttacatcaaggtgcaggaagcagtcaagccaattttagtatggattacagttaagaaagattaaaaatctgtgctcggcattctcctttatctccatacactggagtttatttgcctgtttccccattctcctagtaacagtttctctaaaagaccaagccttaccttagctgccctaaaggaaagggattttgtcaatctcccttcaagtgctcttcattccaggtgcgttacaagagtggctagcccatgaggaggaccagatggaaaccaagaacatttgctgtgtcagggcagctccttcctgctgggtcctagaccttgacacatcttattcactgtcacagagcaacctcacaaagtaatgaacagcaagatgttagtgattaataaccagcttaatgtgttgcaggctcaaacacaagccactaatatattttaaaagtggtaactacaaagccgaggggatggaaattgcaatggagtatcagacctaggcagctctcaaagtctttagaccaataaggcacccctgcacccttcaagtcaaatcaacttcataacatttattccatctattataaaggaaagctggccttgctaacaattggtaagtcacccttagctagacacctttgcgttttgcaacatcgatactgtcacttatgtgtcgtaatatccatcaatacccataataagttacctcatacctagtggatgctgataaacatttgtaaagaggtcttagaatgggttgaaagaaatccaaaagaatccacacagccttaaaaggatgaaggtctggggaaaatattaataggtagtaacaataggtagctacttattgttcagtatctactatataccagatgttatattttttaattaaaataatgcttactatgccattcaaagaaatcacaaaagtagtattaaatagaagtaaaattattttcattgtaagactgatagatgcctggcacatgaaggttacctgataaaggcatattcctgcatttacaagtttaccaagagtctagactaatcatgcagttaggctgaggtcaatgacatttttccttcagatttggttgctcccattgaccttccagagttgaggcatttcacattcaacacagacttgaccatttagattttccccttacaccagaaaaacctcctatatttcccattgcaggaggatgcaccatttaagcaaaagcaaggtagagcatcaatgtaaaaataagaatggtataaactagtgaatataaatgctgagacacacaatacaattctaaaagttctattctcagatttacttagattttcaatatcctttctctgaatctaaattcagaagatgaaaacttgttgctcaccaaggaaacgcttgatatgctggcaattttctcttcatccttcaggctactccttatatattgaactctttagaatatgacttctgtccctttaaattacagagttttctaaccataaattgaaaaaaaaaatttcgtaccagaaagagacagagctggatcatcaagttcaagtctaattttataatgaagaatgatgaggacttgcttggtgttacacagacgcagaaaataatatagaagacaaatctattgactttcatgagggagctattttttagacacctaccttatgtctctgagtccagcagttcttagttattacattctgctgtaggttatatctttgtcaggaggcaatttctttatatcaatacttcatcagctcaaatgtttgcaaacaagcaaaacaagtcataagtgcttttgcataaattcccatttccttttagaagggatatgcaaaacttttttttaaagaataagtttgctggactcatggaatacccaacagaacaattcctagactatgcctataacaagtaaataactaattagtgtgtggtagactggtgagtgtttattaccaatatcccatagttatctcaagaaatttataaatacccagttggtgggcataaaatattttccccaaaacaacacagccttgcaaaacaaattacaatgagatttttcacagcacattctctgatctagtgtgatcaactttgtgcagaaacagcttactctctaacaagatttatggactctctgccataatatagataatgtgaatccaacctacttacccactcttttttttgtctattgctagaaagcagccacccagccagcgacacttcctcttgcatctaggtggggccatgtgactggttctcatcagtggagtgtaagtattagagatgtgtgtcacttaccagcaaaggtggataggaggagactgtcttctctattctgtctctctctttctgcctgaacactgaagactccaagatatctagtaagcagcacagttccaatatggaaggaacttgggttcccagaaagctcaaaaatatctaaattggatgttatgtgagttaaaataaacctttattatgttaagctcctgaaattgtggggtttattttttatacgcattgcaaaaacctaactaacacattgatttttgctagatatatccatggacaaagtagtaccatccagatgatagtagctgctaataaatgtggcatcgagtataccaattttactattacatttttcctctatcatgttcccaggatcccagtcactggctaggctacaccaagtgcagctaaaattcagaagttcttacggccaatctaagcatgttaaaggacttttgagtctaccaatattggggatgataaagcttactccaattgtacctgacttcaaatttctaatgtgaattacatctctgtaagtctattaaattcaaggataattccctgggactcgttatcatgtcagcaaaacaaccctctttcccagtagtaggctccatgtgagaggacttattttgtaatggggaaaaagaaagcgtcaattcctggtactaataatgtgaaggattcatttggagacactacacaatctgcaatacacaagatcctaaaacatgtttagatgtctaaggttctgactaacaataaagttgtgcctcctttttgattcaataatgcaaaagttataaatctcccatgactaataaatctttaaatgatgagttaaattctattggaaatgttcattgtctattttgcatctgtttgtagtttatcataactagtgatgatagtgctttctccaaagaaaacaagtagaagcataaatgagctagttgttgattcaggactaaattgggggaaattacatcatgatagtgtgttccctttggtggtatactgaagaacaaagactttaaatgaataagtacagagtctcacaaagcttttatcacagcttctggtatacagaatgaccaagtttagaccctaatttttaagccaaaaatctatttccagattagcctatggttgacctcaagtgttgcttacatagctcacattctcaaacccaaaaggaatttcacccattttaaatttgcatgatgctcatcaaatatcaaggtcagattaaccaaaaagatgtttggtatagacagaacttttcactgaaaaccatatatgcaaaaaatacaattattatcttggagaagggtctgtttcaactgaattgaacatgacaagtcagtgaaatatatttttttccaaatattgagaccaaataactaattagttgcctctgcagttaatttttcatcagttttgtaggaatattttcttcatgaagctttccttatttttctctgatggatgtaatgtctctccctttatctgtgtaccttttatagcactgattactctctagctggtttttctattcataccttgttgatgtatgttaatagacccaaaatctgagcaaacatacacatctaacttatcttggtatttcctgtactccagcatataatgcagtgccacaaatatagaaagaatacaacaaatattttaaaagaagtgcacacacgctatataactatccactggactcccatgtgtaatgccttacagaaaagaagttcatgtctagacgataatacagaagaggataccacttctgtaccttgtataacaaagtagctacaatggaaatgctcctggatactttcccaataactaaatccttttgagtgatgccagaggacagctctcaagttaacttcagcagaactgtatctagaacaaatgcccaagcactagtattttagaagtacatggatttaatcactttattaaatactgtgcttaaaactttccatggtatttcttcatctacatcatgcagtgacatttgaaagccagaatattatattttttaaacgttagctatttctatcacactgtagcctcaaatctaaaagcaataaattattgggaacaaactttaaaatgtttttaacttccatttgaagtctaggtagagatctagcaacttcttcctcatttatttaattcactatacttctaataatcatttattttaagaaataatctgaggacaaaatatcagattttacctaatctaagatatgcaattatttcatgtcacaccattacttattacaccattaagacataaaaacattgccaattaattgtaagatagcaaaaattttaagaagtattttaatttttgaaatgttaaaaatgtgaaataaaaagttcatcttagagtcaatgaaattaattacttgacagagaacatggaagatgcaacaaatatattatggaaatgtaacacaaggaaaatgaaaggaattctaaagcagaagatttcttttatgatattcacttattgttctcaatatcaactgcttatatagttatatacttttaaaagtataaagcatattccgacttttagtaatttacattgactattatgtaaatctaatggttgaaataatacagtattttatatgcctagcagctggtaaccccagctccctccagagagagaactaggaaatggaatacagcataagaaatggaatttttactgtgtcatttagtaccttttgaactgagtaccatgcacatgcattaattatgcaaatactttgaaaaaaacattaaagcagcctctataactaaaaaattagggtaggaggggatgaagcaagacaaatagaaggctccaccaatcgtccacccgcccaggaagaacaccaagataacaactatctccaaacaaaaaccaccatcataagaaccaaaaagcaggtgagcacttatagtaccatgttttaacttcatgttactaaaagaggcactggagaggtaggaaaagcagtcttgaattgctgacaccacccctcccccatccccaagcagtggctgcatggtgtggagagagaatctgtgcacttggaagtgggagcacacagaaattgtgagacaacgtatattgaactcagtgctgcctggtcacagtagaaagcaaaaccagactaagctcagctgatgcccacccacacagggagtatttaaaccagccctagccagaaaggaattgtcctcccagtggttggaatttgagttcctgcaagccttatcatcgcaggctaaagtactctgggactctaaataaacttgaaaggcattgtaggccacaagaactacaactcctaattgagtcctagtgctgaatcaggctctgagtcagtagacttaaagggcacaggacctcctgagacacgagccagggtagctaagggagtgcttgttccacctctccagcaaccccaggctgcacaggtcatgactccgaaagagacttcctccttcttcttgagtagagaagagggaagagaaaaaaggactttgtctttcacctgtataccagctcagccacagcaggatagggtaccagtgagagttgtgaggcccactttccaggttctacttgtggatgacatttctagacatattctgggccagaagagaacctacaggcttgaagggaaggagccagtcctggcaagatcatcaactgctaaataaagagcccttgggtcctgaataaccaataatgataaccagaaagtacaccatgggccttgagtaagactctgttattagctgtcttcaggtgagactaagcacattctcagctatggtgttatgaggagaatctctgcttgagaaatgcagaaagaaaagtaaagagcactttgtctatagggaactttgtcttgcacattaggtattcgttcagccacatagaaacagagcaccaagcaggctattggggtcaccaattacaggccttggctcttggatggcatccttcgacctgcccttgggacagagggaagaccactgccctgaagggtgagtagcaggccaggcagcattagctacaagctgacttaagagccctcaggccttaagagagcatggcagtaacctggcaatactccatgtgggcctgtggtattggtggccaccgggtgaggctcctctgcctgtggaaaggggagggaagagcagaagggactgcgtgttgttgtttgagtatgaggtgtgagctcagccacagtacaatagaaaaccatgtagacatctaaggtttttgactgtagtccctggctcctggatggcacctctggacctgcccagggcctgggggtacttgccagaacacaagcctagctggctttgccagctgatgattgtagagccccagggccttgcacgaacataggtggcagccaggtagtaattacagtgggctttaggcaagatcaagtgctgtgctggctacaggactgacccagcacagacacagtggtgcttgtgtcactccactcccagctccagatggcccagaacagagaaactgtttggagaaagtaaggaaggagaacaagagtctttgcttggtaatcccgagaatacttctggatcttatccaagaccatcaaggaggtacttctacaagtcttcaggaaccacagaattactggacttggattggggtgccatatgtaaatatggcttaggtaacaacacccaagtcctttcaaataactgaaaagtcctcccaagaagcatgagtataaacaagcctagactgtgaagactatagtaaatacttaactgttcaatgcccagacacaagcaaacatccacaggcatcaagatcattcaggaaaacataatctcaccaaatcaactaaatacagcaccagggaccaatcctggagaaacagagagatatgacctttcagacagagaatcaaaaatagctgtcttgaggaaactcaaagaatttcaagataatacaaagaaggaattcagaattctatcagataaactgaacaaagagattaaaataatttaaaagaatcaagcagaatttctggagttgaaaaatgcaattggcatactgaagaatgcatcagagtcttttaatagcagaattgatcaagcagaagaaagaataaatgagtttgctgataggctatttgaaaatagtcagaggagacaaaagaaaaaagaataaaagacaataaagcatgcctacagattctagaaaatagcatcaaaaaggcaaatctaagagttattggccttaaagatgaggtcgagaaagagatagaggtagaaagtttattcaaagagataataacacagaactccccaaagctagagaaagataatatctgagtacaagaaggttatagaataccaagcagatttaaccttaagaatactacctcaatgtatttaataatcaaactcccaaagatcatgggtaaagattctaaaagtagcaagagaaaagaaacaaataacataaaatggagctgtaatacatctgtcatcagacttttcagtgcaaacctcacagaccagaagatagtggcatgacatacttaaagtgctaaaggaaaaaaaaaaacttttactccagaagaatatgtctagagtaaaaaacttttactctagaaaaatgtccttcgaacacgaaggagaaataaacactttcccagacaaataaaagctgagagatttcatcacaccagacctatcctacaaaaaaatgctaaagggagtacttcaatcagaaagaaaaagacaataaaaaagcaataagaaatcatctgaagctataaaactcattggtaatagtaagtgcaccgaaaaacacagattataacactataactgtagtgtgtaaactagttatctgaagtagaaagatgatgaaccaatcaaaaatagtaactgacaacttttcaagagatagacaatacattaagatataaatggaaacaacaaaaggttaagagttggaggaagcagtaccatgctgttctggttactgcagtcttgtggtatagtttgaagttaggtagcatgatgcctccagttttgttctttttgcttaggattgtcttggctattcaagctcttttttggtttcatataaatttttaaagtttttttttttttaattctgtgaagaattccaatggtagtttaatgggaatagcataaaatctataaattactttgggcagtatggccattttcacgatattgattcttcctatccatgagcatggaatgtttttccatttttttgtgtcctctctggttttcttgagtggtggtttgtagttctccttgaagaggtccttcacttcccttgttagctgtattcctaggtattttattctcattgtgacaactgtgaatgggaattcatttatgacttggctgtctgcttgcctgttgcgggtgtatacaaatgcctgtgatttctgaacattgattttgtattctgagactgctgaagttgcttaccaacttaagaatcttttgggcttagacaatggagttttctagataaagtatggagaaaatttttgcaatctgtccgtctgacaaatgtctaatattcagattctataagaaacttaatcaaatttagaagaaaaaacaaacaaccccattaaaaggtgggcaacggacatgaacagacatttttcaaaagaagacattcacacagccaacaaacatatgaaaaaaaagctctttgggaggccaaggcgggtggatcacgaggtcaggagatcaagaccatcctcgctaacacggtgaaaccccgtctctactaaaaacagaaaaaaattagctgggtgtggtggcaggcgcctgtagtcccagctactcaggaggctgaggccggagaatggcatgaacccgggaggcagagcttgcagtgagccaagattgcgccactgcactgcagcctgggcaacagagcgagactccgtctcaaaaaaaaaaaaaaaaaaaaaaaaagctcaacatcactgatcattaaagaaatgcaaatcaaaaccacaatgagataccatttcatgccagtcagaatggtgattattagaaagtcaagaaacaacatgttggcaaggttgcagagaaataggaacgctttcacactgttggtgggaatgtaaattagttcaaccattgtagaagacagtgtagcaattcctcaaagatctagaaccagaaaaaccatttgacccagcaatcccattactgagtatatacccaaatgaatataaataattctattataaagatacatgtacacatatgtttactgcagcactattcacaatagaaaagacatggaataaagccaaatgcccatcagtgatagactggataaagaaaatatggtacctatacactatgcaatactatgcagccataaaaaggaatgagatcatgttttttgcagggacatgcatggagctggaatccattatccttagcaaactaacgcaggagtagaaaaccaaacaccacatgttctcacctataaatgggagctgaacaatgaggacacacggacacagggagaagaaaggggaacaatacatatgggggcctgtcaaggggtgaggtggagggagggagagcattaggaaaaatagttaatgcatgttgggcttaataactaggtgatgcaatgatagatgcaccaaacctccatggcacacatttacctgtgtaacaaacctgcacatcctgcacaatttacctatgtaacaaacctgtacatcctgcacatgtgccccagaacttaaaatgaaaataacaaaataaaatttaaaaataaagaggttaaggtgtagagtttttattagttttctttttgtttgtttgtttatgcaagcagtattaagttcttatcagcttaaagggttataagacagtatttgcaaggcttatggtaacctcaaatcaaaaaaaacatacaacggatacacaaaaatgaaaagcataaaattaaatcaaatgaccagaaaaaaatcaccttcactgaaagtaatacagaaagaaaagaagaaagagaccataaaacaaacagaaaacaagtgacaaaatgacgggagtaagtccttacttattaataataacattgaacataaatggacaaaactctccaattaaaagacatagagtggctgaatggattttaaagaacaagatctaatgatccgttgcctacaagaaacacacttcacctatacacagactgaaagtaaaggggtggagaaagatattccataccaatggaaacaaaaaagagcaaaagtggctatacctatcctatatcagccaaagtagatttcaagacaaaaatcataaggagagacaaagaaaatcactagataatgataaaggggtcaattcagcacaatatttaacaattgcaaatatacatgtacctaacactgcagcatcctgacatataaagcaaatactattagaactaaagagagaaatagactccaataaaataatagctggagatttcaacataccacttttggcattggacagatcttccagacagaaaatcaacaaagacacattaaacttaatctgcactacagaacacatggacctaccagatatttagagtacattttatccaacagctgaagaatacacattcttttccacagcacatggatcattctcaaagacagaccatatgttaggtcacaaaacaagtcttaaaacattcaagaaaactgaaataacatcaagcatcttccccgaacacaatggaattaaactagaaatcaataaccagagggatttgaggaactatacagacatacagaaatttaaaaatatactcctgaataatcagtgagtcaatgaagacattagaaagaaaatggaaaaatttattgaaacaaatgataatagaaacacaacctaccaaaacctatgggatacagcaaaagtagaagaaagtttatagttatacgtgcctacatcaaaaaataataaaaactttaaataggcaagctaacaatgcatctttaaaagttagaaaagcaagagcaaaccaaacccaaaattagtagaagaaaagaaataataaatttcagagcaaaaataagtttgaaacgaagaaaacaaaacaaaagatcaaaaagcacaaagttggttttttgaaaagataaagaaaatggacaaacttttagccaggctgaggaaaaaaacaaagactcaaataaataaaatcaacaatgaaaagggaaacattgtaactaatactgcagaaattcaagaatcattagtggctactataagcaactatctgcaataaattggaaaatccagaagaaacagataaattcctacatgcgtaaaacctattaagattgaaccatgaagaaatccaaaatctgaatagaccaataacaagtaaggagatgaaagccataatagaaagagtctcccagcagccgggcgcggtggctcacgtctgtaatcccagcactttgggaggccgaggtgggcagatcacgaggtcaggagatcgagaccatcctggctagtatggtgaaacctcgtctctactaaaaaaaaatacaaaaaaattagccgggcatggtggcgggtgcctgtagtcccagctactcaggaggctgaggcaggagaatggcgtgaacctgggaggcagagcttgtagttagcggagattgcgccactgcactccagcctgggcgacagagcaagactccatctcaaaaaaaaaaaaaaaaagtctcccagctacgaaaagtccaggactcagtagcttcactgctgaatttcatcaaacatttaaagaagaactaatatcaatcctactcaaatgattcagaaaaataaaggaagagggaatacttccaaagtcattatgcaaggccagtattaccctgataccaaaatcagacaaagacacattaaaaaaaagaaaactataggccaatatcacttatgaatattgatccaaaaattctcaacaaaataccagcaaactgaattcaacagtacattatgatgatcattcatcatgaccaagtgggatttatcccatgaatgcaaggatggtaccacatatgcaaatcaaacaatgggatgcatcataccaacagaatgaagaacaaaaaccagataatcatttcaattgatgttgaaaaaacatttgataaaattcaacatcccttcatcacaaaaactctcaaaaacctggatatagaagaaacatacctcaacataataaaagccatatacatcagatctataaatagtataatactgaatggggaaaaactgaaagcttcttctctaagattaggaacatgacaaggatgctcattttcatgactgttattcaacacagtactagaagtcctagctggagcagtcagaccagagaaagaaacaagggcatccaaattggaaaggaagaagtcaaattatccctgtttgcagatgatatgatcttaaatttggaaaaacctaaagacttccccccaaaactattagaactgataaacaaattaggtaaagttgcaggacatggccaggcgcggtggctcatgcctgtaatcctagcactttgtcaggccaaggtgggcggatcacgaagtcaggagatcgagaccatcctggctaacgcagtgaaaccccgtctctactaaaaatacaaaaaattagcctggtgcggtggcgggtgcctgtagtcccagccactcaggaggctgaggcaggagaatggcgtgaacccaggaggcggagcttgcagtgagcagagatcatgccactgcactccagcctgggtgacagagcgagactccatcacaaaaaaaaaaaaaaaaaaaaaaaaaagttgcaggacacaaaatcaacatacaaaaaccagtagcatttctgtatgccaaaagcaatcatctgaagaacaaatcttgaaagtaattccatttacaataaccacaaataaaataaaatacctaggaattaacttaaagaagtgaaagatctctacaatgaaaactataaaacacagaatgcaagaaagaaaagaagacacaaaaaagagaaagatatcccatgttcatggattagaagaattaatattgttaaaatgtccataccaaccaaagcaatctatacatttaatgtaatccttatcaaaatatcaacgacattcttcatagaaatagaaaaaaaaaatcctaaaatttaaatagaaccagaaaagacccagaatagccaaagttatcctaaacaaaaagaacaaaactggaagaatcgtattacctgactttatgttacagaactacagtaacatggtactggcataaaaagagacacatggatcagtgaaagagaatagagaacacagagattaatccgtacatctatagtgaattcatttttgactaaagtgccaagaagatattctggggaaacgacagcctcttcaataaatggtgggggtcaaactggatatccatatgcaaaaaaaaaaaaaaaagaaagaaactgtactcctatctctcaccatatataaaaatcaaatcaaaatgaattaaaaattaaatctaagacctcaaactatgaaattactaaaagaaaacattgagaaaactctccaggacactggattgagcaaagatcgtttgagtaataccccacaagctcaggcaatcaaaccaaaaatggacaaattggattacatcaaactgaaaagcttctgaacagccaagtaaacaatcaacaaagtgaaaagacaacccacagaatgggaaaaaacatttgcaaactatccatctgacaagtggttaataatcagaatatataaggagctcaaacgactctataggaaaagaatcttatgatctgaattgaaaatagacagaagatctgaataaacatgtctcaaaagaagacataaagactgcaaacaggtatatgaaatggtgctcaacatcattgatcatcagaaaaatgcaaatcaaaacaacaatgagatatcatctcaccccaattaaaatggcttatatccaaaagacaggcaataacaaatattggcaaggatatagagaaaaggaaaccctcccgcactctgggtgggaatgtaaattagtacaaccactataaacagcctggaggttcctcaataaactaaaaatagagctaccatactatccaacaattccactcctaggtatacaccaaagagaaaggaattcagtatattgaagaggtatctgcctttccatgtggattacagcattattcacaatagccaagatttggaatcaatctaagtggccatcaccagatgaacagataaagaaaatgtgatacatatacacatagagtactattcagctataaaataatgagttcttgtgatttgcaacaacataaatggaactggaggtcattatgttaaatgaaataagccaggcacagaaagacaaacttcacatgtcctcatttatttgtgggcactaaaaattaaaataagtagaagggcggttaccagaggctgggaaaggtagtggggagatgagaagaaagtgcagatggttaatgggttcaaaaatatagttagtataaaacctagtatttgacagtgcaacagggtgactacagtaaaaaataattgtacattttaaaataactcaaggagtataattaaattgtttttaacacaaagaataaatgcttgaggtgatgaataccccatttaccctgatatgattattacacattacatgcctgtatcaaaacatctcctgtaacccataaatatgtatatctactatgtacccacaaaaattaaaaataaaatctggctagcacaactaaaaaaaaatggaggaacagaatataatatgtaaagagtctgatttttcttatccactggattaggagaagaacagtaaacaagatttatgagcttagactcattgcaggcctctccttaaataaatgtcgctgaggatccataatgtgtacttcagaaaggaaaatatttttcttttaagaaatgacatccaccttgagttttccaagaacatccacctctttccatgtgaaatgtttgtcaccccctttcactgaagatattactgggcttctacaggagaggtagaatttatcattcagcacaagatatatactttgggtttctaagaaagtatttggattctaacaagctctgcttttttttttttttttgagatggagtctcgctctgttgcccaggctggagtgcagtggcacgatctcggctcactgcaagctctgcctcccgggttcatgccattctcctgcctcagcctcccgagtagctgggactacaggcgcccgccactgcgcccggctaattttctgtatttttaatagaaacggggtttcaccatactagccaggatggtctcgatctcctgacctcatgatccgcccgcctcggcctctcaaagtgctaggattacaggcatgagccactacgcctggccaacaagctctgattttttaaaataagcccatgtatcaatgtacaaataagggttttctcagacattactggatgtctaaatgcctaaagtggtcctcaagggtaacacgtacacatttaagagtaatatcctgtttgtatacccaacctggagcctgagagatgccacaaaggccccagctgactaagacctttatccatccagcagttacctactgtggtgaagcttagatctcagataaatgaaggtttaagatgaatttttacttctgagtttttctccaactgcctctagctgactggcatactctactttggaacgttttcagatttgaaccataggtgggtgtggtggataaagatgagcgagctgacagatttgtgtgggaaagcacatgctatctgtcaagactatctttataaaatggaaaaaggcactttataaatgagaaaatctggctcaaaaagtatatggattaaacatataaatctcttactggttttgtttctctggagaaccttgactaatacagatgtctgttagatgttaggttctgaaatgtagtacttgcttgtttgaatatgagtaagattccagaactccatgctgatctgttatctcattaaaatgaccctgaagtacagtagtccttgtcctttccatcactggcatttatgaagcatatgctgggggtaaagtcctatcccagcctttacaggaaagaaaagcataattcctacgtttgtagaacttatactctatatcatttccctcaaatatatgatcccactatgcagggttttgtcatggctaaaccgcttagtccaaattattcactaggaatataaaaagtggttggagacctcaaagatatttatctcaatattttccttctcttcttatattacctgaggactttcatcttctgcacacctttttattttgttttgttagaactgaaaagtgcttttatctggacatcaaagataccacttcacctagaacaggttatagctaaatcataacatctctttgaagatccttcagtagtgatcagagatcaaaaataaagtgtaatggactttgatacttaaacagcaaaacattttaagggtcaaggatttttcaacactgatattacacacactaagaatttggatgtgtatgttttgtgcagaagagaagggagtaatacccatcaattattagaaagttagtccattgtgcaactcttgactgctgtatcttccaatccaatcatttgtttaattgatgttagttacatttttagggtgcttaaatgattcaagtatatatttgttaacttccaagtggaccacttgtctggtttgagttttggtggaacaattttaaacatattatctattataatgaggacagagcaacaatataatcacaatctaatgtctgctgttaactaactgaccttagctgccacctgagtctccacgccttttctcctaaagactcttcttcctggaatcgctagccacaaccttcacctggcagtctccttgttgttgagacatcagctcaaatgttgccaatttagcaagactttctctagccaatctaagtattctccatccccacacaaagatgctttatgaaatcagtgtcttgttttactcctaacactcattactacctgattctttttcattttatttatttgttgtgttctttttaaggaaatgaaaaccttatgagtacagaaattgtgccttattgactggtgtattccaagggtttgaaatagtacttggaacacagtaaatgcacaatcagggtataaatgaatgaaatcatatacataaactatatgttttgaaattagtgtttacaacttatcaggtctgaaaaagccaattcaattcactcatttttcattgacctaatttgtacatatcaaatgtctaattatccaacaagaccttcttcaacttctcttcaaattactccaaaactgcaagcatccttataaaaatctaacacaaagctatgaagaaagataacatattaaactttctttcgtgcctctttgttttttaaaaaaaatttcagtaaagaacagagctgacctatgcaataaattggttttttgttttgctttaaatttatactatgtgctagagctatggggggagaaaagggagggagaagatactcagatgaaactaacagaatctctcaccaccaggcctgcactgttgaataagagggtcaacagagaaaccagttacctctacatttaatgacatcagaggtaaactgaagacatcagctgcagacaatttctgtgttcctcccacttattgattagtatcaataatggtgaaagtacaacagttatatctgagggctacttgtgtttaacttggctcatattaaagaaatgaaggcgagtcataaataacagccacagtgaagtaaaagaacaatcagaaaaccatgcatgcatttatttttaactttcatgtacctaatggtctgtttaaagaaaaactctacctcaatgaaaaacacaggtccacaaacattcccaaatataatttccaaaatcagtttttttagacgtataaacaccccctgtgtgcacacatatgcatcttcttatatgtaatgacagacttgatcctctagaactttgaaattttgatattggtgtgtcattattttattgcactttgacaagctgaagcaggtaaattctgggatcatgctatactacatctgcaaggtacattttcatacatggaagtgactgttcaaacttttggttaatatacagtatgtgaagcatctaagaaggcttttttttcaattaatggcaaatccttttaataaactcaatgtgcccaactcatttaatttttgaaaatacctctagtgagaaaaaatatgtaatataaaagcaaatctattttccctactttagaaatcaacggaaaccacaaattttaaaataaccacattttattatgtccgatttttctttaacgattcccttgagctctccgtgttactgaaggaagtcaaagcagcaggttgagctacctttttaggagtgatttttcatgagagagcaatgcaagaaagaacatcatcctttttggtgatttcagaaatatagcaggcaaattcctcatctagccttcaataaatactaatgccatttggatgacaaataaaatattcttgaagggtccgtgaccagagaaaccagcattagatctaaaaagtggtttttcccattgatatctagccatcaaatgaaaaaaaaaaagtttttactcattcatctgttcattccaccagtattttgggggtatatattgaatgacaagcagaaagtgctcttcagtgggatactcagggttgaccttctacaactaaggcacagggatactgacacaggacagacctgcaacagtgccagggcagattctgggggctccttagtccttctgctgttggaccatgaggaaatctggggagccctgggcaggttcagggcagtggaggtggtggtgcagtcttgggcaacttggaagagcatctatttgccaaggagagaggaagtacttcaacgttctaacaacccatcgagtcattaaggagcacagaggaggtggactgaccccagattgcgggcttgtgaatgcaggggtcagtgtccaggaaaaagaaccggggaaggaagctcctgaaacatccaacgagagtgagtggtcagcagatgactccaacccgtactgtaaatatccttcaactttttacctttaaagtcaaatgtgacctccaaaaacctcaaattgaaaataacccagactgggcctagaagcagatgtgtatgatttaagtgcaaagatggaggcataatgtctaaggggaactggagccataaagtgctggtgcaatctgaatgggaggcagggaggagagaaagacaaggctggagagctgggcagcgaccagatggtaggtgttcttctgcaccttgttacagagggcttaggctccatcaagttatactagaaagccatgcgagggcttaaaacaggaaaacgacttgcctagataagtatttttgacagttcactctggctcctatgaaggggttggcttgaggagcaaaatgctaaaggctggaaggctaaacaggaaaaagtatagtcaatagtgaataccctgcacttgtctaaagctccatggcaaggtacacgaccatgatcaaagccagttatggtggcccaaaccacaagaagagatgagaactttggaaaataatctagcagttcttcaaagtattcttcaatggctagatatagaattaccatatgaccgagcaattatatgtgcaagagaaataaaaacatatgtacacacaaaactgtacataaacattcatgttagcattatgtataacagccaaaaagtggaacaacttaaatgcccatcaactgatgaatgggtaagtagaatgtggtatacatgtacaagggaatattatttagtcttaaagaaatgaagtactgatacatgctacaacatggatgaaccttaaaaatataatgctaagtgaaagaagccagtcacaaagggccacgtattgtatgattccatttgtatgaaatattcagaataggcaaatctatgtagacagaaagtggattagtggttgcttaggactggggaaggggaggaaggatggagagactagggagtgataactaaggggcacaggatttcttcttgggtgaatgaaaacattctaaagcgggttgtgcgatcaatgcacgactctgtgaatatactaaaaggcaagaattacatacttccaacaaatgaattgtacagtatgtgaattatatctcaacaaagctgtttacaaaaaagtgtggacgagagccctttcaacaataacaatgtaaagtggccctaagtggcaacctggggaacaccaacatttaagcagcaagaggaataagaaacgccccaaaagagacaaagaaaaaaataactggaaaagtttgggaatggagagagctaaaggagcaaaggatgcctaaatatataattgctcaggtttaattgggaaaatgaaattagatccatgcttatgaaacagtaaggaaaccaaagtatccagtgtcttcaaaagatcaaagaaagactctttactaaacttcatgcaaggttaaagtgaatactagctcaagaacatctcacagaagagggatagcactgggggcaaaaatcaagttattgtatttttatttttcagtgcttctttatctgaagcaagttttatcaattttgtcaagtgcacgggataaatgtaactcagaaaactatctgactgaagtgtgttctcctagatggttcatcacgcttggtcttcatttagcctctgtcaagagtagttacctaacctgccaaataaagggcacatagcagagcatggctccacagtatttttgtgagtatgttggttaattttctgtgtcaacttgacagggctaacggatgcccaaacagatggtaaaacattacttctgagtatgtctgtgagtacatttctagaagagattagcacttaaatcagtaaactgagtagagaagatcaatgtagacagatttattcaatccttgagggctcagagagaacaaaaaggcagaggatgggcacattttcttttttttttgagacaaagtctcgctctgtcacccaggctggagtgcagtggcgcaatcttggctcactgcaacctccgccttctgggttcgagcaattctccctgccccagtctcccgagtagctgggattacaggcacctgccaccatgcctggctaatttttgtctttttaatagagacagggtttcgctgtgttggccagactggtctcgaactcctgacctcaggcgatccacctgccttggcctcccagagtactgggattactggcatgagccaccctgcccagccagaggatgggcaaattttttgtctctctccttgaattggaacatccatcttctcctgtccttggacatcagtgcttctgcttttcagacctttggactccaggatttacaccagtatcaccccctgtcccccagcttctcggaccttagaaatagggctgaattataccactgactttcctggctctctggcttgcagacaacttctcagcttccataatgaggaaccaattcccataataaactcctcttatctatctatgtaaatcctattgattctgttgaagaagcctgattaatacagtaagaaaaacgtgtctcctatctcctacctcctggaatctttgaggtaaatgaggtgggatgggtttctgacagtaagttcataagcaaagcactggtgcttcgtttccactgacaagagacataaaatggggagtgagagagacaggtagcagcaacaactggcttgtatgtatgctagggtaaagttttaaattattttgatagctaacaaccaataagatatggattccagacccagcttatttttcagtgtattagtttgctaaggctgctgtaacaaaatgtcacagtgtgggtggcttaaacagagatgcattttctcacagtcctgggagctagaagtccaagatcaaagtgttggcagggttggtttcttctgaggcctctcttcttggcttgtcgatggctgtcttctccctgtgtccctctgtgtgtctgtggccaaatttcctcctcttagaaggaccccaatcatacgggattatcacctaccctaatgacttcatttcagtttaattaccttttcaaaggtcttattttcaaatacagtcacattctgaagtgctgggggttaggacttcaacatatgaatttttgagaatggggacacaattggctaggtgcaaggaattagaatttcagggtaagaattattcaatcaataaattattttaactgcctttacatttgtttgaggaaaattccgggacacgttttggttttgttttgttttaacaaagttaatctaacccatgcttaaaaattaggtggttcacagtattcaatccattctgagaactgctagtggccaatgtcgctgtccatcatttccctttgccccactgaaatactctcaggctctttggtggtaacagagcaacaaatagagtgcttttccagatctcaatgttgtcagagttgcctttgacaacaaggaaggaaacattgcctttcttgcactacttgtgcctaactctcaactctgaggcactgcaagcaggagcaagagagaaacatcaaggctgagcatgggagaaacacatttgttaattgtgtttcaggctgagcccctgaaaatgtgaagcaaggagactgggcttgattttaatagacctgattctgttcatgtggctagattttgttgctgaggacttttcccttactcactggatcaaaagattgtgagagttaataatataacacaagagttaaaactatttagtgtacaaggctgagatcataaatgaaaaggatgggccaggttttggttttatgatattaggtgcataagtctggtacatttcttatcatctttgctctgatctatttttttttcttttttgtcatcgtagttatacttctaacataatttatgatttctttacttatttcatttactctttatctctctatatgacactaaaatgtaaattcctctaggacagggatctctgtctgttttattccttgatccatcccaagcacctaaaatagaactgttcccagagtagtcattcaataaaggctggttgaatgaatgaataaatatatctcattaaatcaagcaaactgattttttaaaacatgcattccaaaattctaattacttaagtgtgttgtcccttgaaattgtcaccttggggactctaggcttattccaattatgctattactcaaaaatatttagactctttaaagccccagtttatgagccacacaagaaattagtcttattaccttatatagtttacttttcactataaccatcatttttcaatgtgattatctattttctttattgaaatttgttccaaatggcttttagctcttttctcaagtcaaacccatcctgaaaggatgaagagttatgacaattccgtagagaattaacaacagcaaaaaatctctcattacagtcaccagaattgaagggagccccagtaacattctgtaacatctcttgcttctcaagaggaatttggctaatcacatttgacagtgttttgttttgccagcacttgctgatttaattaatttttaaaatcaagtgccactggtatagttaggacactcagcacaacaggaggcaaagccatgaagaatcagcaaagtgacacttctttgtatttcacagggctatcttttacaaacaactatttttttccaatacagaaatattaagtgctaaatggagaaaacctggaaaatgcataaaacaacagagaagtattccgatagaattcctatgtgcagaaatgagtgtgcggaaggccggatggctgcagcttcatctcaggcgcagttgccttcttacagatccctgactcgtcggctctgcagtcccgcgacctcagcactttggcaaaccgctctatcctctgccaggtgtgctgtccccccactgtccctcctttcacctggtagcactatctcaccaaggagatcccagcttacatcatttcctcggggcagccttctctcactattgggaagaagtctcatgagctttggctttgtagcatgtatcactgtgcatggttacatattgggtgactacttgatttatacttgtctctttactaacctatgtaaaatgagggcagggatcatggatgttttgatcaccatagtccctcaagttcctagtgctgacccctcgctcaataagtacattcctccatgctgcactcacatctcaagtgctaatcacttgttagaaccaggttaggagctagattgtgaccaagctctttcattaacctgaagaactcataaaaaatcatcacacttaagtacctggtccctttaaagaagtcctgaggtgatttaagatttgatcataaatacgttcattcttaagctttttatgggagacaatataaaaaatgcccattagaaaaatattggtataacttttgtaaaaccatacagtagcttccctttatctacaggggatatgtttcaagacccccactggatacttgaaaccatggatagcactgaatgatacatatacattatgttctttcctatacaaagatatctatcataaagtttaatttataaattaagagattagcaataactaataataaaatggagctataacaatatactgtaataaggccgggtgcagtggctcatgcctgtaatcccagtactttgggaggccgaggtcaggagtttgagaccagcctggccaacatggcaaaaccccgtctctactaaaaatacaaaaaattagccgggtgtggcggcacatgcctgtagtcccagctacttgggaggctgaggcagaagaatcacttcaacctgggaggtgaaggttgcagtgagccgagatcgtgccattgcactccagcctgggtaacagagcaagattccatctcaaaaaataaataaataaaataaaacaatacactgtaataaacattgtatgaatgtagcctctcttaaaatatcttactgtactgtactcacgtatttttgagctctggttaaccatgggtgactgaaactggaaagtgaagccacagataagcagggaccactctcataaaaaacctattgtctgcaattaaggtccatgtagtaagtttcttctacggaaagaaaaaaggtttgttcctcagaagaatttttctgcttcctacttgaataagaactgtaaaaaccccaaattttcactgtttcttggctatcaagaaggttggaccaaagctgacctccttatcctaataattagtgcatgcttggcacgtacttttcatctgtttgtctgatcttctgaattgattcttgttctactctttaattaccttggatcttcatgttttaataccataggatgcttcaaatctattctataaataggtgagattggaaacaatgagtaaatatttatcggatcattatttttccaatgttaagtgttttaatcagtgtagtatgtttatgatttttgaaactctatttttcatgatatcttgagttattaaacatgattccactaaaagcatttgaatattttatctggcccaaattctgatatatgtacaaatgttcacacattataggcaagattacatataaaagaatggcatacaatgtatcagtattgctgtggaacaaaccattccagcttagtggtttaaaacaacaatcaccttattaactcaagaattcagtgggttggcaatttggggcggattcagccagtcagttctgctgattcagtcactcgtgcagctgcagtccttccgcttttcaggtggggcaggatggcctaggaaggcctcactcccttatgttgatgctggctatcatcttggccacaggtctccagcaggctagccagggcttctttgcacaaaagctgggttccaaaagcagcaagagaaacagagctcctgtgctaaagtgcccttgaaagctctgcttgcaacactttgctaatacaggtcaaaggaaatcacatggccaagctcagagtcagagtgggacaatgatacaggtaggctggattaactggaagctattactgtaataatttactacagaagataataaattaattaaaataatctttcttctcagttttcaaaatacaattgaagttactgtttttgaccaaataataggcagtctctggaaagcaattgtggtttaatacaacctctaagttccattgctcttcaaggatctcgatttactgttgcctgatggccaaaaaaaaaaaaaaaaaaaaaaaaaaaaaaaaaaaaattccttctttttccagatcagaaaaaaaaaaggtcagattcagatactgaggtatgtgaaaatcagtatttcactagatcaggcatagttccaataccagtataaagaaacaaatctgaaagaaaagaaattatgtttgcaaaacaaatatggagacagattctataactctggaaagatatagtagataataagaatacatattctcaacttttcagtcagggaccataatatcaacaaatcacaaagaaagaaagaaaaatatacactatggtggtgaattgagaatattaatgataactatgacttattgtttataacctgaatccaaaaagtcctataaaataaacaagttttcaagttgaatgaaatatcattagctttagtgtgatggttgatactgagtgtcaacttgattggactgaaggatgcaaagtattgttcccaggtgtatctgtgagggtgctggcaaaggagattaacatttgagtcagtgggctggggaaggcagacaatctgatcagctgccatcgaatataaagcaggcagaaaaacgtgaagaagcaagactggcctagcctcccagcctacatctttctcccgtgttggatgcttcctgccctcaaacatcattctccaagttcttcagttttgagactcggactggctctccatgctcctcaagcttgcagacaacctattgtgggacattgtgtttgtgtaagttaatacttaataaactcccctttatatatatgtgtctgtcctattagttctgtccctctagggaaccctgactaatgcagtaagcataatagtattttggttcaataaactgaaaacaactacagtaaaaactggtttattgttccaaatcagttcattaaacattatacatttcagagaatcacaagcaaatgtattgaaagccaactctggcatccacttggaagcttacaattagagtagatttcaatataattgaagtaggttttaaaatctgtccctaaactactttattatcctcatctcctgcatagcatcagccttctaccttcccagaacatttaagcacttgcttctcctcatgtacatgtcttggtaatcattatttctaagccttggtatcccttctccctctcttcaaccttatccactggtcttatttctgaagacccaatgaaatatcactcctctgtgaatccttccctaacacccacaagaagaaataacttgctcctgtgtactcccccaaaacattttacttcctttgtcttcccagacaattcttgttatcctttgggctggtctcttaagcaaatggctctattcattcaggaagggttcaggcttggtatctctgatttgtgatgagatgttaagttaagctatctgctcaattatgtaaaagatgaattgggatgaagagggagaggagaaggaagatggaaaacgggaagctggagacagagatgaagtggcgaggaaaaaagttggggacagggaaaattcaagggggagggaagtggggaagggaggaaatctttgcggaaggaagtcaagaagagagaagagtgagagaagacgctctagctcacaatagagtttacaatgtgtccgactctatgtttttaatctttacaataattttatatgtaaatactattagtatccctattttacggatgaagaaactgagacaaggagatttgtgtacctggtccagaatctcacaattaggaagaggcacagccagagcactaacagaggtctagatgccttcaaggcagagcaatagtcactacatcttcctgcctcacattgatctgcctttcagtcaacaaagagtaacttcagactcttgcctggaactatttcctgatcaatttcatcaagactacaatggagaaaaattatattttgtaaaggttatttgtgaagtatatgccacccactcatctagacagcctaggtttaaaacctcaacaatgaaaagaattactaaggtatttcacttattcattttcagcttatagcagaaattctttcctgaattccttcagtgtgatgccccctgcttaccttcagcgatgttataagcaacagccttatgaaatctagtgctgtatttgttgctggcttgtagcttaggacctagagcctcactagaggaggcaggaagcttgcttcgggggaagtataacctagtgatgaagaggatagattccgcaattgttcaagcactgcttccagttgttactatgtattatgtaaagtttattggattctccaagcctcagcattgtcgtcaataacacgatagtccctggctcacagagttgctgtgaagatttatgagagaatgcttgtaaaacactttgtaccatgcctagcacacagtaagtgctcaatacatatcatcattaaacagtatcccccaaaactaaagttgcatgcaatatctttcaggtctagattctagcaaagattttgcctctcttaaagagttgacatcctcttatttgcatggacattgaacttctcttttagctttggccactactaagatcaaagacaaaatttcacctcaactgtggcacatttgtggaaatctattgcttgtatgtagatctctagtctaatattgttttccatttcatctatattttcccttattctgattgtctattagtatatacattattgtaagctgcttcaaatatttgtggaataaagcaaacatcataaatgaattaataattctgcttttttaatgtctgctcaatcaccaaaaaaggctgtttccctaatgtggggaacatattgattccctgccaaaccaaacttgatgatttgcaagcaacatgttcttagaaaacatttactgagtactattcaatattactattgaatagtatgactattgaattacaggaaatatgatacttaataaaagtcctacagaaaacactgaaattccagttctagataacaatcacgcaaatgtgttttcagattacttcaaatttttttttcaataggaagtgtttttctcccacttttgtttttctggtcatcttttacagtaatttcaagtcatgctcttttctcattctcccaggagaagaactgtgctatgtctgctactgaactcactatgattgtgtaccaagatgcattcatagactttcctgtgagatgcaacccccccccgacattaaaataatatgtgttttggagctcgatgggaatatatgagcattgagactagctgcgccactttttagatgagaaaacaaggcccagagagcttatgaagatggcagcagtggagctgaataagaacacagccttgtcaatctccatccaggtttttctcactatcctctcctgtaactttctagaagagcaagtgtcataatgatggaaactaaattagtcgcatacacaaagaatcatctgttctttccgtttaagtttcctttctaaaatgccttattatacaaacagcaaactatttaaagagaggtttcctggaatgagtgttactggtctggaagggcctctgaagagtccaggaataggtctgctaaccaaaggaatgaccccctcacagagaccaccactgactgccatgtgagccgccgtccctccagctgccctcactccaccggctgctccctctcacatccctctctggattccttatcacaaggtattattatcttctttatcttttctttgtgcatttagggtgttgtcactgcctctagtgtgcaaagtacaccctgcccgttagctggataggcaatttttaactagttgtaatgtatgtggacaatctcattatcagttattttcaattaattctttttctgatgtgtcgaatttgtcacagtcttcatttagatctgtttctctatctgtatattatacacacatacacacacacattataaggttgtcagtgtgatcttaaaattagagtttatatgttcaaaatatttaatatttagaacttgtataaaacatttagggtttttttttcctttcaaatagtcgtattagtttaacatcagctaagaaacataattatgattgaacacatccatcaaaaaagttagatcttcatgttaaagcccaaaataaaaactctaagcatagaaaattaatggatgcatgctaattgccagaaacatttgctgctcaaaacaaagaaaatagagctgaattatattattcttaatgtctttgtaatctagaaggctttgtgagaatatacccaacatgaggaaacagggttagagatttacagatatttgcatgcttttctttccggcaaatgcaaatttcttaaggaaataaaaagatctaaacattgcaccatgtcaaatgaaaatgagtgcaggtgagagcaagatttgcctgttgcaatatctttgcctctcacttagggaacaagagagcttctttttttacattttcccctttttttccaaagctattttagccaaaggaatttttaaaaggagtctcaaaatcaaccttattttaaaaagttaattttaaaaagataaattcttgctactcaccaaaggttaatttctagatcaaaggtttctatttttagttacatatccaagaacacatctaactctaaacaactgcagatccacagaagctgtttccttatgaacaatgttaagtggtattggccccatttgccactaaactgagagctccttaaaagtgaaaattttccttaatttttgtcttattatctagcccacagcctgatgcatagggcttaataaatggttgaataataaatgaataacggaatggtaatcaactttaatatttacaagctttgctttaaaaataaaatgatccagagaagaaacagaaaaacatcaaaatcattaaatttaaaagtgtagcttaaagagaacttgatggtctccctgagctgctcttccatgctggaatcccctcatccaaagctaaacccactttcatctcagcttgacctctaccttccaatgacactcatgcttccaatgcagacaagatttggaattgcagaaaaggcatctcatttctagagaggatggataggcttttgcctccaggaaagtaatcattcactctctcttcaaaaaaatttatatttgcaaaaatgtgttttttgccatctgtttcattgattctggtcctgttttccacagtgccagctatcattcatgtcctcatctgcaacccgggactttgcagcaggatattgaaggtgtttaaggcaattagtaacacgggaaaaaatgcacacaattggtacttttgttacttctctatagtccagaagagaccttaggaggacagaaggcattttcatcaaacagcaaattattctaagcagaaacttttaaaatagactggtattttgaagatttgaaaattttaaagggtaaaagcatattcttttcagtctctcaaaaactgctgtcacaaaacttttgggctatttttttgctttaagaaccatttaacggccgggcgcgatggctcacgcctgtaatcccagtacttcgggaggccgaggcgggtggatcacgaggcaggagatcgagaccatcctggctaacaccgtgaaaccctgtccctactaaaaaaaaaaaaaaaaaaaaaaaaaaaaaaaaaaaaattagccgggtgtggtggtgggcacctgcagtcccagctactcgggaggctgaggcaggagaatggcgtgaacccaggaggcggagcttgcagtgagcagagattgcgccactgcactccagcctgggcgacagagcgagactccgtctcaaaaaaaaaaaaaaaaaaaaaaaaagtgccatttaacgagaatgtactagaaaagattatgcatcccttctatgatcacagtttcagaatgaagtggtttctaatggaggaggcataagacaagtccaagaaacttggtgtatctatccttatcaagaatatcatcagctcaccttcacggtagaggagtttacctatgccatctctctttcctaaaaaccttaaagacggggttatactgatttgaaacttttttcacttcagcttactcaggcttattaactaagagtaagatacataacttttgacattcaagtaaaatctcactaatttggattgtataaatttggaatctcttatcaaaagttaacctttgctttagttacagacatttaaaagaatttgatgaagcaaataaaatgtgtaaaatgattgccacgggcgtatgctggttactcaagaccacagtttgttttaaaaacacttcagtaatccactaaatacctacagttactctgcagattaaatctggaatatctgcctctcagcgtctagcccttgtgaacacagctggggtattctctgactctggctcaatttaggtcactgttgtatgtgtgcaacaacatgagagtttggctattttttgaaggcaaagtcctagatagtttcattgtgttttactttttgttacctgataccgaagtgtcaaaagaatgccttcatgtccctggatctgatcatcactgttctgctcatcttcattgtcttcttgatttcatttctctttctccttgctctccctaccccatctttctctctccctccctcccttccttcctttcttctatcctacttttctttctttttttctggtgtgccagtgctggttttcatataaaaacataaaatatgtttagagcaggatttttattaatgtagttcagacacttgtgttaggcaaataggcaataaacttcatgctgatcactttcttagaaaagttattggtaaagactttaataaaaactatctgaataagtataataagcctttacttactaccagtttccactttcaacaatgacaagtcatctactatatgcttaaaaatgtttttcaagaagagctactacaaatgaaaggagataaaacttcattcctttcaaaaaacatttcaaaattatttcttcattgactcagatgaacttgacataagaattttccccactatttctttttattatataattgtctaatgtttctaatgcaggtctcatgaaggctatatgtaaagttaacttcaattattagggattttaacaacacagattttagcttggtcattgtctccagaaaaaaacaccatgtaattctccaaattgccaagtctccagataagaagaagtgtggcttatgatacgtctctattgtttttactaatttgagctgtctgccaagaaataaagctaacaggaaactttttacaatagaacacgagattataattaggaatcaaacatgagatttctatataaggaacaactccccagcatgcttggaaatttcttttcagtttaggccctatgtcacatttccctgcagacatatgtgatcaaagtcttcagttcccataaaaccaaaaatcacgattgtcttttccatcattatagtcactgtggataaagaaaggaaatacaatacaagcagggactggaagaaaaaagtcatgaaaagctaacctttaaattaaacctctgttgaataaatttttaagaacttaataaaaactggtttccaagtcaaaattcaccatctacgggaatagaatcaatgggaatgaaaagagctcaccggcctctgaccaacaattgccctgaatctttcacctccaacacagcatagatagcatgaaaccttgattatccactaataaataaaataatatttttaaaagaaaaagagtaagggtatgggaggagataaactatgtagctaaagtcatggagcaactcgagccggtgaacaaacagctagtgctttaaatatgatggacatgcaagacaattataaactataaacaccactgtgcaaataaaatatactgtttttttcataacaagaaaattaaaattctaaaaggaaagacagaatggccaaaaagcaacaagaatatgggttactaagaagcatccactttcactacaccaaagacagttaccatgtattataggcattcctccttccacaggacaccagcccaccatgaagccctgctcatccttggtagcagaatatagaagaatggcatgcagctcagtttatctttattaaattattcatgggaaacaggcttctttctcaccaataggctcataggttttaacaaaaatttttcctattcttcaggtcacaaattaacccaatttgctacaaacaacacatcttgctgtaaagttgtaaaatatactgttttacattcataaataaaatttctaggagccagaaatgcaactcctcagctgatttaagcagtgtttaaatagtttattttttgattcagagagtacatgtgcaggttttttacccgggtatattgtgtgattccatggtttggggtacagatggtagtaagcatagtacccaataggcagtttttcagcccatcttcccctccctcccttcctcctctaatagtcaccagtttctaccgtttccatctttgtgtcaatttgtatttaattttagctcccacttacatgtgagtacatgcggcatttggttttctgttcctgcattaattcacttggaataatggcctccagctgcatccatgttgctgcaaaggacatgatcttgttctttttatggctgcatattattccatggagtgtatgtaccatattttctttatccagtccactgttgctaggcacctaagttgattccatgtctttgtttttgtgactagcacagtgatgaacatagaagtgcatgtatcttttatgtagaaaatttatttttctttgggtatatatttagtaatgggattgctgggtcaaatggtagttctgtttgaagttctttgagaaatctccaaactgcattcattccacagtgactgaactaatttgcattcctacgaacagtgtctaagagttcccttttctctgcagcctaaccagcatctactatcttttgactttttaataagtgttattctgactggtgtgagttggtatctcactgtggttttgatttgcatttctctaatgattagtaatgttaagcactttttcatatatttgttggccgcttgtatgtcttcttttgaaaagtatctgttcatgtcctttgcccattttttaattgaattatttggtttttgtttgtggatttaagttccttgtagactctggataacagatctttgtcagatgcatagtttatgaatattttcttccattccataggctgtctgcttactctgttgataatttctttgggtgtgcaaatgctgtttagtttgtttagtttccacttgtcaatttttgtttttgttgcagttgcttttggagacttagccatcaattattttccaaagccagtgttaagaagagtattttcggctttgttttttacagtttgaggtcttacccttaaatgtttaatccatcttgagttagttactgtatatggtggaatgtaggggttttatgagtctagtttcatccttctgcataggactaaccagttatcccaacgccatttattaaatagggaatcatttcaccattgctcatttttgtcagctttgtcaatgatcagatggttgtacctctgtgactttatttctgagttctctactctgttccattggtctgtgtatctgtttttataatagtcccatgctgttttggttactatagccttgtagtatagtgggaagttaggtcacataatgcctttgacattgttcttcttacttagggttattttggatattttggttccatatgaattttggaatagtttttttcctacttctgtggaaaaaatgacgttgatattttgatagagatggcattgaatctgtaaattgctttgggaaatatggccattttaatgatattgattcttctaatccatgagcatggaatactcttccatttatttgtgccatctatgatttctttcagcagttttatggttctccttgtagagatctatcacctccttgtttagatgcattcttagatacttcaattttttgcagctattttaaatgggattgtgttcttgatttggctcagagctaggatgttattggtgtatagaaatgttactgatttttgtatttgattttgtatactgaaagtttactgaagtcatttatcagctccaggaacattttggtgcagtcttttggggttttctaggtatagaattatatattcagcagagggagatactttgacttcttttcctatttggatgtcttttatttctttctcttgcctgattgcactggccaggacttccaatactatgttgaataggagtggtgaaagtgggcatccttatcttgttctagttctcaagaggaatgattccaacttttgcctattcagtatgatgttgactgtgggtttgtcatgaatggctcttattattttgaggtatgtgtcttcaatgcataagctgttgagggttttgaacatgaagggatatcagatttcatcagtttttccacatctattaagataatcatatgggttttgttttttattctgtttatgtggtgaatcacatttattggtttgcatatgttgaaccaaccttgcatcccgggaacacagtatatttgatcatgactaattaacttttgatatgctgctgaattcagtttgctagtattttgttgggaatttttgtgtctatgttcatcagggatattttcctgaagttttcttttttcatgcatctctgccagattttgatatcaggatgatactggcttcataaaatcagttagggaggagcctctcctgtttcattttctggaatggtttcagtgagattggttccagttcttctttgtatgtctggtagaactctgctgttaatccatctggtccatggcttttttctttttttttaattactgattcaatttcagaggttgttattggtccgttcagattttcattttcttttgaatttcatttgaatcttgggagattatttgtttccaagaatgtatccatttcctcaagattttctaaatttgtgtgcacagaggtgttcataatagtctttgtggatcttttgtatttctgtaggatcagttgtaatgccacctttgtcatttctgattgtgcttatttggatcctttttttcctttgttaatctagctagtgttctatacatcttgtttattctttccaagaactaactcttgctttcattgacattttgtagtaacttttgcatctcaatttcattcagttatttccagattttagttcttttcttttgctaagttttatgttggtttgttattttctcctctacttcctgtaagtactatggtgggtaattaatttgaaatctttctaacttcttgatgaaagtatttagcactataaactttcctctcaatatgctttagctgcatccccaaaattttggtaagttgtatctttattttcattaattttaaagattttttttaaatttttgccttaattttgttgttcacccaagagttacttcagagcaagttgtttaatttccatgtttttgctagttttgagagatgttcttggtattgatttctatttttattgccctgttgtccaagagagtgtttgttatgattttttttaacttgttgagacttgttttatagctgggcatgtggactatcttagaatatgattcatgtttggataaaaaccgtgtatattttgtggttgttgggtgcagtattctgtagagatctattaagtccagttggtcaagtgtagagtttaagtacagaatttctttgttagttttatgcctcaatgatctaatgctatcagtggggtgttcaagtcccccactagtattgtgtggctgtctgagtcttttcataggtcaaaaagaacttgttttatgaatctgggtgctacgatgttgggtgcttatttattttattttatttatttatttatttttttaagacagagtctcactctgttgaccaggctggagtgcagtggtgtgatcttggctcagtgccagctccgcctcctgggttcatgccattctccttcctcagcctcctgagcagctgggactacaggtgccgccaccatgcctggctaatttttttgtatttttagtagagacagggtttcactgtgctagccaggatggtctcgatctcctgacctcgtgatccacctgcctcggtctcccaaagtgctgggattacaggcgtgagccaccgcgcccagctattgggtgcttatttatttatgatagttacaccttcttgttgagttgaaccctttgccattatgtaatgcccttctttgtccttcttgatagttgttggtttaaaatctgtcttatctgatataagaatagtgatacttgctcttttttgttttccttttgcatgatagatctttctccatctcattactttcagcttgtgggtgtcactacatgcaagatgggtctctcaaaggcagcagacagttgggtcttatctctttatccagtttgccactctatgctttttaagtggggggcttagatcatttatattcatggttagtattgacatgtaagattttgatactctcattgtgttgttaactggttgttttgtagacttcattgtctaattgctttatactgtctatgatctatgtgcttaagtgtgtttttgtggtagcaagtatcagtctttcatttccatgtttagcattccctttaggacctcttgtaaggttcatctggtggtaacaacttcccatagtgtttgcttgtctgagaagaattttatttctcctttgcttatgaagcttagtttggtgggatatgagattcttggttgaatttcttttcattgaggatgctgaaaataggtcccctatctcttctagcttgtaaggtttctgctgagaggtctgctgctagcctattggggttccttttgtaagtggcctgatctttctctctagctgcctttaagatgttttgttttgtgttgacattggtgaacctgatgactatgtgcttggggatgattgtcttgtatagtatctcatagggggtctctgtattccctgaatttgcatgtccatgtctacctctctggcaagattgggataattttcatgaactacatcctcaagtatgttttccaagttgcttactctctctcctttctcaggaatgccaatgagtcatagatttggtctctttataaaattccatatttattggaggttttgttctttaaacatttttttctttatttttgtctgactgatttgaatgaaagtagtcttcaagctctgacattctttcctcagcttggtctattctgttaatgcttctgattacattgtgaaattcttgtagtgagttctccaattccagaagttcaatttggtactttcttaaaatggctatttcatttttcagctcttggatcattttactggattccttggattccttggattgggtttcaactttttcttggatctcaatgagcttccttgccattcagattctgaattctataactataatgtggttaaaaacatttctgaggggctagtatgttactttagagataaggggactctgtttttttttaattgccagaattcctgtgttgattctttctcatctgagagggctggtgatcctttcctttaactgtgatgtaagatgagtataatgagttggcttcatttctgggtgctttcaggtggccaaagatatgttcagcatctttatttgtggctgaatttttgccttaattttcacaggcactgtatactggcaaaatatttttggtgctgtaatttggactgtgatccagtagatgacacttaacagtaatggccagcagataggctctcactgagctatgcaggtcttttgtattccagtgtttgctgtagtgctctgtggttggaaagagagagatggccccctcaccaagtccacttctgtgtcctggaggagccccttctgatcactggcaccatgtatgcatttcttttgttaggtgttataggcttaggactccctcaggcagaggccacagctggcagataggccatacccttcccagactgaccctgtagaaggaagcatgatcagctcctccaccaaccaatgaactcgggtgtctcaccccctcagtattataagagtaggggctcctctactgcttgggtaccatccaaggtggcgagtcttgcctgcctaggagcagcagggagcaggggacacatgatctgttattggggtgtttcctgggaaaatacggagctgtgcccacccacagatttcaggcaaggacagagccactgtgctgggagcccaagtcttgcctggttaggagcagtggggctgggtggagtctgccatatgggtgtttcctgggagaacacagagctgtgcccgcccagagttcaaacaagggcagggtcactgtgctggaagcagaaactgagctttgtctggtgagaagtggtacagtctgactgctccccagcaccatgactgtggcctccactggggctacagtagctactgctgggctgctcagggatccaaggactgttgggctccctgcggccttaagcggtgccctgcaaaaactcccagaggttctctctatcagtctagaagtccaggaacctcatagggtttctcctattcccaggattgtgcaggtccctgtaggaagtgtgcattccccagggcttttcactctctcaccctttgcccatgttacagaacttctcctggtttcacattggtcctgggtgggcagctgcccagcttcactcttctctgttctccatgtgtccctttgctcccttgatgagtcctgatatggtttcttagacaattcacttggacagtcagtatttactcaccactttgtttcctttctgtgagggtgttacacatcagccccttctagtcagtcatcttgaacccatttgtttttatatttttaaatgatttttgatgaaaactttctaaagtgcagcatctcttccccatatttgttttaattgcataacctaataatgataatttgaacttttattgatgggtggaatgttataagcatctttactttattcactaatgctataattatgtctctgctgccttatttctttctctcttgacattggactataacttttgctgttatggagccaaacctctagcagaacaaacctctttctaagccggtggttctgatcattttggaaaaagatagttaaattttatagtatggtatcctaagtaagagtcaatgaactatatatgaggcctgggagtaaaatctttggctttagctgggaggttttctcattagcagttttatctagttacttttggatgagaaaagttaaaattaacaacaacaaaaaatccagtttatgaatacatttcgtatctttctacctggaaacgtggttatcatatcattttctaatactacaaaggtatcagaattagtattatgtggcattctttcaaagaaagtgaaaagaacactcgagttcaactaaatttccatttctaatgtctaaaggctataacatctaaaaatgttaccacagaaagaatatacagttgacccctgaacaacacagggttagaggcaccaaagtccacagttgaaaatccacacataacttttgactcctcaaaaacttaattactagtaacctactgttgactagaagccttatcaataacataaacagtcaataaacgcatatgttgtaatgtatactgtaatcttacagtaaagtaagcataagaaaatattatcattattatttgagacagagtcttgctctgttgcccaggctggagtgcagtggcacgatggctcactgcaacctccacctcccaggttcaagatattcttctgctcagcctcccaagtagctgggactacaggtgtgcaccaccacgcctggctcatatatatatatatatatatatatagtatttttagtagagatgaggttttgccatgttgcccaggctgctctcgaactcctgagctcaggcaatctgtcagctttggccttcgaaagtgctaggattataggcatgagccaccacacccggccagaaaatatcattaagaaaatcataaggaagataatgtatttactattcattaagtagaagtggatcatcctaaaggttttcatcctaatcatcttcatgttgagtaggttgagaaggagaaggtagaggagggattggtcttgctgtctcaagggtttcagaggcagaagaaaatccatgtataagtggacccatgcaattcaaacccatgttctcaagggtcaactgtgtattttaaaatattgcattaagcttattattatgtggtagcttctgaatggccattattaaaaatggcttggccaaggaggacttaagagttaaaacattccactatagtcccctaccaagctggactctctgcaatgctgtatctgcatttcaaccaatttttccacttatctgatttcctctctgactttgctattaagattaggagatcctaccacttaccacttgctttaactttaagcaaaatccttctttccacaggccagcagtggtctcttactttggcatttcctctctgcttcatcctttaactcgctgcctctggttaaagaagccggcactcccaaaacagtccccgaccacactcccttccacacatatacttttcctagcaacatctgtatggctctccccttaacactcagaaattgtaaatggcaacattgttgaaagctttactgatgaatattccaggttatagccaaagataatactttgccatctatctttcctagctaaacagtacggaaaaaaagttttggattatgagtgcaattaaaaccagtgtttaaaatctaaagtcatttaatacagtcaaaatagtaactttaagaaaatgaactaaagcccataaataatgtcacttgctctccaccaccctattaagtttcaatgaaaattcagaaatgagagagaaaatgatttggatttatttctaatttaaatctgatcaaaacaccaggatcattccagattctcttccactatttttgcattttcaaattaggcatgcaatggaaatgagcttgggcaggaagccttaggcacgtcagactgaaattcaatagccaaagaaatgcattctatgtgtaggggacaatatctttcttatattctgagccctaattctcagctattctttttgcaggttcatcatcagatatatggatataatatccagggcaattctcccatttggaaactaggaaatgttaccagatatggggaaaaattaattctagaaactggattaagtttggacccagaaagtgagtctagaccagtttagcttcattaacgagggttatcgttaaatttgattcctttgttttgttcttttggcaaatattccttcagggcagggaggtgaaggaaaaataacttttgggttcactctttatttacattcttatgtttgtgtggagtttgctgaaggggaataaatttatgtaactaatcagatacaggaacaaacatcagcatatgctttatgtctgcttggctcagctgcctaatataccttctaaggatcccaaaggcagaaacttggtcccaaatgattccccaggggctctcactctcctttcctttccagacagaatgtatacttccctatttctgtctagtcatctcataaaggggaaatgggcacagagtaaggatatgggcatgtggtcctgtaaaaccatcacttccattgaccagggagaaaagaaaacatagtcagtctccttagccaacaatatgccattatagtaatcattattgatatgctttggctttgtgtccccaaccaaatgtcatctcaaattgtgatccccacgtgttgatggagggactagttgggaggtcactggatcatgggggtggttctcccatgctgttctcatgatagtgagttctcacgagatctgatggtttaaaaatgtttggcattccccccgacctctcctgccaccatgtaatatatgccttgcttccctttcgccctcctccatgattgtaagtttcctgaggcctccccagctatgtggaactgtgaaccaattaaacctctttcctttataaattacttagtctcaggcagtttttcataacagtgtgaaaatggactaatacaattatatacatacaagttcagtgaaccaaactgaatccttgccagttcaactagcaggcccagcaggccaaacacacaataaactgtgcccaggacagcagccttaagaacatggtcctgacagttttccatctgatcctcaaatctgcatgtgttgacaaaggtggagaatgaaattagagaaagagaaaatgcttccagacattaaagtttgcatagaagtttaaaaagctcagcacaatggcaacagatatacaaagcttaaaagcagtgaaaaatatgtgcttaaatctgttttgtggtgctgtctccgaggagtgatcaagaagtactgagacagaatgctttcccattaagaggaaatggagtgttcctttgccaagaatgtctgcagaattctgaagcctcattaggagcagtcgttgtttttaaggttatttcttctttccaaagagaatgagtaattagaggcctttgaatgatctgtgtttgtctttctaaaatcaaaggtctttattacatttctaaaacaatgtaaaaattatatttttagctcacttctctgaaagtcatgcccgaaagaaatgcttgataattttaataatgaaacaaatattcctttatgataaaatacattttaccattttatctacttacaatctgatagtataactacatgtaggaagcctttgagttggtggtggttgtgatgctgttgtttggctgtattgatgtgtttgtgctcatcttgtcacactgtatcacttatccaggaacagatatttcacacactgtttcctctctcaagggtgaactaggcacatacctggggcttagctgtttcttattcacagaaggcctgtagggttaagagtaatacaatcaaaagtgcagcttgctcatgtagcaatatgaagtctctatgccaacagaaacctgaggccaagaaaccattcttaacctttgaacatatttctactatatgttaaatcccttggtattggtttcctcatttgtgaaatagaggaatagaatgagatgaactataagggttacttcagctacaaaaattctaacatacaacataatgagcaagagagctgcctccacatttacatactaattaggaattttttagcttaaataagttaacttccttttgaaattatacaggatcctaactacaaaccaagaaaactgaggctttgtgtaattatggcaaacaagttcttcaatcctataactgaaattgtgtgaagattgcctaaaatgcctacatgaactgatttttaaaataagtgaaacaacgaagaaagccaataaaactagactatcgaaaaataattttataatatacctttcataatattaaatattagaatagtttttttataaaataaaaattgtgacaatggtggataaattttgtgataattttgtcatttccatgatttattaaggttagccttgatggatatcttatttagagttttttcaacatataaggaaaaactgattaaggagtaaatatgatgaattgtatttatgatgaagagcacggtttagacactatgctggtagctaattataagcctgtataattttataatgaatatgaacaaaagcaaaagagatggcattaagaatataaatacatcaataattattagtgaaatcaaatttgcctttttagcctttgctttacagaaaaaatattagctatttagagctctactcagatcatgcagtatatgtagaagaatgactaggcaaataagggagaattgcatgactaaaaatataaagacacaggcaaggagatgttgaatgaaaattacaggcatatagtagaggtagatattataaggaaggagaggcaggaaacatcaagtatacaatttatggacaatcaggctgggtacattccttattctaatgaaggatttaggcaagattgttggactcttgtttacctaatttttttgagtataaaattccttcaaatgtacattaaacatttgaaaacaattagtatgtgtatgattgttttgctttataatagctaataaaaaaagaaaccctaaggtgggtgaaaaaagttattttttacaccctgccacctaatccttaaaaatgttccattttgagcaccaaaatgaagtctgtaacaaaaaaaaaagtaaagagttacaatccagtttaggattttaattatattccaatatagcaacctatacacaagatggctagaagccattaaactgcacagacctcaaagctatggaaggagacctgaactgcacaatagctgtggttgtcagaattctaagagggcccctaggattcctcccccatagtgttcacaccctatatatcccctttcccccaagtgtgggagagatgtgattacgataggagagtcatttccttggttaggttctactgaatgacaaaggtgatgggttggtcactcatttgattccattacatgatctgcaccctggagagagttttcttccactggctttgaagacataagctcccatattgtaaggtggccacatggctaggacctgaggtggcctctaggagctgaaagcaatccctggccaacagtcagcaagaaacaagggacttcagtttctaggaactaggaacacaaagacctgattcctgtcaatgatgtaaatgagcttggaagaggactctgaactccagatgagaactacagtgtggtggacactttgataacagcctggtgagattccaaacaaaagattcagagaaaaggaggcctgattccagacccacggagactgagataagaaatttatgttaagttgctaagtggtaatttgttacaccggaagagaagactaatgaccagcatttatctgtggatgatacatttaatggtcaacaaacacatctcttaggcacatgatctgaactgcaaagtgaattaaagatattctgaatccaatacccaaaccattttggaaactctaggttttaattctactgaatatgcattacagacttgcctggataagtgagtttccgtttaagcaatgatccccattctctagttaccttaactcatatcattcttgttcacagacactacttccctaacatgtgttctgtggtagtttttaaaaagctctcatctgctttcttcatagccaccccaataatgatgctgaagacagagaacaaagagaagtagatgaaatgactcactgaagaacacttttctaattaggtgccaacttaagaaaactgggcttatgtcaaagtctgaacatttattgtaagtgtttttggttcctcttgtaattaattgtaaatatttgtacaaaacatagaagtttttttgcattcctgtcactgatcaactaaagtcacaaaccaattttaaaactaaatatttcagcaaacagacttggcagtaaaatataatttcctcaacatctgatatattggtgaaacgttattaattcatattttctcatgcattcatggctgatcttatgagtagagagagagtcaagcttgctaagaaatgtgatttgaggagtaggactacaagcttaaacccaaagctcacatcaccttaataaagtgcccggtattcctgtcattataatttactctgtggccctaatacttttttgaagtagttatgtgaaaattataaataggtaaaatcaaatatatatgtaaattagtgaaaattaactcatttgggttaaaatagtcttcagaaagactatgaaaatccaaatatattataaagtagtagttaggtcttaaaatatatcaaccaattgtccagcaaaaggtttctttgggaatgggacatggaatagccaatctttgatagaagagggtactgctatagaaggtcctgaaaagctaagagacaggataaagggcctggaacccagggcaccctaaagataaaccaaatattttatgaattcacttgcactgaccctagatacagataagatattgaaagctagttttctaatttatattattctatcaaatgaattcagctgccctgtagacccatatagaaaactaggaaacagaaaactttagcaacttgtccatggtcagtggtataaataaggctaaagacgaaggcaagagatttatatttaatctttttctcaaatcaagggataaacaactaaatataccattaaaaatactgggaaaaaattttaagatttctcattatggaaaagtaatgtacaaacaaagtcaccatgcaatcatggcctaaaagagcttctcaattttgaaattaatatatgattacatggagcagggatcagcaaactgtggctcacgggccaagtcagccagatgcctgtttttataaataatgttttattgaaacacagtcactccctttccttcatttattgtttatggctgttttcccattacgccggcaatgttgagttgtcatgacagaaacagcatggcccgcaaagcctaaaatatttactggttctttacagaaaatatctgccaacccctgttgtagttcattaaaaatcagtgtttagtgcaagtctacatctactatacctataatacctagaacaaatcatacatgatctcactaaagaaagcccttggttaattaagtaaataaatagaattgatattaagtagacacaacgaaaatgttacatattgagcctggcagtcaattccacaaacacagacctgcacaatatggactgtgacaatatcttgctttttttgtaaacattcttaaaatggtaaacacattccactggcatttttcatcatcacatatcattcatttattgtaaatctcaagattttagtcacaaaacattttttgatggatttcactttctataggcctttgtgcattgcagctttgcaaaaattatacaatcctctgggtacaaattaacttgagagcctggctgagatggaaaatatgataaaaatggaaatacaaaaggctgtgatggctttttaaattacaggatatgtatagcaataaatagtaaatctggtactttttaagaaggatgccattgttaagaagccagattttaaaaataacaacaaggaatatcaagcctattcccaacattttccaaaaggaatttaactcacttaaatagcatctgtaattttagataaatagttaaactcaaaagcaaatttagggacatgtgcaatggctcatgcctgtaatcccagcactttgggaggccaaggcaggaggatcacttgacctcacaagttcatgaccagcctgggcagcatggtgaaactctgtctctacaaaaaataccaaaaaaaaaaaaaaaaattagccaggcatggtggtgcatgcctatggtcccagctactcaggaggcttgagccgggaggcagaggttgcagtgagctgagatcacaccactgcactccagcctgggtgatagatccagaccttgtctcaaaataataaaaagcaaatttatttaatataatttcttaatttttttatggtgcagaattttttagtttctgttgagtatgtatccataactttgagaaaattattttttgaaaaactatttgatgttgactttaggcaatcataccagactacaaccatgtagaattaaaatgacatcacgtctaaaaaataattaaagtcaaagtacctgatttttgtaaagggttgtcaactctatctataagactgtgtctactaacttagtataaaaattccaaaccacaatatcatgtctccagatatgcctttgaagacatcaatgattgacttcaaatcctaattacccaaaactcagaaaacatatatggaatttgcaatatttgagagattcaagaggctatgctaatagttgctttctctcaattccctaagctcttttcattcatttattcttacatccaaacattacacactttctgataactactgtgtgccaagtatatcagttatactatcactatgtatacagctcaccagcaaaagaatgtcatattctattttcaaaaatcatttgtgaagtgcccataatgcatgtactatatactatgttaagttctaaggataaagagattactaagacacaacaatggttctaaaatgtgagtatgtaccagatatatcttaggattttataactatatagaagcttagcaccatccatacccagtgtatcagaatttctgaagcacaactttgatttttttttcaagttccacttgtgagtctgaagcacattgaagcttgagagtcatttctctggaagatgttccatacagtgtagagataaggcaagtactatgaataaaacagaaacacaaagagggaagcatcaagttctacctagagtgatcatagagatcttctctaaaggggttaaccttgaagctgagttttagcagataagaaatttaccaagcagataagcaggcagtggtaaaccatatgcaaaagagtcaacacacctggaaatatatgaaggcgtgagaacagcatgctatgtttggggaactgcaagtagctaggtaaggatgaagggcacagatgcagaaagcccaggagaagaagttggaaaagtaggcagaagaagccagatcatgaagtgctttgtatacaacggcagaaattttgatgccctcttgtgagccatagaatgttactgaagttttgtaatcaaaggagtgatatgattagacaaattgcaaatagtgaaggagaatcagatggcagcagggagatatgttatcctgggtgagaaatgatgaagatttgaacaaaaatactggtgttaggaaagaaaagcgcagataaaatagatcttcagggagtaaagttgacttgtccaggtgataaacagattacaaatggagaaggagtacaattactagtttctaatttgaggactcactatattatgcattttggaaagagtaataatagctaacattaatagaacatttgccatgttctaggcactgtttttggagctttgttcacttaatcctcattatataacaagagacattatttcttttaatttttattattttttgagacattggtctgggcaaatatttcttagatataaccccaaaagtacagcaacaaaagcaaaaataaacaaatgggattgcattaaactaaaaagcttctgcacagcaaaggaaacacttaacagagtgaagagacaaaccatggagtgggagaaaatatttgcaaaccatatgtctaataaggggctaatacccaaaatataggaactcaaataactcaatagcaagaaaacaaataacctaatcaaataatgagcaaaggacctaaatagacaattctcaaaagaagacatacaatagccaacagttatatgaaaaaaatgcctatcactaataatcagggtaatgcaaattaaagcaatactacctcacacctgttaatattgctattatcaaaaagaaaaaggatagcaagtgttagtaagggtgtggagaaagggaactcttgtgaactgttgctgggatgataaactaacacagccattatggaaaacagtatggacattcctcagaaaactaaaaatagaattaccacatgatccagcaatcctacttctgggtatatatccaaagggactgaaatcagtatgctgaagagatatctgtacttccatgttcattgcaccattcttcacaatagctaagatatggaagcaacctaggtgtccatcatcagatgcacggataaaggaaatgtggcttatatgcataataggatagtattcggcctcataaaggggggaaatcctgtcatttgcaacagcatggctgaacctcgaggacattatgttaagtgaaataagccaggcatagagagacagatactgcatatctcactcatacgtagaattttaaaaagttgaactcacagaagtagagaatagaatggtagttaccagaggctgggggaagggggtcaagagggaaaggggagatgttgatcaaagggtgcaaagtttcggttacgagaaataagcttcagtgatctaatgcacaaaatggtgactataattaataaaatggatcgtatacttcaaaattgctaaaagagattttaaatgttttcaccacaaaaaatatgtaataaatttgttaatcagtctgatttaatcattccacattgtaaacatatatggaaacatcactttgtaccccataaaaataaactattattatttgataattaaaaataaaatttaaaaaaaggttaggaaaatgaggcacagaaagggtgagtaacttatcaaagttcaccaactagaaaatgacaaaagaagtcgggatttgaacccagtctgtctggttgcacagcctgtgctctgctaatcactctactatactcctatttaaagagaaatacagagaagcatagaggacttcaggaatcagagtcggctttgtaagaaaaacactctgatcaagtggggagatgttaactttgagactcctgtcaaagtatccagtgggcagtgaagaatgtggatctagagttcaggagaatggtctgctccaagcatttagaattagaaaacatcagtatgtaggtaatttgccactgctggtataaaaacgataccaggaagaacttgtgcactgagacgataagtaggctaagaatagcattgataatattttagatggagacaaacccataatgtttataatgtactgttatgtttacatagagatttatatctactcatctacatctacatctattttattacaaaagaatttcacttctttgagagacaagggtgcctcatcacttaccagaagacaacaaaagttgtatttttgaaaaagtaatgaaacaattacctgacaagatttttcaacacttctttgttggccttaacttgtaggagaggaaacccatagaaaggaaacagactgttaaatggaagaaaagtcatgtaacttcctcttttagattatttacaggctgtgaagcaaacagtgaagttaccaaacctgtagctaaatctataaaatatatcatgtttgcacaacttcatcaaatgacattctaaaaaggattattccaaaaagactcattatattgccatcagacatttcagccaaaataccaacagaatgccatgatccaatgtgaaactgagaaagctacacacatatcattttggtagcaaggaaaatgttagattactttcatttctcccagcttcaataatagcctgcttcattctgtaacagtgagattccatgtcaccaacaccattaatctgtcaaccatgaacactacttaactttgtgctcttccctcaggatttacatataaaccttacagcagctcttggcactatttcctggctcttctcagcaaacacaaaatattggcaggaactaggattaaatactctgtcatatctaaaggatggcctaaattggaaagcaatattagaaatatcagtatcatccttactctttgaacaagtccgtgtgatgcagaccttcaacattttaattttattaatattaacttaaaaaaacaaaaattacacatcaaaatttgtcttctttgtatatgaatttatccaaaatacatgcttttgattattaacatacccaaactatcttaccttgtttttatttagagttaggagttaaagatttagtatagtgaaggaaaggtgtcagaaaagccagggtttgtgccagggcttggcatagtgcctgcctcccagcaggagatcaataactgttgaatagacaaggcctcagttcccaaggtgacagatatatactgtgaccttttgggttaggtagataatgctttttaaatgttctgtatagtcccaatataagagttgccatgtattgatgtttcctggttggcattagcttgacattaaaaattcagcctttattatgaaagcattccaaatgttcttttggttcattcttgctgagaaaatccctccctgtttcaaatgaaagggggaaaaatgcatattagcctgtaaggcattactatatagagagcagtaggactgcctaacacgtgttgggtaacactgcatattcaatagtatatacaatatttaaatgcctcgaaattttgtatgatttgctactcttatcagaaagatgtgtcatatcactgggaggttctacttttttcttcaaagcaattaaatgtaggtattgttttcctaatggtgaaagagaagttagtatctcagtttgcttccattataggaattctctgtaacactaatcagccgtgtggtcttgggacatatttgtaacttttctgagcctcagttctctttctgtaaaagaaaaaatttaaatgatggttgaaaatcacattttcttttaagtctagctcattaattatctcatgcttttattttagaaaggtatttcttttacagctctagtttatggtaagaggttttaattaatatactgtaatgccaatcaacttttattttctccaattggtaattatttgaaattctttgtatctatgatttattacttctgcatctgagttcatatattctattttccattacttcatagctaggcagaaaaggaaccagccctggtacctactgatggtgttcctaggttctgcatacttttctttgaaaatagattgaggttttttcctttatcttcatcaaaacagtgtgaaattgaagtgggagcattatttgccttagttaagaaaatgatgtaaacaattgaactcacttttaattttttctgtaaatcactttcctttcttattcacatcaaaaaaaaaggtttacaagcagctccttagcaaattttagctttagaatgtctgcaacaataaatgttttggaatcttaaactctgcaacttaccacagagggcaagattaaagaaaacatttggtcagaaacaaatctctccccccaaaaaatgcttcatacagcaaattaattacctaaacacaattatgtcaccaatttttaaatttgctcactcataattcttaggttacaagacaaaataaccaaattttaccaattatatttggatttcagataaacaataaataagttttagtataataatacatgcaatatttggaacagatttatactaaaatgtattcttatactaaatgttaacatacactatatgttaaaaattatttgctattcatctgaaattcaaatttaactgggtatactgtatttttatttgctaatttgatgaccttttaatatttctatttataaaaggaattacagtgatgctagctggataatgtaaactccaagtggcctaatacaagaaatctgtttctcatggtctaatgtgagtcttcctagtggaagacggcttttctctaagtggtcattcaagaacccaaactcctctcattttctggctgtatcatcccataggctttgggaggagtcctctgcatccagcagacagaaagagggagggggaataaggcacacccacttcttaactgtgtcaacccagaaatgacactatttgcactcacaagtcattggtgagaagcagtcacatggccccacctagattcaacaggaactgagaaatttaaacccttgctgagtggtgacttcccagagacacctctaaataatgaaaaagatgaataacattttggtgaaaagtctgtgcctcagcatggaaccaaaggaaataaatacgataagcatctgatacaatttcattttgtattaggatggagcaaaagtaatggcaaaaactgcaattacttttgtgcccacctaatactttggagagataaaccaccaaatttatttgggaccctcccctcattttattagcagtgtacaatctttgatatttagtacgcagtagaaatgaagctgacctagttgatggttttgtgtggaatttttttcatgatactgaaaaattgtgattacacatctatatcaatctatgtgaaagatcatgagaatcaacaagttaataggtgtgaattgctttggggaattcaaatgtcttgcattaataaaatcaaaacacgtgttacaactgaggactcctcagaggatatagctgtctgctacaaagaccaccagcagccacattctccctcaatctgggatataacactgagccctgaagtccgcttgaaacttaaccagaaggatcaaccatgatacacattatcttaatctgtgagtctgtctttccaactctgagagggacttggtttcttacttgcttagtcatgtctttggaacattctgattctgcccggctgtttcctatgttctcgtccttcttggatctcgacccactgactctgatgttcccaattggtccagaattttgcactgacctactgtttgatatgcctccctctcagggcttgtcataaccacagtaatattccttccctttgtagctgggctcttgatcaaggtctccataaccccccattaccatatttctcaccagcttcagtctccatgggctcttgatattaaatctgtggccattattgataagctgcattgcctaaattgtctttataaatgcattctcctaacctcttcaaaattatagaaggttacctcttgctcccatacgaccaacagtgagctccagtgttgtataggtgaaaactgctcgagacctggctttttgcactttttcccctatggacaaaatgaacttagtgtgtttccttttctctataccactcaaaggaatttctcatttttcttctatcctaaaagctttgagttctccaatcaagggagcctggtctataagcatgtagtgcttcacatcaaaacatacctctccaatagcaatgtcataaaaatgcaggtaagtgtatgtttcataaaaccacttaagagatagaagattcttgcaacatctcactgtcacttagctagattcttaccgtcttgtcaaaagccactccataattcatattactttttttctacttgaaattgtgaatatgccttactttattttaaaaacttatttaccaccctaattttaatcattttttttttttttttttgagatggagtctcactcgtcacccaggctggggtgcagtggcacgatctcggctcactgcaagctctgcctcccgggttcacgccattctcctgcctcaccctcccgagtagctgggaccacaggcacccaccaccacgcctggctaattttttgtatttttagtagagatggggtttcaccgtgttagccaggatggtcttgatctcctgaccttgtgatccgcccgcctcagcctcccaaagtgctgggattacaggcgtgagccactgtgcacagccattttaatcatttctctaaacatttttccatgtgtctttccctttctattctttttttttttttttgtactttaagttctagggtgcatgtgcacaatgtgcaggtttgttacatatgtatacatgtgccatgttggtgtgctgcacccattaactcgtcatttacattaggtatatctcctaatgctatccttccccactccctgcaccctatgacaggccccagtgtgtgatgttgccctgtgtccaagtgttctgattgttcaattcccacctatgagcgagaacatgcagtgtttggttttctgtccttgcaatagctcagaatgatggtttccagcttcatccatgtccctacaaaggacgtgagctcatcattttttatggctgcatagtattccatggtgtatatgtgccacattttcttaatccagtctatcattgatggacatttgggttggttccaagtctttgctattgtgaagaatgctgcaataaacatacatgtgcacatgtctttatagcagtatgatttataatcctttgggtatatacccagtaatgggatggctgggtcaaatggtatttctagttctagatccctgaggaatcgccacactgacttccacaatggtcaaactagtttacagtcccaccaacagtgtaaaagtgttcctatttctccacatcctctccagcacctgttgtttcctgacttcttaatgatcgccattctaactggtgtgagatggtatctcattgtggttttgatttgcatttctctgatggccagtgatgatgagcattttttcatgtgtcttttggctacataaatgtcttcttttgagaagtgtctgttcatatcctttgcccacttgtagatggggttgtttgttttttcttgagttctttgtagattctggatattagccctttgtcagatgagtagattggaaaaattttctcccattctgtaggttgcctgttcactctgatggtagtttcttttgcttgcagaagctctttagtttaattaaatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaagaagggatccagtttcagctttctacatatggctagccagttttctcagcaccatttattaaatagggaatcctttccccatttcctgtttttgtcaggtttgtcaaagatcagatagttgtagacgtgtggtagtatttctgagggctctgttctgttccattggtttatttctctgttttggtaccagtaccatgctgttttggttactgtagccttgtagtgtagtttgaagtcaggtagcatgatgcctccaactttgttcttttggcttaggattgacttggcaatgtgggctcttttttggttccatatgaactttaaagtagttttttccaattctgtgaagaaagtcattggtagcttaatggggatggcattgaatctataaattaccttgggcagtatggccattttcacgatattgattctacctatccatgagcatggaatgaatgttcttccatttgtttgtgtcctcttttatttcgttgagcagtggtttgtagttctccttgaagaggtccttcacatcccttgtaaggtggattcctaggtattttattctctttgaagcaattgtgaatgggagttcactagtgatttggctctgtttgtctgttattggcatataagaatgcttgtgatttttgcacattgatttttatcccgagactttgctgaagttgcttatcagcttaaggagattttgggctgagacaatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacctcccatcaatacctaatttattgagtttttatcatgaagggctgctgaattttgtcaaaggccttttctgcatcttttgagataatcatgtggtttttgtctttggttctgtttatatgctggattacatttattgatttgcatatgttgaaccagccttgcaacccacagaggaagccaacttgatcatggtggataagcttttcgatgtgctgctggattcggtttgccagtattttattgaggatttttgcatcaatgttcatcagggatattggtctataattctctttttttgtggtgtttatgccaggctttggtatcaggatgatgttggcctcataaaatgagttagggaggattccctctttttctgttgattggaatagtttcagaaggaatagtaccagctcctccttgtacctctggtagaatttggctgtgaatctatctggtcctggactttttttggttggtaggctattaattattgcctcaatttaagagcctgttattggtctattcaggaattcaacttcttcctggtttagtcttgggagggtgtatgtgtccggaatttatccattttttctagattttcgagtttatttgagtagtggtgtttatagtattctctgagggtagtttgtatttctgtgggatcagtggagatatcccctttatcattttttattgcatctatttgattcttctgtcttctcttctttatcagcctggctagcagtctacctgttttgttaatcttttcaaaaaccaggtcctgaattcattgatttttttaagggtttttcgtgtctctatctccttcagttctgctctgatcttagttatttcttgcacaacttttcttgcacattctgctagcttttgaatgtgtttgctcttgcttctctagttcttttaattgtgatgttagggtgtctattttagatctttgctgctttctcttgtggacatttagtgctataaatttccctctacacactgctttgaatgtgtcccagagattctggtatgttgtgtctttgttctcattggtttcaaagaacatctttatttctgccttcatttcgttatgtagccagtagtcattcaggagctggttgttcagtttccatgtagttgagtggttttcagtgagtttcttcatccagagttctagtttgattgcactgtggtctgagagacagtttgttataatttctgttcttttacatttgctgaggagtgctttacttccaactatgtggtcaattttggaaaaagtgcaatgtggtgcttagtagaatgtatattctgttgatttcaggtggagagttctgtagatgtctattaggtctgcttggtgcagagctgagttcaattcctgaatatccttttaactttctgtctcgttgatctgtctaatgttgacagtggggtgttaaagtctcccattattattgtgtgggagtctaagtctctttgtaagtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactgggattgcaacccctgcctttttttgttttctatttgcttggtagatcttcttccattcctttattttgagcctatatgtgtctctgcacatgagatgggtctcctgaaaacagcacactgatgggtcttggctctttatccaatttgccagtctgtgtcttttaattggagcatttagtccatttacatttaaggttaatattgttatgtgtgaatttgatcctgtcattatgacgttagctggttattctgctctttagttgatgcagtttcttcctagtctcgatggtctttacaatttggcatgtttttgcagtggctggtaccagttgttcctttccatgtttagtgcttatttcaggagctcttgtagggcaggcctggtggtgacaaaatcactcagcatttgcttctctgtaaaggattatatttctccttcacttatgaagcttagtgtggctggatatgagattctgggttgaaaattcttttctttaagaatgttgaatattggcccccactctcttctggcttgtagagtttctgccgagagatccgctgttagtctgatgggcttccctttgtggataaccccacctttctctcgggctgcccttaacattttttccttcatttcaactttggtgaatctgacaattatgtgtcttggagttgcccttctcaaggagtatctttgtggtgttttctgtatttcctgaatttgaatgttggcctgccttgctaggttggggaagttctcctggataatatcctgcagagtgttttccaacttggttccattctctgtgtcactttcaggtacaccaatcagacgtagatttggtcttttcgcatagtcccatatttcttggaggctttgttcatttctttttactcgtttttctctaaacttctcttctcgcttcatttcattatttgatcttccatcgctggtaccctttcttccagttgatcgaatcggttactgaagcttgtgcattcgttgcgtagttctcatgccatggttttcagctccatcaggtcatttaaggacttctctacactggttaatctagttagccattcatctcatcttttttcaaggtttttagcttctttgcgatgggtttcaacttactcctttagctcggaggagtttaatcgtctgaagccttcttctctcaactcgtcaaagtcattctccatccagcttgttccattgctggagaggagctgcgttcctttaaagggggagaggtgctttgatttttagaaatttcagcttttctgctctgttttttccccatctttgtagttttatctacctttgatctttgatgatggtgaggtacagatggggttttggtgtggatgtcctttctgtttgttagttttccttctaacagtcaggaccctcagctgcaggtctgttggagtttgctggaggtccactccagaccgtttgcctacgtatcagcagtggaggctgcagaacagcgcatattgctgaacagcaaatgttgctgcctgatcattcctctgcaagctttgtctcagaggggtacctggccgtgtgaggtgtcagtctgcccctactgggggatgcctcccagttaggctacttgtgggtcagggacccacttgaggaggcagtctgtccgttctcagatctcaaactctgtgctgggagaaccactactctcttcaaagctgtcagacagggacattaattcgtattacttctaagactcctttctgtaatttctgtgctaaaaattccactgtgcttaaccattagagtgctaaaaagccctcccaggacttcttcacaggcatagatgaattattactttcttcatatcaaactattttttttttggtgcctgtatgatgtctagcactacatgaggcactgcagagctctaccaagatgtgaattttgccttttatcagtggtgtctggttcataatatatgcacaatacatatttgttgaataaattaaggatctgagtgagagaactatggtatctcttgttctgttgtgtgccatttccttactttaaagccaattaccccattgcttatggtaggggcagtgttaccataggtcaaatctccaagagcttaggaatgcaaagggctctgagagaacacaataaacaccctagagcttaacaataagtatatgcattcattgaataggaacatagtccctcttcatttacacatggtaattttcacagattatagaccatattaatttcagccttttttttaggaaaagaagttgttctgatgtttttttgtatagtctgttgaactgaaaactatcatgtatttacttggaattatttagaacaaataaagattattttcttgtatggagatcgaagactcacaatgttactttaccaaaagagtagttactaaaacatctactttgaaaatacacattattgactgactcttagagcccatgaggctacaagcaatttcaatctattagaactcagtgatttcctaggcagcaggagaataactgactagagttactacttgattcctctattcaaattgcaagaactaaattatattgggaatgcatatggcaagtggaaggaataaataatatttagtcactacaagtaaaatataatcataaccagaaaaaaaatttatgagagaatgaaacaaagacagaaaatttgcatcctaggactacaaggagagactcctaataactcacctcaagtatagccatcatctagctcctcagtgtttataaagtaaaggttaaactgcttaccttggtaggcaaggcatgctacattctgatcctaacaattacatccagtctcaattctactttctcctccctttacctcctggccacataattgacatttagagcaatttaccagagtatatattcacacatgtaggcagaaaatttaatcagtattttagtgcttaactcttaagtatgagcacagagacaagaatcatcagacatttagggaaagccaccaacataaaagagacccaaataaacaaccacaaagcaatctggagttaatagaggctatgaagggaatggagaatacttaaaaaaaaaaaagcaacaattaattttctcagagagagataagaaacaaatcagagaacaagaaagagtaattggaaattaaaaatgaaagaactgaaattaaaaataaatcagttaaagaaatggaagaaaaagccaaggaaatatttcagaaaataatataaagtagttgaaaggatggactacaggaaaaacaagctaattaaagggtcaatcaagaaggcccaatatcaaattggctccatgagggcaatgttttgttcactgctattacctctagcacagaattacaatgccttgctaggggaggggcatgataactatttgttgaatgaataaatgcatgctccaaagagaaatcagagggataatgatgggatcaaaagaggacgaaaataaaccttccccaaaatgaagaccatgtatcatataaaatggcccatcaactgtccagcacatttttttcaaaacccgtattaattattaatgctcattatcataaaatttcaaaatcagagataatgaaaagatactaaacccaagaaccaaaaactagccatatgcaaagaatgagaaatcaaaatggcttagatttctcaaaaaaatattacaagttaaaagttataagaacaagccttcaaattctaaaagaaattatttcttagcccagaattattaatcaaatggtgaggtagaatagagacatttttgcatgtgaaaaataacagaaaatgtctgtctcattcttgtttgaatctgttcccctacttactaggtgtgtgacctttggcaaactacttcagctcccttgcctcacagcgtaattcacatgtaaaatggggactcccctcagacctccttcataaggttgctgtatggattctgtgagttatttcatgagtagtcctgagaacagagcctggcataaagtaagtactcaataaactgttaattactatttttaattattctaaaataaaacgaaagtctccacaaagcaataggatatttatgaagttcatgtgtacatcttatttggttactagaaagccatttgtatttttcttcttacataatgttagccatactttttgtattctcttttttttccatttgtctccctgtctttcttacttcaacatttattatattggcacaactgctaagttttttggtatgtgatgagagaatgacataaaatctatgcttaagtaaattgagggaaaaagggaaaaatgcaagaaaaaaacttgttctccagacacagtgggaaaaaaatagaattaaacttatattgcacttttaaatcaattttttgagttaaaaattataagtgaaaatgatgctctgagattagaaccaattcattaatcaatgttgaatacaagcacttggctatgtctccagctcctaatgcctttctgagctgacacgcttcattattgtcagatgagttttcaattgagagggatagctttgaacactcaactgccctttagcaggcaaacacgcaggaaatggcacaagaagcttgaaaccaaactcgtgttcctggactcagtttggttttcactcagtgtggctgactggcacctgtttcaacaaacattggtaccctttccctctattccttcatgaagctatcttctcagctgaggaacaattagaaaaacatttggggcacatggaaggaattaaaagaatatccaaagtaaattctcctcctaccacacaataaaccctgactcccataacagaaaaatccacttgcaaatcaaattctaaagcattctaaaggatggctttggtgaagactgcttgaaatagcttatgggtaggtccagattttcagcacaactggattttaagtgtaaggagaaatgcctttctgcagtcctgtttcctctacgtaaacaaggtgtcctcagcacggccctcagaggcccacccactcacacctgccaggatgttgctggcctccagcacatgcttcccccagtgaattcagttcactccaaaagaaagaaaaattacataaggttttctcaaaaccaaacaaaacaaaaacataaaaaactgacatctctattacccttttgttttccagaagtgctagcagaatatcaggataagatggacaaaacgcaggctgaaaggcaagaaatctggctctaacaccaaaacctcatgccagcgttctgagtctgcatttcttccctataaaatactggtgattcctatttataggccttcttgcctccttgagaaaatcaaatgagctacttgatgtgaaaggacttaaaaactatctttgttattctaattgataaaatgtatttttttttaacaaatatttgtttagtatgcccagcactattctaggtctggggcacataagaacgagcagtagtaggccatgcgtggtggctcacgcctgtaatcccagaactttgggaggcaaaggtgggcagatcacttgagccgaggagttcgagactagcctggccaccatggtgaagccccatctctactaaaaatacaaaaattagccaggtgtgatggcacacacctgtaatcccagctactgaggaggctgaggcaggagaatcgcttgaatccaggaggcagaggttggagtgagctgagattgtactactgcactccagcctgggcgacaaagtgagactctgttttaaacaacaacaaaaacagcagtattgatataaagtctttttctccaataagttttcatttaaaaatacatatacatactttgggaggccaaggaggatagattttgtgagtccgggagtttgagaccagcctggccaacatgccaaaaccctgtctctactaaaaatacaaaaaattagctgggcatggtggtgcatgcctgtaatgtctgtagtcccagctaatcaggaggctgaagtggggagaatcacctgagcctgggagatcgaggctgcagtaagccaagattgggcaacagagtgagacactgtctcaaatataaaaaataaaaatatatatatacctacattttttttttgagacagagtcttgctctgtcgcccaggctagagtgcagtggtgcaatctccgctcactacaagctcagcctcctgggttcacgccattctcctgcctcagcctcccgagtagctgggactacaggcgcccgccaccatgcccagctaatttgagagagagagagagacatgaaatacacatacataatatatacacataatatatattagggttatccggagaaacagaattagggtgtgtatacatagaaatatatatttatttttatatctatatttatatatttatatttacatgtacccacatacacacagagagaaagagatttattttaaggaattggctcctgtgattgtggagatttaatgagtccaaaatctgatgagttgggccctaggcagagctgtagggaagactccaaaggcaatgtgcttttacaaaactcagataaattgtatgatctccggtttaatactctgtctgaaagtccatctaagatttagaagttgaaataattctatgatccattggctggattaatgaagttatgtttaatggtagaaagcaaatattcacattttcatttaagtccccaagagaatcacggttatctggagcattaaaaaaacattaagcattaagagtagtatcttaaaagctctattatccagttatatcactgagcgacaagaaacatagctatatgctttgccatctgtgcatgagctgaataacagacatgcagtgaaaggagtaacgtgattggtcactgatcaagttgcacattcgttatttgcatagtgatttgtggactgaagaggtagcagttgtgctttattgcaattaccacagttaatgtacactgactggtaaccaaaattggaattttgcttgtgtctatttaaaacccaagctggttgagatcatataaggaattactagacagaaaacaggaggaagttaagtactataccaggtgggatcccaaattgtagaggtaaaataggaaaaatttagtaaaagagattacgataaagcagtcagtgaggtggtgggaaagcaaaaaaatgtagtgcctacaaatcaaatttctgtagtgttttgagaatggggaaactcttgactttggtcagcatgctcctaagtggactgcaggctatgtgggaactgggtgaggcctgtgactgccgtctttcccccacttccctggtgacctgtgtgactcagcaaaggcagccataatccccctgtgaacatacctccattgggctgagaaccacactcccatcccccacagcagctgcagcaaggcccacccaaggagactctgagatcagacaggcctatccttgtccccacctagtggtctttctctgcctgccctggcagctgaagacaaagaacataatctcttgggagctctataaccccacccactgcctgatcctgcttatacagctgcagctgatacgctctggaaaatgagacagagtcttgctctgtcgcccaggctagagtgcagtggtgcactcttgtgttcctggctgaaggccaaccaacacaaaaccagcacactaaagaaaaatacaagcaaggacccacacagagtctatttcactttgcagacattccttagtaccagctcagagcctggtaggctctgctgggtgactagacccagaagagcaaaagcaatcactgcagttcgcctctcaggaagccccatccctaggggaagggggagaacaccacatcaaaggagcaccccatggagcaaaagaatctgaacagcagcacttgagttccagatcttccctctgacatagcctatccaaatgagaaggaaccagaaaaataattctggtattacgataaaacaagtttctttaacatccccaaaagaccacaccagctcaccagtaatggatccaaaccaagacaaaatttctgaattgccagaaaaagaattcagaaggcccattattaagctaatcaaggaggcactagagaaacgtgaactccaacttaaagaaatcaaaaacatgatacacgatatgagaggaaaaatcttcagtgaaatagatagcataaataaaaaacaatcacgacttctggaaatcaaggatacacttagagaaatgcaaaatgcattggaaagtctcagtaatagaataaaatgatcagaagaaagaacttcagagctcaaagacaaagcttttgaattaacccaatctgacaaagacaaagacaaaaaatatttaaaaatgaacaaagcctccaagaagtttgggactatgttaggcatccaaacctaagaataactggtggtgttcctgaggaagaagagaaatctaaaagtctggaaaacacatttcagggaataatcaaggaaatctcctctggccttgcaagagatctagatatccaaatacgagtagctcaaagaacatccaggaaattcattacaaaaagatcatcatctaggcacatagtcatcaggttatctaaagtcaagatgaaggaaagaatcttaaaagctgtgaagcaaaagcatcaggtaacctataaaggaaaacctatcagactaacagatttcttagcagaaaccatacaagctagagtaattggggtcctattttagcctccttaaacaaaacaattatcaaccaagaattttttatccagagaaactaggcttcataaatgaaggaaagatacagtcttttccagacataacaaatgctgagagaattcaccactaccaatctggcactacaagaactgctaaaaggcgctctaaatcttgaaacaaatcctcaaaacacaccaaaatagaacctccttaaagcataaatctcacaggacttatgtaacaataacacaatgaaaaaataaacaaggtattcaggcaacaaatagcacaataaacagaatagtagctcacatctcaatacaaatacagaatggcaaatggataagaattcaccaaccaagtttctactgtcttcaggagactcacctaacacataggaactcacataaacttaaggtaaagaggtagaaaaagatattccattcaaatagaaaccaaaagcaagcaggagtagctattcctatatcagaataaaacaaactttaaagcaacagcagttaagaaagacaaagagggacattatacaatgataaaaggactaatccaacaggaaaatatcacaatcctaaatatacatatgcacctaacactggagctcccaaatttataaaacaattactactagacctaccaaatgaaacagaaggcaacacaacaatagtgggggacttgaatactccactgtcagcactagacaggtcatgaagacaaaaagtcaacaaagaaacaatgtaggaggcagtcactattttccctctccattcccacctccctgtctgcctccaaacattccagttgggccttaggccatgttactccagcaaaacaaccctgtctaggtccagattgatcttaatattccagtttcaatggttaattagtccacactacttgacctcttaggagcattttgaccaaagctgaaagcttcctccttcttcacatgttactaaaatttggtttctgggcactgtgctttcttggcttttccaccacctctctggctgctctttctcttttgctaaactttccctgtctatctcacgtctacagttcggggcactaccgggtatagtccttaacctcttactgttctgtatctagtaactccctatatgattctcaaccagtttgaggttttaaatagcatttatatatcaatgactcccaaatttgtatctctagccaccgtctcttccctgagctctagaataggtgataatattcctctcaacttatcacatctaaaggaaaacttttaattttcccttcccagctgctgcttcccatcttctccatctttatatatcataccattatacccttacttgccctagccaaaaacttaggaatgatctttaattcctttctttccctcacagcccatacctaatctatcagtttgctcagtttggtcttcaggatataccctgaagctgacctcttcttaaaccctattgctaaaaccctggtccaaaccatcattattcctcacctgaactgctgcaaaaacctcccaacttggcctccagccaggaaggggttttcttgtttccactatagctattccatagtcaacttttagctcagtttccagaatgatcctctaaaaatgcatattgaatcacatcactcctctgattaaaactgtctggcagcttctcatcacacaaagtataaaatccaaactctttaccacagcctacaagggctcctgtgatctgtcctctttgtgcttctccaagctcatcttctaattctctccctctagctcactctagctacacgtctacattctgctgtttttatactacaagctcattcctcttttgggggatttgcatttgctattccttccacataatattccccacctccttcaatcttagcagtgctttattgattgattgcctaaaggtcagctcagcaggatgtcttccatgatgactttatataaaagagcacttcctgttcgcatccctgttccctcttcattttccttcataaaaattatcatacctcttgatattccattataagtacacacacacatacatacacagggtgagagagagagagagagacaatcctcacttagcacacttttgatatgcatggggttcagttacaacattttaaataaaaaccctagtccctcaacagcatgcttcaaatttcagttctcatggtagattaacagtaagtaattgcataagatacaaaatttgccaccagcccttcagtccacaaatcgctatgtgaaaagagagatgtgcataatgatcagtaactaattgcatcactcctttcaccatccgttagtgattgctcactgtgtttgttattcagttcatcacagacagcaaagcatggactttggatgcctctttgtctcccactgataaacccataggatgttttatgaaaacgggtcactgaaagagagaattagacaacaaagatgaaaaagcagcaaagaaacaacaaatgataacacaaaataaaataaaaataaaatgtaaatagagttacaaaagaaatatctgaccatgggaatattgatactggcatcatttgagaaactatagctctataaccaaaggaactcagtgaagcacagctatcaacacacatgaggaaaagtgggtgtgaagaaaaggatgaagatgccccagaagtcacgcttgctgaaaaacttccccttaaaggaattctcaaagatacatcatgatattgaaggcacaaaggagaaaacattggaaggtgattcaaacttagaaaagagcatgatgatttgataagatattgagaagatgctcactctgtatggtaggttatacaagaagaaggcaagcgctgttcaaactactcctgacacttttttcccagaatataaaatactttaattttgaatgtttctaatgtttgaaactatagtatgttaaattagtattggttgtactattttttcattttcttatactttcataactttaagcagtaagagattttttaatatcaaaatgttttataggttatggaacaatagtaatattttcattgatttttacaatcattttgcatggtttcagcttgcatggccatttttacagtcccacaccactgtggaaagcaaacattgtataaagaaacaaaaataactaccatagtcagaatcatttttaaaattataaaaaaaatgggggggactcatgttaactggcttaaagaatattataaagctgggaggccgaggcgggtggatcacaaggtcaggagatcaagaccatcctggctaacatggtaaaatccgtctctactaaaaatacaaaataaaaattagccggacatggtggcgggtgcctgtaatcccagctactcaggaggctgaggcaggagaatcgcttgaacctggaagacagaggttgcagtgggctgagatcgcaccattgcactccagcctgggtgatagagcaagactccgtctcaaaaaaaaaaaaaaaaagaatattataaagctacaataatcaaatcaggacagcgccagtataaggacagatgaatatatcagtggaacagaatagagtccagaaatagatccatacataagtggttaattgatatttgtcaaatgtgccaaggcaattcaaagagaaatggatagtggtctcaaaaaattatgctgaatcaactgggcatctttatgaaaaataataaacctcaacctcacaccatacaaagaatgaatcatagcctaaaacataaatctaagcataagccttaaaacttctagaatgaaacataggagaaaaattttacagccatggagtaggttcatttattaatttaaaataaatataatttatatttattagaattaaaaatttattaatgagaacatgaaagcacaaacatagaaggaaaaacaatacactgcaattgatcaaaattaaaacttttacttttcaaaggatatcaagaaaatgcaaaggaaagccagaaatttggagcatgaatttgaaatacatatatctgacatattgtatatccaaaatatataatgagatcttgcaactcaagaaaaagacaaactactgactaaaaataaacatgcaaacaagcaaaataattgggcaaagattgagccgacattcgccaaaaaaagtatgagaatggtaaataagtacataaaaggatgtccaccttcattaatgaaggaaataaaaataaaaatcacaattagatactacttcagatctattggaatggctgaaattaatcagactgacaataccaaagaagggtgaagagcaactgaaacttgctacagtgttctttggagtataatatggcgtgaacattttgaaaaagagtttggcaaacaccgcatgttctcactcataattgggagttgaacaatgagaacacatggacgcagggaggggaacatcacacaccggggcctgttggggggtgaggggctaggggagggatagcattagaagaaatacttaatgtggatgatgggttggtgggtgcagcaaaccaccatggcacatgtatacctatgtaacaaacctgtacgttctgcacatgtatcccagatcttaaagtataataataataataaaaaaaggagtttggcactttttaaatgaagtttaacatctactgacccaaaggtatagaatctccaacttctagatatttgcccaaaaggaaatacgtgtccacaaaaaggattacacatccaaataacaataaagaaactgaatccataatcaaaaagttctccaaagaaaaatattcaggtccagataatttcactggagaattttaccaaacatttaaaaaattgacactaattttgaaaccacctttgcaaaattataactgagcaaattatgacagtgaaagaaatcagacctaaccgactccatcttgcttctaacctttaagctgtccttgttcattcccgggtgtagggcaaactaactttgggaaggattcagttcatggtttaactatcaaacaaaactgataacagccctttcctgaaaagacccccttcttgcctggggaccagtctgcctttacaggactaacaaattagctacaagattaaaaattacagtttaggggtcatgcagcttctggctccaaaagtctgaacctccccaaattgctcctggggataacatcactattgtaaaacctaagatcagtacttgagacatttttcagaccctgcacttgatggatcagctgacaccacccagactggtaatctgcctcaaccagttctgccatctcacccaggaacagaagacattaagaaaacctaacttcaaccccctatgattccatctccaacctgaccaatcagcattccccacttcccaaggccctatctgccaaattatctttaaaaattctgatccccgaatgctcagggagactgatttgagtaatgataaaactccggtctcttgcacagccggctctgcatgaattactctttttccattacagttcccctgtcttaagaaagcagctctgtctaggcagtgggcaaggtgaacccactgggcagttacaattttacacaaccattctgagaaaacggaagtggagggaatgtttctcaacttactttatgaggctagtattgtaatgataccaaaacctaacaaagacagtacaaacaaagaaaacaaaaaatatattctatgaacttagatgcagaaatcctcaacaaaacattagcaaattcaaatccaataacataccatgaccaagtttgtatttgttccctatatttaatgctggtttaatatttggaaaattgatcaatgaaatccaccatatcaacaggttagagatgagaaatcatatcaattggcacagaaaaggcagctaacaaaatacaggatcattcatggttttttaaaaatagaactctcaggccaggtgcagtggctcatacctgtaatcccagtatttgggagatcgaagtgggtggattgcctaaggtcaggagttggagaccagcctgaccaacatggtgaaaccctgtctctactaaaaatagaaaattagccaggcatggcagcgcatgcctgtaatcccagctactcgggaagctgaggcaggagaatcccttgaacctgggaagtgaggccaggcatggtggttcacgcctgtaatcccagcactttgggaggatgaggcagttggatcacaaggtcaggagtttgagaccagcctggccaacatggtgaaaccctgtctctactaaaaaaataagccggacatggtggcacgcacctgtaatcccagctactcaggaggctgaggcaaaagaatcgcttgaacccatgaggcagaggttgcagtgacccaagatcatgccactgcactcaagcctgggcaatagagagagactccatctcaaaaacaaacaaacaaacaaacaaaaaaccctgggaggcagaggttgcagtgagccgaaattgcgccactgcactccagcctgggtgatggagcgatactctgtctcaaaataaatacataaataaaataaaaataaaacgttcagttctagccactgaaataaggcaagagaaagaaaaaaaaagatattcagactgggaaagaagaagtaaacccatctctatttgcagataacgtaattgtctatgtagaaaatcccaaggaatctaccaaaaaaaaaagaaaaaaaagaaaaaaaaaactcccagacctaataagcaagttttgcaaagttgcaagatagaagatcaatccacaaaaatccatcatatttctatatactaacaattaacatgcagaaactgaaatttaaaatataatactatttagaatcacttcaaagaaaatgaaatacttaaaaatatattaagaaaatgtgcatgggatcttatgctaaaaattgcaaaatgctgatgaaataaaagaaagatagaaataaatggagagatataccttgttcatggattggaaaactcaacatagtgaagtggttaactctccccaagttgacatatgagtttaatataattcctatcaaaatcccagctttgtggacatagagaaaatttatatggaaatgcatagccctataatagctaaaagaaagttgataaagaagaataaagtaggtacagaaatcactctgccttttaataaggcttacattattagctagaaaaatcaagacagtatggtagtgttttagggaacagactctagatctattcctagatccatccagagagagccacagaagagaacccagaatccagaaacagacccacaaaatacatccagtggcttttaataaagatgccaatgaaagttaaaatggcttatatccaaaagacaggcaacaataaatgctggcaagaatgtggagaaaagggaaccctcatacactgttggtgggaatgcaaattagtacaactactatggaatacagtttggaggttgcttaaaaaactaaaaataaagctagcatataatccagcaatcctaactgctgggtatatacccaaaagaaaggaaagcagtaaatcgaagagatatttgcactcccatgtttattgctgcactgttcacaatagctaagatttggaagcaacgtaagtgtccatcagcaggtgaatggataaaggaaatgtggtacatatacaaaatggaatactattcagccataaaaagaatgagatcctgtcatttgcaacaacgtggttggaaaaggagatcattatgttaagtgaaataagccagacccagaaagacaaacatcatatgttctcacttatctgtgggctcaaatcaagtttttttgtttttgttttgagatggagtcttgctctgttgcccaggatggagtgcggtggtgtgacctcagctcatcttaacctccaccttccgcgttcaagtgattttcctgcctcagcctcccaagtagctgggactacaggcacccgccaccacgcccggctaattgtttgatatttttagtagagatagggtttcaccatgttagccgggatggttgtgatctcctgacctcgtgatccacccgcctcagtctcctaaagtgctgggattacaggcgtgagccaccgcgcctggcaatcccatctttttggtaagggattgggggtagggggaagggtaagaagcaggtgaggatagttaatgggtacaaaaagaaacaatgaataagacctactatttgatagcacaacagggtgactatagtcaatattaagttaatagtacatttaaaaataactgaaagagtataattggattgcttctaacataaaggataaatgcttgaggggatagatatcccattctccatgatgtgattattacacattgcatgcctgtatcaaaacgtctcatgtaccccatagatatatacacctactatgtacgcacacaattaaaaattattaaaaatttttaaaaagaattctcataactcaacagtaaagaaacaccattcaaacagaaaatggacaaaagacatggaaaagatattttaccaagacagatacatagatggcaaatgagtacatgaaaagatgttcaacaccattaaccattaaagaaacaaattaaaactacagtgagatatcactgcacacctgtaagaatagctcagataaaaaagagtgacaacatcaaatgctgatgatgctgagaagttggctcaccggtgcaatgatgctggaaatgtaaaacggtaccgttattctggaaaacagctcagcagttttatataaaactaaacatactatcaccatatgacccagcaattgtgctcttgggcatttataccagagcaatgaaaacttatctttacacaaaaacatgtacactaatgttcacagcagctttattagtaacagccaaaaactagaaacaaccttcgatgggaaggaaacccattgatatacacacagcttagataaatctcaagggaaggatgctgagtgaaaaatgtcaatcttaaaagttgcatattatatgattccgtttaaatagcattcttgaaataacaagattatagagatggagaatatattactcatttccaggggttggggatggaggagatgtatgtggttattaaagggcaatgcgggagatctttgtggtgacaaaactgttctgacaggggtggtgaatatgcaaaactacacatgaaataaaattgtctagaactaaatatacacacacacactcgagtacatgtaaaactgggaaatctaaataacatcagtagatgataacaatgtcaattcctggtcatgatactgtactataattctgtaagatgttactactggagaaaactgaataaaggatacacggaatctctctgtgttatgtcttaaaatcacacgtgaatctaaaaaatctcaaaataaaaaggtgtattaaagcaaaaagatttgaatacaatctcatagtagcattttcataacagtcctagaccggaaataacccaaatgcccaacaacaggtgaatggagaagcagattttcctactcagaaatagaaatgaacaaattgttcatacatgcaacaccatagttaatttcccagacaatactgaatgaaagaagacaatatttcatttatatgaagttgcagaacaaataaaactaatcaatggtgatgaaaaaaattaaagagttggtgaaagggaggagtgaagcgactgcaaaagaatctgcaggcctttctaggatgatggaaatataaagacatcttgattaaggtggtggttacatacgacacacatttatcaaaacttatcaaagcatatcctttaaatctgtgctttttattgtgtatgcaaattatacctcaacaactcaacaagttatttttaagtgtcggtatggttgtaagacagagaggagtctaggatattgaagatggaggcaaggaaatgtctggggagtttctaatgcaggcatctttgatcctggtcagatggccttaaagggaagggtataccagtcaaggaaatagggcacattgaataggaatccaggaaatctgggagtagtaaagcctcttttctctattacaacacctctatacaccacagagggtgtgaggaatgagaaacctaaggtctatatttccgtgagatactgttaatgatgacttttaatttgtacaggctataatttgcatatttttccatgtgcctaattagtgttatcttcaagacttactgggtaaacaaaaggggtctgttggttcaaggacatacctgacttatcatatcctcccttgactatgcacttttgattactgaacatttccagagaattaacaaatagagcaggagattaaatgatatggaaaatattaattagtgggcttaatatccgtacttggtgggagagacgtatatatatgcaaagagattgaagcatgttccagggaaaagcttagaagatgaagctaccagcttctttattaatggccttcaactacctcaagcttgccgtgtttttaaagcaaaataatgtgtttctaacacaaacactccagcagcatattacagcctgaaagggaaatctggtaaggatacaaacagctctctactatttatgccttgtggaactgccatggaaattctgatgtcctgacactggaaatatccaactagcctgcagagaagccaattcttggaaagtgcaccatcattttaattttgaaataaaaggaaattaagacatgaggaaaagatgcctgagatgctaaatataaagacagcatttaattattctgagtcagttatctagtttaaagaataaattcttcactatcaaaaacaatgcaccactatctttatgaattttctttctgctaaacctctcttccttttagatatctatattctagagctattgatttttgaggttcctctcatgcaaacttgggagcaaattcattgtcaactaccaatctggaacccaggaaagagttgagcttttgaaaccaggattccatgtcatttactagctacttgcttccaagtttccttactaaaaaaaaaacgggaataaaaataattccttttctatcttcctgacaatgctatttgcaaataaatgaaagaattcacctaaaacataaagtatattccacacattatataagtgctatttgatgtacatttgagaagacacttgatagaagagatttacaatacagatatttgatacagtttaaaaactaacttttaacaacatgaacaacccaaaatgaaactattctatagaactaaaatcttaaatctgccaaattccattagagttgaaaattaacctatatatttggtttgaagcaatatgataataatgtgaaaccagtcagtcaaacacaaagaaaagacttgtacaattaaataattttaagctagtttatgaattctcatgaccttattacaagttatttgataatgaagatcaaagcacataatatataaaaacaaatataaattgctaactattctctgttttgtccaatttactttaataatgaaaacataaaatctatccaccgtcatatataaaaataggccagggaactctcttcaagtatctgtacaaagggcttacatgaaaaatatctgtgtttactatagtcatcctgttgtgctatcaaatcctattcctttgatctaactatatatttgtacccatttgtatttagacagtttaagcagaataaattttttaaaaagaaacttcttcgaagtgcccctaggtttcaaacagaaaggtttagtaatgctaataaagtatgacagtatattacaatctatagttacactatcttccaccacatgcgaatctgaagaaaaggttattgatttagaaaccatctgccacagacttcacagtttcacccaaagaagcaatttgtttttattttctatcactataacttcttaccctctcatgactctcagttataagtcccagtgagtcactttcctttgtttcatttcttcaaacatttctagaaaggtgaaaataagtatattggtttgcttgaaaatatttcctctactattctttctcaagtggtcaatagtatgttactaacaaatgcatttcaactaagaatatatgtttcctgagctgactcccactcctgctacaagtgcattattgtacttcagtaaccaatctgccttcctcttctattgcacaccaatattttcctaggctaaaattttaaacaaacttgagctttggaaatcaaattccaagtaggtacactgaagatagaggtcttcattcttttcacaaattctacactttgaaagcaatttatttttgttcttccttacctcccaattgttgacagagctagtcattatgcaatttgtcagaatcctaactatacagccaatatttttaaaattagatacattcacaatttttacttttttctctatggcaaaattttctttatcatccataccctgctgctacctaaaattgcatgcacagaaagagtattcccaagggataaaaaaaagtttttcacattaacttaagcaaagtaattaaaaatataaatttagtaaaacagacatgtttttgagtaagttttttccaacatgtggtgaggcatgtatgtataactgtatttatgaatacggttatactgtacataatacagtacattaagaatttgacatgttttttcctttatgatactgagaatatataatttagcctatttccatttttcccctggctgccagaaagctgagagtcaaacaaaccagctgctcattatataactatattagtctctttttgaacaaatttgttttattttctgtgccaacttctagagtactgtctagtagtaattcattagttttatggtgcatatgttacacatcataacctttttcaagtctcttttagataacaggtaggatacaataaaagggcagacatatttatttaagatcaaggaggtaagttgttattttactaaaacttaacagaaattgacaaatacttttatatgtcttgaaaaagtgcttaaagccacatttcatcaaataaaatagattttattttagcttacctattggtaattttcagggctctgaaaaggctttaattaaagagtatcagaggatttaagagcaggatggctgtttgtgtcagtattaagccaagatttacaaaggcctattacggttccagtgacatttccttcctatttttccatatcagcaggaacatttcttgagggaatagattgctacttgctgataagatctctgacagtaaaggtaggctaagcaggatgccaggtatgaaactagagaataaaatcttatcaaatgtaaaacttgtaacattgcacctgccatgtagttggtttacctcgaatggtcattgcttttcctcaaaagcatataaagttgtatcctaataagtgttggtatgcaacaaaattatgttttaataaactgagtaatttttaaaaactaattttggagcatgatagaagtttaataaacatctaaagagatttaaaagcaaataagtaatcatagtcatcaattcacttagaagcaaacctctcatatactttacatctacttcaaggctttttctactgcatgaatcaaatcacagctgccttattttcacccaaagataacacactgttttgtgactccataaggttatttattactaatatattttatatttgcatggcacttttctatttacaacatactttcatttatagattatctcattcaagcttcatcattctgagaaaacagattataatcacattaaaaagtacaggatgaggttaacaaatggactaaatatacaaatagagttaaaacagcctgattaagatacagaatttaaatatttttcaggctgtgcaaagctaagataatgtcctttgtcatcaagctcactgaaaagcttttattaggcaacatttgtatggagcactgttctctgggataaactacgaaccattaacatgggcaaacatacaaggagcatacaagtagagaataaaggcaagattaaggtacataatagtagcaaaaaaagtcttttatcagtcaaagtccagatgcataagagtaatatacatatggatatcacaggagtggtgacaggtagataaaatttatcacttttcttttgtatttcaagataataatattttaacttatgtaattcctacaagaaccccctataaagtaagaactattttatgcctgaggaaactgaggaacaaagattaagaaacattactgaaagccaggcgtggtgcttcacgcttgtaacctcaacactttagaaggctgaggtgggtagatcacttgagatcaggagcttaagaccagcctgggcaacaaagcaagaccgtgtctctacaaaaaaataacataaaaaattagccaagcatggtagcttgcacctgtagtcctaactcctcgggaggttgaggcaggaggatagcttgagcccaggagtctgagcctgcagtgagctatgattgtgcctgggcaacagagtaagagtgagacactgtctgaaaagaaaataaagaaaaaagaaaagaaatgaaaagaaagaaaagaaaaagagaagagaagagaaaacatcactcaagatcacacacctaatgctaataagtggccaaagtgggattcaaacccaggcagtttggctgcctacaactcaaccctaccctcactctactgcgtggaaaaattacctgccatggtgaacgggaaactgaaactgtatgaaagaaagaggagagcaaagcttatcttatgatcaggtggtacctgtgagaaatgatttgagggaaaaacaagtaaaataacttaaaaatattcacctcactgactctccaccatgagaagtttcccttttaggatctattttccaaaatcccctatttgatgcaagtattcaggtatatgtacagtcactatccaacacctttgttttcaactaatatcatggggattacaatgactctcatgacacccacgtgaaagaaaataaaaccccacatccagggcagtgtctagacctgaacgttactgagagaataaggaaaccaaaatagctggcttcaaatgtgggctgaggaccaggtagtaagtggatgacatacaatggaaccttccaaacacacagaatagcacccacagaataaaacagagccctggacgccagggtggtcattgatcaaacaaggctagagggatgacagagaaaaggcgagacttcaaggctttaaaattgggagcagagaccttggcaataagaaactgctggaaagctttcagagaaggttccaaatacaaaggcaggttggttaatttggcaccaccaggaggaatactgtgtggagtctagccaggcctatgaggccttgaatcctgagacaggagatggcaggaaaccaaatgcagaaggtggcaccaggagagtcctcatacaccgcacatcctagaatatgctccagggattcagaatgatggatgatggagaacgggctcttgcttatgatgtttccaggaaagatctgagacacagtagcctcacagaatcttgggtttttcccccgtggcaacttgactgaaggagacaattttgatacgccatatctgctttctatttcataccacccagagaaggtcagagggaatgggaaagtaaaagttcactgttcaaaaagagtgagacggtgtttcatgtctgtttctgaggagaccaggggtactgtgacagacaaggagatgttcagcaatggtgggtagcacaggaaatggagctctctaggcagcatgatcacagaaagaattgccattggcagcccgtatttttcaagaggaaattaaaggacacataaaatcagagaagaaagtggggagcagaaagggtttcaggagcagaaagtacattgagtaccaatttgacagccagtcaccataaaagatatgagtttggatccaaatgccgagttgatagagcgctaaggcagcttagaatcttcaacataaacacagcagagaggggtataaagtgaccgagctgagatgtaaacaataattcctagacccagatttcaacagcagcagtatagctcttggtgggaagaataaatattttatatgtatagaagtaaaaatgatatgtgtgttaattcccaaagagggattaaagacctttctctaacatagtaccaatgtgtaaatgttctccaagacttattttattaagcacacattcctgggaaggtgataaagctagctattagattgcattctgaagatgctcaattattttctttatatgtggtcccccgcctttctaaaatctctacactgggccaaataggagaccactgagcttagtatgccagctcattcctggatatgtttatcgctactaggagcaaatgctgtgtcttccaccaaatttttaagtgtctgagcagacaaatatcttgaaaacctgactatattttatgctgagctctccaagtctgtgctgaataaatgcagggatacggcttatactagagaaaacaaagtaaagatacatatatgttccttatgttggtaacattaacagcagctatcatttcactgtttatactatactaagcatgcagatattaaaattaatcctctcctaatgatcctttaaggtaggtggtcccaatttacagaaaaggaaactgaggcctatgtattggaacaatttcctcaagaatacacaaagctggaaagtggcagaaatgaggttaaatacagatctgcttgaagccaatatcttaaccactaggctcctaagcacagtactgtcagctgggaatacaataatgaatatgtcatggttcagtcttccaggagtccacatgggagtaaagagagagaggagaaagagtcgatataatccataacagtacgaagaaatcctataagtatatgcagactagcaactaacagcctgagtatgaacagtgagggtcagtgttagcactgggccttaacaggagcagtttggttggcatgagggctgtggatagctgcagggggagagtgtccatcctgaaggagtgccttttaccagctgatggaatccattctaaacatcagtggactgaatcattgaatagaatcacctataaggaagattttagttttaatggtcacttttcaaaataagcccgagtttctcattattcttaagctatcttcaggttttattaagccagctttttaatacattcaacagattgatttttttaaaaaaattaagagtattaaaccagaagagcttcaataaagaccctcaggttgatggtaaggttttaattactggcttttgtttttagtactctagttaattgggtatctgatcatcgtatatttcaaagcagttttcccaggttcattagcaagaaacttctataattcaaatccaaatcttcacttcaaatatattgcccttctttcttcttccttatctacagggctacagtttgtcactgaggaaattaaactgagcaaaaacaagttatttttcacaaagccaacttgttaagatttaatactttgtaatactgataagattatatctgctaaacaaattaatttagcagtttagaagtatctaagaaaacctaaacattgtataacccataataatctgactattcagcgtttattctatagaaatccccacttaggtgggcatgatgaagcatgtacaaggatgttcagtgcagtatatttgtaaaagcaaaagctggaagcaacatagatcatcatcaattgagcaatagctaaataggtatcctgtttagcctacgaattgacaatgaggtcaatctgtatggactaacacagtaagatctctacgacatattaatgaaaaaaaatcaaattgctaaaaatgtatgataaaacatcaactgtgtagaacatcacacactcacaccaaatcacatatatatacacatatgcatacaaaggagagatatatacatatatacataagtttttgtagatatctctctatattatatttatgtacatagctctctttatccatatatgcatgcatatagagttgtcccttggtatccacgtgggattggttccagttcctcccacagataccaaaatctacagatgctcaagtgcctgatacaaaacagtgtagtatttacatataatccgtgtacattctcctacgtacttgacatcatctctagattacacataatacctaatataatgtaaacacatgtaaatagttgttatactctattgtttagggaataatgacaagaaaaaaatgtctgtacgtgtttagtacagacacaaggttttttaagagtatttttgatccatggctctttgatttcacagatgcggaatccacggatacagagggctgacttacatacctatatacatatatatgtgtgtgtatatatacatatatgcacacacacataaatatatatgtaaatgcatatctaaatgcatagagattaggattgaggatagcatttatggaaactttctctgttctcattactttattgctgtaaaaataatgaatttccatattacttatacagatggtctccaacttaccatggtttagtttacaattttttgactttaaaatggtgtaaaaatgatacacattcagtagaaaccatactgtaagtatccacacaaccatcctgtttttcacttttagtacagaattaaataaattatatgagatattccatactttaatataaagtaggctttgtgttagacaattttgcccaattgtagactaatgtaatgttctaagcatgtttaaggtagactaggttaagctatggtatttagtaggttaggtggattaaatgcattttcaccttatcaggatttatcaggtcggaatcccattgtataatagcctatagtttttagcgtcttttcccgcttttaaaagaaagaccaacgttgagcattttgatgcaaattaatttcacgggtctccaagcatggctgagaactcagtgggagcaggacacacactttacagagtaccacaaaatgggtgtttaataactattaaaaaaggaatgaaccaaccaatgaataaatgacagtctcagtaaatattatacttaaagtttctaagcattggttgaggtttggaacctggcaatttgtagggagacattagaggatattcaaagtaaaaactaaaatcactctcttttactctgtattgatttgttaatggtgctaaggactgaatctccaaaagcaaattaagatttacatattaagatttttttctctagcccaggacattaatttgttaatttttctcttatagtttttgaacgtagataatacataattaacataatgtggcattttagggacagcttcctaagctttcattagccattaaacataaatacaaattttaaaatataaccaacatttcattttaattcttttaattattaaacaccttattttagtattttgctaaaagtcacaaattccatttcaatttggtatctacctaattttaatgcaatccaaaaactctacaacatttcttaataaaagttaattaacaggggagtatagattaaacaacatccccagaatacatatgataaaggcttaatatccaaaatatataaaggaactcaatagcaagaaaacaaaccaattaaaaaataggcagaggatctgaacagacatttctaaaaagaatatatacaaatggccaacaggtgtacaaaaaaatgctcaatatcaccaatcagcagaaaaatgcaaattaataccacaatgagatttcactgcatacctgttagaatggctattatgaaaaagacaaaagattgctgggtgtggtggctcacatctgtgatcccagcattttgggggtttgaggcgggtggatcacttgaggtcagggggtcaagaccagcctggccaacatggtgaaatcccgtctctattaaaaatactaaaaattagccgggtgtggtggtgcacgcctgtaatcccagctactcaggaggctggggcaagagaattgcatgaactcaggaggtggaggttgcagtgagctgagatggtgccactgcactccagtctgggcaacagagcaagagactccgtctcaaaagaaaaaaaaaaaaaggccaggcacagtggctcatgcctgtaaccccagcactctgggaggccgaggcaggcggatcacctgaggttgggatttcaagatcagcctggccaacatggtgaaacctcgtctctactaaaaatacaaaaattatccaagggtggtggcacgtgcctgcaatcgcagctacttgggaggctgaggcaggagaatcacttgaacccgggaggcggaagttgcggtgagccgagatcgtgccactgcactccagcctgggcaacagagtgagacactatctcaaaaaaaaaaaaagaaaaagagaaaaagacaaaagataaatattgacaaggatgtgaagaaaagggaacacttgtgcactattggcaggaatgcaaattagtgcagccattatgaaaaccagtatggaaattcctcaaaaaattaaaaatagaactgccatatgatccagcaatcccaatactgggtatatattcaaagggaataaaatcagtgtatgacagagatatctacactctcatgttctttgcaacatttttcaaaatacccaagacatgaaatcaagctaagtgtccttcaacaggtaaatggataaagaaaatgtggcacatatacacaatggaatactattcagctttaaaaatgaaggacacttgtgttatttgcaacaacatagatgaagctggggaatattgtattaagtgaaataagtcagacacagaaagacaaataccacatgatctcacttgtatgtggaatcttaaaaagttgaactcatggattagggagatgttggtcaaaggatataaaatttcagttagataaaagtaataagtttaagggatctattatacaacatggtggctacagttaataacaatgtattgtgttttgaaaattgctaagatagattttaagtgttctcaccacaaaaactgatgcgtatgtgaggtaatgcatatgttaattagctcaatttagccattccacaacttatacatatttcaaaacatcatgttgtacatgataaacatataaaatgattgtcagagataaacaaaacaacatcctctaaaattttatctatgaaaagtttgtcagcataacataatgtaaatgtaagcatgtagaagaattaagagtagagttcattgaaaatgtggatgctataactttattccaagcctactgaattggaatctcctgcactgggactgaggaaattgtattttaacacactccattggtgaatcttttgcacaccaaactttaggactgctgagacagaatgctgcactcttctttgaacttgtacacctttgctagtcaaagtgtggttctaggacaagcaacatccacatatcataggagcttgttagaaatgcagtctcagataacactcaacactgactgaatcagaatatgtattttaacaagagccttcattgattcataggcacattaaagtttgaaaagcagtatgataatacaatatactacctttttgttatgatttaaatttaaaaattatagggatgagtgtattttttaagtacaaaagggataaaatgtaaaggaaaagtggttttttttttttttttttttttttttttttttttttttttttttttttttttttttttgagacagagtctcgctttgttgcccaggctggagcacattggtgctatcttggctcactgcagcctctgcctcccaggttcaggcaattctcctgccttagcgtcctgagtagctgggattataggtgcccgccatcatgcctggctagtttttgtatttttaggagagacagggtttcaccatgttggccaggctggtctcaaactcctgacctcaagggatccatccgcctcggcctcccaaagtgctgggattacaggcgtgagccactgcacctggccaaaaaagttttttctccaccacctatcccagtttcactcttcagaaaccataaataggaagtttcttcttatttatttttctttaatttccttgaaaaaggtattgctactctgtgttctaacatctggtatggggatgagaaatttgattcacatttcaaacatttctgtgataattaatttcagatgtctacttgactggatttaacaatagcaggagaactggtgaagcattgtttctaggtttgtctgtgaaggtggttctagaggagactggtaagtgggtcagtggcgtgagtggggaagaccactcttgatgtgggtagaaccctgcagctggctcggggctcaggtagaacaaaaaaggcagaaaagaggccatttcttctctctcctagagctggaacactggaacactcttcttcccttttcgtggacatcagaactccaggctgtctgacctttgaactgtaagacttaaacaagctgccccttaggttctcaggcttttggccttaggctgagagttccaccatcagcttccttggttctaaggcctttggacttaaactgagccacactactggctccctggttctccagtttgcaaatggtctgtcatgggacttcccagcctccataatcatgtgaaccaacttccctaacaaatcttatctattgattgatttattgatctgtctcctattggttgtctctttggagaaccctgactagtacaatttctttgtaagtaaacaattttctttttactgtaagcttttcagattttctcttattcttggagtgatgaaatttcccctagaaagtatcaaaattaatttctcctaagttttgtctttttcatttaccttgcttggcacttactgaattctttaaaaatcaagaatcaatctttctcttttttctttttttctttttttgagatggagtcttgctctgttgcccaggctggagtgcagtggtgtaatctcagctcactgcaaccaccgcctcctgggctcaagagattctcctgcctcagcctcctgagtagctgggactacaggtgagtgccgccagacccaactaattttttgtatttttggtacagacggggtttcaccgtgttggccaggctggtcttgaactcctgacctcaggtgatccacccacctcaggctcccaaagtgctgggattacaggcatgagccaccactcccagctaagaattaatctttcttaagcctgtaaaaattttcttctactctttctttgattatttcctctgcttcaccacttctattctctgctttagaatcttggactaacattcacctgactgaacaataattctgattggatggcttccattttgatcagtctgtgcctatgtcatacacgtaggtaaatattttgaacgttacttccaactggatttatgctttgggtccttaaacacttttgctctcatgttttccattcctgtgctatgtttctataatggattgaattgttgaccccaaaagacaagtctatccagaacctctgagtgaccttatctggaatagggcctttgaaggtataattaaggtaaagatcttgagatgagacccttgtgaattaggtatgagtgtctctatgctgggcaaagggaagctgacatggttactcagactgccatcttgaactagaagtccgtatctactgtttcatgttgtattattttaacttctctaataaattataaattcctgaagaatagggatttctttcttcacttatgtctcctatagaaattagcataaatgcacatttaaaaattaatcaaatgaatgaattcataagttagtaagtacatgagtgagtgaaagaaagccagtaaaacaaagttaaaagctaaactgccaaagtgaaggaaaaatctaatacttttgctgtttgaaaagcggcagaagtgaattgtaacttaacacatatgtgagtaaaaagcattaatcttcagctttcaattaacatgcctcttaatgcaaaatttcatttcactggatcagataactcacattctcttcctaattgccaggatattcaatatttatcattttagatctagtcatcttcaagaaacatttttattagatttttgtaaatgtgtagattactaactatgcaaagagatgtggatccatttgtacttggcaaatgcatttctgcttgttaaattcactgagtttttgtgcttgaaaatcaatactagaacaagttgaatggaataatctgtggggggctctataatcttagtatcttaatttcaaaattggacattttccaaattgagaaagccttttaaaaagcgactcaaagtcaatttattccattcctatacaacttataaccctacaagtcagtagtggaaaagaggagaggatcagctttattaagtggagacatttaagctggtcttagagaataagagggaatccaccaggtagaagaaaggacaaagggcattctaggcagaggaagcaaagaagcatccaacaaattaagattaaaagggagcatcctcaacatggtaaagggcatccaaaaaaactcatagctacccagcatcatacttaatggtgaaggatgaatacttccccctgaccctaagatcaggaacaagcaaggatgtttgctctcttcacatctattcaacactgcactagagattcttgccaggacaattaccaagagaataatatgaaagtcatccagattggaaaggaagaaataaagttatctctacttgcaaatgacatggtcttgaatatagaaaaccctaaggaatccactacaaaactactaaaactaataaacaagttctacaagattgcaggacaagattaatatataaattaatttctatttgtaaccaataaggaaatttaaaacaaacgaaaaaaataattcatttacaatagcttgaaaaacaataaaatactcgtaaataaatttttaaaaataagcaaaatttatactctgaaaactatataacattttgaaagaaattatgaagataaatagaaagacatcccatattcatggatcagaggatttaatatcattaagatggcaatgctccccagatttaacactctatcagaatcccagttagcttctttgtaaaaatgcacaagctattcctaaaattcatatggaaattcaaaggaaccagaatagccaaaacaattttgagaaagaacaaaattgaagtactcacacttcataatttattaataaaaacttgctacaatgctaagtaaacaagataatgtagtattgtcatgagaacagaaatacagataaatggaatagaactgagagtccatgagtaaagcctaacacttatggtcaattaatttttgacaaaggtgccaagaaaataaaatggggaaaaaatagtctttcaacatatggttgggacaactgggaaaattgtatatcttcatagaaaaaattaaagttggactcctaccacatattatataaaaaattaactcaaaatacatcaaagaactaaaggtaaaagctaaagctataaaactcttagaagaaaacacaggtatgattctccaggaacttgaattagacaatggtgtctgacacaaaaagcacagcaagaaaagaaaaaataacggtacttcatcaaaattaatgtgaaataatttgcgtttcaaaggataccaacaagaaagtgaacaggcaccccacagaacaggaaaagctatttgcaaatcatgtttgataagggacttgtatctagaatatataaagaacttttacacacaatacacacaatatttacacacaatatttagcacaataataaaagctaaataatgtaaaaactaatgagccaatttaaaaatgggcaaaggatatgaacagacatttctccaaagaagataaacacatggccaataagcacatgaaaagaagatcaacatcattatccattagggaaatgcaaatcaagaccacaatgaaataatatttcacactcactaacataactacaatcaagaaaatggaaaataacaagtgttgacaaggatgtggaaaaactaggatattcatacactgctggtgggaatataaaatagtatatccactttggaaaatagtctggaagttccttgaaaagctaaacatagagcttccatatgatctagcaattccactcctggttatatgcccaagagaaataaaaacacatgtacaaatgaacacaattgttcatagtaacactataattcataaaagtggcaacaattcaaatgctcataaatcaatgagtgaataaataaaacatggtatattcatataaggaatattatttggcaataaaaattaatgaagtactaatacatgttataacatagatgaaccctgaaaacatcatgctaagtcagacacataagattacatactgtaattccatttatattaaatgctcagaaaaacaatagtgacagaacacagattagtggttgcctagggttcaggggactggaggtaatagagactgaatggtaatgggtacagggtttcttttgggggttatgagtgaattgtatagtatgtgaattatatctcaatgaagctgttataagaaaaaaaattaagaatctctggagactgagaatcatgacattttagagacaggacatttctatctctcattttatagattttgtttgtttttttgagacggagtctcactctgtcaccaggctggagtgcagtggcatgatctcggctcactacaacttccgcctctcggattcaagcaattttcctgcctcagcctcctgagtagctgggacttcaggcgtgtgccaccaccacacccagccaatttttgtatttttagtagagacagggtttcaccatgttggccaggatggtctccatctcttgaactcgtgatccacccccctcggcctcccaaagtgctgggattaaaggcgtgagccaccatgcctgtccattttatagatattttttaaaggcacttggttttgcattaggtcacaaaatttgaagactacacttataatttaacatttattaaatgttgatatatatgatttcaggaaatttgttcattatagaagtcaaattatatatttatacccactgacatacatatgtctttttatatccatccaatagatcaatgattttcagggattttgttattgttgttgtttttactaatcctaacacacttaagggtgtgtcaggaaaaaatgttttgtgaacatgaccagaattaaatcataaatattgactatcctggcaagaaagaagagactatgagttatctagtccagtgaaatgaagatgacatgttaatagaagaatctggcaagttcccatcaagatatgatcttaaatatagaacatctttcaatagagcagcaggggtggtgaatagggggcttatctctgggacagaggagggacatgagtgtttgataacctgcaagttgaaatatatatattttggaaaaattttctcccctcaaatcctgaagaacacatatagggagctgtgtttaccccaatctagtgaaaatcactatgcaaacaatattcaacagtttctgcatactcttcaaaatgctttttaaatatctctgctaaatctgattaaattgatcagagtttggacaaaatgaagtgggtcagaggagagtaaatctgaattacactgatgaccagaatatgaataatgagtgttatcagagtgagacacattaatccagagaggtaagtgcaagttctcataaaattgtcttggtaaacacacataaatacaaaggctacagactagcatatccccacatcccaagagttcctagcacatagtaggttctcaataaatatttactgaatacaagaataaaaatgtgattgagaaagagagagaagctgaaggagaaaacaggaatgaaagtttaaaagatgaaggagagaaattaacaacgaggagacctagggagaaagaagggacagaaagcacaactgcagcagtcactttgtaacaaatccaaaatgaaaaaaagaatgagcgggcgagagagagagagagagagggagagagagggagagagagggagagagagggagagagagagaaagagagggagagagagggagagagagggagagagagagaaagagagagcaagagagagagtcactcagcaagcaataacaagaaacagattaccctgttgttgttgttgttgtttgagaggaagttttgctcctgttgcccaggctggagtgcaatggcatgatctcggctcactgcaacctccacctccggggttcaagcaattctcctgcctcagcctccctagtagctgggattacaggtgcctgcaaccatgtccagctaattttttctatttttagtagaggcagggtttcactatgttggcaaggctggtcttgaactcctgatctcaggcaatccacccacctcagccacccaaagagctgggattacaggcgtgagccaccacacccagccaactgccattttttaattctgtatttaccacttcatcaaaagtcaatacagatattgtaacagcaacactgtacagaagtattttatagtttatgaaatattttcccatgttttagctcattcctgacaatctaagaggtaaatatattatttttatttagcagatgaagaaactttggttttgagggtttaaataacatgagcaggaacatacaagcagaggagctggaacttcaaccagccctcaacccatgcctctataatgggtgttaggaatcaagaaccacagtgtaggacaaaaaagagataccaaacctgttcatcttcaaccctttcagaaaaaaaaaaaaaaagttctagaacatatgtattatccttagttttgatgctatttcaatggactattcttgcttatctagaaatcaccttcttgaaagtcaccaatgatccattaatcagcaaagccaaagaactctcaattttcaatccacttttctaatctataccatccaacactatttaccattccttccttctttaatctgtttcttctcatgaccctgttctgtcatctctttgcctttcttctcctgcaattgctccacatatctgtttccttcaaatgtatgaagacacaacataaacagacctttatcactcttacttccaccacaattcttgagcttgatttccccacaagaacatcccactaatcccatatagcatgaccaaaagggaattgtatcatccccaattgtcttccaacattcttgactttggctaatagcatcactattcttccagtaactaagtcaaaacattgaggggagaaagttttgccgcctcctcttgtcctcttttcctcttccctggccaatcagccatgaaacaccagttacattactcagaaattctttcttatcaatagtctcaacttagtccatggtctctgaactatttgtgttttcctaagaaatatttccctttgcctggcccctctcttttcctccctctctccttctgtcacacctacagtttttctactgttagcagagttattgctcttaaagattattcctatactcaaaaactttcagagaatccctataatccacagaattaagtcaagattccatagcacaactttcaatgccatccatgatccagtctcaatttactcttttagtaaagagtaatttcccctaaaagtctatttgccataaaactggattattctatgcttctgaatatatctggggttcaccagtggctaaactttaactcatgttaggccacttcatcacatacctgtccctggaatgttcccacaccggtcccaattatctttcaaggttttgtctgaacattaagaagctcttttgattttggatctttcctgctttctcttgtgggcatttagtgctataaatttccctctacacactgctatgaatgtgtcccagagattctggtatgttgtgtctttgttcttgttggtttcaaagaacaactttatttctgccttcatttcgttatgtacccagcagtcattgaggatcaggttgttcagtttccatgtagttgagcggttttgagtgagtttcttaatcctgagttctagtttgattgcactgtggtctgagagatagtttgttataatttctgttcttttacatttgctgaggaggagagctttacttccaagtatgtggtcaattttggaataggtgtggtgtggtgctgaaaaaaatgtatattctgttgatttggggtggagagttctgtagatgtctattaggtccacttggtgcagagctgagtaaaattcctgggtatccttttaactttctgtcttgttcatctgtctaatgttgacagtggggtgttaaggtctcccattattattgtgtgggagtctaagtctctttgtaggtcactgaggacttgctttatgaatctgggtgctcctgtattgggtgcatatatatttaggatagttagctcttcttgttgaattgatccctttaccattatgtagtggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgctatgtgtgaatttgatcctgtcattatgatgttagctggttattttgctcgttagttcacgcagtttcttcctagtctcgatggtctctacattttggcatgattttgcagcggctggtaccggttgttcctttccatgtttagtgcttccttcaggagctcttttagggcaggcctagtggtgacaaaatctctcagcatttgcttgtgtgtaaaggattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcactctctgtatttcctgaatctgaatgttggcctgccttgctagattggggaagttctcctggataatatcctgcagagtgttttccaacttggttccattctccctgtcactttcaggtacaccaatcagacgtagatttggtcttttcacatagtcccataattcttggaggctttgttcgtttctttttactcttttttctctaaacttcccttctcgcttcatttaattcatttcatcttccatcactgataccctttcttccagttgatcacatcggctcctgaggcttctgcattcttcacatagttctcgagccttggctttcagctccatcagctcctttaagcacttctctgtattggttattctagttatacattcgtctaaattcttttcaaagttttcaacctctttgcctttggtttgaatttcctcctgtagctcagagtagtttgatcatctgaagccttcttcactcaacttgtcaaagtcattctccgtccagctttgtcccattgctggtgaggaactgcgttcctttggaggaggagaggtgctctgctttttagagtttccagttttttctgctctgtttttccccatctttgtggttttatctacttttggtctttgatgatggtgatgtacagatggatttttggtgtggatgtcctttctgtttgttagttttccttctgacagacaggaccctcagctgcaggtctgttggagtttgctagaggttaatatcacaattaaaagaactagaaaagcaagagcaaacacattcaaaagctagcagaaggcaagaaataaccaaaatcagaggagaactgaaggagatagagacacaaaaaacccttcaaaaaattaatgaatccaggagttggttttttgaaaggatcaacaaaattgacagactgctagcaagactaataaagaataaaagagagaaaaatcaaatagacgcaataaaagatgataaaggggacatcaccaccaatcccacagaaacacaaactaccatcagcgaatactacaaacacctgtatgcaaataaactagaaaatctagaatggataaattcctccacacataccctctcccaagactaaaccaggaggaaattgaatctctgaatagaccaataacaggatctgaaattgtggcaataatcaacagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatactgataccaaagccgcgcacagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgaaaaaattcaacaacccttcatgttaaaaactctcaataaattaggtattcacgggacgtatctcaaaataataagagctatctatgacaaacccacagccaatatcatactgaatgggcaaaaactggaagcattccctttgaaaaccggcacaagacagggatgccctctctcaccactcctattcaacatagtgttggaaattctggtcaggtcaattaggcaggagaaggaaataaagggtattcagttaggaaaagaggaagtcaaattgtccctgtttgcagatgacatgattgtatatctagaaaaccccatcgtctcagcccaaaatctccttaagctgataagcaacttcagcaaagtctcaggatacaaaatcagtgcacaaaatcacaagcattgttatacaccagtaacagacaaacagagagccaaatcatgagtgaactcccattcacaattgcttcaaagagaataaaatacctaggaatccaacttacaaaggacgtgaaagacctcttcaaggagaactacaaaccactgctcaatgaaatagaagaggatacaaacaaatggaagaacattccatgctcatgggtaggaagaatcaatatcgtgaaaatggccatactgcccaaggtaagttgtagattcaatgccatccccatcaagctaccaatgactttcttcacagaattggaaaaaactacttgaaagttcatatggaaacaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaatgggctagccatatgtagaaagctgaaactggatcccttccttacaccttatacaaaaattacttcaaggtggattaaagacttaaacgttagacctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaattttggcaacctactcatttgacaaagggctaatatccagaatctacaaagaactcaaacaaatttacaagaaaaaaacaaacaaccccatctacaagtaggtgaaggatatgaacagacacttctcaaaagaagacatttatgcagccaaaagacacatgaaaaaatgctcatcatctctggccatcagagaaatgcaaatcaaaaccacaatgagataccatctcacaccagttagaatggcgatcattaagaagtcaggaaacaacaggtgctggagaggatgtggagaaataggaacacttttacactgttggtgggactgtaaactagttcaaccattgtggaagtcagggtggcgattcctcagggatctagaactagaaataccatttgacctagccatcccattactgggtatatacccaaaggattataaatcatgctgctataaagacacatgcacatatatgtttattgcggcactattcacaatagcaaagacttggaaccactccaaatgtccaacaacaatagactggattaagaaaatgtggcacatatacaccatggaatactatgcagccatagaaaatgatgagttcttgtcctttgtagggacatggatgaagctggaaaccatcattctcagcaaactatggcaaggacaaaaaaccaaacactgcatgttctcactcgtaggtgggaactgaacaatgagaacacatggacacaggaaggggagcatcacacaccggggactgttgtggggtggggggaggggggagggatagcattaggagatatacctaatgtaaatgacgagttaatggatgcagcacaccaacatggcacatgtatacatatgtaacaaacctgcacgttgtgcacacgtaccctaaaacttaaagtataaaaaaaaaagattgtctcaaacatctcagatcaagaaagtcttatctcctaattgtctctttgcccataaccataatcacactcatatgtatgtaccatgatcacgtccatcttggagcttttatcctttcttcccttttgcttggaattcctaccttcctctcttctccaagcaatagctaaacctcaaaacccattttcaagtctcatctcctccctgagaccctccctgatcaattcaattaactgatttcttattccttgtctgttaaaacatgatataaatggaaatacagaaatatgaatagatttgaaaattatttaagaggtagcaataaagatggatttttgtgatagactgatttccttccctttctgtcttctttcataagagaatgtcattttaggggctgggagatcatcatgttatcatgtaaaaaacaataatcagctgtctggcagagaggagaggccatacaatacaattctggccaatgacatttaattggattgagcaattactcaaaaacggagcaaactcagctttattttcctccttttttttctttgttagccttgttgctattttttgcttttttagccttgttatttttttctttttagcctttctgctttttttctctccttttttctgcctgaaatatggatataatgttagagatggagcacctatcttgtaaccataagaaggccacaaagaatagggtaaaaaaaatttgaagaactaaactctgaaatctttgagccagcaaccacctacctctcaaactctagttaagggaggtaaacaaaacttataaaatatctagtttgtgggagggagttctaaacacagacactttgactaacattagcctctacacacttttaatacctaaagaattcaaaacaaaaatatacaaacaagaaaacctttattctatctaaagggataacattttgaaacaattcaatatttgcttaatgtctatgaacagaaattaagatatttctttatttgaaaaactaaaatttactttctttgatgttgaaatatttgttaaacatattataaataaattaactcttatctttggcatttgttatatccattcttcatggtactctaagagggactataataaatagcatttcgttttccagtgaataaaaatatacactaaatcttacctaaaaacagtcttgactttggaaatgcctttgtgtcatgttatttacagataactcagtaagcaagcttgtgctggcagaattggagacactgttatgttgccaggaattcttgctatgatacatccataggaagcttgggctttggtccaagaaactacagctggaaaagtcatcccctacctttccagagaattactaagaaactactctatcctgtaggttgtccattttccacagctacccgtagcaagaatattctcttggcatttattcctctacactgtgttctatcagcatttttccaagctcccaagcctgaaaggtacctgctgggatggctctacacaaattgtatgagtttctccttaggcattcagaggaaatcccaccagatgtcaaaggtgtccgatatcacagcactctaagaagtagctatggcaagagacataaggtcacacaaactgagaagtgaaatggcaaaattataaattcttgttataaacacactgtcatacgaagtgagaaattgcagttgcattaagctgatggataatctggcaacaagcaaacagatacttattttctcttcaatctaaactgtgcaactgtcccttcctgacttacatgccaatcttttcaaatacttcatctttaaattactattattagtaaagtacaagagagcagccagtatcatttctcctgaggctacctctggaagaaaactgctaaataaaaagaagatttaaatgtttttcacttggcatttttattgaccatccaaagggtatatcactagcagatgcgtatatacagccctagtggaatccacaactgaaaatgcacagtaaagatttcagaaagcaacaagacagactcacttctcagtaagattacagatgtatgattactgatactctttgaaaactttaaaaaatacttattaatcatgcacattcatatttcctagtattgtttccaaatattcctagcatatactgtaaatagtttttctttcctggaatttaacattaacattaccttttaaatttgttaacaaatttgcttttatcagagctttcaagaattttcttcccctagaggatgtcaaaaattatcatttctaaatttagaagggtaatgggagagatacaactccttatcgaagcacttatataatttgacaaaagttcagtcagaacaacaaatacaatttggaagttccaagttctaactatagataactatatttcttcgaataaagatgtagtgggaggcttttagtaaagccggtcttggccacacctgctttccttctgcaaagggaatgtgaggtcataatctctgtcattaaactcccatgaagtcagacaacattcgctgtaattaatttctgtgagaacaatggggcattaaatgaggagttcacaggcattaactctgaagaagttctgaggcttggtaataacattggaggaaagattttatatggaaacctaaaaaagcacttactaatataccaaataatatattaataaaatacatatattttgcattaaccacccctcatttaagggattctaccaggcaatgttaagacaattgaggcagcctgattttgtacttgaggccccagagcacacttttggattaaaacctaacttgtcactaaatagtagcacaaaagaaagaataatcatgatcctggacctcttattattagatatacccccctgcctccccaacttctctgatcatgcaggaatttcaggaaagacatgagagatatgacgtattgtccaaatttgctagaggcttggagatctagcctgtgaaccagagacagagccttccaggcacattccaaggcttggccttacacatagggactggtctgatgtcagaggagaacaagaacttcaaggaatttctagtcctccaaatgagttacactatattgggacagcaatgagataagagctgggatgaaaagaatttgacagagcaagagtagatgcatgatacaataggttacaaggaagaaaagatccgtgttcaatggttaagtcaatgggggcaggaatttggtttttgttgttcaacactacatacccagtttcaggcccataacaagagaaatgaatgaatgggagagtgagtgaggctatttgatcctttctctttgtttctttaatctagtatttcccaatgtatggaatgcttcaactagtaatctgggacatcattttaggtggtaatggtacattaaacactctaaatcaggtagagacaaagtgtttccccttttaatttcctagtatcaaggagaaaaatttcagtttggtactagtaggcctttaacatctttctattcttgtttaaacaggagacatgttctcagggactgagctccaggtaactttatttagttaaaactatatacagtcatttgtcacttaacaataaggatacattctgagaaatgcattgtgggtgattttgttgttttatgaacatcatggaatgtacttacacaaattgagatggaatagcctactatacgcctaggctggatggtatagcctgttgctctgaggctaccaacctacacagtaagttaccgtactgaatactataggcaaatttaacacaatggtaaccatttgtgtatctaaacatatctaaacatagaaaaggttctgtaaaatatagtattataatcttctggaaccactattgtatatgcatttcatcactgaccagaatgtcattatgcaatgcatgactgtacttcatctggtttttcatcctattcatttttatagttaccatctattttgggaaaaaatgatttttctaatttgggctagtaatgtaaaaatttccttttaaaggccaggcgcagtggctcacgcctgtaatcccagcactttaggaggccaaggcgggtggatcatgcggtcaggagatcgagaccatcctggctaatacggtgaaaccccgtctctactaaaaaatacaaaaaattagccgggcatggtggtgggcacctgtagtcccagctactcaggaggctgaggcaggagaatggcgtgaacctgggaggcggagcttgcagtgagccaagatcgcgtcactgcactccagcctgggcgacagagtgagactccatctcaaaaaaaaaaaaaaaaaatccttttaaaataatttatttaaaacacaaaatttagttgacttaaaagaaaaacattaggtaaataataaagtcatgtgtatctatgaggctaatcagatgatgatactcaaatgaattaaatttggcaagctgcattctaatcgccctggactccctacggtctttaggtctccactgctacgacaacaataaagatctaaagcagctgttcagctttgggtggaccacacagagccatccccaggagacacagcaacctgagacaacagtcagtcaaacaaatgtaaacataatcttcagtgtcctggtgagcaacttaaatgcaaatgcaaaaactccatttcccaaaatctgccatcaattttatattcttatagagaaagatgcctgtaactgtcccttcatttgactccccactattaagctcatttagaaataaatactaagctactaaggtaatgaattcatggtaagaagaaagagaaatgataaatttaaaagccaaaaatcaatgagaagttctgttaggtcctacaaattcttttggatgatcataattttaattctgttacaggcaaatggtagctctcacactaaattcagcaacagcttgcaatatgtaaattaggagcccaaagttcttgaactaacttgcaaaggtagtattagttgctaatagatgacatttaatttctgactttcagaactcaagattaaaataagggctaaattagagctgaggttccttaagcggctgctaatagcctatgtcattgaagagttactaaaaatactgattaagtacatgagagatttttttgtgtgtgtttaaccaagcacaacttgattttcatagtacaatatttaaaaataaaataacaaaataaaatctgtacattaagtcatcaacctggatcctcattttcttcttccttttttttttttttacaaagaattccttagtccgctggcctctacaagcatgtacaaacactgacggaatcataatctaaaaggaagagagacactatcagaatttttttcattcttaataattcattttacctgaatcttttgtttctccttcttcctctaattttgttggcttttagccaattcacaataattaagactttgatgttgaggccaagagggaactggcaaaaagtaaaactcattcatcaatgtaactcagtaattctcacctctcatattatgacatagccaccagaagctactgcaacaacttccttaatagctcagaacaacaagaatacctaataacatacatgcttcaaatccagagtcatggcaatatttttttctattttaaataagtcatgctaatgttgaaatgctaactgtgaaattctttacctcacatgggtgccattgtttaatacagtaactcctacaaatatactttgagcttcctgtaaagtgacatgtaaataaagcattattgccataacatctcccttaatgatttagaaaaggcagtaaatagcaagctgatggaatcacagatggtactaaattgagacgtgttgcaaacatcagtaaaggcagaaaaaattacgcaaaaaggacctaaagtgcttaaaataagaccaaaacatttctaacattatgggaaaaagaaaatgacttttttaaagagtgtccgaaatatgctgtccagcatagatgctacaaccaacaggtaaaaaacatgccagccagaattgttttcatttctttgaaacaaactaacatgccaatgtgctctgaatagggattggtagtcacataaatataatacttacaataaacagtaaagaaaaaccactgtgatttcattaaaaagtgccaatgaaaagttcagtttggtatgtctgtaacttcgaaagaacacagagttccatttaggaagagtattccaagtaaacctgtttcatcctaagcattttcataagcctaaatttgcctcccacttgggcagagccatctgtctgggcaggttttgcacagggaccgaaacagaaagaaggcatcttataggggcttgtgcttggggttgcaggtggctttgagtttgtcctctacttcccatggtgacaaatggggcacatgagatatgtggttataaatacagtctgtaatggtagtgacagaataaagcagactgacatcaccactaccatgcttctctcttttatgctctaacctgtaccttttgcaaaatttagcctcatgtttaatatcaaaacattttaatgtcaaaacgtatgtattctctcttggctcccactatacctgttggttgtttcatctgttgaggtgacagacaatagttgctgaatgtaaggtcttgatgaatccagcatgggttttctcttttttcaggagccaggctcattcacccgttcttacccaaccaaattctctaatcactgaagtccaacacatgaaatcttactggaaaacagtctttcaatgctgttgtggacctgagaacataccgtcaaactttattatcctgaggaatttatttacacagaaaattgttttacaagtgatcaaaaagaaaaacacttttatgtatctgtcagagtaaccctagaccctaaaaatgggtctagatggagtaactgaaaataaactgattaaatactatcatttatttctctttcaaacaaataaaaagactggaggtaatcagcccaggtctgggatggcaccccatgaggtcaggcacccaggttccatctacctggttgctttgccatcctcagcacgcagcttccacctagcagtccctgatggctgcctgccttcttctctccacactgcagtccattggctagaacctagtcacatggctatgcctagctgcaagccaactagaaaacaaagtctttattccaggaatccatgtgcccaggtaaaaattagggattctgttatatctatactgaattaaaaaagagagactagatactggaggacaattagcagtctctgcttcaattaagaatcatattttaatagtcaaagcttgctaattttaaagattctttcagcatttatccttggttaacaaaatacacattgatacctaattgtttattcaacacagtttacttgagtttgatatctgaacaaaatttcctaatttttccttcaacttttaaagaattctgcttcatggttttacagtttgtttcctgtaaggatgtcatttctgctatcacaaaatgtaaaacatttatgaaattataaaaagtaaactttaagactttccctttttctatgcaggccttacttttttaaagatagaattttaggaccagttaaaattatcactttagtaaggaatattttaaacattttagtcacataaacagttttatgtatatctgttcacattttaaaagcacataattaatatacatagactgtgcttcatatatattgaaagaaatttattgtaaagaattggatcacttgaccatagaggctggcaagtccagagtctgcagtgtgagccagcaggctggaaacccatgagagacgatggtgtggatgaagtctgaaggcagtcctttggagatttctcccttgctgagggcatcttttcattctattcagtccttcaactgattggatgaggcccaccctcattatggaggagaatccacttacttacttatttactcatcagcttaaatgttcatctcatccaaaaacccaaaacaccctccaagttgacatataaaattaattatggctgggtgtggtggctcacgtctataatcccaacattttgggaggccatggtgagtggatcacttgagcccaggagtttgagaccagcctgagcaacatggcaaaaccccatctctacaaaaaatacaaaaattagccaggcatggtggtgcatgcctgtagtcccagctactcaggaggctgagtagggagaatcacctgaaccgggaagtcgaggctgcagtgagccacgatctcaccactgcactctagcgtgggcatcagagtgagattctgtctcaaaaacataaataaataaaataaaataaaataaaacaaaataaaatcatcgtcacacccctctttaagggggagtggaccaggtacattttgcttaacaaatggctcatggtcattataattgttaaccaggaacattaattaattgtgttaatcattattatttaattactaacaataactccacaagtctcttttgtatatttcttgaaactggaaaaattatggcaataatagaaaatctaaatttggaaaaaaataactagcggactcaaagggaaggaacaccaaacactgcaacattcagaagggattttccttgggtctaacagagaggattacagttccctcttcaatgttaacttgagcctcagtctaaaagttacttctgaagtctttaagctgtgacctgaattgtccctacaactgtttatctgtgtgttttttaagaaggtcataccaaacatttatgatcagctcaaatagaaacattttctgtttttctagactattttcatagtaaacaatgaggctatttgaaaaacatttctaagaaatgtacttaaataacaggaaaccccatgccaactttgggaaatacagtacaaataggggaaactccaatccctagcaacaatggaaatgcaatggctctggtggtgtcaactgccataaagggcatgttacggaatttcactccacaatcacagtgggccctggaataactgagtactgggcaggcctgaagggaggtagccatcactgcctggaataaggtttctaggatatgcagcagcttcttatatacccacagagatgggaattagtcttctacacaccttcatctgttgggcctgataaaaccaaaagaaattccaagattcattcgtgccttgtcaatatctaaggggatatttacatttaatgttagcaaatattgcatagtactctaacacatcccaaagaatcagtccaccatccaatttctctgcatttaaacaactgtcatgaaactgactaagatagtcaacaatattttaggtgcacacagactgtctttttttttttttttttttgagacagggtttcactgtgtcccccaggctggaatgcagtggcatgatcacagctcactgcagccttgacctgcagggctcaaatgatcctcctacctcagccccctgagtagctggaagtataggaatgcaccaccacattcagctaattttattttatttttcatagaaatgtggtttcactatgttgcccaggctggtcttgaactcatgggctaaagcaatcttcctgcttcagtctcccaaagtgctggggattacaagcatgagccaccacacccagcctaggctgcctctttaacacccccaatcatttgttttcttcctgaacagctactcaattcaagtgttcaaagagcaaagtacaagtctttaacttatcaattgagaaattacttttttcagcctctctgccatgtataaatgacaacatgcaccagaacatgttcctgaagggtaataaagaacatattaagaggcttttgctggaaatagaatataaagtaaaacctaaagattaaaccaatcaaccacagagattttttttcttttagcttacaaaaataaatttctcatcatttctcagataagcatgcaaaaatagctcataggtgtctcataccagtagaataatgagctcttacatgttaatgtttcctctggattctccatggactcagcctactattaataatacctgacagcccacttactggctaccattttaaaagaatcttctaaaagcatggcagttaaaaaatcatttattcatgacctgacacaggtgtcagcagtataggcctcagagatgttagaataattcagctgatttccctcttaacattttcataataaattggacatctcccaactccagacagtaatggcttctgacccaggctataggaacatacaaggaactttacaataccagctccaaaagagattagatgctaacaaatatgcatacccttcccaaaccaggagcaaatgaataatgaaaataaagaatatatatccattgtcctatactattatgtaggccttaagattccaagaatggtcaatgtcccaagttcaagtgggaaagaacattttactcttccccttccactttacattccactgagaggttacagtgcttgctgctgccttcccgtctttcctcagggtttcatctctctcctttacatcttcttgctccgttctgggttttcctttgtgtctaaggacatttccctctccattccctcccacctagtctgtccccataccctcttctctccatctcccttcctccctcccttttgtttgactttagaagatattttaatgtaaatatgtatttcattaaaatgaggggagagagattccagaatcattagataatttgctcttaatttttttctgatgcatgacctgttttgtgaccctattccctaagagatggatgaaagtatatcatctctaattttattttttaaatttccacaggtgttgggggaacaagtggtatttggttacataagttctttcgcggtgacttgtgagattttggtgcacccatcaccactgaacccaatttgtagccttttattatccctcacccccttcccaccatttcctcccaagtccccaaagtccattttccctccctctttaccccacctctctgacctcgccataatctggacccaaggatatttattgttaatgtgtttgttcttgttttttgggggaaagcatgttgtatatatttaaatagagtattgtggctacgttaatttttttaattatttaattgaaagagaacctcctcttctgagttcgcctccctctgccttgaacatgtattttagtccactaagcaataccaaagaatacttaaatgagcaaaactaagtgagcaaaaatagtatgaagaatctctgtgtgacaggtgcaggatttttcattttcggagtaaatcttggtaagtggccacacatccactgccaatgctttctgtaattcttctcccagtcaactaagctctctgtcacaatttactgctctctcagaacacctttttttttttaacttgccaactatggagggctcctttctctattttccatgagaatattttgtttaagttcacagatgtgggatttttctctttttgaaaatatttactgttaagtaaaaatgcaactttttaaaggaagaaaatccaaatgttcaccaaaacctaactggcattaaaagaacagtcccattttaaactatgttgatatcaagatagaggtgaagcaaaaaaaaaaatttatttgaggttactttccacatgaggtcaagaaagaacccttcatttcctgaagcaattaacaaaacagctatgcaatatcagataaaggggagactacaaaatacaacgggattttaggcccctcaaaaagaaaagattacattccatacagagaggagatgctggatgaaaagctctcatccagacccctctcccagcctctgtcagcctcttagacaaatagactcaggcccattaagccttggaggccaccgaggcagaatttgatttatttatttagttttaagaaaaaataagaacctgacactttaaatcctgctacaactggtaaattcaagctcagaagatgtgattaggctatgtctcatgtgtcttctcagctctttttttctgccttattcccaatccccccgaaattaaagcagaacagacatcgtgactgtttaatcacaacaccttatagttatgtcctgaaagatcatggttaacattagtgaaagaaaagcttgggatgtgtgtagttgttctgctccagtataaatggaaagcttaaactatttttctagccctaatagaatcaatcatcacccatttcacgatgaaacccaagacaaagctcagaacctaaacagccttcagaattcagaaaagataaacgggagaaatgagagcagtcaaagagagatcagatttccatctgagacagacttggtattagctaaaaggcaactttataggaatcataggaatcataacaaatagtttataacatcttctagaatcagggcacatgtacaattgtctcagagtaatattatttcctttctagtgacaggctgtgtctacatagctttctgaagatgggggagcttaatggaaagatgttttacaatacatgtcatactacttttttatcactaggtcattaccttatattaacattatgaattaacaaattgttgcttaaaaaaaaggatgcaaagcatttatcaaactgtaaaaaatacaaagaaatataaagtatgtctctgccctctaaaagcttattatctagttgggtggaaagtttagtgtgcataaactaaaatagctcagaaaatgcaagcttgaagagctcagaagtcaggatcatgtttttatacattaaaatacttaaattatactatatatcagacactaggataagcacttttgcttataaaaaatgctattatagtagttcaaacaaaaggcaccaaaaaatggagagatttccaataagttgatcagagataacctcaggaataaaatgatgtttgagactttgaagaaaaggcaagatttaagagaattcaaagagaagatgcccttagttgaagaaatggcacatccaaaagaacaagaacaacaacaacaaaaaacaatgaatatttaggaattaactagttcagtttgtccagcacagggcatttgtaacaagctaaattttatacactctgaaatgaggttctggacatactgccaataccagatgggagtagagatgtaatttaagaatcaatcttatagaggaagaaagagagaaacgtaaaagttatccaaggggaaagataagagagtttgggccaaaaacttagaaaaacttccatgcagccaaaagagagagagagagagagagagcgagacaaatgagacagttccatggggtcaccagggaaggtttgtcaaaatatataaaattttagctgagtcttaaggagtgaggagaacccaaattagtagataatatggtttggatctgtgtctttctccaccaaatctcatgattgtaatccccaatgttggaggtagggcctggtgggaggtgattaaatcatggggcagatttctcataagtggtttagcaccatcctccttggtaccgtcgtcccgatagtgaacaagtccttgtgagatctggttggttaaaagtgtgtagcacctccccgcaactctctctcttgttcctgctttcaccatgtgaagtgcctgctccctcttcgccttctgctatgattatgtttcctgaggcctccccagaagccgagcagatgccagcctcatgcttcctgtacagcgtgaagaactgtgagccaattaagcctcttttgtttataaattacccagtctcaggtatttctttgtagcaatgcaagaatgaactaatatagtagagaagaaaacagagggtgtcatagatgagcacttgatatgctttaataaatgaaagccaaaaaacacaggaagcttggaggacaccaatagctgaccgaagccagaacaagcaattttacctaacactggcaagagatatttacaaggatacaatttggatgaggtgcagagatctgtgattcttactaaggagtctaggttttatccaaaaggcaatgtggagccactgaaaatttttcagcaatgaggtgacttgacagaatttcaggctaactgctgacctaaaacactaatgaactatatcccagatagtgaccccaactcgattagttttctactaaaatcttggacagtatatctacaatttctcctctaagataccccaaagcatttgcaagtactgccaccattcctttccttgggtcttattctgccttattgatgagagaaaagtttggttactcacgcctgtaatcccagcactttgggaggccggcagatcacaaggtcaggagtttgagaccagcctggccaacatggtgaaaccccatctctactaaaaatacaccacaggtgtggtggcgggcgcctgtaatctcagctactcaagaggctgaggcaggagaatcgcttcaacctgggaggcggaggttgcagtgagctgagattgcaccactgcactccagcctgggtgacagaatgagactccatctcaaaaaaaaaaaaaagattggttacacagtaagagggagatgaccactgatgcttaagagagattatgtgtcagagtgtttgagagcctgtgtctacatacttcttagcttagtgggaaaagtccctgggaaaagattttctttctcaagaggggactggaaaagtgatctcccacatatcttcttcctgctctcttcccacacctttattcatttctgtctacccctttactagtcaccatgcccccagcataatggagaagaaaaggaggcctccagaactaaggcacatgctcctcttaacagagaagatcttggaggcttgcagaatataataaagaggaaggtacctttctttagttaacaaactcttataaaccattttccatgtgacaggtaatgaaacatacactcacaaatacacacacatatacacatacatatatgtgtgtgtgtatatatatacacacacatatacacatacatatatgtgtgtgtgtatatatatacacacacgcacacaaaatatatatataatttaaccctcataacaatccaatgaaataggtcttactattaaccccgttttacagatgaggaaactggggcaatacaaagttaagtgacttgcgtaaggtatgtaagtttcggggctgatatgaaaccaggcaacctatcccagaattcccacttttaaccactgccttgtgctccatctttattctcattctgcttttggtccttaaaacatgacttctagtgagccctgtgggagggttggaaggaatggagatggaaaggacacaatatgggactctcaggctccctggccataggactagcaaaatctcactcttaacccagtttgcctgaggctgcaattttttgaatttttgcagtcagaccttggcaatgaccttgagcagcaggatataaataactcccacatgtttagcgttctgataatggaacactaggcatatatgggttttaatcggtatatccacaagaaatacattttctgaaaaacttaaacttcaatgaagtgaatttgacgtgaattgacactgacagctgtaagaacatccccacacaccttttttttaaactgaaattctatacttagttcgttcataatttcccattagcacatgctgaaaaaaacttcccatcgtttagatttttaatcttatgtggaaatgttgctcttaatagaaggaacatttcaaacagttcatggagaatgcaaatagaggtagaggatggaaatggctattgacattgctgttagagaagttttaccaatagcaagggacaatattgttttcagtaatcattttattgctttttgcatacagtgaacactgggacatttcctaaatgtcactgaaagactgaaaatttttaaataaaaataattcaaaaagtggagtaatgtagggccatttagtgcataaacagctctatacacttagaatatcttcacacatttatggtaataaagatgattttaatgatcatgaatattatgtataacacctaagtaactaatagcaatttgaagccaaatccactcataagaaaactgatggataaggatatatatatatatacacatatatagacttttgcttctcaacaaactggggtaacaggaatcagatttaccttcccacttgaaacaacaacagccacaaaaacaaaaacagaccaaatctatgatgtgaatctatagtttttaagacaatgacatcaggcaacaaaagacagtaatatccaaaaaataagaaatatacaaagtaggccctacatttgactcaatttactgccatgagtgattctataccacagcacaatgctgagtagctgtagcagagccagtggtaatatcagatggaagtacagatctacataaaggaatgaagagtaccagaaatgataactatactggtaaatagataagatcatgttcttattatttatatatctttcaaagatagttgtctaagcaaaaataaaaatatattgtggaattttcaacagagacataaataaaatgtataacaacagtattataaatgtcaagaagggaaaattggaagtatactattgtaaggttcttatattacacatgaagggatatagtacttgaaagtagactttgatgggatagctgtagagtataaaacctaaagcagtgttttcaaccttagttcttttgtcattttgagccagacaattctttgtcatggagagctgttaggtgcattgtaggagttttagtagcatccccagactctactcactagatgccagcagcatctccccagttgcaaaaattaaaaatgttctcagacattgccaaatgatccctggaggataaaaccactgccagataagaataactaaagtgatcactaaaaaaaaaaaaaaaaaaacagtcatagctaataaacaaagatgaaataattataccatcaaaaaatactaaattaattcaaaagaagacagatacaaaggaaaagggaaaggaagaagacacaggactaacataataaaacaaataggataatgatgataatagactttaactgaatcatatcaataataatattaaatataaatggcctaaatactctcaattaaaaggtagaaattgtcagattgggtaaaataaaaggtcccaattatatgttgcccacaagaaatgaaatttaatttttttttttttttttttgagacggagtctccctctgtcgcccaggctggaatgcagtggccccatcttggctcactgcaagctccgcctcccaggttcatgccgttctcctgcctcagcctccagagtagctgggactataggcgcttgccaccacacccagctaatttttttgtattttagtagagatggggtttcaccatgttggccaggatggtctcaaactcctgaccttgtgatccagccacctcagcctcccaagaaatttaaatttaaagacataatgtgttaaaataaaattatgaaaaaaagatgtatcatgctaatactaatcaaaagaaagctgaagtgcctatattaatattagacaaagtagactgcagaatagtgaatagtatgagggaaaatgaaagttatttcaaaataataatgtggccagtgtacctaaaggacattataatcctaaatatttatgagtctaacaacagagcttcaacagacatgaagcaaaacctcatagaattgtaaggagaaatacagaaaccacaattatagccagagatttcaacaactcttttccaataattggtagaataaatagacagaaatccagtaaaagtatagaaggcttgaacaacacaacctgacctgacatttgttgaacattatatccaacacttcttttcaagtgcacgcacaatatttaccaaaacagacaataccctgagccataaaacaaacgtcaatatatttaaagggatccatattgtacaaaagatactgtctaatcacaatggaactaaattagaaattaagaacaaaaagatctcttgaaactcctgaatatttagaaactaaatggcatacttctttttttttttttttctcgagacggagtcttgctctgtcacctaggctggagtgcagtggcacgatctcagctcactgcaaactctgcctcctgggttcatgccattcttctgcctcagcctcccaagtagctgggactacaggtgcccgccaccaggcccagctaatttttttgtatttttagtagagacggggtttcactgtgttagccaggatggtctcaacctcctgacctcgtgatccgcccgcctcggcctcccaaagtgctgggattacaggcgtgagccaccgcacctggccctaaatgacatacttctaaataaatcataagtcaaagaataaaacaatcagcattagaaaggattttaaactgaataaaaatgaaaacataaaaatttgagggatgccactcaagtagtgtttagagggaaatttatagcattaaatgtctataatagaaaagcaaaaggttctcaaatcccctcagctatcacatttgtaaatttaaaaaagaagagcaacttaaatccaacgtaagcagaaaaaaggaaacagcaaagagaagatgggaaattaataacacagaaaactgaaaaacagtggggaaagtcaatgaaaccaaaagctaggtttttgagactatcaataaaactgataaaccttgagccagaccaggcagatcagagaagaaaaaaaaaaaaagagagaagacacaaatttctaatgtcagagtaagagaggtgacttccaaggaaagaatatttttatatttttgcagttagggttttctgagcaaatacacttgaaacttttgtcaacaaacaaatcttgggagttaaagggtgattcaataacgagagaccatccagaaagatttacctcttcaaaggcatgtgcctacatttcaaagagggctgagacacagagccatagagatatttcagaggttgtaaacacaaagacttatcttccacctggagatatttctttatattccaaagggtaataacccagtaatctttccctttcctcccagggtgaatttgtttacattgagaagcttaaatttctgtctttcaggagtagaagagtcaagatttacataaatccctagattcgaatttttatccttcctcacctatatagttcagataccagtacaagttgggtgacttctggctctcatcctccaagaagagggaaagactgaggaaacgagaaccaacgcagttattgctgtgagtaataatagtctattcctactcctgaaacctcatgtctacttctgtgataacatgaataaacatagatatttaaaacttatccgtgacattattacacattctataaatattaaaaggagaataatggaataaaaatgacattctcaatcaaaattgacaacttagaagatatagacaaattccttaaaagatgcaaactcccaaagctgacttcaaaaataaatggataaactgaatagccttatagctagcaaataaattgaatttgcaaaaaaactgtcccacacaaaaaaattcaaggcccaaatagcttcactagtaaactctaccaacattaaagatgaaaaatattatttctacacaaactcttccaaaaaatttgaggaagaagaaatacatcccaactaattctatgaagccattatttccctgataaacaaagacattataagaaaactatagaccaatatagctcatgagcatagattcaaaatttaaaacaaaattttagcaatatataaacaatatataaaattaatattattatcaggcagtgttttcctcagaaatgccaggttcatttaacattaatttcaaaaatcaatgtaattcactatatcaacaaacacaaaaataaaatccacataataatttcaatagatgcagaaaaagcacttgacaaaaaatcagcatttattcctgataaaaactctcaccaaacaaataataaaaagaaactccctcaatttaataaaagacattataaaaaccagcagctaacatcataatgaagagagactaaatgcttttttcctaagattagcaaaagaaaaggacgtgcattcttatcacttctattcaatatttttctggaagtttaagccagcacagtaaggaaagaaaaagaaataaaaggcctctagattaaaaaggaagaagtagaaacactttctttctttctttccttactatgctggcttaaacttccagaaaaatgcacatcatgaatgtatacgcctgaacttaaaataaaagttagaaattttttttaaaaagtgtattgtgcaataataatgaaaatgtaactgtatcacattgtgataattattccatctgctcatttaataaatacctattgcttattcaccaaaaaaggaagaagtaaaactgtctttattcacagatgacataatcatctttgtggaaaatctgatgattctacaaaaatgctactaggtcagtgcagctcatgccttgatgtcaaccttgtaagagctggagtagagaacctagttgagcctccctgagctacttctgactacagtactgtgaaataatacatatctattgtttatgtcactaagtttaataattaattatggagatacagaaaactaataaacctactgaagcaacatttatggaaagtggtgcccaaggatctgtatgtttaacaagctcccaattaattctaaacacagtaaagtttaagactaactcaactggaagaacacggtcacaaaaatggaacagattgggacttctgaacttatagatctttcaaagcagaggaggccatgcccatttttacaattttaatacaattcttaactaattccttgctgatgatattctcttaacaacatgatgaagaaaatgctttaaggtaatttactgcatcttccaagctccaagcaaggatgaattatgtcctagtcaaaatctattcattctgtttttagaagatagggaatatatatgcacaagttcaataatgtgatccattgtacaataccactttcttgtctgcactttcttcctaaacgccattctaaattctctttagtgtaatttaacccagttttcttttcagatcctggaaaaaatagttaatagctggccatcttcctttatgtcttctcccttacttcccgtgaggactgtctagtagccatatgcttatccccaggaggtcaattgtgattggtccagatagaggttatatatagtctttgctgattacggtataaaaagtcaatatgcaatttagttctgaccaaaaatacctaagatgaagcctgttgggtgataatgggaacatcccacaaatagtagatatgggctgagttgtctactatttgtctccctccgaaaaatcacaaaaacatttataaaaatgcacataacacatccaggaacccaggataatcagaactgctggagtcatcctgtgaccatagagggagatttcactgaatcctgatgatggcagaagagaattatgaagagtgcctccgtccttgaagactctgttgagcagccaaactgaccctggaactgcctatttcaaaattcctcatgaagtaagctttaaaatggccttcttatttaagccatttttaggtgggtattctgatatttccctataattcttgtagtctaagccattttcatatcagttcacattcccagaaagttcccaggaatgcttggctatgtggcagtaacctccagtccctcttttcagcctattcttaagccagaaatcccccacatcctctctggattggcaaggtgagactctgccaggccatttgcagggtttccaaacatagccatggcatagacagtctggaggatgtagtgtgtgctactactcagccccttaaccttttcccagaaccagcaggcaccatgtctgagcctagactgaagctccccagaaacatccaggagagtggctgtgaaatattaggttggtgcaaaagtaaccattaaaagtaacggtttttgccattaaaaataacggagtaagtaatagaccactagggacatgcggtgggttggaactctggtaagacggacctcaaaccagtacattaagaactgcttcagttcctctaggcacgactgagataggaagccccatcctaaagctcctgggtggctacttgctgcctccctcaggaacctttgctagaagttatggctgctctttcacagcaagaaaaccagagttgaaagggagagaaagagtccatgttatttccctggcaaattgcagtggaacacaagagaggaaaataaatgctcactaactcctttgattcattaataaaacatgatgagaaaatgtataattataattcttgatatttctcttcgaaaattcattttcgtgatcccagcctctttttttgctttattctgtgaaacatctagtgggacttgtagagattggaatgggcaattggcaagctgcaagtagcctaagaaatagcatttaccttgggtaattcaccatgatccagagccttgtttttgactctgctaagacagagcctgattccttcagcatgccacacgagatgctgggccaatctgcaaaccataactgacatatggatctgaatattcacattgatatgaccagtacattctctgcagtagcaaatctatgaaaggccaactcataaaccaaatgtagcagaagcagcatgaaatcggaacaagggaaatttgttagtgattcaaaattttagaagaaacaaacatccatcgccatgtgagaaagtcacaagaattgacgttcccatgccggtctccttgggcagttcttaggccagcctctccacagtttctttctctgactctccgctacctgcaaggaggtttcagtctgagcagccatctgtctttggattggtatattattattaatcattaaatacgtgaatctttcagttagtttatagttaactcttaatcatataccaaatgtaatagaattgcgtttttgctacattctgggagaggcattctgatatttctatctctctgctttatgttgattttatacttttgcatgggggctaacactgtttccaacttttttcataacacctcattgttactcctaaacatcacaaaaaattacgcagatgccaaatcaatgtgtcactcatatcagagttcacttgctcagtccaggatccaggaccagcctcagagaggttggaccacaggcacacatagctcattcaggaaaagcagaactgccgtcacaacctttataaccgaacatgcagcaggaatcctggaacaatgcatgatcactagtcgcctgataccaagcctcatattcttccaattagtccttaaaattattctcattctcataccaactacattaatcatacaattcctggatgactacagacccctaagccctcactattccaccaccttccacactgccaccagcatacatacacaagcacaccgcgtatatgcagcacatctaactcagcacaagccttgctcggtataatctcaattcccttgtattctctggggagagatgaatggcatcctttttgatttcagtatacatgtagctatgacaaatttccatctttcagggaatttacaaaagctttttggctatcatgcatctaactgtaccacccaaaacagattttctcaaaaaggggagaaaaaacttggtctcacatctcactgttacacaaacgtaacatttggtctcgtagaagaaacattaaaaaggccattgagccctccagtggcaaaattctgaaaatgttatgatgcacatctaagcaccctggagaaatctcctgaagacgcgcagaaacagaataggcagtcttaaatcagtttaggctttgggggttttcaagttcctaaactttctatgaccacaattagcccaaattatgacagtgatcattgtccgagcactcaattttctggaaaaatctcttccaggtaatgccttaatggaaaagccctctcaaatttatttctgtgctttaaggtttatttattttgacagctgtagattttaataaagagtttaattaaagatgttgccaccagacatatctgatgagtctagttctggggatgaattataagacttgtgaaaatcaaacaaaacagaaacaggagtcattcctagaggtctgtaattgaagactaaatgtcttaattcagaggctacctggcttgggttaaagatgttcaatgactttgctaattattttctcttgatataggtattttccagtattaagttacagaaactcctgggtacatgtttactactctcttctttgcttttctaatttctaaaggactgagagggtggaaagaggtgagggtcacttgcttttgatagttgattaggacagatgatctctcttcctatgaggctcttcattttattataccactgtatctctctcctcacactttttctaacattttcttcttcacatttttaatttttttattatgtcaaattgaagatttcttacatatgttattacacatttttatccaatttttcctcctcatgaaattttgagtcataaagttttctatatgggttaacgattctacaaaggttggaaatatactatgatctcatctgtattattattctttgcattggcatttaaacttttataatatatatttatttacatacaaatttcataatttttataactgtatatgtattgaaaacatataatgttcttcatatagttaactagcgaaatcagtatctcttaatgtttgtacaatttgcctatttctatttaattttttggaattcaacatttgacataaaaataacataaggctattttcattttaggttatatctacaatgcttacctgcatttaaaagctgatattcagatactgaccttaagtttgagaatcatgccttgcacacataagagatgtagtagtatagattagatatgatgctaacctggtgttcacacgcaagttcagggatggcagaaacaaagtgaaggtgggcatttgctcttgagctttcaaaggctgagaacttctcaaggtttgggtggagcagtgaggccaaggctgaacttcaatccatccctaagcccttgacagtaatttctggtctgcttctgttcccctcactgcactatggaccttttgagggtagatgctttaccttatttgtctaggatagtgtttgacaaatagtgaatattcaacagacttttaaaaatattcagcaaacatatctatcaaatcagtgcaggcttatttttgtgagatctttgttaggtgtgtataggctggcaggtttaaaacttggtcatgtacactgaagtcttagcagtgtgccattttaggtttaatctaaacattcctctacctttagaatctcttatcttccttttattatccacattcttttcatacttacagcttaaattctgactagttaaatcctcgtatttccttttttgttgtcttctctctctctctccctctctctctccacccacctcttttcttcattttaattgagagagactacatattagaaaatatcctagtaggatattttatactataaaattatttaccatcttttattctaaaccaaccagagattctaattttggggggtactttgttttaaattcatttatttttatgaaaccttattgagcacatactatataataaggtattgctctaggtacagttataactattgaaatctagctttattaggaaaagaaacttttaattagccaaatatcttctctattattatccttcatattcagtaaaccctatccatgtgggaaatgtgcatccaaaacattgacatcagtctttccacacaagtcaagatctttctcacatctcagtatggcagctgctttgcaggacaatgtcatatttgtaactcaacttatggtctctaaaatgaggataatgccattatttttagaacattaagaagtctgcataggaagataactgtacaactcatttcctttaaaccatagcagcttgaaaaacacatagacttggagattcctctgaattcacaagagccagaagttttaaactacacctagagcctcatcctgctaaagcttagccaatattttagtgggggaaagcatctcaaagaccacattattcttacattaggctgttagcaatttcataacatttataccatatttctatttgctcaaagttctccctcagaacatagtgctcctgcaaacttctgaagtaattttccccaattaaattcctaagaaaattgaaatccttcaaattttagtagctgtaaaactccatttacactggcattacagtctatttctacctggcagcaacattcatcaaacacctacatgctactgtatagaaatgagtcacttccccttctgggggagatttaaagcacaattccgcaaagcaaaatagtctgaaaagctagaaagttacatgctttccaaaaaaggaaacactgaaccacagtctctcactgagtgaaaataggcaaagaaaataaaaatataaaatgagtataaagtttaatgaacgtcaacacctttatgaatcaaaacgcctatgcaaaggcttagtgagaaaaaaagtcctcagagaaatgcttatcatcatttcattcaaatgaagtggtcctccttattcatttaaaactaacaaccttgtagctatttttaactaagaaatgaatagatttatcttctaaccaacaaaaactagattgatttatctagtttgttacatttttctttaccttttttcccttttgtgtttcctacttatttctggcgagggattactaaaaagagagaaataaaaatacaaagtggaaaactattatccaaactcagtcatttggaaatttgagattctgaaaattttctaatggttggcatctttttaaaggtcactttttgaacaagagccctcaaatacaaaattgtgagatgcaataagagaatattctattggaagtaataataaattttatatttctggccttatttgtaataacataaaagtagaaacagcccaaaggtccattaacaggtgaatgcataaacaaattgaagtatatctgtacgttggaatactactcagcaagaaaaaagaatgaactattaaatgccatgaataaatcttaaaattattacactgagtgataaaaatccaaacttcctaataaaaaggacgtatactttttcatctcacttatataaaattctaggaattgaaaattaaatctaggtgacataagtcagatcagtggtagcctagggaaagggatgaaggcagagagagattaaaggggagcacaaggaaattttctagagccatcaaaatgtttgttatcttgatgtggtgatgattttacatggatgtacacgtcacaattcattaagctgtgtacttttaacatgtgaaattgtctgataattatgctgcaataaacctgtttttaaaaactatctgctcataaaatgccacccccataaaaagtcactaaaggtcctgtgaaaattagaacttccactatttaggacatgtgaatccataagcaagatgaatcccagcactaggagggacacagagacatgacatgaggaccctgacttcctcttaagactgtgatacaagggaaatttggctttgttagacatctgtctctgatgatgtgatcaggacaaactacgaaagtaacggataagtagaattcacagaaaattcccaatgataagaaaagatgagactgatttaaaatagaaaaaaagagggaaatataaaattggaaaaatataagttttcagacccagaacaatagatggcatacatctgtggttttagaaagaaggagaacaaatgaggtgagtccagttagaagaagtgatatttgggctgagacttaaagaggagaaagaggtagacatgtgaggaaaaagagggacgttcagcactctgaaaagagtcatcacggaacctggggaaccacagcatgaatggagcatagagtctgaggaagtagtgttgagaaataagataggtaggagccagaccacaaagggtctaatatgtcattacagggatgttagactttgtcctgagagcaatgaggaatcagtgacattttaagaaagcaggagaaaagaaaattctggctctagttggagaacacgttagataagacaaaactggagagagagacaccattttagtaatccactcgagatgacagggactgaaaaccaaggttgcttctgaataaaaaggtgaacgagtccaagagatattaaaaaggtaagatgggaagaatttggtgatggattggaagtggcaagcagggaaagttaagactaagttaaataaagagatgaatgaataaagaatgagaactaaacaagatggccagctttctgtcttgggcaaccaagacaatggtgataccatttactgtaagaggaaacacagagagtattcgaagacgattctccactggtgcctcgcctttcacatattgacactaactggatgccggtgttctagaaaatcatctctaggatgtttatacagtgcaaccttaaaagacagagagagtatctccctacagagtagagagaagatatttttaacgtacagtctcctaaggataatgcctccctttattaaatgtaataggttgcttccaagatggctgaataggaatacaaaagtagaaacagctcaaaggtccattaacaggtgaatgcatgaacaaactgaagtataaatgtacatctgtatatcggtctatagctcccagcaagatcgacgcagatgacaggtgatttctgcatttccaactgaggtacctggttcatctcattgggactggttggacagtgggtgcagcccacggaggatgagccaaagcagggcggggcatcacctcacccgggaagcacaaggggtggggggatttccctttcctagccaagggaagccgtgacagactgtacctggagaaatggtacactactgaccaaatactgctcttttcccatggtcttagcaaccggcagaccaggagataccctcctatgcctggcttggcaggtcctatgcccacagagctttgctcactgctagcgcaacagtctgcgatcaatctgtgacactgcagcttgacgggaggagggacatctgccattgctgaggcttaagtagctcacagtgtaaaccaagctgctgggaagcatgaactgggtggagcacaccgcagctcagcaaggcctactggctctatagattccacctctgggggcagggcatagcagaacaaaaggcagcagacagcttctgcagatgtaaacgtccccatctgacagctctgaagagagcagaggttctctcagcatggcgtttgagctccaagaacggtcagactgcctcctcaagtgtcgcctgactgggaaacccctcccagtaggggctgacagacacctcaaacaggcaggtgcccctctgggatgaagcttccagaggaaggatcaggcagcaatattagctgttctgcagcctccacctgtgatacccaggcaaacagggtctggagtggacctccagcaaactccaatagacctacagctgaggggtctgttagaaggaaaactaacaaacagaaaggaatagcatcaacaaaaaggacatccacaccaaaaccccatctgtaggtcaccaacatcaacatcaaagaccaaaggtagataaaaccacaaagatggagagaaaccagaccagaaaagctgaacattccaaaaaacagagcacctcttctcctccaaaggatcacagctcctcgccagcaagggaacaaagctggatggagaatgactttgacaagttgacagaagtaggcttcagaaggtccatactaagaaacttctccgagctaaaggcgcatgttctaacccatcgcaaggaaactaaaaaccttgaaaaaagttagacaaatggctaactagaataaacagtgtagagaagaccttaaatgacctgatggagctgaaaaccacagcacgagaactttgtgatgcatgcacaagtttcaatagccaatttgatcaagtggaagaaaggatatcagtgactgaagatcaaattaatgaaataaagcatgaagacaagattagaaaaaaaaaaagagtgaaaagaaatgaacaaagcctccaagaaatatgagactatgtgaaaagaccaaatctacatttgattggtgtaccggaaagtgacagggagaatggaaccaagctagaaaacgctcttcaggatactatccaggagaacttccctaacctagcaaggcaggccaacattcaaattcaggaaatacagaaaacaccacaaagatactcctggagaagagcaaccccaagacacataattgtcaaattcaccaaggttgaaatgaaggaaaaaatgttaagcgcagccagagagaaaagtcgggttacccacaaagggaagcccatcagactaacagcggatctctcggcagaaaccctacaagccagaagagtgggagccaatatgcaacattcttaaagaaaagaattttcaacccagaatctcataaccagccaaactaagcttcctaagtgaaggagaaataaaatcctttacagacaagaaatgctgagagattttgtcaacaccaggcctgcattacaagagctcctgaaggaaacactaaatatggaaaggaataactagtaccagccactgcaaaaacatgccaaattgtaaagaccattgacgctatgaagaaactccatcaattaacaggcaaaataaccagctaacatcataatgacaggatcaaattcaaacataacaatgttaaccttaaatgtaaatggacgaaatgccccaattaaaagacataaactggtaaataggataaagagtcaggagacccatctcacatgcaaaggcacacataggctcaaaataaagggatggaggaagatataccaagcaaatggaaagcaaaaaaaaaataaaaagcaggggttgcaatcctaatctctgataaaactgactttaaatgaacaaagatcaaaagagacaaagaaggccactacataatggtaaagagatcaattcaacaagaagagctaactatcctaaatatatatgcacccaatacaggagcacccagattcataaagcaagtccttagagacctacaaagagacttagactcccacacaataataatggcagactttaacaccccactgtcaatattagacagatcatggtggataagctttttgaagtgctgctggattcaatttgccagtattttattgaggatttttgcatcaatgttcatcagggatattggcctaagattctctttttttgttgtgtctctaccaggctttggtatcagggtgatgacagcctcataaaatgagttagggaggattccctctttttctattgattgaaatagtttcagaagaaatggtaccagctcctctttgtacctctggtagaattcagctgtgaatccatttggtcctagactttttttggttggtaagctattaattattgcctcaatttcagatctgttattggtctattaagagattcaacttcttcctggttcagtcttgggagggtgttatgtgtcccggaatttattcctttcttctagattttctagtttatttgcatagaggtgtttatagtattctctgatggtagattgtatttctgtgggatcggtggtgatgtcccctgtatcattttttattgcatctatttgattcttctctcttttcttctttattagtcttgctagtggtctacctattttgtttatcttttcaaaaaaccagctcctggattcattgatttttcgaagggtttttttgtgtctctgtctccttcagttctgctctgatcttagttattccttgcttctgctagcttttgaatttgtttcttttgcttctctagttcttttaattgtgatgttagggtgtcgattttagatctttcctgctttctcttgtgggcatttagtgctataaattctcctctacatgctgctttaaatgggtcccagagattctggtacattgtgtctttgttctcattggtttcaaagaacatctttatttctgccttcattttgttatttacccagtagtcattcaggagcaggttgttcagtttccatgtagttgtgcgattttgagtgagtctcttaatcctgagttctaatttgattgcactgtggtgtgagagacagtttgttgtgatttctattcttttacatttgctgaggagtgttttacttccaattatgtggtcaattttagaataagtgtgatgtggtactgagaagaatgtatgatctgttgatttggggtatagagttctgtagatatctattaggtatgcttggtgcagagctgagttcaagtcctggatatccttgttaaccttctgtctcgttcaacaaaattcaacagctaaaaactctcaataaactaggttttgatggaacatatctcaaaataataagagctatttatgacaaaactacagccaatattatactgaatgggcaaaagctggaagcattccctttgaaaactggcacaagacaaggatgccctttctcaccactcctattcaacatagtattggaagttctggccagggcaatcaggcaagagaaagaaataaagggtattcgactaggaaaagaggaagtcaaattgtctctgtttgcagatgacataatcatatatttagaaaaccccatcgtctcagcccaaaatctccttaagctgataagcaacttcagcaaagtctcaggatacaaaatcaatgtgcaaaaatcacaagcattcctatacaccaataatagacagagagccaaatcatgagtgaactcctattcacaattactacaaagagaataaaatacctaggaatccaagttacacaggatgtgaaggatctctttaaggagaactacaaaccactgctcaatgaaataaaagaggacacaagcaaatggaggaacattccatgctcatggataggaagaatcaatatcgtaaaaatggccagaatgcccaaggtaatttatagattcaatgctatccccaacaagctacctctgactttcttcacagaattggaaaaaactactttaaaattcagatggaaccaaaaaagagcccacataaccaagacaatcctaagcaaaaagaacaaagctggaggcatcacgctacctgacttcaaactatactacaaggctacagtaaccaaaacaggatggtatggtaccaaaacagatatatagaccaatggaacagaacagaggcctcagaaataacatctacaaccatctaagctttgacaaatctgacaaaaacaagcaatggaggaaggattccctgtttaataaatggtgctgggaaaactggctaaccataggtagaaagctgaaactggaccccttccttacaccgtatacaaaaattaactcaagatggattaaagacttaaatgtaagacctaacaccataaaaaccctagaagaaaacctaggcaataccattcaggacataggcatgagtaaagacttcatgactaaaataccaaaagcaatggcaacaaaagccaaaatagacaaatgggatctaattaaactaaagagcttctgaacagcaaaagaaactatcatcagagtgaacaggcaacctacagaatgggagaaaatctttgcaatctacccatctgacaaagggctaatattcagaatctacaaagaacttaaacaaatttacaattaaaaaaaaccccatcagaaagtgggtgaaagatatgaacagatacttctcaaaagaagacatttatgtggccaaaaaacatatgaaaaaatgctcatcatcactggtcatcagagaaatgcaaatcaaaaccaaaatgagataccatctcacgccagttagaatggcgatcattaaaaattcaggaagcaacagatgatggagaggatgtggagaaataggaacgcttttcactgtcggtgggagtgtaaattagttcaaccattgtggaagacagtgtggcaattcctcaaggatctagaactggaaataccatttgacccagcgatcacattactgggtatatacccaaaggattataactcatgctactataaagactcttgcacacgtatgtttactgtgacactattcacaatagcaaagactcggaatgatcccatatgtccatcagtgatagactggattaagaaaatgtggcacatatacatcatgggatactatgcagccataaaaaaggatgagttcatatcctttgcagggacatggatgaagctagaaaccatcaatctaagcaaactatcacaaggacagaaaagcaagcaccgcatgctctcactcatacgtgggagttgaacaacaagaacacatggacacagggcggggaacatcacacaccagggcctgtgggagagtgggggcctgggagagggatagcattaagagaaatacctaatgtaaatgacgagttgatgggtacagcaaaccaacatggcacatgtttacctaagtaacaaacctgcacgttgtgcacatgtaccctagaacttaaaagtataataaaaaaataataaaataaaaataatgaagataagcaaagggcacatttatttgtagcctgttacgaaatgttgagttccctaagctcaagttttctgtgtgattcagatgtacagcaactacctgagccactctgcatcgccccatgggacttgggggctgagggaatgaacatgaatgtgaagctcatattattgttatgtcaggaatcataaagtcctttgtttctaatccaggaacttcgtgttgtgtgtcagtatacatgaaactgtggtggctaactggttagcttgcaagtataataacatttcagacccttcacagtttttgacagaggagaggagacggtttttatgtttagtataatgcaaagaaaataagatttagagtcaggctgatataagtttgaattttggtccatccacatcctagctgggcaactgtaagccagttatttaacttttggatttctttttctcctctataaaaatgaatacaatgatataaaaatggaagcgttcttgagtacaatttaaacagaataacttatgtgaaatgcctagaacaatacttagcacaaaaatgctttcctctttaatgatattttcattttctactttttccttatagctttattattatatttttaaagtgcataaatatgtcttaacactactaataggtaggcttacatggaaaatgctgaatctcctcagtatgtagtatatgagctactcaacaaatatctgttaaatcagtcaaggactagttgataagaatagcttattttattcactcactaattcatgcatccttattgagatgttattatgctccaggcactgaactaggaagcagagatttagcaaagaaagcccatgctctcatgaaacttacttttggtaaacacagatttagcaaacacagacgagaatttcggacagagacaagtgctataaaacagcagaagcaagaaagagcatgggcggctggtgaggtttaggagaagcttctatgagaaggggttactttatctcccacctggcaatagaaaggggccagcaatcaaatatctgaaataagcactttgcaagcagaagggaaagcaagcgcaaagaccctgaagtgagaacaagcttgaccattagaggaacctaaagaatgtcagtatgcctacttctcatagaaggtgggagggacgagaatagtcaagaggttcaggttgaagaaggaggcagaggccagatcatgcaggtactcatagcatggtacagatttggatttcatgagtcattatgaaagaatgaaagaaattaagaaagaattactcactagaagagtaatttttttaaacacgtttctcaaatttagggaaagtaactccataaatacatgtggatggtggagtttaagttgagatttcttatcttgctaggggattccctatattaatattatttatgtttgctcttgaaatatccctgggaatacactgtagttgagaaggaaccagaatttaaaacaagcaaaatttctcttatagtaataataagtaatatatggtgcttactattatagtacctggctctgttctaagcagtttatgtatatttagtcatccaatcctcacaataattctataaacaacagtaataatagatactattatccacaattaatagataaggaaactgaggtgcaaagagattcagaaacttaccccaaatcacatatctagtaagtgttgagtgcatataattaaaaacaaaatcttttcccaacccagaaaacttctccacaaaggtagaagagaaagaatacaattttattattgaataagcatcaaagcagaatatcatacatcacaggcaatctgctaagagattacaaagacagaaagaaatcgtaccctttttatatttatatagccaagcagatacaacccatacatacatgttctcaagataaacaatgactagtcctcaaggaaggggacttgacagcaccatttgtcatgcacagttcatcctaaattagcctggtattggggtgaccatgtgtgttactaattggctttacccaaaggaaaaattaacttctcctatctctatgacagaaggtaatttaggaactaagaatcccccactgaagttaggctgctaccctcccacaaaaactggaagataggggcactatcttccttgattgcatttcaaaaagatggttctctgttctctgatccttgagaaagacattcctgggtcacagaactcaccagagccttatttagtttttaaaaagatgtatatagatttcaaagagataaagaatgtgcaattacaagttttctaaagtaaatgctctaagaaaagggaaggggtagaaatcttttcccttatttttaagaagaagaattaagcctccaatttttaatttgtatttgcccttaaataagtagcagagctgagatctgaacctacacagtctgggtctaggatctactttcacactttaacatttctatttcttaggcgctccattcctatttttccctatttttttatttcttaggcactcattcctattttccctaattttcctattaagaatgtgtagagtcatattcttaattctcattttttctgtctttgctttgacaaaaaaagtatctagatagggcagagcaagctaaaatcatatatatttggccccatactgtcaatggaactgatttaattcccaaggattaagcactgtagcaaatatagctcaattctaacaataatttggcaatttgcccatctaatttgacattaacaacctaggtagactgacaaacaagatcattttatatacattccagatgatgattttctaaaactgtctgttgccatgagccaatgctgtctaacataaatcattcaaggaaagagtacttggtatgttggaaaatgaaaatcagcaactaatacaataagtacagcagtttacatggccactagcagaatatgcaagaggataaaatggaggtgagaacacataaggtggattttcttagttttatgtgcatgaaaattaccatcctttttagaaacaaaacttcatttctaaaatatcccttttattcataaccgtacaagaatttttacccacatactctgtaagaacactgccagggggtgggacaaccatctacctggtataatttgatctctgattacaagaagtttaataattccattcaaaacaagaagaaggtatataacacatgacatacactagtttacatttaatagaaaattaattaagacacaattaaacaatgtactgcaaacacagtacacacagctatattatgtacccccttatattaaccttccacagtgaatctttgtctttgctctttcccgatgaaaatgtatgaaaagagtgactaaagagagacccaaattgacttacaaccatttataactaaagaacacatctttagaataaaataaatgtataggtacatatgtaagtaagaaaacaataaatatgcaaatccaaactaatataaaaagacaagattattaaagtttctgataagatgtttcatttcattacatatgaatcctagtggtgggaacgagtgtgggaggaaaggagattgcaagtttgctatttttgaaagcataatccagtattctagtagcagacagtatactgctcttgtatatttgcaattttcaggattggtaaatatactgtagcctgggtcacaaaatacctattatcatattaactttttattcagccagcaataaattcctagattttaaaaactcaagtcaagcaacttttatcactgctaaaaatttagtcaataaaaatgtcaatatcttagtcttccaaaccacaaactacagaagcattcattcataatgaactaacagagcttcaaatacttcccttccctcttgtatttctctcaaacttatacttaagatctggaatttttcactgacaatgttttcttctataagctatctataaagtcagccagaaacaatgattatattgatagggataattaaaacagctaacatttgttacggctaacatttgagggctccctacgtaccaaccactggttctaagggttttacatgcatttaattttcacagtacccctatgagacaattagtgtaattatcccaatttccagatgagaaaactcaggaacaccgtgaataaataccctatctaactaaggtcacacagcaataatgtgatgaagcaaaattctagcccaggcagcctggctccagaacctacatcttacccacaagcttaacagttaataaggcattccgtcttttctaatgatctacatatgatgcctttcagtacttaatctcaaaattaacattgaccctcttctatatgtcattatgttgagccatatgggagctataatgaaatgtagacatggatactatgttaagatgctcaaaataaaaggttaagacaataaaataaatatttcaaaaactactacacatattaattgccaagttaatcctctctatgtactatatagatatactagaggcagaagagagaacttccggatgtaaaaacctgttctgacacttccactcaccagttctgtgatttggccaagacaattagattctggaagcattgttatactaatttgtataacaattacaaattctattgatatcactcttttcaaattgtgggatacaacccattagtgagtcatgaaatcaataaaatgagtcaaaaccagcaacttaatttttttaaatggaatggaaaatatgcatcattagtaaatttctcaaaactttcagggttttcttgtacatgtgtgtatgtatatgtgtgtacagaatctgatataaaatgtatgccttcatttgagtatggtcataaaaatctgaaagccactgttctattccaaattgataagggttgcaggagtttatgggttagaagctcttgtttctgtaaagatctttccaaagatgaacaaacatctttctctatatgcaaactcctcaagagaagcaaccctgtcttactaatatttgtatacccagcactagcacagtgcctgacacacagcctgttttcaataaatgatggataaatggaaatagacagtttaagaaattagaatttacctacattttaaagaattgatagaatttggatactttaaagaagagagtagcaggcatttttagaattcattctttcatttcccaatcatatactacagcagggaaggaaaccaaacaaaaagctttctacttagaacaagaagagaataaactgagtggcactgcaaagccaggatggtacccctggtgcactgatcccacacctacccctatgaataggcgaaggttacaggtactgaagcctgaagctggaaagatacactgagaacaactgagaagggctgatgttaacccttttcttagaaaatataaaatcagaagatggtgattcatatttcttattttaaacaggaatatagagaacaaaagtcagatattacttgagaagcagagtgtcagagaaccaggaattaaagacataagctaatccccaatcaagcatctaactgcatcctgcctttaaggattgggccccagaacttctcagggattcttccagagaaatcagtaagtcactgccctacctaagcaatcagtgcatcccagcactgcaccaggcagaagttcggtcataaacaagcacaacggaagtgttcgtctgtagctcgaggcattcatgcctaaacagaagcatcgaatgctctcaaataaagggctaaatatcatacttcatgaaaccgttggtaaaaatccacaccaagttctgccatgtggaatttaaacggggagaaccctagcttgatgcatcttacattatttcctcctttgctttcttccttgatttactctttggtatttctcagaaaagaaagaaaagaagaatgagagcaaaggagcaaagaagggagaaaatgaaaaaaagaataaggaaggaaaataaatggaggtttcttttctggcaggtattaagaaagtatcctgaggaggtgctggaagaaagttttcccctacctggaagcggggcatggcccactccctgtgctgcttggcagatgtctgctggcaaacccaatccttgtcctctccttacccatctcagactgctggctctctgtcagcaagcatccaactgggctcagccatgggaggagagctggaagggaaaagtcagagtacttggtacctacttcattgggtgaccctgacagctggactcctaactacattgcatcctctgttcctccagcctaggggtaatagtgacgtcctgctgttgccaaaccctgggttgcctagaagtccctttttggcttcttagctcttccacagctgtgtaaccaattccctatattatattctctctgttttaaatattcagaattatgtttttctgactagactctgcctaataaacttttcagaaatgcagctaaaaaaaagagagagaggaaagagacctggcttagttgcagggagtaagagaaagcaagacgaggtggtaaagcaggatccaaaaccaagtaggacattttagggcacatttacatgttgacttttcatcaggatgcccttcactttattgttttaactttaatgacactgtcttgttccaatgtattttatgtttacattctattcatgacatgggatttttacttagagtagtgacagagtttttctgaaatacatatttaactttttttaaatcaaattagagaaactattaaataaatcttgtgcaggtgttggacacatgtggccaaaactatgaatggctggaatttaggaaactctggcataagaaataataatgttcttacataatttcaatactggtaaggacatttaacaatattgtggtttgccaggaaatttccatcattacattactgtcctcaaactctcctcaaaacagatgttgacaacagtttctggctcaattccttgtgtatatgatgagagcttgtgggatacaggcacttcatgagtactaaaaatatagtctgaggagatgagtaaaattaacaagatctgtctcattttactttttaaaaaataattttaatgttaaaaaaaccacttgctattttttctaattataaggtatataattcatgatctagaatttgaagacaacagaaaactatttttaaaaaatcccacaactctttgataaatgaatgcctacattgtttttttaatctttcaatgaacttatattcatagattatatacacatacaattcatatcacagtttgtccaattttgtgtttttaaaacctcagattataatgaacattgttctatgccattaaaaatgcttcccaatagcaatgagcacacttagtgcccagatcttgtcatctaatactattctcaagtaaaagaaaacaggaatccttgaaaacatggctatttctaagactagagcaggaaatatataagaagagcctggacagtctaatgggaccgtaaagaaggaaggaagtgctccagaaaacatacacacacacacacacacacacacacacacacacagacgggagtatatcaaaggggcactgggtcgaaatgaaagcgttcccaatggcctgtgccagaacaatctgagcaaagaaataaatacagtaatattgggttataatccaaagtataaaataaatatccattagtccacactgatataaatatatgattgaataaataatgggagagaatagacaactctgtgctgaattccaaataatttatgtaaatactcaaccttcaaagaggtgggacttaacttttcaccttttaaggataagctgtgcacagtgacttccctccaaagactacagtatggaaaatggggtggggtgagggcaggtaaagtgctgaataactttacagtggagaaacctgacaaatgctacctcagccaagcaatcaaggtcaacattaacagtgataagtcatgttgatagtacgtaccctcaatgtgatgtgatgagaatggcactttccctttggggtttcctcccaaaaacccatgactccagtctaatcgtgagaaaaacatcagataaatcccaactgagaaacattctacaaaatatctgaccagtactcctcaaacctatcaaggtcatcaaaaacaagaaaagtttgagaaactgtcacagccaacaggagcttaaggagacataactaaatgtaatatagtatcttagataggatactgaaacattaggtaaaaactaacgagaccttaataaagtatggactttaagttaataataatgaatccatgttggttcgttaattgtaacaaatgtactacagtcatgtaagctactaataacaggggaaactaggtacaaagtacatgggaactctctgccctatatttgcgatttttctttaaatataaaactgttctaaataaaagttcattaaaaatgcttatcaaaatattttgaaaacatttttaaatgatgctcaattggtagtgataccttgtcaacaattaacccctgaggaaatctctgtcccaacagaggctacatacagaactgggggattcagatccactggtacaggtagcttaaatcctggagccaaaatatgggtagagtgtccatcagatcccgcccctaaggctggtgaccttgtagctatgggagcagaaaatgaaggcatagtacaatttcctaaagattaaaaacaatatcatgttctcctccatttttgttattacagggaataacctatctactaatgatcagcacctgtgtctttgtgtctgaggccaagaataaattcatcaactgggtagccactacagcagaagaagccaaccacagtcaatgttgactacgcgtcaagttgccagaggccacaggaaatggactaccttggagaatcatccctgccaacatttctgaatggctatgtcactaccaatggggccacaacaacaacacttgcaacccaacctggacttcctttgaccaaaggaagaaatctatctttgcccatgtcagacgaaaggtgaacaccacccttgccttgtgtcaaaagctttggtatcctgcccaatatgcctggaacagtatatattgggaaactgctgtgctggtggccagattccatatagccccccactttgtctggaggccttaaatggctcctctaatgttactctggggtttctcctgccagacaactgtcaacacatactcgaaatcaacaacattgtccccagtgaaacacaatctctttcctgctttaataacaccttaatacactataattacaaaaaaaccattgctgtaccctggtgggggccctgtgggtatgcagatcctacgagtggcaatacctgcccccacattggatggggagatgcacttagaggtggccattaattccattcaccatccaggataatattcccctccccagtaatctggactccctggtggtggtaccctatcacagtattctcccctgccaccggtacaatcctgcttcagcaaaaaattaaaatattaagcttacatgtagaagaagctcttaatgatagtagcattggacttatgttgctatcaaatgaatttgctcagctgtgtactgttgtgttacaaaatcgaatggcattagatatgcttaccgcagcccaaggaggggtttgtgcctgactgcatactgaatgttatgtgtatatccctgataattctcacaatatcactctccttgaaaagccatggtgggtgtggtttttattaattgtgcttttaattctcctgtgcttatcctgtatctgtaatctgtatcaactatgccttccccatgtatctgtaagggtatttttctacaattgagtatcaaattgaggctgagtgtggaggaaaagttaaatattaaatttgaactcaattgaacatgacacaaacgatggtcaccaagtcccagaacaggttgtgtgagccccttgaggcgctcatccagtgctgattcggagaaatctctatttcagtctattcctatatgttagttatttaaaaaaatagacaattgcaaaaacaagttgacctttttgtgttccttgagcccagtcacaaagggttctcgtgactggaaatcatgccaaacaactcattacaaaaagagttagggttccagactgcgcaaaagcatcgtgagacctctcctcgtctgtgcatggatgagtggccgactctggagcccaggctattgattcctggtctgatggtgaatcctccatagtctggtgagtgtaaatatatatatgtatacacatatatgtatatgtgtgtgtatatatatatcttttcccttctccccttcccattgcaatttgcttttgcttatatcatttgcttattatatcatttgcttattatatctatattgccatatacttgggataaaggctgtctacccttaaaggtgctgtgtgtgtgtcttttcttctcccctcgcacgtttccagcacagaacaaatgaccaggtaataacccagagggtttactgtaattacttaagcattcctctattattggaaatgtgagcaatttccaatttttctattaaaagtaatggagtgataaacaattctaaatatatttttggttcaattctttgattacaaccttgcaatagattgctggaagttcattctacctttttaaaaagttaaaataacacatattatgcacagtagctaacccaaagaagctgaagtcccattagactgtgaaacttttccgaggtagattctattcctctagatagtaaggaaaatatccgaaatttgttcccagccctattcattgatttctgcatccattcaataaatatctgagtaactgctatccatcagacaaataaactgttggaaagccatttaaccactttgagaccttgtactctgatccataataaacaccaaatggtcttcacagctgaagaccatttcctgatccttgcaatgaagcagtacatatatgaatagtatgcagtgggcgctttataataattttctgcagcacttgaatctcccggctacagtgtgattctgtagctgaaaaaaaagattcctcccacattagcatttggtgattttttgaaatgcttatttaaaaatctaatttcttttctgtaataaatgattttttgtagtacttgcaatctccatttaattttgttgcactctggtgccacctaacgctcatcttctctgggacatctgtgtttcttcatccttccataaatgttattttaagcctgggtgtaaccctaccagcaaaacttcccctgattgcttcaaaatgttcatctgtcaccaagcccttcaaaatttgttgccactgtttctatgacatctgattgtttcttcctaaaatttacagatctcttcaagaaattcaacaatgatgtcaatcagacggagttcttgtaaatgttctctgcaatggagatgtacatctagccaatttattgggggtggattgggctgccctgggagatacacccatgaggaagtaaggaatcaagattggacagaaggagaagttaacccacaatgtggtttcaaatgaggcctccttcagtcctacagggagctctggggctgggactgcagagtttccccacatagaggcaagagggctgggcctttatagccccccatcaaccagccactggccacttggagggacattactttgggagaggctgtgtcctgaggccaacggcaatgcctagtaggggcacagctgtgaagccatcacagtccatgtcccagcagccagagtatgggcccatctcgagatgatgggatctgggcagagacaggtcagccttcactaactctttgcctgttcatttaccttcatgagtcgagctgaaattaagggaatctaactcttgaaaatcaatcctacaatccacagacacatttttttgatcacaggatcacaggtgatttctaagagcacatagttcatttcaagcgtgaaatggctaaccaagccagcaccttctacccatggctccaagcacagtaactcccataaggtaaacactctgtaaacaccttaaaaggataccaaaagcatcattattcttaagcattacacccatttttaggaaatgtgaggaaatcagacataaaaataatataaaaggaccaataatgagataaagatgcccaaatcagttctcagaactaaaatctgagacaggactgcatggagggctgtgtgcttagaagattagaaatcaagttagaatatctctatttgagaaagtgattatctctatttaaccttgaaaaataaattccttgtaaacataattgtagcaatgtgggaaattctcagcaggattacaaagtagcttaatttaaaaacctaaaaactcaaaaaattgtggctaattagcccctcgagatattactttaacaaaatatcaaaactcttcaataaatattaaaaaaataaaaaataaagttcatttatgtcaaacaatgtcatctatccctaattattctatatactacattaaaaattaaaagcttttttcaatcagtagacaaatcatatatttgttattcaatttgatttcgcattatggggcatttactatgtgcaaagcatatatgaagcaaagggagtgactacaagtgactcctgcttagaccttccattttaagatgtgacagaaaaattgtgcaagtgtacgaaggctaagccttatgaaaacattatctatgcagtgcaagcagtctctggcttcctgaactggggaaggtccagagttcactaggaagctatgtttactggcttcatttgcccagagaagcaatgtcactaatgggagttggtttccagatgagacctcctaatgtacttctagcagctccagcccaagttctgagagcaagaaatcatgagggacaggacggtggcagaggagaacagggcagtttcccattcccttgccagacccagagccattcttcagccaagctatggatcaaagcaagtctgtagttagcatctcatgcctcccttcccatgcacctccattcaaagctccactagtttccagcctcttgtcacctcccccatactaagtcctgtggcacccatccaggcccaggttgctgccacaaattctacagattgagctaaatcactctcacccacgcccactgctcaaaatttacaatgttctatccagaaattagaaggcaagaacctagctgagttaattcatgctaaagtataaatggtcattcctgaaggctccaagagacaccagtataacttttaaagatacctgctgcctcaaaagtggagatgaacgactatcagaagtgatggagtggaggagaataaagaatgtgtattgagcattgccatgtgccaggaactttcattgtaccctcctaacagcaccatcaggttggtatgttattcccccagatttacagaaaagaaatgtgaggtttagagaggttaagacttactcaagctctggaagacagtctgcctccacctctcttccccatgggcaaagtcaaccagtccagtctccacccaggggcaggcaactctcctaggccattcttcccttgcactgtttcttctcttcctttgtattgaaaccacagatccccttaaaaaaccatcttcttgcaaagtgtgatgacagggacagtaaaagaagctgaggcagcaatgggtaaacactactaaagcatatttgtataatgaagctgcttgcaagtggagtgtggatcaggaactgcttatattctaggctctgaaaggaggaaaagaggatggtaagtggatttatcccttgagcgtcagtatctacctctctaaagtatgttttctaagttctttgctaaaattctaggacttcatcaatgtgatagcctttaggttaactcaggtgctgttatttgtaccatagctaactttaaaactagtcatctcattagcatggcttttcaaatactaaaatccattcaggaagaaaagcattaaaaacctagttgatatacactttaaaattccatactctatgctcgttttatattaaaaacacagaaaaacagtctccctctccaaggcagtgcttcagaccagcagctgagtccagcagctcatagatagattttctggatggctgattattcatcttccccactgctgcttattgaccaaaccccacgcgggcactggaaatatctgcctgcccacagcaatttgatttgcctttaaagacccacctctctcccactctcagcccacagtgtttggattgaatgcccctcacttctgggttccaaaagacacacatgacctgtccaaagcaccccctggccacagtggacagagtgagggtccaaatcactcccaatgtcactcactgccaagcatggtctttcccacaggcaggcacagctgtgaggaggatgtgtgcctagagatgctgacagccaccagtagagagtctgcctgagagagatgtccaaagcgaagcaattctgggagaaggaaagaaagaaaggtggcagggggtggtggggtaaagacagagacctgatgactgaggcctggatccagcctgctctgggtcttttcaggtgtgaccaatacactctcctttgaagcctaatccaggaagagttgagctcctgtatcttgcaatgaaaggctcatgaacagcccgtccctggtgcctgggctctactccatccatcctattagacatctccgttcctacccaccactcctcaaatgttcccagtatcatgtggggaactactgtgtgcctttttagctcccaagcatggcccagctggcaggacatgaggagtcagccccagcagcagctcagtctccttggccttctgtacaacaagcttcagtccaagaggtgttcacattccaccctcagctctacccagcttccttttcataggctgctgccccaagcagagaatcgggcttccaggcaaggagctataagttaggcctgtggttggcttattttaaaggaagcaatcgtttgtgcttccatttatcaaagcccagagtgcacaagcacagatccatatccttctgaatcatccaccacctctcaggtttgagaactgccctctaacaaagctctttcttcacggtgatttcagactgcaggcttctacatttcccagcacatttataagatggccatgaaatcaatgagaagaagtgaacagagagctgagagtacactactgctggtgcaaaccagaccaattgttcaagcagttgtcgcaaatgaggtcattaagcctctgtatttatctcccaagacacagggattcccatggttttatttacttaaaagtggaatgtctgtgctacctggtagtgacatttatcttttacatatatatgctacctccccatctaagagaaaaaatctctggagtgcaggagtattgggttcccagaatctagaacagattttcaattccttatgtgtgtaggcggcagtcagcaaatgttgacaactgaggaggataatcagagagagcttctattagatatctcagtctctggcaaaggaatctcgcttctgaaaggcccagacccaaagaagagtctcatataagaatgcataagaaggaaacagaaatcaacttctaggaaacagaaccccatattagcaagaaactccaaatttgggttcccctcacaccctggtctctttggtaaatgctgcaggctacagcttcctttttatttctgggcatatctagacctactgttaggaggccagtctacagatttttcctcctaaaaatcaatccaagtgccctgcaaggttctaggataaataaatatgcaggccatggttgaaatttcagagactcaagttttaacttttataatgctaatggagccatctaattttcataagaattgttactgagtcttccttttacccaagggtattaactgagggttctggagtccatggattgaaagtcatgagtttccttccttgaggaagaatgcacaattctggttttgtgtacatttctatggggaaaataccacaacctttgttagtttctgaaaagggtttatgatacccaaatagaacgagaattactgtttaaatctgtttactgtttgaatagtataatgtttacttggtcatgactccagtaaaatactacatgaagaacaacagaaagactacatcacatttttccataatagcagataaaagaatacataggttcttgataccctttagacttgggcatggcttctgtcatgaaaatttttactagatgctatttcctagtccagatggcagtaatggttggatgcttaaagcagtccatgttcatattggtcattgtagtagctggctggggaggtcaaagcagagattggcaaacctcagtcgggcagggcttggtacaatttctgatcactcatatttgctagatgtgctagaatccataccctgagcgttctcagaatagcaagtaggctggcttatgtcgccacttcaattttgattgtgtgacagactacagtctccatgaaatattttgacattgccttcttttccctcctataacattgtataacaaatgtaatggtgagctttaacacactttaacttttccttcttgcttgagaacattgctgcaaatctgtttcataaatatgaatattggctatacatggaaatataaaatttagattttatgtctgagaaaatatacaggaaaatatgaacaaattaaatcccctttaccatgctttagatctgttcaacggaaagtcttcctaattaacccatgattatgttaacaaacaatacacatttttaaatgtacacctccttatagaaccctctccaaagtttttcatttttttcccaccctaacttcaggaaagaagtttaaatctcctgaaaatgtatttttttataatttacagttgtaacatctggatcactgagctttatctaattttcatctctacctaggctcggaaatgtgctgtctaggagaaatctctcccctgagcactgataatgagacatcagattgcatttcttgccttcatttactttccaatagtactcaataaaaaagcaatgaaatggcatgtttttccagggggaaagacactttcatcctctaggtatttctatttttgtcgacatttttaaaatgtcatatcctaataaggaaaacatagctccaacctacttccctatctctttacaagacaactttgtgagtacaatgtggttccacacatagaagcaaaggaaagctattcccagaccaaggacatgaagtctcctgaagatggttcttcccttcaaggctgagcatctgggttctcaaaattgcttcagtccttgctaaagtccaaaatctccccaagatctgcaaggttctgcataatctggtccctgccactaatcccagacccatctcccccaacacacacacaccttccctcttaatcaccaaatccccactgcccaggcaatcttcctctaagtgcttcctgctgtggttccttctgcccagaactgtctgccacatccctgccttccctccaccctgaagaaatctgaccaactcctattagttattttcattcgatcctaaatgcttcttcagggaaacctgatctgatcctccctctctcaagattgggttgggacttcttatcatacaattcattcctacaattctctgtactcctctgattcagttatcacaattgtaattggtaacaatttgcatattttttaatgtaatggatgtttcttctataagatcgtaagctctatgtgagcaggaactgtcttattatcaaggtattaacaagatactatgtctaccacaacatagatatttcataaatatttgaggaagggagaaagagaaagatggttactaaaatcgttggtacttaattggaaggagatcttccagctacacatacatatttggggttggtttattatatagaacattttaactgaatattctccccattccaagacatctggaaaacagctacaagacaatactcatgagcagatgtaggggatcgatcaaggtggtgggagtaattataaagataaagttataggaaatagacacgaaccttcttggaaggccaggaggtttgcatagcttcagtaaaagatttggctgaaggcagctgaattctcttaaaagcttggggtatagatacacaggaatgtagaggagtttatctaaatagcttactcatgtggtcctaagaccaacaacctgtgatcatctgtgggcacatgactgctctctactagggaggtcggcaacgttaatcaccctttagtggtgtttactggagacctttgtcatttaatctgtcctaaataaatgtgaacttcaccagcttattggggccaaagctgcggactcagacagcagagccccttagctgcactgagaggcaaaatacctgtgtcagtgtatgtctttcatccatcgctgggtcagggtctgtgggttggacccggcaagcagacctagcagcttttcaatattgaagaaagccacctataacatagcagttagactcttgagttttggagccagttctgagctctgctgtttaccagctttgtgaccttgagaaatgtcctcattttttctaagcctccactgatttatctataaaatgaggctaagaattcccactgctttactgttgtcacaaagattaaatgaagtaatgtctgcaaatcaattaagacagcaactgacgtaagactaagatttccatgctggtattattattattaagaaacattagaagttgtgccaaattcagaagacattatctcacaccttgctttctccttgttaaaggaatataccccaaatggacatctttacaaaacaactagatgttcagaaaagaatttgttttcctgtccaaagatcataactcctagactaaatatggaatgtatagcattatttttcagaggagtttaacaacatgatttgaagtcatgatacatgtatagaactcacaagaagaaagatctgaaaatattcacttatgaggtctcaaaactgagcctgcaaataaacaaactaacccactctcattcactggaaacttttcttcaactaatggtggcaccttcctctagccttctctccaaaacaatggaaagacctatcagcaaggctggtgataagggacagtcagactcaatcacaaatcatgggtttgggtaccaagcatgtatttagcactggcgtggtgatgtggcctcactaatggtgaagcagtgggtagcctggaaattatggccttggtagcaatcagatgtctgtcaatatctagctttgccacttactaactatggacaaaaccaggactgccgaaaagttacttagcctctctaagaatttcccatacataaaatgcaactaacactatctctttgtcaaaactgctgtgaggtttaagtgagacaatgtacataatctataaatgtttctttgagatgctgtacatagaatgcctaagagatagatatatttcgtttatttcccctaaaactatgcctttcaggggacaagaaagcagaatgacagaaataagatgaggctatagaatatagaaaatgaaaaattataggacttttaacgtataacatatgtctaataataatatcaataacaaaaataatgatggtgatttagtagggtgcctggtaaggaataatttttttttaagtagaactgtcatttaaaagttgctagttacttgggattatattttcctaaactgggttcctcaggcacaacctacttcaggcagcctattctgtagtgtttaaaggcacagactctggtgacatagacctgggtccatcatacagatgtataactttgggcaagtcagttaatctcctgtggttcagtttcctcatttgtaaaatgcagaagacatcaacctaagtgttgcagtaaataaatcagttaatatatatacaacacttagaatagtgccttatacataataaatgttacatatgtttagctattattaatattagttatgaagtgtcattttaaaatggcactgggtaagaagctccacatgttggttggcctcaggccagaggcgagatggcacaactgagcagagagaggccagctcagggtaggctggggaggaactcatcagcaagtcagacctcacctaatgcagctttagaagatagactgcgggccgggcatattgactcatgcctgtaatcccagtactttgggaggctgaggtgggtggatcacttgaggtcaggagttcgagaccaacctggccaacatggtgaaaccccatctttactaaaaatataaaaagtagccaggtgtgatggcaggcacctgtagttccagccacttgggagactgaggcaggagaatcgcttgaacccaggaggtggaggttgcagtgagccgagattgtgccactgcactctagcctgggcgacagagcaagactctctctctcaaaaaaaaaatgcacattgtgatttaacaaaagctaattcaaagacagggtagtaaagagcaagccctaccacaatagataacacaataaatattttcatgtacacgtatgcaaaaccagctcacacaacaaatttctggtaccaaatacaaatgaaattatctgaaactcacatcagatatatgctcctagaaaaagaatagattttaaaatatgaaatgggcatttgtaaatacaccattcaggatataatccagatataattaagaggatgaagaaagtaataaaatagtgtaagaaatgtttttcaaatagagccactgcgagacattagcatggcaacattaacagaaaataagacattacactaggcagccacccacgacataggaaggctctgctgtctcagatccatttgttcctaattcagttattcaccagctctcattttgaggtgatctcaaaaaatgagattcttgtgattatgagaatatatttttatgatcctaaaagtatttctcttcctcaaattagaaaaaaaaaatgaactatatcaatagagaaactcaccaaaatgcatccctattttttacctgtaaggatcattttgtgagagttaagtcaggccatgcttgaaaacactaatgattgatattagttattgtgacatctggggttgaaaggattaagggactaattcaatgagtgctcttccatggtggctgtaagtatgatacacacttacaggagaatgattattctactgaagaaaaggcattccttatatattatagattttacatatgttataattaattacaaaacattatatatatttttatatatggcactccatatatagctatatagatagatagatagatataaaatattttaaattcaaagtaagattattcatttcctttgtagaacacataccatagtggtttactaaccacaaatgccgtcttccaattgttttataattttctcttttgctgaactagttttcgtacatctattcagactagataaactaaagccatttgtaaaaattatttcatcatttaaatgtaatactattactttattactattaaagtggatgattaaatttagaagtggaagaatattggcattcttctggttatctttgactccagtgaaaaatatgatatgcatgaaagagtaggcatgtgcataaaccatgcctggtaaaggtatcctctctgtgtgtgcatacgtgtgtataaggcatatgtcaaagcaacacaaaatgtcacaaacatcataggagtcaattatttaaattttgccatgaaaaaatatattataaaagctactaataaaaaaattgcctgattgtcctttctttattttccctgctcactttccaagcaaagaaagaaaactgacattatagctgaaaggtaagccagagggcagagaaggaagagccaagacctaaataatataccacctggatagtcccacaacacagttccataggctaatcatccaagttatccaagtcatccaagttatacaaagttatccaagtcatccaagttatacaaagatcctctcatggcaaattccatattgttcttcctcattcctggcaaatgctcagcaggaaaaagttgaagtcaaggaaagtgaaaatgtcagataaataataggtataaatacactctaaaatgctctatcttccttgaaaagcccagaggcagagagcatgaggcctgagaaattctgccaactgcaggtctccctcccatctctgactattcccttctgtcttattctgctgattcccacagagaaagcaaggaaatcacaaaagcaccagcctgagtgtagaacattttgctgcatagtgggccaaagggagcagagagaggctgaggggatgacccaaatggtcaagttttttttccacttgaaatgctattgagttgaactggtgtgtatacaaggtcagacaggactgggcaaagtcacaatcacagccaaaccccattactgttcctcacctgaagctttctttagaagtagaggaaaacaaagaagaaaagagaaggtgcagcccacgtctgctctcagctagagacagcgtggtccctgctgatttgggggtttggccccacagggcgcaggaggcaactgttctgtggtgacccagagcttgtctctaaaatctcttccaatcccaaaagatattttggaaaacatctggagtcccagtgtggtgtggtgaaaatactattcaaaagcaactatcaaaatagcgaaattattcttgtatcaaaatcaattttacatttcaatataagaacaggaatggatagaatatcatttctattttgagagaatatctattggcagttttcagaaatggaccatttgccatgcacagatcagccttgcacaggagagaggatgcatattttaacatgtttgcagcacactaccttgattaagaatgaaaatttccaacagagcccttggatcccaacctccttcattataactatttctccaaatatgtagccaccctggcatcaagcaccataaagattcagctaacaggtatatgtaggaggttttcttgttttgcctgattttttaaactaacatgttttatttaccctttcttttgctctattaacactcactactttcagtgcctgacactgcacaaaaaagagaaccattttattctgaagaactcaaataacttcaagaataggagctattagagtacataggtgacaatctgacacttaggagcctggcaccctcagccattctgcagaaatgcaaacccaaaactcaacccctacccagggggaaaaaagatgtttcaataaaagcatctctgaacagaactaggaaaaatcaaaaacataagaaaaggggaaaatacgctgtgatgaactctttttactcccccttccctggacattcagccaatcccctgatcccgcaaatctttccatctttctgtcaccaaggtcagagcacagcccagctgcaagctctcactgagactactgtggcctccacatgttctcctgtttccacatcagcttcgccctcctaaggctcaggttgacccagtcactaccctgctcaattgcctccagggttggagagtacacgtctcagccctcatatctggccacaccttcactctcaccttcattctcactacccctctgcccacaccctagctttcagtcccgctactgacttcccattttttgcatacacaggacacttatttgcctttgtgcttaggcaacagtctttcaatatctccctatgtccaaatcctaatcacacttcaaaactaggaagtggccgccagacagaacaccctcaaactgttaccaccaagcctacagacctccctgcatccacgtccacactgtctccttccatctgcaatggaaaaggggtgcttcttctggctaaaggctaagggagacctccctcccatggcctgtgggacccaccccaacccatgtacttaggaaccttctcccatcaattatccccctttctcctttatctttgacctctccctctccataggctctgccccatcaactcactcaaggtatctccatttataaaaaccttcccatgaaccatttccaacactttctccttctccaattactgctttctttttttctttttttgagacgaagtcttgctctgtcgcccaggctggagtgcaggggtgtgatcttggctcactgcaaactctgcctcccgggttcatgccattctcctgcctcagactcctgagtagctgggactacaggcgcccaccaccatgcccggctaattttttgcatttttagtagagacggggtttcatcatgttagccaggatggtctcgatctcctgacctcgtgatccgcccgcctcggcctcccaaaggctactgttttgttttatcatctgtatagagccaaattgcttggccactctccctgtccccacctccacaatttccacatacccccgcaaccactgcagcctcaccttcatctcaccactcatttctcctggctggtgaactcatcccattagtttgtaaaatgtattgacgcctacatgtcatattgatgcttacatgtattgccccagacaacacatgcctagcacttgcccagcacttgggggaaggggaagtggggagaggagaaaccagatatgacctctctgagtcagaagttctaactgatagctaaattcatgccagagatatattttatttaacctatgatgcttttaaaaatatattatttatttgacaaaaattcaggaatctaaagacttcacacaaaaatctgggatttggcttctattaaagaatctagaagctctggcaacacggtttctttcccaggtgccagtattcagctgagaagcagctgctccttccagagggcaggggctccctggtccaccatggccccaccaaaccctcttggctccttgtctttactttggtggcccctgtgggcattggagtttggagtttgaaatccctgctttagatcagtgttatccaataaaaatacaagtatgagacacatatgtaattttacttgtaaaactaactttaatattatatttaatttaacctaatatatccaaaatgttatcccaacacgcaatcaatataaaaagtttaataatgggatatttcatattcttttctttgtacaagtcttcaaaattcagtgtgcatgtatgcattttacacttatagcccatctcaattctaactagccatgtttccaaagtcccatagcaaaatgcgggtagcagttgccacatggaacagcacatctctggatgctaaatggttgttacaagaatcagatcttgcaagcagagaaagtcgggatgagagagaatattaaggagaaagaagaaagctggcaggactaagaaagtgggtgtggatgttaaagaataggcatgtgagatgtttaaaaataggagggaaagggacaaggacacagagacaatgaaccatgctcagtgaaaaaatctgctctagtctagtcctccatgggagaaaaacgtcctttataagcaaatgcagttgatgggcaatgcagactttctggagggaggatttggggttttttaactaagctcagcattagacaggaggggtcaatgtaaatatcacttggccacttgtgtgaactccacttcacacacttggtatttaagaggcaacagaatgaaccaggctagtgaggacaggattcttggtcaatattgggattttttttttttttttttttttttttgatcgagtttcactcttgtcgcccaggctggaatgcagtggcgctatctcagctcattgcaacctctgcatcctgggttcaagcgattctcctgtctcagcctcccgactagctgggattataggtacctactcaacacccagctaatttttgtatttttagtagagatggggtttcaccatattggccaggctggtcttgaactcctgacctcaggtgatccgctgcctcggcctcccaaagtgctgggattacaggcgtgagccactgcgcccagccaatattgggattttaatctgagtcatggctggaagtaaagggaagataagagactttcttagataatgggcttgggatgcagaagaagtgctaggtacaaaaaacaggtcaggccgggcgcggtggctcacgcctgtaatcccagcactttgggaggcggctgaggcaggtggatcacaaggtcaggagactgagaccatcctggctaacatggtgaaaccccgtctccactaataacacaaaaaattagccgggcatggtggcgggcgcctgcagtctcagctactcgggaggctgaggcaggagaatggcgtgaacccaggaggcggagcttgcagtgagcccatatcgtgccactgcactccagcctgggccacagagggagactcggtctcaaaaaacaaacaaacaaacaaacaaacaaaaaacaggtcaaggagatgggtcaaggagaagtagcagtgaagaaggaagggaaggagagtatcttgagccaagatccaggcagaattcaagactcagaggcatagctaagtgaggatgtataggcaggaatcagaaatccagatgtgtgggtgcaatgtcagaggccagaaaggagacttgggtgcgaaaaatggatacccagagtcagagtccaataccaagaactacatccctgacccggagacctcagaagtaggatgtttttccatcctccatgggagcacaatatggcagccacttagtaggtaccacatcctcccctcaccaggctttaattctgcttcttgtctgcccaagaaccagaattaaagtctaggctggcaaaagccaagctaccagctggtggaagaggggaacatcaaatatatctgccaggcttaaaaggacttggaattgagaaggcaataatatcatttcacaaacataaagcgattttgaagcttttccagaggtcttatctctgaacagttctagcccacccattcatcccttcattcattcaggcaccatttattgagtagtcttcccctgaactgttttacaatgctgattcactaggtcaattgtactagggattgccaaattccactccagcagagctggcgaggcaagtgaaggtggttcaggcttaagcaaaataagttcagattgttaatgctgaaggggcctctctaaatgaacccagtgggattaggaggatacaaagatcctaagatgtccagaggtccacttgtctatatttgttgtaattttccaaattggctaggacccaagagaacaggaaataaggctggtataaaatatctcgaaaagacttcactgaagagaagaaaattgttctctcaagaaggcagtaagcaggacttttaaatctcattatattacaaatacagttttccatattgcaatacaatctcattatgttacaaatacagttttccatattgtagtatggaatattgtatttggaatacaatattccatactacagttaaatacaaatatttggagactttagggacattgcagcctgatattctgccagaaaaaaaaaaaaaagtttctaatggtaagaaactgctacatattagaggggaaaatgtatttggataaaatattgaattgttagggataaacttctcacctctgattcataaaaagcactgtgagttagaagaaaaggttgatggtgaagagcaaattaaaatggcacataaagttaatgatgtagaaaaaggctgtatcttcaatggtgccgacaaatcaaaatttacaaaaactgtaaaggctatttgttaagtgaacaaatgacttgagaaaaaggtgcctcttctttgattcaataattagctttacagaaaggtaagcatgtcataaacaggtatggtttatactctagttttataaaaacatgcacgtttatataaagcaagttctaggataatatctacttcgttcacattaaacaaacaaacaaacaaagcccagtatgcaaataatgaccctcagttatcaagaaatggtcttatttagaacgcttgacttactgaggcagggaaatatgtgatttttagtaagttttccggtagcaaaaagaaattaaagcaaagaactttctgtttcaaaaaattattttcaagccaggcatggtggctcatgcctgtaatcccaacaccttgggaggccgaggtgagcggatcacctgaggtcgggagttcgagacgagcctaaccaacatggagacaccccgtctctactaaaaatacaaaattagccaggcgtggtggcacatgcctgtaatccgagctactcgggaggctgaggtggaagaattgcttgaacctgggaagcagaggttgcggtgagccaagattgcaccattgcactccagcctgggcaacaagagcaaaactccgtctcaaaaaaaaaaaaaaaaattattttctgcttacctaatgcagatgcctgctacgatattataaatagatatagaccaagaagaaaaaatatatataacctaacttctaaatctgcagattttgtcaatgcttataaagttatgtggacatattatttatactccattaaccaggattggtaaatgatttaataagcattatgatcaaagaaatcatattacatgtttcctttaggtatcaaaaatatattattaacctttattttgtgaaatcattttcaaacaatgaggtaaaagaaagaggaagaagaatgttctatttttaaatgaatctgctaatcccatttttttccctcaacataacatattcattcttcatgataatgcatacatacttgctaaaaataatgtaagattttttccattgctgtataaaattgtaatgtcaccagtactaccttgatttgtcacaggctactttttccaacactgcaagtaacatagttcatatcctaaattaaataagaaggaatggcaaagcaccctgttaatttttttcaaccacacacttatttgtaatagcagcaattgcaaaacttcagtatactttccaataataataacaagcacagcagcaattgctaatgtttattgaacacttgctatagtttaagccaatctctcataacatctacatgctaacacttccatttatgcaagattcatagttcaactcaaatttgccagacacttattatagcaagtaaaggttaaagggaaatatgtcatcctctttactccctttctttggaataagctgatgatccgagcacttttcatgaatgctatcacacatcaaactccactttccaccctgctccaaaatgtcctaaggtctcatctaccctctctcactttcaatatgaaaggggtcatttctgaagctagaccagtataaagctactaacattgttttaggggcttgattttgatattattagttttcttcagtgactttagtcgtttataataggaattatgtttttaaatctgtgccttctttaagatggagttgtgttctttgaagtcatagtaaaaacatctgaaaaattgcaaaaatcaacccaagtcatgtttttgaatcattttgttaaatatgtgctttatttaaaagctcagctaataaagcaagatacacttcatgtatagacttaattgtagaaaattttttttccactttttatcagggcttacagatatgttgtaggaatcttatcccaatgaatagattcctcttgctatgtttcaaaacatatctaacatacactgaataattttcctacttcttttcaaaaatagtttatcctttgtgaaagcaattttaacaaaatttatttaaagagaaaaaaataaaagttcagcattcataaacactacatgcttttgttaaaatactaaaaaaatgcaacgtattcattcctcactctttatcttaaaatactgactttctgatcctagcaaaacataattttagtaactcgtcaaggcagaatacataaaattggcatatttttgatatgcacacaaattgagaaagcatcttttccaactgtgttgcagaaaatgaaatgcatctggtatgacaatatggcccaacacgtgaaccagaatcagtgggaagaaagggatatttttttttccttattctcaaaacagaacatttgaaataatgcacatcccccaacagcaaggcattattaagtctgttaatacatattgcaaagtgtgtttggctaatgaaaacacaatagcaagaggaccagcaggcacatggaaagtagcctggtttgttcacttttactcatatatacccgtgactcccaaatctctttccccagccgtccaaactgatttttttttctttgcttttgcttaacatctccacccactgtcagagtacgtgcacatatgttgttggggcctcgtgctgggctagggaggtggagacgtggagagtgtgttggagaacatggcttatgccaggatcaagcagagaacaagagaaaaaattaaacaatttgcctatttttgcaatacattttatttctgccttgaaagaaaagtcttttcatctaggcactctaaagatgtattaaatacttttattgtgtttctttcttgagtactgtgcttgtgaactgtgaataaagctgaaatctgtatgtgctacacacccctttcccatgcccaggtcactttggagatgagctgctgagagagtaaggaaagatctctgagatattcaggaagcttggaagagtgctgcaaagctaagctgactcctgagcagctgaatgcatccccttccaggttccaattccattttttcctctttcccattcagaggtgagccgggctcctttgagatgggcagagaggtatttccaggactgagaaatcctctcttttacattggtcagagagtgctgctgaaagccattatttgtgactcattacagagaaatctctccacttcccagagaacaaggccccatgagcagcagacgctagggaccaaaaatggtatctctttctgggactgtgtctggcattgggcaagtccctcagggtttaccattctgtctgcctatatcccatctttctcttattttttgaaagatattttagcttttctatttctcttatgtctatgtcgaaatgctgattctctataatgaaaagcttcttcagagttatagatcatgataatctcattcgtgacaaaatatacatgcaacaatacatcacagaacaaattacaaattatgatagctaatccatcatagaattgattgtatatagggatggggaaaaatctccagaatatacgtaaacttgcaaggctctactttcatcagtaagaccaaagacatctaaaaaatggaacaagttctaaaagttgtcaaaggtagctgtcataatggaaaaagattctggagactgacttgagtacaaaacttctctctgtcatctactaactacgtgaccctggaaagcttatttaacctatgtgagcattggtttacgaatctgtaaagtgacaatcacataggtctgctgtgagggttaaactatgtagggctataaaatgcccagcatatggtgaaggcatacataatagtgttaatttagtatcttctccagaataagtttatatcttttgtatacaaaattcatacttacatagtagtgttttttttaataaagattgacagtttctgaaaactttttggcaaaaaggaacataaaaaattcagagttatctatttttgctttaaaaatatcttggttcagtgaactgtaatgtgatttaataagttaacattcacggtaatatgatatatacctttcaaaataattcaattattatttgttattctattatccttgatagtgaaagaaaaaaatgtaaagttccccaactctgaaattcttctacattaggattatgtacacgctcaaaaataaatacttcctttaatatatagtattcatctatactgaatttaaaacattcttctaaaaccatttatcactttacttttaaaaccaaaaacaggggctctatccagttcactttcaagatgacaggaaaggtaaatgtatttggtctttttgtcactattatctctacttactcttctgagaataaaatatttttctggatcatcaggtgtttgcttacagcaagcaattttgtttattaaggaacaaaacatattcatattctgctttactttctggagctacactaagaaatcagtccatgaactataaaaacttccaactgaaagcctatctattcccgtatcttacccttcaaacacagcctgtttctttgtagctgagcttttaatctactaataactaaagttttaatgcaagtgtcattcatctaacataattaatcagagtcaaaacaatgagaaagtgtaagtaaactaagatatattgggagaaaaatgttctttaggtctctggcagagtgaaacttccaaaatattttctagaattaaaatgatttgataaacatttacaaaaagagcagtgcctcttcgaaattgagggagtaaaaacggctattcagtgggacacattgtgggtcccacacataaaatttctagtaaaagcacttttacaaaccttgactcttgtctgagcaatcaacatgatgtataaagcagcatactttaaaaagcaagtgcttcaggtgactattaaaacttcacaaggctcataggaacatatgcatttgactaactgggaggagacgctcccgctgtccacttgaagggcggtgatccaattgcagcaggaaggtttaagaaaggggtgccggatgcaggcctgagatgatgctttccctggcacaggacctcacatgtgccataatttacctctccacgtttctatttcttcccgccagccatttgcttccaatggtacctctccacaccaccacacgtgatcgtaattgtttttaagttattgggttagttttttcttttgccaagatgagatttggctggacatctcctttcaggagaactctaaaaagtacccactttaggtctaacttttcattgactactcagaaagcttctggtgacaggtatcatttctaccaaaagtaaagtccgggtgcaagtcagaactctttcatctttgctaaaccagagcgagatgttttctttcgactgtttcatctacttagaattaatagcatttctcctcccgcctcccggcccccgccccccgctccccgggtggtgaacgcctgaagagggaggcgtggtcccgcgcaccttgtctccggccgcgccaccggcactcacctggctgctgccgtgctcctcgcccgtctccggggcccgagactccgcgggactccgcgccggctctgcgggaggaggcggcggctccagcagctgctccaggcaggcggtgcccggcagagaggagctcttctggtggcacaagtgcgccccggggccctgacgccgtgcaccctcatctcgggcgcggtcccccctcgggggaggctggggcgaggaggacagggaggatgaggcggaggaagaggaaggagctgagtcgggggagcgtccgccaggaggcgtccctcccgctgctcccgaggccgccgcgggcccctttacggcggggagcaaatgctcgcggatccggcggcgtagcgtggacccctgctcggctctgccggcgccgccgggctccaggggctccggcgacgagcagcacaggttgggctgcgaggaggagaagactcggtccagcacttgcttccgcttcttgaagccgctccacctgctgcctgcaccactccccctggccggtgcattccctgtgcccaccgggggtggcggggagggcgacggggtgtccgcagtgcggcgctctggacccccagcgcgcccgcccccgccgcccttgctcctgcccacccccagctgcaggttcttccagagccgggcctggaaggaggaggacgccgccggcggctctggctcgcccgccgcggcagcccggggctccatcctccaccccctgctcctcctctcccctcctcctcctcctcctcctcctgcttctcctccctcttcggctgcacctcctcccgggtccccgcggcgctggcggtggcggcggcggcggcggcgggcgcagcagcagaaaccgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccccaggccgcgccctggctccctcttctctctgaccgagctcgggaagctgcacgcaccggggcgtgcgcgtccagctgcgccagggaccgcacccggcgccctctgggcagcacctgtcagcggcgggggcggctgcctccaaattgggcgcgcacgcggctcacacaacaaggcgcgtctggctggagactccggggaccagcagtccccctggggcgccccgggaccatcctccagctcctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcgctccctgggtccaagacgagagtttaatttcttctgtcttgacttcatccccatccacccctcccttttctttatttgcctctgcactggtctcttatgatcaggttctagcatttccggagtctgacgataaagccagcccttaagttgcagggagtttacggtggacgaagatgggtgatgcgcactgcctttgatccgattcggcacgcacagaatcttgttcttttcattcaagcgcattttttctttggttacttcatttgcttgttgcaaggcaaacggaaaaggctttttagctcattcagactttgcttctcccaaagctgctcagccagggtcttctgattctgctaggagagacttctgaaaggccagcaacacaatgcctctttcgtcctcctaaatggggaaaacgggagagttccctaagctgcggtagcacactgatcagtcttgtctagctagcagtatgctttggaggtgttaccaacctaagttttttgttttgttttgtttttgttacctttataacaaatatttattaagcacctactatataccaggcactgtgataggctctggggatgcagctgtgaacagggcatcagggtcccacccacatggagcttattgtgagggtgagggttgggaggtgatgcgagacaataaacagaatttctaatatgcaaaagtcccatggaaacagttaagcagggtaccacataacagagtggctacagaggaagagcttccagacaaaatgcaggacacccaattaaactgactttcagagaaacaatgaataatattagtatatgtatgtcccaaatattgcatgggacatacttatactaaaatactattatttatctgaaatttaaatttaactgggtgtcatgtttttgtttgctaaatctggcagccccatatggagaggtttttggttttttacattatgtgtacagggagagtctctctgagaagataaaattttgagttaagacttaatgaggacagagaaccagctattgacggatctgactgtagaatttcaggtagaaggaacagcagatacagaggtcctgaggcaggaagcagcttgactgggcatattcaaggacagaacgataccactccaaatagagtagagcaaggtgggtggggttggtaagagatgtagtgaaacaaaaggtcagctaagggagtgggtcctatagccagagtgagagtccatgtttcctctaaatgaaattgggagacattagaggtcttttttaatcgtgagggtaatgtgatgtgatttactaatactaatgccaggtattaataaatagcctcacagggctattttgaagattaagtggaaaaaggacttagctcagtgcctgtatatagttgatattattgttatttggtagacccagtatttcccaagtatatgaatactatgctttggaaaaagagcaacgtgaatggagaaacactgggctgcatttaaataatattattgaaatgacaagattatagagatggatagtggttgccaggggttagcggtggggcaaatgtaaaggatcagaataaagaagtttatttgttatgatgagacaaatttagattgtggtggtggttacatgaatgtgtgttatacacaggataggactgcatagaactacatacatatatgaatgcacataaaaacgtgacatctgaataagataagttgtaccaatggcaatttcctgggtcttaatattgaactatagttatgtatgataatatcattgggggaaattgggtgaaggtcacacaggagctctatgtagtatgtttgcaacttcctgtgagtccataattattttaaaatttaaagtataaataaaagcaaacaataataaagcatgtttttttgaaaaaattgtgtgctgctgaaagttttcctttggaaccttaataattagagaatgaaacagtcttagagctacgatggcctaccctttctttgtagctctgttctggccaaccccacctaattcctgaggaagcctctgagaagcaaatgagggaaaagtcaggactggtgaggcagagtccacattagggcaagctcacaactgcaaaggtaaacacagaggctgtgaagcactctccacacagaataagaaaagccaaccacatttgcctttatggaggtacctccccaccgggtgaaagcagaagggttggcatttttcactggcttttccttcctcttcactccagtttcctttctctgtattttatttctgtgttagtccttacttttcaaagtttcaggtaaaccttttaaagtttcagttaaaactcttcagctaaattataaatatcatagctaagtctaactgtgtaagctggtggtggcttaagtgttaactctctctggagtatttatgagctttatatatgggagctttataaaactgaaaatctccatcaaaataagtagaaaccttcattaaggacttggccattcaaggtagtgttagtcttacaaagcgagctacacaccaacttcagaggctttcgctccaaacctgcatcaatcccttattaaatcaatatggagatcattttcaaaagcccaaggcaaactgtcttttctacaccaatcaagctgaaagcaccaagaccacaaaaaactacctgaatataaagctgctctgaaagcacaaaaagaaactggactacccagaaatcttattctctagagagaacaagaggaaaaatattttgtttctagtttgttataattgtagactggagataatgctacacaattcaaccttaaattcatttagtcttcaatgcatttaattgactttttaatattatttttctcttctacctgtcttaaaatactctgagatattgagttctgaaatctataatcccaaataacacatccatcatatgaattcatttacatatcttgaaaaagcatatgtaacttttcctaaatatctgaagtggattataaaatgagactgtcctacagattgtatatcatataaagctacactagataaggtctcttctgtcaaatgtcttattatatttaagagaagatatttataagaaccctacaacacaagcagaaagtgaatggtacaaattaatcactgaggaagtgaagaattacttctggcttgactaaccaaggaggacttcttgttggaggcatctgagctaagatctagtgcaggtggcagggtataacaagaagatggattgccaccagcaaggaaaagcaaaattcatgccatataccaagactttaataaatgttagctattctttttattattttcattaatacaatttactgtctcgaatattgatatttattgcttagattaatattaaatatgcttcaaacattgatattcaggaggttgaagtgatgtataagccacttatacaatatttatacaatgtataattatacaatgtataatatttgagcagaaacccaaaggaagtgagagaagcagccaaatagtgaatctgaagaaacatttttccaggaacaggaaacatgaagtgcaaagaggctgagcaggaacattctcagcttcaacaatggcaaggagggcaaagtagctgaaagaaagagagcaagaggggaataagaggagaaaatattgcagagaagctcagggccagatgatacaggattctgtaggcgacagtaaagactttggacttggctaaaatggaaagccattagagggctttgagtagagttttttaataatcaaattgcattttaaaaggctcattgtggcctctttgttgacaatagagtagagaggtatggatgagaacagagtttagataggagcccattctgggaacagagtttggataggagccgtacaaaagggacaatgatggcttccactcaggtggtaggcaagaagtggtgaccacagtgacattctagatacaggacattttgaagacagaactgacagctgggcatggtggctcttgcctgtagtcccagctacttgagaggctgaggagggatgatcacttgatcccaggaatttgaggctgcagtgacctatgactgtgtgactgtactccacatgggtgatagagcaagaccccgtctcagaaataaacaaatacataaaattaaagatagagctgagaggatttaccatagtttggacatggggtactcaagtactatgttaaactgtttgcattatttatcatacatagctctcattgcaaccccatttcatagatgaagaaaccaaccctgaggcatatgaagagacttgcaaggtcactcattgagtaattagcagatccaacaatagaagccaggtccatgggcttccaaagccacatggcttctttaattttaaaatatatgcataaatagaataaataatggaaagaagcctcaaaagatgaactgatccatgcccttgccctaggtgagcaataagatgaccttggacagaaccaaaacttacactcaatgagatcaaggatgtaaatgcaagcacgaaaacaacatttctggaactaattgagttaaaggccaattaaacggcacttcaggagccccactgtcagtgcagtcttggctgctgtcccagctcccagcactaggtcagatatcttcaggccctcatgttctctcccagtctctgaaatgggataataatatttgtccacctgacccatctcacaaggacccaattcaaagacaaatgtaagcagcatttttaatgagtaaagcctgtccaaaagagtggcattatcatcactttgtaaccaaaaacaagaaaagctaccagactgattcgttccatcttacatggaaaaaccctgcctgtggggaatgaagcattttgaaccattcaaaaccaagaactcagtcatcacaattcaccatattgagttgactgctaactatacgattaactcaagagaatgaattcctattctggttataaactagtttttgtcatttctttcttgaaagatatcccagcagagctctcaaattcagttgaatgtttaagtaacttcaaaggagatatttctatttattctgtttaacctaagccatatcacattttcttttaaatcaaagtgttttttgaaattcttgagttctagttctatgtaggagaggcataagagcgttcatgtggccagaaggagagagggaggggacttgaaactatatttgcattaaaaaacactttttttggtaatcaattgtccatgtcaaagaagagagaaaggagttaagtggagatcagaagacagcaaacgtttcttccaactcaagccttgatgccaattctgtgctggaaaagtcagaaggcatgggtgtttgccttggttttgcacccaagtgctctgtaactacaggaagcttttggggcctcagtttcttgttaggaaaataaagaaatagaactagttaccctctaaggtctttttcagcttaaaaattgtgtaaacctctgaagcaattctccaatatatgatataatccatctactcattcctgatctgactttctactttcgatggtgtacaaaaaggccactagcactagatggtcatctaataatcccctttgaatgtacaccatgtagcagaagccgtcagggccccctacttttatctcttaggccccagaactccagtatgagtatctgcatctttcttcctcagggctggcttcatactgcaccctttcccccaagtgcctggaacagctttcaaccaatgagtgatggcattgatgagagttgaggtatctctagctccctcctgcccagtgagggaccaggcgtgataagaaagaggaaaggattctgtatttcccccaggtccagcacctcctggtcactggcttggtaacatgccctctatcagcttcctttccttccctctcccacttgctccactccactaaagctggtctctgcgattcccaaataaattgcttggcatttgagtccttgtcaataaatcagcttctgagggaatccaaactaagacacattaaaatggacattttaattcctagctagtgaggttcccaacttcaccactctatgagaataaagtagtgttctccagcaaaagtcctttgaatcatacaatgcctttacagggaattataaagacaaagtttatctgagcctataatctattccttaaaagtgaggccccttgagagccagagtattaatctatgatttacttccttgatgtagtccactgacttcctagaatacacaatagggtagactcctcagcatccattataccctggaaagttagtctccactgatcatggccattctatcctttttgtcagatatgtgaccaatcaggaaactattaactggagggtatattaatcgggactgggtccccccgtgagtaacacataaaccttaaacatgttaaagaagtctgaaggtcattgcccagaccttgtgtggtattccttctgttttgttgacccaccacacattcccaaagtcacctcatgctccaagattgtcagtggagctccagccaaccagcaaaaatgaagaaaaagcaaagaagagagtgaccctttctttacagttactctgcaagtcttcttgtatctcagggcttagaactcaggcacatggccattcctacccatgatttcaaaattaactgaaacaacatctttatcctgggcagtcatgtgtccagccaagaaatggggctttttgaggaagaaagggaagatgaatattgggggataagaagcaactcagacacagaagtgtagtcatttgacggagttcttcactcataaagaagaggcacaaaagagatgatctcttttccttatctacatgtttggtgcaatgcctcgaactactgcagccatcttgttagaaatctgaggatgaagcaaacaccacagttcgcagagaagagagatgaaaacaacagcaattcttgatgatgtcattgtgctacagaattaatccaccctgaggctttcctgaactcagatcctattatgtacttattaattattaattagaaagttactttatctagctttttagtaaatttctgttgactttatattagttttctattgctgttaaaacaaatggtcgcaaacttagctgcttaaaacaacccccagggcagtgaaactactctgtttgatactataatggtggatgcatgtcattatacatttgtctaaacccatagaatgtgcaacacaaagagtaaaccccaatgtaaactagggactctgggtgatagtgatgtgtcagtatagattcatcaattgtaacaaatgtactactgtggttggcaatgttgataactggggaggcaatgcatgtgtggaggcaggaggtatataggaaatctctgtatcttctgcttaattttgctgtgaacctaaaactgctctaaaatataatgtccaacttaaaaaaaatgtattctctcacagtgtctgtgggtcagaagtcagaagtctgggcacagtgtggctctgctggttccttgacttcaggtctcacgagactgaaatccaagtgttggcagggctgtgttccttcttggaggctctcgagacaaatctgcttccagccttgttcagattattggccaaattgttctacacccttttaggatttaatctctatttccttgctccatacttcatttctagagactgcccgcatttcttggctcgtggcttcctcatcttcaaagccaacaattgcagatggagtccttctcacacttcaaatctctcaggcctccccacctgcctcttgtctcttactggttctactgccttcttctagttagggttcatggaattatattgggcccacctagataatccaggacagtgtctttatactgagttcaattgattaggaaacagttatatccacaatgtcccttcacagctttctttatactagcatttgattcactagaggacagaaatatttaggggacagctttagaaatctgcttaccataagtttcttagagcccaaaacatcctgatgaacacatcctcattgagactaagagaaaggctatatctgcctaggttgcctcattcacaatggggtattgaacttaaaggaactggctcagtgttgcaagtaacagaattaatacaaaccaatattaataaataataaggacactgggaaactggcccaaataataggggagacctttcttctttgctgtgttattttgcaaaatctggccattttgctgcttaaaatcatactactccttcattttctcctaacctgatgctttctgaccagattgcaatgggtttttttgtttacttcaaatccaatcccctaatttacacatttttttctctaagagggataaaactagttaatacatattttaaatacatatgttattgatttcaaaccagtgcctaaaaatgtagctgccttctagcaaaccctactttaaaaatacttgcctagaaaatacaagagaaaatggaaagaaagagtagcaaaatgtgtacaagagaaaatggaaagaaagagtagcaaaatgtgtacaaatattcttggaaaaatagaatgaagtgcaaatgtcttttctgcagaaaattacctttgataaaatgttattggctaaaaagttttctcggatcctgattagcctgtaagtccatctcccaggtttattctcaatctcaacttctgccttcatccacagttaaatctctaaattctggccatgagggtatgtagacattacagatactgttttccacttttgatagatagagcaactaggaaaccaaggcatgaggggacttggaccatatgaagttagtggtgggaccagtgaggtatttacaggtagcaccatcttttaggggaccttaggcttaagccatccttactccccaccactctcagtgtttgcagatctgtttttcattcaattctacaattcggcagattggatccaacagtgatttaaacgctccaagacagagaattgctagtctctgtgaggctatatcagatgatagcctgaactccaaagacattaggtct

SEQ ID NO: 321 - DNA, 44904 bp, Homo sapiens
caaaccaccagaagctaggggagaggaatggcacagattcttcctcacagtccacagaaggaaccaaacctaccaacacctttatatgggatgtctagcctctagaactgtaaaataataaatttatgtttggcagtcctgggaaactaatacaatcagtattccagttgggaggtaattttgattttaaattttattatttattattttattataccttatattaagtaattgtcatcatcttcattcccaaaaagtctatgagaaacaatagttttttttgatgcagtcctaaattaaggtcaagtgaggaaattaggatcactgagccttcagaagtagcattttaacaagcttaatctttttttttttttttttttacagcccagaggtcttttatttatttattaacacctgttatgccatgaattcatagggaataggttccagcagctcaggctccttcgcattggttctcacaaagtgtgcttctctgggtggagcaggctggtgcttctgttgaacccaggtacctttctatttggcttccttctttttctgatcattttccttcatgtgtttcaggaaactatctcagcttttagagtgcttaatgtgctcaatacgcacattaattctcttggcaagaatcttgcccttaacttgtgtgtttacaacaatgccaacagcatgctgggggacattatagactcttccagttttgccatggtaacacttgtggggcattcctttttgaacagtacccattcccttgatgtctacaatatcacctttcttatagatttgcatatacgtggccaaagcaacaactccatgttttctaaaaggcctagagaacatatattgggtgcctctcctctttccctttgtgttcgtcattttggcgaattactggaagatggcggttccggctgaaaggaacaagcttaatcttaatggatattttttcttattttggctgatgattcattatgttgagtagtgacttattactatttgtactaaaaaatgcaaagatatacaacgtcaaatacattttattctcccatggaactcatatttgaagatgttatgttcaattaatctataaatgaacactttaagacagtgtgctaatttaatgcagtccagtttcttcaacaagtaaatggcaaaaaaagagacagagataccttaatggaatgaaatgtgtggactttgtttccatcttgatttgaaccagtcataaagaaacatgtatgagacaatcagggaatctgaacacagactgggtacttgaagataaggagttatttgcaattaaatgcaacaacgtcatttagagatacatactaaattgtttatgaataaaaaagacatgatctctggaatctgtgtatatgcatttttcgggggagaggaatgaagagataccaatgaaacaagattggccacatgttaataactgtagaagctgagtgacccatacaacagagttcattacactatcacctctgctattgtatatgtttacatttttccataaatttaaatatcattagattctgcaaaaacaaaagtgtcttaacctctgtagctcagtgatcacacttagcatcactaacagtgggacaaccagatatcatgtgcctgctgatgtaatgcaatgagaactgcacagcatcacctttaaaataatcttgtcaaaacactcaacttagatctaatcaagtctttagacctaactttacatttataggaaatgtaaataacaagtaacaccgtgagtaaataatcaggtgaacccagaatgtcagacattcaacaaaggcctgggctcttcagaaagcaaatactaatactaaacaaagactaataccactactaataaaggctatgtgtgtgggggcagactgtatttgagccaaaggcttcccctccagccccactgacagtctggtgaagccaatgaattcttttctcagaatgtcttaaatgcatgaaataaaaaacaggatcattaaaaaataggttttttttttttttgagacggagttttgctgttgttgcccaggctgcagtgcaatggcgcgatcttggctcaccgcaacctccgcctcccaggttcaagcgattctcctgcctcagcctcccaagtagctgggattacaggcatgtgtcaccacgcctggctaattttgtacttttagtagagacggggtttctccatgttggtcaggctggtctcaaactcctgacctcaagtgatctgcccgcctcggcctcccaaagtgctgggattacaggtgtgagccaccacacccggagaaatatagttatcaaaatattttaaagtacaatatggaatacacatgttccattattaatgcactaaataacaagatctagcagcaggtccaataactacaatagttttattttatttatttatttagagacagggtcttgctctgtcacccaggctggagtgcagtggtacaatctcagctcacggcaacctccacctcctgagttcaagccattctcctgcctcagcatcccgagtagctgggattacaggcatgcaccaccacacccagctaatttttgtatttttagtagagacgggatttcaccatgttggccaggctggtcttgaactcctgacctcgtgatccgtctgcttcggcttcgcaaagtgctgggattacaagcgtgagccactgcgcctggccaactataatagttttaaagtagtgatgaatataaatgatatttctgagatattttcattagccgtaatgtgatatgaaaacttctgtaatttatattgatgacaaagccacagctcatagtattgtacttcgttatcttcatttgtaatggaaggaaatgctaaatttttttttttttttgagatggaatcttgctctgttgcccaggctggagtgcagtggcgcaatctcagctcaccggaagctctgcctcccaggttcacagcattctcctgcctcagcctccagactagctgggactacatgcgcccaccaccacgcctggctaatttttggtatttttagtagagatggagtttcactgtgttcgccatgatggtgatggtgttgatctcctgaccttgtgatccgcccgcctcggcctcccaaagtgcttggattacaggcatgagccactgtacccggcctaggaaatgctaaattttaattagaatttggtgaaaataaaaatgtaatttttgcctcatccaacttcatggaccctttgaattgtatccacagactcctaacttaagaacttctgctctacgtttaaaaagacaagagatttggccaggcacggtggctcgtgcctgtaattccagcactttgggaggctgggggaggtggatcacttgaggtcaggagtttaagaccagcctggccaacgtggtgaaatcccgcctctactaaaaatacaaaaattagctgggcgtggtggtgtgtgtctgtaatcccagctactctgaggcagaatggcttgaacccaggaggcggaggttacagtgagccgagatttgagactctgtctcaaaaaaaaaacagaacaaacaaacaaaaaaacaagagattgctcagttctggggcataattaaaaaaaaaaaaagagattgtagccaggagtggtgactcacacctgtgaccccagcactttgggaggctgaggcgggcagatcacctgaggtcgggagttcgagaccagcctgaccaacatggagaaatcccatctctactaaaaatacaaaaattagccaggcatagtggcgcatgcctgtaatctcagctactcaggaggctgaggcaggagaattgcttgaacccgggaggcgaaggttgcagtgagccgagattgtgccattgcactccagcttgggtaacaagagtgaagctccgtctcaaaaaaaaaaaaaatttaacaatcaaatgtaatacattgttatttaataggtcttgttttgaaaaaaggaggacacaaacaagcgaggaaatctggagtgagtactgcataattttaggaaactattgttattccctattgacataggtttctaatagcaacaacttgaaagcagactgcatgttattgtgctggatgtgatatggtattgtggcatgtagagaatgcttattttggaagtacatactaaagaaaccaggtgtgaatggttattatgtgtttacacacacacacaccccacataaatatgtcaatataaggcacatccggggaaatgttcacagttgtttaacggaggtgataaaaaatgtctttttcttcttcttctttttttttttcctgagatggagtcttgctccgccgcccaggctggagtgcagtggcacaatctcggctcactgcaacctctgcctcccgggttcaaatgattctcctgcctcagactcctgagtagctgggactacaggcatgtgccacagcgcccggctaatttttatatttttagtagagacggggtttcaccatgttggccaggctggtctcaaactcttgaccttgtgacccacctgccttggcctcccaaagtgttgggattacaggcgtgagccactgcacctggctaaaatgtattattctttctacttttctgtatgtttgaacttttcataataaaatctttaaaaagcgactttaaaaatatttttattgaggtataatgtaggtttgttaaggtgcattactagtaagtgtacagcttgatgaatttttacatgtgtaaaacatgtaacaccatctaaccacaccagattaagatacagaacatttctgtcactgttctgtagtttcctagtgcccataatttctaacactattgataaagtatatactctttcatgtctggtttcttttgtacaacacgagttcctgttatattaaagccagttttcatgcagggcacagtggctcacacctgtaatcctggcacttttggaggctgaggcaggtggatggcctgagctcaggagttcaagaccagcctgggcaacacggtgaaaccccgtctctactaaaatacaaaatgttagctgggcatggcagcgtgcacttgtaatcctagctactcgggaggctgagatagcagaatcgcttgaacccgggaggtggagtttgcagtgagccgagatcatgccattacactccagcctgggtgacagagcgaggctccacgtcaaaacaaaaacaggctgggcgcagtggctcacgcctgtaatcccagcactttgggaggccgaggcgggtggatcatgaggtcatgagttcaagaccagcctggccaagatggtgaaaccctgtctctactaaaactacaaatattagctgggcatggtagcaggtgcctgtaatcccagctacttgggaggctgaggcaggagaatcgcttgaacccgggtggcggaggttgcggtgagccaagatcgtgccactgcactccagcctgggcgacagggtgagactccatctcaaaaaaaacaaacaccagttttcagagactccatgatgccatgtttgtcaagaatgtggaaaaacaagccttttcttaaattgctagttgaaatgtaaaatgatgaaacctttcacaaggcaatttaaaatgcccacattctttgacctagtaattctacttcttgggtcctgaaaaaataaaagcaaagtgcagaaggcaggcatggtggcgtgatctgtattcccagctactctggaagctgaggcgtgaggattgcttgagcctaggattccaggctggacactctagccaggacaacatagcctggctgtgttgacacgctaccctggacaacatagtgagaccctgtctcttaaaaaaaaaaaagaaaagaaaaagcaatgtgcacaaagattagataaatcttgaaatatttatactatggtatgtcgaaagctattgaaaatgtgagggactcatgtttgtaatcccaccactttgggaggcagaggtggaaggattacttgaggctacgagttggaaaccagcccagtcaacatagcgagagcacatctctgcaaaaataaaagtattagttgggtgtggtggcatccacctgtagtcccagctactggggaggctgaggcaggaggatcacttgaacccaggagctgcaagctgcagtgagccatgatcatgccactgtgctccagcctgggagacagaacaagacgctgtttcaaaaaaaaaaaaaaaaaaaaggtgagataggcctgtatgtaatttgaacaatctccaagatatattattatgttaaaaaagaatacaactgggccgggcgtggtggctcacgcctgtaatcccagcactttgggaggttgaggcgggcggatcacaaggtcaagagatcgagaccatcctggccaacttggtgaaaccctgtctctactaaaaatacaaaacttagccgggcatggtggcgggcgtctgtaatcccagctacttaggaggctgaggcaggagaatcgctggaatccgggaggcggaggttgcagtgagccgagatctcaccactgcactccagcctggcgaaagagcgagactccgtctcaaaaaaaaaaaaaaaaaagaatgcaactgaacaatatgtacagaccatttatggttaaaaaaaaaaaatggagaaaaatgcacacgccaaatggtgggaaggtaaatggggggagcggggaataaacatgttccttaagttttgccctgtattttatatttctcaattgttgcatcatgagcccaaatatttgaatattacctgtgtaattaacacataaaggcaaataagttaacttcaatacaaaagaagaaataacacaaagagggttctaggataaaaaaactcatggattcccaaacaactcataacagtgggggaactgggcagatgaggggtggaggtgggaaagagactttcactattttctttttttttttttttttgagatggagcctcactctgtcgcccaggctggagtgcagtggcgtaatctcggcttactgcaagctccgcctcttgggttcatgccatgctcctgcctcagcctcctgagtagctgggactacaggcgcccaccaccacgcccagctaattttttatatttttagtagagatggagtttcaccgtgttagccaggatggtcttgatctcctgacctcgtgatccgcctgccttggcttcccaaagtgctgggattacaggcgtgagccaccgcgcccggcccactattttcatttttgtatttttaaacgtttggattaaaaaagtatgtgcaggctgggcgcagtggctcacgtctgtaatcccagcactttgagaggccgaggcgggtggatcacctgaggtcaggagttcgagaacagcctggccaacatggtgaaaccccatccctactaaatatacaaaaattagccggccatagtggtatgcgcctgtaaacccagctacttgggaggctgaggcagaagaatcgcttcaatctaggaggtggaggctgcagtgagctgagactgcaccactgcactctagcctgggtgacagagtgagacttggtctcataacaacaacaacaacaaaaaattggctgggcgcagtggctcatgcctgtaatcccagcactttggtaggccaaggcaggaggatcataaggtcaggagatcgagaccatcctggccaacatggtgaaaccccatctccactaagatacaaaaaagtagctgggcgtgatggcacaccgagtcccagcaactcaggaggctgaggcaggggaatcgcttgaacccaagaggcagaggttgcagtgagctgagactgtgccactgcactccagcctggctacggagcgagactgtctcaaaaaaataatttaaaaaaagtacgtattttatattcaataaaaaatttaaaagtgtacaggacagttttggtggggtggggtccaaagaagcccttgtccctttttacaatttagcaatggtgtccaagggagtgaatacagtcatgggttcttagtttctgtttctggttgggccagtaaagccccttcctcatcccccttttccacttatcactagagactgaaactaaaaaccatggcttcagggtgctaaaagcctaaacaaaacaaaacaaaacaacaacaaaataagacaggttggacaagcttgcgagaagtagtcgtgacaagatggtgtatattcaactggaataaggaaggtttttgtgggtttctgttgtcagagaaggggttgtgttaaaaagactgaaggagaaatggaagtcagataaatggagaggggcccggaattggtggggtgtggaacccgggcaggggagggcttagaaaagccatggagacaggctgggcgcagtggctcacgcctgtaatcccagcactctgggaggccgaggccagcgggtcacctaaggtcgggagttcaagaccagcctgactaacatgaagaaaccccatctctacaaaaacacaaaaattagcccggtgtggtgtcacatgcctgtaatcccagctactcgggaggctgaggcaggagaatcgcttgaacctgggaggcagaggttgcagtgagctgagatcgcgcctttgcactacagcctggttaataagagggaaactccgtctcagaaagaaaaaaaaaaaaaagaaaagtcatggagacaaaggtttgcgtaggaggataaaggtttacataggggatgcaggtaggctaagggctgtttgtggaaggatttaaataccaggctaaggactttgagatttatcgtctaaagttcattgagcacttattcattgttgggtaccgcgctaagcccgtatatgtaattctcacaataaactgacggaaatggtgctattttgcagcttagccaacaaagttgtttttgaacagggaacgacataaatccgtttgtttaggccaggcacggtggctcacgcctgtaatcccagaactttggaaggccaaaccgggcggatcacgaggtcaggagttccagaccagcctggccaacatggtgaaacccagtatctactaaaaatacaaaaattagctgggcgtggtggcacatgcctgtaatcccagctactccggaggctgaggcaggagaatcgattgaacctgggaggcgaaggctgcagtaagcagagatcgcgccactgcactccagtctgggcaacggagcgacactccatctcagaaaaaaaaaaaaaggtataatattgaagaaatccgtttgtttagagtgacaagaagcacaaacagggcaggtacggaatacagacgttgacatattcacactagcctttttcagaaagcagagctccattatctcaaaaagctaaagcgtgactagtgtttcccacgtcatcatcctcatttccgcaaggctgggctggagaagaggaggtagacctaggagccaacaaatggctatcaatcccaccaaataggctccgcagtggggttgctaaacaacgaagcttccagaagcggaccccagttcccaccctcttgctgatcctaaagcctttctatgcaaaaactagcggaatgctattgaatgtaggtttccgagccagccctattctctccgactacttcaacatcaacgggggcttatttgcccaagggacgtcgcaactgggcctttcccattctattatcactggtggctcaccacccccactctcccccatcgccagctccgccttaacctcccacgaaatcaaatccccgctttaccaacccgcagcagccgggggcatggagagagaagcgggggtggggtggggtagggtagccggcccctcccccacccggggggggggggggggcgcctccaccgactccgaactaccagtcccggcgtgccctggggcggcgcgggcgcaggggcgcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagtgtgcgcctttgggaaaaaggcacctaacggcgcaggagatagaggcgggctcgaggtgattgaggcttgagggccgggggcggcgcgggctgcgccctgagaaggcggcggtcagtgctttgtgcggggaaagcgcattgcggatggcaattccggtgcgtcattgtgagaaagcgctttgtgaagcgagagtgctgcgcaggcgttagagtgggagagagagcgtttggcgcgtggcacaccctcgtcaagtgtttgttattgttctgaggaagagggcgcggagagagcagcctattgtagggaggcgacgggagcgccatggcggcggttaggggaagtgatgtggcggcggggggggaggggcggtggctgtttcgggcggtcctgcggcgcgcccggccgcttgggcagctacgacgggtttttcggtgcttcctggagccccggggtggttgcgttcggtggcaactcagctgcggatgggggtgggtttggcgccacggggcgggagaagtgcgttgtaaaatggccgttgcaagatggcggcgccatcatggccgccggcgtctcggtcccgtatggaggcacagcttacgggcagatgcagcgcccccttccacgacgaccagaaggttgccggggccctccgcataccacagagtggtgggtggggacagaaaaaaaaaagtgagatgagcgttttcctccgctttgtgttgcctggaggcatcactctgctattcttgggcgcagtgccgagatcctatggtaatgtgagtgagctctcgctttgcagttgctcgtaaaaagtaaataaaaatgatctgaatgcagtgttgacgccgtttgcatttgtaagtcccattgcctcgacgtcattttttaaatgcagtaattgtttgattagttgcagtgtttaacaatgacttgaaagttgaatttctttttattaattggttttcgattgacatgagttttgggtaaggttagactgactcccagtggaaggcagctctttaaattttcacaacgcttcagttaacgtataataaggtggaggtctaatagctaaaaaggaagtaaagtcctgttgagaaaggaggaacactttaacattccttttcattgctatggaaatttatgctagttaccgtaaatacgatgtctacatgcgtacgatttttgttctaggggtttttagacttgcattagaattccttttagagccgtaaacctcaaaccgtagtactgcgtattttaagtttatggaatatttaaggaggttttaggggtattttgttaatgagtgactttttttgtttgtatttttgagacgatgtttgtcacccaggctgtagtgcagtgacgctatctcggctcacctctgccccccacccgggctaaagcgagcctcccaagtagctgggatcacagacgcgcgccatcacgtccggctaagttttgttttgttctgttttgttttttagggtttttgttttttcttttctttttctttctttttttttttttttttttgtatttttggtagagacggggtttcatgttgcccaggctggtctcgaactcctgggcttgagcgatccacccgcctcggcctcccaaagttgtggggggttaacgggcgtgaggcatcgctctcggccgtgtgacttttaatacccctctctcaccttgagaagctgttgactctacctcctatgggttcattattttactagacattttagagcagatattcttaatctagagtcagtgcattaattgagacggtgcgtgaaattgaggaagatttttttttctatctcccaagtttagtatttcaattaacagtgtaattgctccccctaaaccccgaaaaaaaccaccacattagcattttcagtatattttcatatctcaacattacagttatggaagatgttttcagttatcgcattcttatttcttcaaaattagggtagttattgtattagcagccaagtcttgtttgtcctgtaatgtcatagaacgtgacatttaaagtgttttgtttcagtacagttggtttcctttgtactagtgtgtgttttatgtatttatgaaactattaggctcgtagggtttatcagactgtcaaggcacaaaaagttaatcgctgctgtgggaacaacctaaggatggctgttctggaagaagcgctttagttctagagggttgctagttaagagaggagtagcagcagagatttccttgtgccgttttaagtggggtaattggagaagagtaggaaccaaggtatccccaggtaagggtttgaaagctgtgtaagagagtctgtatttaacattactttccaggtgtgttttgtacttgtgtttaaaatggaattgtgtaaccacgttttaaaaatgattttagtgggtggggcacggtggctcacgcctctaatcccagcactttgggaggccgaggtgggtgggggcggtggatcacctgaggtcagcggttcgagaccagcctggtcagcctggtgagcctggtgaaacccagtctctactaaaaatacaaaaattagcagggcgtggtgttaggctcctgtaatcccggctactcgggcggctgagacaggaaatcgcttgaacccgggagtcggaggttgcagtaggccgagatcctgccatcgcactccagcctgggccacagagtgagactccatttcaaaaaaaaaaaaaatttattaattagatgatcggagaatatcttgcaagggaaaaagaatatttgatgagtgctaacagaatcgtcttgaaacactgtagagtttatgtaatggtagagaaaagagtggcgagaagtagtgtttttttgttttgttttgtttttttctttttgagacagtcttgctctgtcgcccaggctggagtccagtggcgcgatctcgggtcactgcagcctccgcctcctgggttcaagcgattcacctgcctcagcctcctgagtagctgggattataggcacgcgccaccacgcccagctaatttttgtatttttagtagagacggggtttcaccatgttggccaggatggtctcgatctcctgacctcgtgatccgcctacttcgccgtcgcaaagttctgggattacaggtgcgagccaccgcgcccggccgagaaatagggtttttaatgattcttgtaaacttgttaaaaaaaaaacaactcgtaaacttataaaaaagtttttttttatttgataatggcgtgcaatatatgttgtataagcaattcttaaggcatagtgattgctttgcactggacttggttttccattggaaattcttttttgttttgttttgtttagattttgagacggagcatttgctgtcctgggtcatactcctcagctagctgtatattttttcaacaaaatactagggcctcgtagctagaatggaggtcacagggcctcggtttcagtgcacttttttttccggcagtagcagccaaggggagaaaaatggtaggccattttcagagtgcctttaaaatgtaccaggagagtgaaattaggaaacacagatctgatctgatcttgttcgctgtttattagcagtatagtttacccattttagttctcgttcctgggccgttggagaagtctttgatcttcccgttttccagtctccgtctttaattcagaaatgctattcgtaggtccagcagcctctagcagtgattctttatagagtgaccacttaaaagaattatagaactgatttaaaaataaagttaataggtcgtgctctgggagagtctaataatatgggtctttggtggggcttgaaaatacatagttttaaaaaatattttaaattttagtggtttttttttgaggcggagtcttgctctcccatccgggctggagtgcagtggtgtgatctctgctcactgcgacctccagctcctgggttcaagcgattctcatgtctcagcctcccgagtagctggtagctgggactgaaggtgcacatcaccacgcccggctgatttttttttttttttttttttttttttgagagggcggctccttctcacccaggctggagtgcggtgacaagatcttagctcactgcaacctccacctcccgggttcaagcgattctcgtgcctcagcctcccgaatagctgggattacaggcacacaccaccatgcctggctgatttttgtatttttagaagagacagggtttcgcctgttggccaggctggtctcaaactcctgacctcaggtgatccagccacctcggcctccctaagtgatgggattacaggcgtgagccacctcgccccgcctgctcttttaattttagagctaaaaaagagctgacattcttggatatttcagttgtccatgggtcttttgaaaccaagtggactgaaaataatgtgtgcaaaatctttcaagctacactcaaatgtaatctgaggtactgcctagaattgcttccaagacttccaggtcctgacattttctttagtcttgaagtaggctcaacgtagactgttacgttccaaaggttaggctttattgtctcatttctttgttcattgaagcaacttagcacctagaacatcattccacatttgaagaatgaacatagtgagaccccttaatccagccaatctctgatgcatattgatattttaatttgtacgatatttcactgagtaaaagggttggaagcagagatacaagtggagagtaaaggtcctcaacttagaaaaacagatgaggaaagcatttaaaaaactgtattttcagatatatagttaaaaccaaccaaccaaccaacctcgacagctttgcaggagagtccgcttatgtgcttaacaggtgatagatgatttgattatttaagtagattgacctgctaatgaattgtttttgtttttaccatcggataccaacgtgtttttgtcgtagggtatagttgaagtttgagccaaagtggtgctctgtatacccgtcctcatttttcctaatttggctaggaataccttaataaaagtgtgatgactctctaagatgttaatctttttatatatgagaagaaattacaattcagtactttttctccctttacaggtgagcgagtgctgtgctttcatgggcctcttctttatgaagcaaaggtatgaaacttgttttcttttgagaagttggccaaaactactggttagatctggccatttaatatacaagtacagtattttgttgttgcctcagtaagagagttgccttttttaggttcgtagttaataaatttcttcatctttctgagattcttattgttttgcttagtggctcaaatgaattaaaacattgctactctcttccacttttcttactcatctggaagtagcatttgaggggaatgttagaaggggaagatgggctgtgggaacaaagagcattttgtggttaatgacttggtgagaaaacattgctgaagttacttttaaaagtaatatatgctgagtaagcattgagctaattatattaggttaaaggtaaaagccaatattaaaaataagtacatttaactgttgattgttgatttgtctggcaaagtttgtattctgggaggccccctttgtatcagggtgtgctcaagttataaaaactgattttacatttagctgaaggtaagcaggagaatgcattccaaagtaaaaaaaagtttcagtattttgtttctgataacttttttagtacaaatatttaagacttgactataccttaaacagtcgtagctccaaaaatgagcccgtaaaatacaaaacagtataatgtttaatttatgtaatttctgcataaattcttggtgagtagttttatgctatatgtgtctgaaaatagccttaaagtgtcagacatttctgactaaatattagccattttcactacttttttttttcctgtgttctaaatacacagaagtgtatttttaaagttctaaagagccaaacgcggtggcacatgcatgtagtttcagctactcagaaggctgaggctagaggattgcttgagcccaggagttcaaggccagtttgggcaaccaagcgagactctctctctctttatttttatgctccccgccccgccccgccccccaagacagtattgctctgtcgcccaggctggagtgcagtggtgcgatcttggctcactgtgacgtccccctcccgggttgaagcaattctcctgcctcagcctcccgagtagctgggattacaggcaccagccaccacacctggctaatttttgtagttttagtagagacggggtttcaccatgttgaccaggctggtcttgaactcctgacctcgtgatccacctgcctcggcctcccaaagtgttgggattagaggtgtgagccattgccccttgggagactgtctcttaaaaaagaaatcctaaaatgactgaatttggatgtatggagatggtcaggaatttctaagtatatgtatacgtacatacatcttaatgatataatgtttgtaagtgctaaattacgactcatggccaggggctgtgacgtacaagcctgtaatcccagggctttggggagccaaagcaggaggatcacttgaggtcaggagtttgagatcagtctgggcaagatagcaagactgtctctaccaaaaaaaaaaaaaaaaattatgtcctgttaatcgtttttatccctgaatgttgttattgttgtatcaacgtttggcaaactctactaaactggctgatttttctcctggcacctgacactctggtgaacaattttcgaattgaagctattgaaacaaattaaactgttgtggttattttggttttctcttaaagacttttaaatccaaaaccagatagtcatcacttgtcatagttaatgacttgcctctagtaattccttttgtctggctgcttttaagaaaagtgaaatatttttaattcattgctttacaagttgtttaaactaacttttcagaaacaggtccatttactgcctttcataagctaatgaagtttttttataatatagtttaaagactttgctttagaggaatttgcttttgaaataaatatagctcctggctgattagactgagaagacacaagcatagctttcattagctgtccttggatagcttttgtaatccattgattaaagatttaaggtgaccttttatgcttgtggttctcagctttgttggaccttttgtgactaatcttcagttttgtaacttgagtattctacaagcttagtgttcttagtcattctgtttaggccaccataaagcttgtgtagagtgtctttgaaggatgatttgaaaaggtagtgtctttaaaaaatttctaagtgaattattattttttttttgaatttcagtgtgtaaaggttgccataaaggacaaacaagtgaaatacttcatacattacagtggttggaataaaaagtgagtattagatcttacaattctatttgtaattaacaagatagcttgtgtcactgactggcttagcaagcatatgcttttcaattctgcagttttaatgtaatatagtacatattgaagcaaaggtgaatcatttgtagtatgacaaaactattagaaattagggtactgagccattttaatttaaatatacttggatcttgggaatatttgttatgttctagtgtaatatctattagtcatatagtcaatcaattattctggttgaatgtggcaatcacatttttctgtttttttttttttcctggttttggtacatttttaggatggcctgaattatttggccttaccacaaacatgttgattatatatgttatttcaagcagctgtgctaaaaaaaactagttgggttttctgtctagaaaaggggaaaggataaaggttgcttgattgggaaataaagacagaatttaccagtccatattctgaactttggaaacattatttagtgttgaccgaaaatgacttcatgtgactcactttttagcatggtttaacacagaaacattcaattatagagtcttaatttctcacccctaagagttaagcctttttttttttttttttttgagagatggagttttgctttcgttgcccaggctggagtgtgcaatggtgtgagctcggctcactgcaacctccgcctcaggggttcaggtgattctcctgcctcagcctcctgagtagctgggattacaggcacctgtcaccatgcccagctaattttttgtatttttagtagagacggagtttcaccacattggccaggctgtcttgaactcttgacctcaggtgatccacccgcctcggcctcccaaagtgctgggattacaggtgtgagccactgcccggcctttttgtgtgtgtgtgtgtgtatgtaaagtaccgatgttattgatcttgttctaggaatggacagtgggtatagattgaacacattctagaatgtccatccagtggagctgtttttcagtgatgggacttttctccttgggcctcacaaataaccctgtctaaaaatttacccaagtctcctatttggtgattgtaatgaaaagacttgtaatttttactatgggaggttttacattttattaatgatgccttgtccttcaaagatagcactgccattgctatttagtattgttcttgtggaattgtcctctagtaacttaaggctttgtgtcacctgactcaggctcttttacctggtttactatgggatcagtgccatctgatttgatgagtattctgttactatggaaggagtttatttttcctgtgaagttcactggccctgtgactttggtcttgtttcatctagtactctatccaggtgaccaacccagttaattttatttctttgttaggaagttgttttcacgtatcagatgttttcagctgagaatttatcagaccttttacttccattaatataaatgtggaaaggtagaaatctgaaatgcatagaagtgcatcctgacaacttgtgggtatttttttcccagttaatgataattaaagtatttctaatcagtgaggtgtggtggtgtgcacctgtagctacttggaaggctgaggcaggaggattacttgagcccaggagtttggggctgcagtgagctatgatgtgccactgcactctagcctgagtgacagagcaagatctggactcctttaaaaagaaacaacaacatgtatttctaataatgataggtaatatttaataatgataggtaactccaacctcatggacttgtattttaaatattgagaagttgggaaaataatggagaaaactgtcttggtagaagtaaactgtgcttttagtactaaatggattctaatatctaggaaacaggaaaatagtgactcctagtgtatctcatagctttttattactaaacaatgccttgctaaaactgcatttcaatctttattagacttatattttgtgtgttgatattctgacaatatccagataaagttgagagtgttaggagaatttcatttctctacaggaaagataacatcttaattttatgcatactatgagtgggaaagaccatataggatatcaaaaaaaaacacaaagcaaatttatggtttaggcttaatctcctccatctcctgcattttaaaggaattgttttagagccagtatggtggtgcctatagttttagcttcttagggaggctgaggttgagcccaggagtttgaggccagcctgggcaacataggtagacacccctcttataattaagcaaataaaaattttaaaaaagtgtttgaggctgggtgtagtggctcatgcctgtaatctcaacactttgggaggccaaaacggttggatcatttgaggtcaggagttcaagtccagcctggccaacatggtgaaaccccatctctactaaaaataaaaaaattagccaggtgtggtggcacacgactgtagtcccagctgctggggaggctgaggcaggagaatcgcttgaacccaggaggcgaaggttgcagtgagctgagattgcaccactgtattctagcctaggcgacagagtgagactcaggaaaaaaaaaaaaaaagcgattgaacacataaaaaactaagggaaactacgacaagggaatagaataaagaagatatttttaaaaaccttaaaaaattattttagaatttcaccttagtaactgtgaatacagcttttgtgcttagttctttttcacatataatagataaccctgtataaaattgcacacatagatgtgtacagcgcaaagactggattttaagtggcatttgtagcttgtcacaagttgtgaaaataccaaatgcttgtattttcagattttattgtttcgaaaaataatgggcattttcctctttggtgtattgtagtccagtaactcaaagaaatgataggtttgtgtagatttttttgttctcaactaatttgacacatattaattactgttggggaaagttaagaaaaaatagcatcaaatattagagatttgttactatctttgtagatgtattgaggaatattaatatatcagaaatgtctttggttgacttggcatgtagataaatatatgcaatgttgaaagaatgatcttagctttagaaagtctttaaagaaacctttaaattcattttgaaagggggaggagttattcagatacctagtgtgttgtgtatttagtctatgtaagtactgcccatggatcattgtgactctgggaattagtcacattaccgttagaaaactatgaaattctgggccaggcgcggtggctcacacctgtaatcccagcactttgggaggccgaggcgggcagatcacaaggtcaggagttctagaccagcctggccaacatgatgaaatcccgtctctagtaaaaatacaaaaattagccaggtgtggtggttcatgcctgtaatcccagctagtttgtaggctgaggcaggagaactgcttgaacctgggaggcagaggttgcagtgagccgagatcgtgccactgcactccagcctgggcgacagagcaagactccatctcaaaaaaaaaaacaaaaagctgaaattcttgccaggcgcgatggctcatgcctgtaatcccagcactttgggaggcctaggcaggtggatcacgaggtcaggagttcaaaaccagcctggccatggtggtgaaactctgtctctactaaaaattagctgggtgtagtggcgcgcacctgtagtcccagcattttgggaagccgagggtgggcggatcacctgaggctaggagttcgagacaagcctgaccaacatggagaaaccctgtctgtactaaaaatacaaaattagctgggcgtggtggcgcatgcctgtaatcccaattactcaggaggctgaggcaggagaatcgctagaacccaggaggcagaggttgtggtgagccaagatcacgccattgcactccagccagggcaacgagagcgcaactctgtctcaaaaaaaaaaaaaaaaaaaatacacacacacacacacacacacacacaaatatctcaaaaataatctcattttgaaaatggcttgtgcagggtactttttaaaattcgtacaacaaaaccttaatccctaaattggaattctcttaaacttcagttaatcttttttcaaaaacataatagatgatggagatttctaaattttcaaacctcattggaatttgttgacacacacttaaatactccatttgtaaatgaatcttaataaagctgaggctcaattctgcacctggtcactgagattactttgtactatgctgtctgtatcagaagtgctgtgaggcccaggcgctctgaaaaatctttgaagacacatgaggatattgtagccctttttcctgttcctgaaggagctccctcagtacaccaccccctcctgacctctaggtaaatgcatgttttgaaattttctctaggaaatcatgttcaggattgctttttattattttcctcttggctgtattatataagaggtcagaggtgggaaatcattaaacaaaagaaagtcttaaatttttttttgtaattgggtgccttgagagtacacctaattgtgtcactaaaggagctccatcagcaggagaaaagatttactgctcaaaaaaagttagcattccctaagaaattacattgtttttgtttgccattttgggggaaaaaacacataatcagaaattgtgttttgaacaagctctttgaagtgccagaatgtcttaacatttttgagagagttggttctgccttctaatatttagaaagccagctttctgatcagccttgaaagttattagtgtgtattcatttgtgactgaatgaaggtggagaatggtgtcaaatcattttaatactttacaaacttaagttagtctagttggtgtttgagtattgtagacttcctaatatgtttctgacatacctttagtgttgttttgtgtcagggattctcaggtgttttacatgtattctcataacagttatttgagataagtactgttgttatcctcatttcatagagaatgaaatgaaaacacaaagctatatggaactttgtcattacacacagctggttttaatttttaaaaataactgagtttttgactcctgtgctttatttttgacaataaaagtctttaagataacataagactaatcacttagtgaatcttacattaagtgccaaactcttaagccatttctaaaaatgatttgaataatctgcttttggactctggcagcttagatttggaatgctgctttttgaaaataaaaagttttcctttttacagaacagacttccattagatcttcattttagttgagaatatatttgtagtgccagttcatcaaattacttaagagaaatccagtcttgcctcttgatctcagaaaattagttggagaacagagtatttttgagttaaattttaactttcctctttttcagttgggatgaatgggttccggagagcagagtactcaaatacgtggacaccaatttgcagaaacagcgagaacttcaaaaagccaatcagtaagtttgttttgtgaactgaatattaaggagaaatgcctgtagattaattctggacatggaatgaacaatggagatcatgttggctgccctgcctataaaatgattcctggtacctttcagctgctgtgttacagctttgacttcaagcgatcaagccatatctaggtaaaggaagtagcatacctgccattacttgagcttatcttagacctaggtagaaaacagcagaatgttgttggaaattgctataggtatgaactcactgataaaaatctttattttcgggggctctggaagacaaatttggtggggaaacaagcaaacgaggcatttcctattctgcttttcatctctgaaagcacgggaaaagggaccctgaaagactctatgatttatagggtaatctcaaagttgaaatgtatttttaaaaaaattaaaacgatggctgggcgcagtggctcacgcctgtaatcccagcattttgggaggccaaggcgggtggatcacgaggtcaggagatcaagaccatcctggctaacacggtgaaaccccgtctctactaaaaattcaaaaaattagccgggcatggtggcgggcgcctgtagtcccagctactccggaggctgaggcaggagaatggcgtgaacccgggaggcagagctttcagtgagcggagatcgcgccactgcagtgtagcctgggcagcacagtgaaactctgtctcaaaaaaaaaaaaaaaaagaattaaaatggtaatgggaacaaataaaacactgggattagtgaattccaaaacaaatggaattttcaatgctatgagaacagtctattacagtcactttttattacattgattttaattgagccttttgctgtttcttgagtgttttgtttgatttttgtggaaatatctctgtccaacttgttaaaaacttgttgccagaatttgaatgtaaattcctaatggaatcaggctgacaatttttttttcacataaatgctcattttatgttgacattactgaaattatttttgaagggagcagtatgcagaggggaagatgagaggggctgccccaggaaagaagacatctggtctgcaacagaaaaatgttgaagtgtaagaagctctttgttttgattttgcatactatatgtgaagataatattttatgttcattgtgtgttagactgtgttgaagtggaaactttggaacattgttggaaccagtaagaatcccattcctcaggtatcaggtcgttaaagtagtttaaaataacgtattccttaattttcctcagcaggttccccctccctttaacttgtgtgtataaatatatgtgtgtgatgttttctcttacaaagatagtactagtggttataagttttgagataacttttggcaagccttttcaaacctaaaaagcaagtgctggcaagtgctaaaaatacatacgaattaacctccactttggtgaaactcatggtaagaatatgtgagaagttaaggtttcaaataactgccctcctcatccccacccctaagaaaaccattgcttttttttgagacagagtttccctcttgttgcccaggctggagtgcagtggtgtgatctgtgctcactgcaacctctgcctcctgggttcaagtgattctcctgcctcagcctcccaagtagcggggattacaggcgtgtgccaccacgcctggctgatttttgtatttttagtagagatggagtttcaccatgttggtcaggctgacctcctgacctcaggtgatccacctgccttggcctcccagagtgctgggattataggcgtgagccactgctcctggcacaaaaccattacttcttgttaactctagattttagaacatctgataagaagcctagagtgagaaagtcatgtgcatgcatacattttgtatgtttaaagtttatgtaggacggtgcggtggctcacacctgtaatccccctactttgtttgggaggctgaggcaggagaatggtttgagcccaggagtttgagaccaacttgggcaacatcgggagcctctggttctacagaaaaataaaaaaattagctcgggggtggtggcacatgcttgtagtcccacctattcaggaggccgatgtgggagggtcacttgagcccaggaggtcaaggctgcactttagtcttggcgactgagtgagatcctgtcttttaaaaagaaaaaaaaaaaagttgatgtacctgaaagtggatgacaagagtggtaacttaataagtattcttaagtatttgtaataataaaaacaaaaattataacttttattaagaggtcattttatttcctaccagaattactgatctgatttttctacttaaaagtaaggtgttacacccagtgctttgggaggctgaggtgggagggattgcttgaggccaggagttctaggctgcagtgatctgtgattgcaccactgcgctccagcctcttaaaaaaagtaaggtgttactaatgaaggtatttagtatttaatgcatttggagatgtttgaagctttttatttttttttaaactctttttggtgagaagataattggcaaggattaagtgtgttactatttgaggattgttcatagttttaataagtggtaacatgttttcatgatctggttctttggaaaactgtagtgtagtatttcattaggatttaatagtaattatgtcttaaaaggcagtaattttctctatatagaaaagatttttatcaaaagtaatagttcataactaattctttatcactgtgctaagttattatatagaaatcttaagtggtagtatgcccataagttatttgcatttgaatacagcattgtgcagtctccactacaaaaataatggctgagtaaatatatgaagtaaagctttaaaatttaaatttcccattcttgaacagtagaagcctcttcaaactggcttctgagtcttttgaaggatcctcagtctagacgtttgaagcatgaatgtcaagctcttactactaggacttattgaagtgtatgggttgaatatcccttatctgaagtgtttcggaccagaagcgtttcagattccagactttttttggattttgaaatgtttgcgttatacttacctgttgaacatcccaaatccaaaatgcttcaatgagcatttcctttgaatgtcatgttggctcagaaaattgggatttttggagcattttggctttgggatgctgaactcatctatattttatagatcttttactttagagttgagatcacctgtcagtattttagttttatattacagaggtgagtgggtaaaggattgagtgtgaagactattggtttctcttggtctccacatattgacacgtgcaagtaaagttcatggttgactttgaccgagaaatacagtccaacagatttttacaaaactaacagacaagagaaaacctatacacagatttttgtgtttatatccaaacataagttaatttgaattgtcaaaccttaagacctaaattaaatgaatatatttaattaataacatttataagtattatttaaagctacagaaaagtaaaaaatccaggtgttatagtatctttccatcgaaagtaatccataatcatgggctctataaactgtttcctttgtggtctagaaataataatgtaaaaaagcaaaattaggccaggcatggtggcacacgcctgtaatagcattttggaaggccgaggtatgcgaatcacttgaggtcaggagtttgagaccagcctggccaacatggtgaaatcccgtctcttaaaatacaaaaatgagctgggagtggtggtgggtgcctatggtcccagctacttggaaggctgaggcaggagaatcgcttgaacccgggaggaggaggttgcagtgagccgagatcacccaacagacagagcaagactccatctcaaaataaataaataaagcaaaattagcaatttaccatttgacagtatataagtgacgtgaggtaagttgctgttagagatgataatcaagatgaggagacttaaaacaaaaaaattacacaaatctaaaaatattttggggaacaaaaataattggaaaaaaattttaacctttgacaccttttttttttggtgggcctaataatgtagtatatactataacatatattaatataaccctggaagaacgaagttgtttactaaagtgttcttggtttgcttttcttttttttttgtctttgagacagggtctctgtcaccaagactggagtgcagtggtgcaatcaaggctcactgcagccttggcctcctgggctcaagcaatcctctcacctcagcttcccaagtagctgggactataggcgtttgccagtatgcccagttaatttttgtattttttatagagaacaggatttgccatgttgcccaggctggtctggaattttgagctctagagatccaccccctcttcacctcccaaaatgctgggattacaggcatgtgccactgcgcctggcttggtttatttttttctattatgtggagagagatgggaatttaaccaactatcaataaaaatccttgtgtctgagtaggacacatatttaccacctgatcctttatccaagttagtatttctctgtgaacttaaccctgataaagggagttgaaacagaggcagttttactggaaataattatttttcttttttttctctccttttaggaaaacgaaaaagaacaaacagaaaagtaagaatattaactttcttaacgttaatttatgttacctctatgacattgacgtttttattttgaaagctatgaaattttggagtaagcttatgtttattgattatctcaaataggagtctcacagcagtgttataaaataggtacatggtggtagagacctctttttgccaaggagaaacttgtgagcatttattttcatctgctttagtcttaatgtctcccactgagaagataacatttataaataaatggaagatggtgatactaaatgttgtctatactaaatgttcggtagagctcttcatgaaagttgtatttttggtaggaatatgattctttaacttagattgaggtaacagctgtgtaatggagaaataatgaaaagggttaatgtgtcaagagactattttccttatagagtttgttaaattagctaaatgagacccctccccgccaacatttacagcacctggaaatggagatggtggcagtaccagtgagacccctcagcctcctcggaagaaaagggcccgggtagatcctactgttgaaaatgtgagtttttcttgtgtttatgaatagcatgttaggatttttagtctcagttacatgacataaccatgggagctttgattatctacaagatttgcttacatggttaatacctgaaattaaaaattttctcttttgggggtaaaggataaatttctgtatatctttatttcacctgtagctccagatttacctacccaattgatcatttgttgtgtaagcttcatgttcacctacaagactatttctttggtgttacgtatttatttttaggagttaaagatgtacctttaagatggttgtgtttggaatagttttgatatccatggtaaataagaaaatactaagttaaaatgtatcaagtcagggtgtttcatttcctgaacaagaggaaccttactgaagaatttttacctttacaagaaaatgcactaaatagactatagttcaggtcagattcttttctcccaacagcgaaccgcgtatggtcgtttttattaatgattttaaaaaatgacagtacagctgtatgcttggctactttaagatttatccctagtgcctctaaaagtcagctcccctccatgtttggtatttagcaagaaaggttaggtttttaatactcctcctgtttctgtttaggaggaaacattcatgaacagagttgaagttaaagtaaagattcctgaagagctaaaaccgtggcttgttgatgactgggacttaattaccaggcaaaaacaggtaacttgaaaagctacccagattgttaagctatatgatacattcttgctagcaaaaaaagtttttaaaggaaaatgttatattgacttgaattattaaggtatgactgataaaataatattttaatttagaggctgaacactttagaactactaccagaaagagtaagttagaagaataaaagttcacatataaattttatgaggttataatgataaaggtggaaataactcatttttggagattgctagggcaggaactcgttctgaaaattcataaaggtgaagaagcatatgtcttactgtcattgctaatggtaggccatagaaagcacacaccaccacctgcaaggtattcatgaccctgaaaagaacctgaatcttactaagcgcctggatctattgttagtttgcaggaaataggatgtttaatggagtgacatgtttgtcaatcgttgaactctataattgagaattttataggacaaatgaagctatttgaacaaatggcataggtagggttagggatagttgggggagatgattagggactgcttgaggattatgagacttaagagacctatcagtcatatacagtatgtggatatagtttgaattctgatttgaatcctttggagggttatgcagttacagctaaactgcgaagattcaagcatggctgtatcacttattatttgtgagtttggacaagtttcttagcctttttgtgcttctgtttttgcatttaatggaataatagtttgtatttgacaatgctgatgagaggacgaaaagataattattttaatgctttagactagatctagcaaatagtatgcataacagtaaatgatgacttggtagtaccacaaaggcacattcgtgtctgttatgtgtgtgtgacagattgacatttttaaaagctgtgctgttctgtctagtagagtctcatttggctgtttaaatatatagatgctccataacttagaatggggttacatcgcaataaacccagcagagagttggaaaattaagtccaaaccattgtaagttgggaactgtctgtagtttctcagccacattatccatgttttaagtgctgaatagtatctttcctaatttgaaatactgttactgttacctgatctttgtataaaaacttgcctggtatgatttttctttaaaaaagagagtgcttatatttaagcatatttttgtcttcatagctcttttatcttcctgccaagaagaatgtggattccattcttgaggattatgcaaattacaagaaatctcgtggaaacacagataataagtaagaatatacatttttcagatgacactcaaaagacatttaaaaaagtttctaaataagtcatctgaaacttgtactgactccgaaacattaataccaccagaaactagcaaaatagaatttcactgctttgacacaggagttggctggctgactttttcttaaagggccagatagtaaatattttaggtaaaatttaagctatcatgtaggtatttgcataaccatttaaaatttaaccatctgaaaatgtaagaatcatcttaattgctttagtttgtcaaaccctgctttcatatgccctttaaaaaaatctcagctatggttcattattactagctcagcttttaattctttaaattggttgaattattctctatgtcagttatttttattgaccagttttggaatatttttgttcatttatcagggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttggtaatatgtcatgtagaaaataatggattttactttttggggggtcttctctaaatgaataagaggtaaagtaattaactttccaaaacatgactcccattttaatttgaacttttatctagaatgttaaatagcaaaatctctttaggagcaagagttttaaaaatcgtgtattttattttataattttttttttttgagacagacagtctctgttgcccaggctggagtgcagtggtgcgatctttgctcactgcaacctccgcctcctgggttcaacaattctcctgcctcagcctcccaagtagctgggatcacaggtgtgcaccaccacatctgtggtaatttttgtattttctgtagagatggggtttcaccacgttcgccagggtggtcttgaatacctgacctcaagcgatcgcctatctcggcctcccaaagtgctgggattacaggcgtgagccactatgcccggcctaaaatcatgtattttaaaggaattggtggtgtttgctcacataattaaaatacatggttgtagtgcccctgccttggatgtaactttggataaattctcttgtttaaacagtacgaattggagcaatgttggcttatacacctctggatgagaagagccttgctttattactcaattatcttcacgatttcctaaagtaagtctgtgcttgaaattataaacatggatttgaaaattagcgtgtaatgggagggattggcagtatagatgctaaaacattaaacattatattggtacaggcatagatagttggtaatggagcagtaaaagtaagtgcaaacacatgggagtctcagaaatgatagatggtatatagatgatatattggtgcagtaggggaaagcagtggagtctggtagattggtgataagacagctgacagtttggaagaaaacaaagccacacttgtcatgtaccaaaattctagatgaatctgaagtttaaaattaaattgttaagataatgaaaggagaaatgtaatattttcatagttctatagtgttccatttatgataaatggttggtacctttaatacacacagagttcttcggtaagaaatgaacaaaccagtgaaaagtaggacaggaaatttacatcaatggcagcacaaaggaccattaaaaatatgtcagaaataatgatgaaagtataaactgtcagtaaagtagcacttgtcagattggctaaggtttaaatgtttgaagaaatggagaaaagggcaatcctggtttctacaagtttttggagggcatttttataatagtgaagaatttgaaacaagcacttattaaaagggtgaggtcactctaaacatactgataaagatgtccatgttttcaattgaaaaacagccaagctgtagtagaggagtatggtgtaattgttacttgtagagaaacattattttaatctttgcataagatctggctttccaatgtggatcttagttaatactgggttatttcttgggcgtggtgttggaagggagggtgggagttttcagtttctactttgtatacttctgtatatgaattttctcattacaatcgttttacagtaaatttaaaactgcaacgtggacttgagaatgtaggcaagatttatcatcttttctttactaatgataaataccttctttggacctcagtttctttatggaatgtgctctactacttgacatttcacgttcccttttatgtaattaaaaaaaaaaagtttattcatttagagatggagtcttgctctgtcgcccaggctggagtgcagtgatgcgatcacagctcactacaacctccgcctcttgggttcaaacgattcttgggcctcagcctcccaagtagctgggattacaggtgcacaccaccatgcctgactgatgtttgtatttttagtagagatggggttttgccatgttggccaggctgatcttgaactcctggcctcaaatttttgtgcctcggccccccaaagtgctgtgattacaggtgtaagcaactgtgcttggcctgataggatttttttcttttttcttttcttttctttttttttttttttttttttttgagatggagtttcacgcttgtccatgctggagtacagtggcgtgatctcagctcaccacaacctctgcctccaggttcaagcaattctcctgcctcagcctcccgagtatctgggattacaggcatgcgctaccatgtccagctaattttgtgtctttagtagagacgggtttctccactttggtcaggctggtcttgaaccccaacctcaggtgatcagcttgccttggcctcccaaagtgctgggattacaggcatgagccaccactcccggctgataacgattttttttttagaaaatgtctagatgttcttttagggtaatgctgtcatgtaataggataataactgtttcttaaagatggttcaagctcccaagttggtattctgcagacataactgttctttgctgtttagaaataggggagtaactccagagttcattcctttgtatatgtatagtgttgttcattgtataaccttatttatttacctgaattgtcattatgtgtggttttactgtgagagaatgtctggtttaatgtattttaggaaagtgttttctgtggcttatgtatataatatataggaagagatttggatcaagataatgacctttaaaaatttttgtaatgaatattttatttttaggtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaagaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaagggcaacgtttctcccctttgatagggacactaaagtggtctgtacttgggtagaggatggcagacgttaagaattaaaatgcgtctgggtgcagtggctcacgcttgtaatcccagcactttgggaggctgaggcgggcggatcacctgaggtcaggagttcgacaccagcctgatgaacatggagaaaccccatctctactaaaaatacaaatattagctgggcgttgtggcgcacgcctgtaatcccagcgactcacgaggctgaggcaggagaattgcttgaactcaggaggcagaggttgcagtgagccaagattgtgccattgcactccagcctgggcaacaagagtgaaactctgtctcaaaaaaaaaaaaaaaaaaaccctcagaaaacaattaaaatgcaaagcagcagataagttcagatggcgagagttacagcagcaatacaagagggataatgagtgcaggagggaaataggagtaagttccaaagaagcaggatttgcttgggttgtttgaagggaactgcttctacccatagttgtcttcctgccgcctccttcattcggcttacttgttctctttttctttaccctttttgtcacaactgtactgatttagttggatttctaacaaatagggattgttgttgcctggggtctttcagctgttgaaagttcttgtttatctagatgtgacttaaaaaatgaaacacttcaagaatttacgtgtcattcttggcacaggggccatgctaatcttgattgtttgaatttttaatatttttgctaacaaaatgagccctagatgtgatttttttttttaatgtgtactcatggtcccttgaacattagtgttactggttaggtatttaaagattttcttgccgagcgtggtggctcacacctgtaatctgtaatctcagcactttggggctgaggtgggaggattacttgagcccaggagtttgaaagtagcgtgggtaacgtagggaagagaccttgtctctacaaataatttttttttttttttttgaggcagagtctctctctgtcatccaggctggagtgcagtggtgtgatctcggctcactgcaagctccgcgtcctgggttcatgccattctccagactcagcctcccgagtagctgggactacaggcacccgccaccatgcctggctaattgtttgtatttttagtagagatggggtttcgccacgttagctagaatggtctcgatctcctgacctcgtgatctgcctgcttcggcctcccaaagtgctgggattacaggcatgagccactgcacccggcttctacaaataattttatgagtagcctggcatggtggcgtgtgcccatggtcccagctacctgagaggctgaggcaggagaatcacctgaccccaagatatcaaggctgcagtgagctgtgattgtaccattgtgttccagcctgggtgacagagcgagaccctgtctcctaaaaaaaagttgaggactcgatcttttcgtttatattatcaatatttactgtgctagaaattaaaactttaaaacttaaaaatacgtgtcttcattagtcatcagaatgataccgtcacacatcatgtaacctcaggaaaatttcatgtacactcgagaaaaagactgatttaaaatagctttaacctcataggcagcatgaaaatatctcaggtactgcagagatctctggaccactcgttgagaactgccgctatagatatttgtgtcctgagggttgtaacagtcttagggttctgtattcagaaatttaaacattccttcacaaaacctgaaagtcaagattttgttcgttattcattaagcctcctccctccatttaaatatagcattagaaaagaacattgataggtttacctgatgacactaaaagaggcagtaatctttggacattaaatctacagagtattttgaatatgttttcatttactagtaattttaatgtcgctccagaatatcttacatattagtagtaagtagctggaatgatgtaatcaaaatcatactgattaataattacttaccaaaacatgaaattagatgaatattaatattagtaccgttaggttttaatacggttttttctttattttttattttttgagacagtcttgcactgttgcccatgctggagtgcagtggcgcgatctcggctcactgcaacctccgcctcccaagttgaagcaattctcctgcctcagcctcccgagtagctgggactacaggtatgagccaccgcacccagctagtttttgtatttttttagtagagatggggtttctccgtggtcgtcaggctggcctcgaactcctgacctcaactgatccacctatctcagcctcccaaagtgctgggattacaagcgtgagccaccacgcccggcatgtttccagatatttttactctctggtgtttattaaacttaacccaggcagactgagtctcagccatgttagagattttcctggattagctgccttgtagtacaatctagaatttttagtgttcaatttatttcttgaactaatcattcaagtagattgaaggaagagttactggaagggtaggaagaagcatggcttgtgatgaagggtgcattttgacaagtattcttctggctctttgccatcctctccttttcctgttactgcttctaattaaaggttctggtctatatctaagtaatacataggtttttttttttttttcttcttttttttcttttttttgagaccgagtcttgctctagagtgcagtggcttgatctcaggtcactgtaacctccacctccctggttcaagtgattctcctgcctcagcctcctgattagcttcgattacaggcacctgttgccacgccctgctaattttttttgtatttttagtagagatggggttttcaccatgtcggtcaggctggtcttgaactcctgacctcaagtgatctgccgccttggcctcccaaagtgctgggattataggtgtgagccactgcacccggccaatacatagttttttttgttttgtttttttgagaaggagttttgctctttttgcccaggcctgagtgcagtggcgcaatcttggctcactgcaacctctgcctcttcggtttaagctattctgcctcagcctcccgagtagctggtgttacaggcatgcgccaccatgcctgtccagttttgtatttttagtggaaacagggtttctccatgttggtcaggctggtctcgaactcccgatctcaggtgatctgccttggcctcccaaagtgctgtgattataggcgtgagccaccatacccggcctcaatacatagttttttaaagttcactcttttttttttttcttttttgagatggagtcttgctctcttgcccaggctggaagtgcaatggtgtgatttccactcgctgcaacctctccctcccgggttcaagcaattctcctgcctcagcctcctgagtagctgggattacaggtgcgtgctaccacactggttaatttttgtatttttagtagagacgggatttcaccatgttggccaggctggtcacgaaccccagttttttatttctttttaaaaaaattcgttaatttccaatgagcacaagccaggcagtttttatagtttctcccattaatcagttgtgatattttctaagttttgaaattatttcctcaaaatcgaggtaactggcccttgattctcctttcttgggcatccttataactgccatgtcttatgggcatttgttgttgtaatatctgccgtcatttttgcagtgtatatttcaaacaaagttagttacagaggtttagtaaccttgcctatggtctggtcgtttagctaagaagtgacagcgctgagttaaacaccaccttgtttcccagccacacacatatccattaaattcctgagtcttatgaattaccaaatacttttgtctgtcccatctgcctcttaaatgtctacagtggagaatgtattttaatagttttctggattaaaataatcatgctcctttctcctttaaaacaaatggtttcctgtatgatagtgttttgaatcatgggagtaaagggcaagttaggttaaggtacaaactctgaagctaaacacagcttctgtagcgtccagccccatggggcttagggggtgttctccccgtgtgcagagacgagagattgtaagaaataaagacacaagacaaagagataaagagaaaacagctgggcctggggggggccactgggtgtgctgatatttattgcatgcaagacaagggggcagggtaaggaaggtgagccctccaagtgattgataaggtcaagcaagtcatgtgatcacaagacaggggctcttcccttttaggtagccgaagcagagagggaaggcagcatacgtcagcattttcttctatgcacttatcagaaagatcaaagactttaagactttcactatttcttctaccgctatcttctaagaacttccaagaggaactaggggtacgggaggaacatgaaagtggacaaggagcgtgaccattgaagcacagcaccacagggaggggtttaggcctctggatgactgtgggcaggcctggataatatccagcctcccacaggaagctggtggagcagagtgttccctgactcctccaaggaaagggagactccctttcgtggtctgctaagtaatgggtgccttcccaggcactggcgttaccgcttgaccaaggagccctcaactggccattatgcaggcgtgacagaaggcttacctcttgccgccttggttacttctcacaatgtcccttcagcacctgaccctatacctgctggttattccttgattatattagtagtacaataaagagtaatgttaaaagccaatgattaataatgtttatactaatgactgataatgtccatgataatctctgtatcgaatttgtattataactattcttattctagctattttcttcattatactgaaaccgtttgtgccttcagtctcttgcctcggcacctgagtaatcctttgcccacaagcttccccagtcttcacatcaccatgctgtgtttcagtcagttctcctttgctttttgcttctaagcttgctttcacatgctgttgaatggaagaaacaagttggagaacaataatacagtatatgaaaaaaatatcgtatttcctagggtatatacatatgtgggttggtttttttttgtttttttgtttttttttttgagacggagtctctctctgtcgcccaggctgtgcagtggcacgatctcggctcgctgcaacctccacctcctgggttgaagggcttcttctgcctcagccttctgagtagctgggactacaggtgcccaccactattcctggctaatttttgtatttttcgtagagatggggttttaccataatggctaggctggtctccagcttctgaccttgtaatctgcctgcctcggcttcccaaagtgctgggattacaggtgtgagccactacacccagccaaatacagtttcctcttaaatgcataaatgagcaaaaaaaaaggaagagactaaaactgaaaaccccaaaattttgcctgccttcaatctaggtaatacagagatactgcatacaaagtatctttaaaatatataaaaagaattgaaaatgtgagaaaagggaacaaaatagacttaaccaagaccagcataaagtaatggcatactttgtaaataattcagagcaatcttccactgaagacaagaaaataagcagagatataaaacatctgcttgaaggcattggagacctaagaaaatggcgaagacttaatgggccagcatttggtagagaattgagtttcagggctgtaagtccatattcagtgtggcttttattttgcagttgtttgcaaaggtcagagaggcttttggtctggttcttttgatagtctcacttggactaaaggacatgatttggagtctgatatctgccaagaaattaggaccccaaaaggatataccccaggaataaagatgaaccaaatttaattacttcttcaaacagttttacaaatatatgcagcaaatagctagttttgcgtgagacaaaactacatgaagtcaggtgtggtggtgtgtgcctgtagtcccaactacttgggaggctgatgtggggggattgcttgagcccaggaaggctgcagtgagctgattgcctcactgcactccagcccgagcaacagagagaccttgtctcaaaaaagaaatagaagtacttggagaaaacatcaagaaactcatctgagaaacagagacaggatataggctgttgtagatccagtttactttaagaagtaagtgctggtggggtataatgtttcacgcctatgatcttagcactttgggaggctgaggcaggaagatcacttgagcctaggagttgacgatcagcctgggcaacatggcaaaacctcatttacaaaaaaacacaaaaatgaactgggcacggtggctcacacctgtggccccagctactctggaggctgaggtgggagaatcacttgagctcaggaggtggaggttgcagtgagctgaaattgcaccactgcactccaacctgggcaacagagtaagaccctgtctcaaaaacaacaaagtgctctacatcattccttaagtaaggaaagtcagatactgacattttaagacatttaaaaaagtatgcttactatatttagagagatgagataacttaaacagcaaactttaaaaagcatatcagaattccacatgcaaaacacagtagctaaaataggaactcaataggtttaacagtgggaagataggtcaggaaacaaatacgcatattgagggacagagacattaaggatagacaatgcattggtaaacctaactgaaaatataattattgcaggagcgaatggggcaataatcgagattgatgactttgcagaactgttaataaagtgttaactttaagcatgacaaaaataaccagttaaagatattaagactaggcactgcagcttaattagtgtaatcctagcactttgggaggcagaggtgggaggattgcttgagcccaggagttcaaggctgcacttcagcctgcataacagagccaagacgtctttaaaaaaaaaaaaaaaaaaaaaaagcgtatataattaaaacctaaaggcaattttaaaggcatcccaattaaaaagacttgacaatgcaaataatggaagccaggaggcaatggagtatgtttagaaagctgaaacaaaactgcaatttaaaattctaaactcagtaaaaacccttcaagaaaacattttcagacaaaactcgaaaaatgtgttagaaaatttaccagcaaacccaaactggagaaaaagttattttgttttttgagatggagtctcgctgtcacccaagctggaatgcagtggtgcagtcttggctcactgcaacctccacttgccgggtttaagcaatgctcctgcctcagcctcccaagtagcggagactacaggcacgtgccatcatgcccagctaatttttttgtatttttagttaaccaggatggtctcgatctcctgacctcgtgatccgcccgcctcggcttcccagagtgctgggattacagtttgtttcttaaatgttcattgcaaggtggactgtgaaagcatatcacaatttaaaaaaattgttacattagaattgttagattagaatcatttagtatttgcatggatattttgctcatacatggttttgtaagattttgcattggtcatttggaaaatatttactgagtcacgcaaatttttcaaatattgacctgccttacacaatatggaagactgatgcaaggatttctgaggaggagttatgtagatgggcctctttagatccagagtgaagatattagtgtcttgtatgaaagttcaccaaagggcattcatggtagacaaggcttccatgtgtcatctcgtgtaagaagaattgtaggtgttttaaccacgtccccagctagggtctcattgccagacgtgagtgagccttctgatgattatagctcccagtctttgagccctcccagctgatgcagaatgggacagagatgagctgtcccctccagctcctaccctaatggcagacttgtgagtcagataaataatgttccaagctactaagttttggagtggtttgctatgtagtagtgggtgacctgaacacttggctacttgccattgcgattgccaaatctgccattccctgatatggtgtatttcctgaggttacaagccagccacttggtgacaggttaattacgttggaccccttccatcatcaaagggatgccagtttttcctcactggaatagacatgcattctggatatctggatttattaatataatattaatactttccctgtctaatgcttttgctaacacaatcatccgtgaacccagaaacctttattcatggtattccgtgtaacattgcttctggcatacactatcagcctgagaaaatggaatgagctattgaggagtcagttgtggtgccagttgggagacctgaaaagttgaggttcttaattaaaggatgcagtatatgctgtgaatatggcccatagatggtgatctctcatggaatgcacaggtttggaaattaataggagtggcttctcactatcacaaaccaattacagaatgtgtgcttcccattcctgtaactttgcgttcagttggtatagaggttttggttcccaaggagaaattctgtcatccaggcaacatgatgggtcagttggattggaagttagatagctattttggtcatctcataccaccgagccaacaggcaaagaagagaagtactgtactggctgagatgatcggctctgattaccaagaagaaatttgggtgctgctatatacaatgaggagagaaaggaccatgtctggaacccagaggattctctgggatatgtcttagtacttctgtgttcctaggtaaagtttaatagaaaagtacataagttaaaaaacacaagaccactgaggtttcacattcttttaggaatgagttttgaagtcaccctatctggtgacaaaacaagaccaaaaccaaaaacagctgaggtgctggctgagagcaaaggaaacatggaacaggcaggaagaggaagaaatatcaactacatagggtcttaacgaccagttatgaagacaagatgaagacaaggactataacagctttgtgccttttttcatgttatagaataatcagatgggattacatttgaattagaaaagtaattaacattgcacagggagggatacagactgttgacactggtgaagaggatgagagtgtctacctttgtatgaaggatattgtatcttactaggccacagcatgaagtggtggtgttatgtggtgattaaaatatgtgtggaagggtgtatatggatgcctagcatcctaaggggaggactgagttggttatgaagtt

SEQ ID NO: 322 - DNA, 83336 bp, Homo sapiens
ctgccctttgtgacaatgaggatgaaccgggagaaaattatgctaagtagaataggccaggcagagaaacacaaatactgtactgcatgatcttacttatatatggaatctaaaaaagtcaaactcatagatgtagagagtagaacggtgcctaccagaagctggagatttggaggtagtgattatttgaatggggaaagggaagatgttgatcaaagggcacaaagtttcagttagacagaaggaataagtctgtgatctattgcacagcatggtgactataattaagaataatgttttatatatttcaaaattgctaaaagagtatattttaaacgttcttacataaagaaatgctaagtatctgagatagaaaatatgtcagtttgatttaattattctataatgtgcatatatgttcatatataacatctcctgaatatatacaattcaggatatatatatatatacatatgtctcctgaatatatacaattattgtcaattaacaataaaattaagaaagatatagcaagcaaaaaatactcctcttccactttccctcagtactttacaaatacatttcccactgcattcttatgaagtgctagtttagtaattagtaagcctctttatacttcaccctcattttaagtcaccgtttccatctattttcctttactgaaatctgcctatcctttcactctacagctttctcttaaggaggttgttatttttccattccctacatactaggggactgtgatgaagggtagcaatctcctggtttctcattgccaactccaggttggtttgcttccatggcctctagaaaaactaatgctattagaaggtggtctcttccatctggctctaccatcctctgatcatccctgtggctttgatttaccagcccctccaacagctggaccttgtatcatggtcttcgtcttaccccaagtcctatctgccacagttctaggagatgtaatatgaatgtagacaatacacacatggagatttaaaaaaaaacaaaccaccttccccctttcccccatctgactaattcacttgctcacttcttggatctttccataacctttagaacttattactcttctaaaaccttgagctccgatatctccctccaggacctcctctccttccctctttcacattccctcaccctaccctcatggctcttagactcctttaagtcctccagtcccttgatcctccacccccttgatcctccaccttcccccatcatccaggtccttcatggcttcattgttccccacagggctggatttctttgattgataagataaacttatacttccccaacatcctcaattccttgaggtcctatctgatcagacaagggtgaagggctgtcagaaaaaattacacgcccttgcagattggtaccatttctaattcatggtccctaatctgacatggtcaaatctttgtcatcttttctcaaactcattatgcaacccttatctcttactttgttaagaaaattataccatcaagagtcgtctttcttaggttcacagcacctactcttaaactatctagaggccccattcttacctcctttcttccagccccatgtctccattctaatagaggactatgatttctgtcagagcttctgatcccattcctctgggatcttgggccattagccatacctctcttagtgtcttccattttttcttctttgtgaacttcttttcacttgcttacaaacacgctcaaaactctctccttagtaaaagaaaaaaaaaataccccattgactacctatcctctgctgttcatctcccagtatctcctcccttttcatccagactttatgaagtacaggtttgttgtttcttttcctcacccacaggctgttcacactctctccaatttgccagagtttcgctcttgaggcaatagtccatgtgaattttgtattgggtatttgaaaaaaaaaattccggagtaaaataagggtgagagctctgtgtgtgaagaagtatttaaaagctatttgggttttaaattgtattaaaagtcagaaaatttaaaaacaagtcttccttaagcatttctgttcaacttacaaatctttttatactgtttacaagttgagtataatgagaaatatcacctttacttttttattgattactgtattagctatttttggattaacatttctaaattgaacagaataattttcctcaatactttaattatattcgattaaatattttaaacagtttttcaaaaatttgactttaatttttaagcatttcaaatgtctgacaggacaaatttacaatacctataaacaaaatgtttccgagaactcagataatgcttgaaataaaattatttatactcaggaaatataacaaatcaaagtaccttatataatctgataatatacggaaacttagtcaaattatttttgccttttagcttaaaatcaaacttaaaatcaattgcatattcaattggaattatgaggataacctctgaaattctatgtattttatatactgtataaagttttaaataagaaacagagtttttctttaaatttagcacaaatgctatgtttgctttatttcgacatttctatatttaattcaaaaccatcccatggtggaaaggcacttacctagagtgaccataaaatatatcttctaaactgggacacatttgagagggaaaaggggaacactaaaaataattaaaacttgttaattgatctacagtaggtataaaccaggactatcccagccaaaccaggctgatggtcactccttcctgatccaagtgtagggaatcacttacaatttggacgagcagagctttgtgggtcaagtgtttatgctcacaatatggctatataggtcagagatgtgagtgagaccagacataggtcctgagagcgatctgcttcctcagtgattccatctgtgttgcagggggacctctgaggttttttataactgttgcatcaaccagggacttcaagtttacaccatcaaagtgattttgtgattaattctttctcactttctttattgcctgatttgggtagatagaagttaccaccaccatcatcatgggttgcttttaatgtttccaagaggtcacaactctaaagtcacagggatgatcagaggatggtggagccagatggaagagaccaccttctaatagcaaagtcattttaatggcatctcattgtctttggcatttccttcatcctatttttctggctctgaaacaaatttttgtttttgctcaggataaaggtcattaacaacttcttaatcaaatctaatcgaatttattttttcttagtattaatggaccacatgattcattatctaaatgactgtctcctgcacttcaatttccttcatacccaacttccccgctaacaacacacacacacccctcacctctctaatttcttagctcatcccttaagactcactttctccaggaaaactctaaaagatgcccagctctgtgttttcacagtatctaaatttacccttatcacattgttttataatatttgacttctctttctgactcttctcaccagatcaggagtttcttaagggctcagagactatatagatcatacatctttccctcttagcactaagtttaaggaccagaacatgatggtgtagagaaactttcccgttggagacagggcatacaaatttatttcatgtgaacacatgggagccttcagaatgaagacccaaagatccagggaaaattttccatttttatgattagctttgttaacccaaaatatctgagacaggtctcagtcactttcgaaagataattttgcccaatgttaaggatgcatcggtgacacagcctcaggtccacgatcggccttccactgcatacacaatttagtctggttcagtgaatctgcatttttacataaacaatagggcagagaaagcaatcagatatgcatttgtctcaggtgagcctcagagggattactttgagttctgtctgtctttcgtccacaaggaatttccttgggcaaattgtgagggaggtatgtagcttcttatatttgtagctatctcttccaggaataaaacgggaagcaggtttgtctaacatagttcccggcttgacttttcccttggcttagtcattttttcccttggcttaatgatttatattccacaggttcaacaaagtatggacagccatgtagaaatatgattggacaaaaagggcatgacatactgctaacagactgagtggggaaacccagcaaagctgtctgtctagattcttcttggcctctctgtgtaggattccttccttatgggtatgagtcaggtctctctctggaatgggggtattataacccacagtcaaacaagataggtcagacaatttcttcatggccatattcgcatatcttttggttcttacccttcacacagaaaggcagagggaaggttagagaaatatgtttaggttttacggctggctttagggaaaagatcttctggtttctattatccaccttggggaagaaggattctagtttctatggtagcatcagggggataatgggcgtgaaagacaggcaggagaaggtcagagaaaaactttcgcttttgaggctgcttctgaggacttcctttttggggtgttgttatctgaatctcaacagtggaaaaaataataattaatcaagagtttagactttgcaattaggacagattcaggactgaatctcaattactttagttatataaatttgagaagacttcttaaatgctctgagcctcatgttcctcatgcaatgatagtgataataacaccaacacttgtcctttctcaaacatcacatcctacctagaatttaattatctcaatttaaggcttaatacctgtaaaattcataaacccctgggtgaggtaacattttaaggtgattttggcaacttaacaggtttgataggtttgattgacattttgatgggctagagagagggaagtcctgaagattccaaacggacaaggaagctttggggagaggcaaataagcagaaaagatgaagttacagcaattcaacttctctctctctcctcctctgtaaaatggaaattacattaatagcaatgacattaatatctgtgaggattaaatgaagaatatgtggctcttaataaatattagctgttttgttgttgctcttgaagatgctcagaagacaaatatgactttgttcccaatttgtttttaggattgtatgtacagacaacatatggatttgccagagaagaaaagcaatgcttttagacttatttcctgccttaagtttttaaagtggaataaagagcagtgggtcacataagagctcattatatgggtctttcatcatagctttagatcctgacacgctaagcagagattatgttgcatctgtgatattaaaatacatctgggtatctattactttttggcccttttctatacaaagcacagaagctgagaatcatgtctcttcagatcaagattgaacatactctctctttcactgagggaggtatagggttcagggcttaatcttacactttgcttatcctataacagaaataataatacctattattatttataataggtatgtgaagatcctgggagtccagggtagatggccattctgttaacctgaatatgcttttaatgtgcagcattaatctaagaaaagtgaaaaaatggtgagattttacttcaaaaaatccaaattatatgcaacttaagtcatcttcagtagagtttcagaaatgataggggagatacaatttgaagtgaactttgaagacaagacaaggtgatttgcaatgaaggatatttctagggtaaaagggactttgaatagaaggaacgaataaagaaaactgaaggagaacttgattctattgcaacaagaaacatatggctaattccaactatctggagcataccaactttaaagcagactgtcaaaactgaccctacttaactcattttaaagcatggggttcttccctcaaccaaaaacacagatgccaggttacactttataactggactctccactttcattaaaggtcattataaggaattgccacctaaaatgtgatgtaaatattttttgagaaacctagtatatcacttgcaattccctctataaagtacctgcaataaatgcatttttaatattagatttcagtaatattttcttcacttgtgacatactacttattttgttttatcactatgataatgggagaatggaacacttctctttgttttttgttcttatttccttaaagttttagagtaatagtcacatactaacctataagaaatttagaaaggttcaattaggccttctatgacaaaaatatctaagtctctagttactaaaatgttaatgtttatgttgtatcatggtctatactgcagagtcagggtaaagacacatagctgtattttttagatcaataatttgttcagttatttacaatcaagagtgttaagagaacttggattgcagacaaatctcttatacatttatccaattatattcaatgttttttcagaagggtaccttaggactggcctggtacatacttgcatatcttttgcttcttaataaacactagccactattttcttttcagtacattttttttccttcttgggcaggataaagagaagttgattattctgataattgcctgtggagaagtttctttggatacaattttattaagggcattgagtctctgagtttaacttttttcttcccaatgaccacactgtgcacaacgatgatgttgtggattttgaacctgaatttataccagttcagacatctttggcttcttcatgctggcataggcttgcctggctgagaatctgaagatgcaataatttttaaaatgtattactgtcattattataattagtttacttattgttcccccagatattttttcaacaatgttctgctaaatctagagtggctgcttgctaatagaactttagctttttcacaaagcttccaatgtgggaatctaatccattgtcaaaagtagtggccaaaatgtccctactcattgtggctgtgatacaggtgtattgtaaaaagatgtgattcacacaccattggggatctctaagcacacctccatgttatttagaatttttattttggcccaaatatctacaaggtagtggggagttatgtgagtttcttaggccatgacaacttgccagctttaataccttcagatgaggatgggttaccagccagcttgggcccattttgtagtacccatccaggacagacatactggtcaggggcagaaatataacaattcagtgggaaagctgatatggttggctgaggtgatacatttcatgcatttgtgtgaatacttcctcctgaagatttgatgattctggaatggtttggagacgacttcaaaaataacatgtttagtaaaagggaactgtaggacactgaagaaccactgctcaagacccaacatagtcagctactggtgataaccatttcagtactttgttggctaggacctagaagttgggaagacatttatgagagattatcaaaaagggagaagctgttggaatccttatactgtttcataatcagaattgttgtaaggtgacctagttcttgataattatctttagaaaagcaagggtacaggttaacagagggggatttataggataagaacagaagggcagggcaaaatctatgttcacaaatagaccgactctccttgtcttgttgacatagtaatcaaaaagggagaccactgaaaatttttgcgtattcaaaattattgaaaattttgtcttccttttattttagggcttgttaagaaaaaacatgacccaaaatttggaaataaggcaaaaatattactgcctaccttttcaaagatactgcactaaagaaagcactgtcccacaggactgcccaagggttatccaagtctgggtagcaaggggtcgtctgattcaggcactaccctgagcggaaaacaatggcccaagacctcgaccaaacccagctctccacctgtttttgtacagctttgaactgagaatgcttttttacaatcttaagtggttgagaaaatatcaaaagtagaataatattttgtcacatgtaagtttacatgaaattcaaactttagaagaatttcctcttcacagacatcacatcttcaagagcaaatgcttgagccctaacctgcaagttatagtagaaaagtccagaagtccagcctggtcctcgccaagtttccaactcctatgcctaggggtattttatgcttacaggatctaacttggttacaacgtctaacttttagcagagaggcagtgctgagtagaaactggacttgttaaccatatcaagtcacttaagttggctaggatcccctacttaggtagcggccataaagcctagggcatccctgtgccctcaatggttcacttctgagtggtgggcttcctgctcctcaatagagcaatcggcagaaaggcccctagaaagctacattgtcttcatccgcgaaggattccctgtctcctattcctcaaaggagcacccggattctactttcattcttcttttgccattgcattttataacttaaaagaaatagatgattgtaacagaagaaagaaaactttacattgtgagaaaatttagacctaaagcttatagtaatgtgaggacgaaagtctatactgtttaagtaaataggttctatgagcagcatccaggctaacatcacacagtggtattttgaattaaattgtacttgtgttttgtttccgtgttttgctgctgtaaggaaagaggaaagcatcccctttctcggccctcctcccacgtccaggctaatttgcagcatttctacatctcagagtccacccttaagatccttgccacccattattttgtttcagaacgcttaatccatcaaggaaggttaaattggattaccccagtagggaagggacgggggctgtaagcatgagggattatccctgtaaagggctcgtggtgtgtgtgtgtgtgcgtcctgctagtgttgaatgacggagacctgagtttggattctgaatccaggtgtattcgatgccgctccggcgtagaacgggttaaagatgcccccagccaggtagagccagactgggagttgtgcaaggtctcaaccccctaaaagcggcccctcaaattgaagatgagtaaatcatagttcgtaaatcagaaagattatccagtactacgttactctgtttatttccctttcgtcatccctgagtcttgggtcaagtccatcccagctctgtcctccaggaatcaagggaaatacgcaaacccgcggtgggttcgcagccgcaggaaggacaaatcttgcccccgccgcggcggccgccccgcgttagctgcctaagagaatctccgtggccggccagtacccgccttggtgaggattctccctcccgcgagaacttctggaatgccgccgggccagattttgcagctgaggcctccgacgccactaatattgggccaagcagggagtgctgctcttccttataaggttttagcgaaagttaagtaagccaattaaagtgcaaaacacacagtctggaacaatacagcgctctataaatggtctccattattatcattatccgttagttataactggggataaaaaaaaaaaaaaaacgacaaaaacctggagaaccggaaaggtctgcaaaaggggcggaacgcgggaacttcgatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgggagaactgcttacttgctcttttgtatgcttccggcttctttttcctccaaacgtaggccttctccgcgctgaagttttccccagcagcgtaatactgtaagaattctgagactttcttcgaaaaggagtacaggcgtccgtttttagggctgcactgtttggaggcctctggcttgaaactgctttgttttgcagccttgcaagttagagttcaatttccttgtgccctaggccctgagaggccttgatacaaggggtcattgtgcggtgggaagctttgtgctgaggagggcacgagttctgagagtagcagctggcttccctggggttttaaacacttctctcctggttagtattccgagagagaattacagcacgtaaagaaaaattgatgataaaacttaagacctcttctaggcagtttattactggctaagaatgcgttcttgtttgatttttagaaatttttggcctatgggataggaaggtctgcgatcttctccaaagcatctcgattccctacactcgactgcagttttcccgggagaaggcgaatttctgcggtcagtgtgtaatcagccagattagtttattacgcccttgcaggtttaaatgagccacttagaatgagaggaatggtgaagggtgttgcatccagacttatatatgaaacttattttgtcattttgaaaagaatcttgcatccagcaaatatttatagaaggcctctcccctgccttcattgtttggcggaaacaaggcagaaatggttttcatgaaactcgtgtgaagtatgtgacttctcttaggtgctcatctataaactgagaattttactgcagaatttgctaggagggctagaattatattgtctatgttgcacatggtagaagcttattaagtggtagtgcttataagtgggggaactgagattaattttgaatgatcttttccccaaaaattattaagttattgtgttaggtatcattaggccacaacttttcaccttatccttgcaggaatacacttcaagcgccattaaaaatggagaaatggtgtttaaaacagtcttactttaatctggttagcattctccctgccacagggtttcccttcaaattaatgcagtgcatttaagtgcagaatgggcaatgggattctcagagacctgatgtaaatattgaatagtgtgtatttttggtcttggcaagcttctggatataaaattaagaggtacatatggtgctaggactgcctgctgatttctcttttaatttagaacagatgacagctttgccgtagagattccatgatgccagcaccgtattccccagacttctaaggcaacattctgtatagaagatgtgaggtgccagtgtccagagcaaaataggttaataaaaaccacatcctattcccaaattatagaatgatggggctggagtgttccttcaagaccatccatatagccacacaaacccgttttgcgggtgtaaagttgaggcccagaaaggtcagctaagtatccagaattacacagctggacctagataatgacagaattgggcctagagcctggcattccaccaactagatgtgaggcatttctgaaatctgaagtgtggtctctgccctgttttcttgtgacctaatgcacaattaaaatgagcacttgatagaatgtccatcttgaagagggaggcagagggtatgcagaaagcaggctgcctccagtgcccactgcacaccacccaggtataggtataggaggcacatgtgtgtctgaaccccattggtgtcactggcaggtcctttgagaggttgctggatttaaatacagtaacatgtaacacactcagcccagttccaggtactcctttaatgtcagcccaagtacctctcttcttaaaatagagatattaacggggtggatcttaaattcattctcaattttagaggtgcagttaactcatgcaagtgaaagattccactgagttttggattggcagtatatttggcatatctttcaaatctagccatctactggtggaatcctattcaaaaatatttattgaatacctgctagacaatggggatgcagctttgagtaagcgaggcctttatttattttcttcaagtttatattctagtcagggtgggaaaccaactgacatgaaagtgaaacagcagtaagattccattgggtgaggggtgtcagaaaagactcctagggaggtggattttaagctgtgcagtagtctgcctccaaaatctgtatgttgaaacctaatcgccaatgtgatggtattagaagatggggcctttgggcgtgattggggtcataaaggtggagccctcatgaatggaagcagtgcccttacaaaagaggccccagagagctgccttattccctctactaagtgagaggacaccatctatgagccaaaacgtgggccttcctcagacactgaatctgctgtgaccttgaacttgctaagcctccagactatgagaaatttctgctgtttataagccacccagtcctaagatattttgttatagcagcctgaatggacttaagctgatagtgaaaatagggataaagggtaaagatccaagtgaagacctgaggagagagatgggggtaggagagcgaaaaccaagatgtcgcagaagtgagctcagtgtggtaggaatggaaatcacggatgcacagtgagaattgggtggatgcagctcataaggccatccttgtagaccgcgatcaagaattttgattttaaatgttttggaaactgttgaagggttaagagtgggaggcagcatttgatttacattttaaaatgattactctggctgttgtatacagaatagcctgtgggcaggggaagagctaagagatcaggccagaagtcttggtgctggggctgaagtctagggtgggagccatggaggtggtgaggaataatcagattggggatagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagagtaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagcctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatattaagggagatggacaagtcatggtttgtagactgtggaatatgggcctttacactccctgctttgctgtcttgagtgtggcctgcaagggccttcagcctgagagtccttgtgtggctatctgaaactgaggacaacctgcaggccccagttgaaaatcacatgaccaacaagccttcattttttttgcctagggacacaagggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggattagtaaaaatcttaccctataggtacagctgaggaagcagttaaggaaaatgtttgtatgcagtggattctggatcctcacctgtggttgtagtcatggcattccagcctgtgcctcaaaagcatctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaacctcatctctgcaaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaacacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccacgttttaaaaatttatggtctaggggccgggcgcggtggctcatgcctgtaatcccagcactttgggaggctgaggcgggcggatcacaagatccgaagattgagaccatcctggctaacatggtgaaaccccgtctctactaaaaatacaaaaaattagccgggcacggtggcagcctcctgtcatcccagctacttgggagactaaggcaggagaatggtgtgaaactgggaggcggagcttgcagtgagccgagatcgcaccactgcactccagcctgggcgacagagtgagactccgtctcaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttttttttcactgtgaaaatgctttctttggggtgtctttagaacatgtgatgtcaagacacaacagcaagcgcacatacactaagacatggctgtcatagaacagattgtgcgtgaataaagggttcacaccacttccaccctttacacagtaacagaaggctctaggccacctacctcctccttggctcactcaaactcttcctcctcagccgtggcctcctgctactgctggtactcagacaccaggtcgttcatgttgctttcagcctcggtgaattccatctcatccatgccctcgcccgtgtaccagtacaggaaagctttgcaccgaagtatacctgtgaactgctctgagatgcccttgatcagatcctagatagcagtgttgttgccagtgaaggtggccggacatctttagccctgagggtgggaagtcacacacagctgtttttatatcttgggggatccaaccaacaaagtagctgctgttcatattttgggcattaagcatgtgcatgtccacctccttcatggacatgtggcccctgaacatggcagctaccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgaggcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaacttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaacatgtaagtccacagacacagttactttataactaaggcagtactgagttgacacaaacttagagactcaaaggaatgtggatagaattgggccatcagtgcttgggtacttcatcccagttgtactttgctgtggagccagcaggtggcgacattggccacatcttggccctgctggcctccatcttagaggtccagtttcctgggatggcgggactcagttgctacacttgtccctgtatccctcgcacaatgtaggtttccgtaaacaactggacctagtaaagtgactggatgggcttgcctgcagatcattccagagcagtagccactcttgctttcatgtccagggctactacatgttccttgctgagggctgagttgccagctacctggtgcagagtcattatgcagccaggtggtgcagactgaagcttggggttgctgagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggctttgccacttaaggaaattgtggtggacagtcacaaattatgtaaccatgtcatgggaaacaggcagagttcttcagtaaaaacctcactaaattgtccttattttcttgtttgttttttgttgttgttgctttttttgtgtgtgtgttttgtttttttcaggaaactgagccagaaaggtaaccatttttttacgtgttgataggactcaacttgtgtaacctgacctgaaaattatttaatgcagatgttcactgaattcttaatcctggaatttttttcttgaggcctactttattttatttagttacccttgtgacaatagatttaaagcttttcattgaaaaacaacaatgctcaggtcacttcgcattaattaggtttctaataaagttagcctggcactgtttactctctaggaggtaccagcccaaggaaatttccctaatgatttgttacttatttttagttttaacagtttagttaatttttatttatttttgtaattgttcttgtttgtctttcttaatcatcaaattagatcaactctcagaggatagtgctaggtttctttaactcagacaaggactttcaagataatctctgaaaaatgcaatacaatgcatgaacttaaaaaaaacttataactaccttttgaattatttatatttgcataaatgtatttactgagtaatatacatgagtatgctatatgtatatttacaacatgtaaatatgaatttgcatacatatatgaatgattgttttcataaatgtatatgcgggtaacttttcatgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcggttctaagggtctttccagcctttgttacctcaagtcatttccatgatcatcttagacctggttaacacaagcagacatttccagtgctgaattcttagtgtcatgatggtggcttgttatcctttctgcctttcaccttcacacctgttctcaaacctgcccaataaccttgacacatctaaatttgaccagtctaccatcagagttccctggggtactcgttacaaatagatctgactaaatggtacctacacaggtgcccatggtaaccttgagtcctgtgaatctatgcctgcagagggatcaataagtaattgattaaatgattatattgataatcagatcttgcctcttctctaagttgtatcctcagactcttcagattccatgagtcctgttgtggttgaacaattataatttacatacctgtttttaaatcactgagttaaatgtcattttttcattgcatgcagccatctgatgccttaattttggggaagataaaaaatgttgattgcgtcctccttgcaaggtatggtattttaagctttttggatgttactactaaaggataatttaaatttaacttaaattctggaaagagtaaagatacaggtctgagcttttatatgttggcagaatcagaacatcttagtaacctttatttacaatgttttatttttggttaagttatattgacttaggagatcaaagatctcatgctcttgccccttacattgggaaagtagatcagatgactaaaatcaaagctctggttttagttctaactgcaagaagaaatgttttgttcatttttttcccccttcttataaagataaagaaaaacaatgcatcattaatgacctcttgctggtagtagttatatgtctgtgggaagtaggcttagggcttctgaagtgggttacttgtgtctgtgctgttgtttccttaaggaggctggtgctgctccatattacagaggaggccaagtcatttttatcccattgttagaagttagtcaagatatatgtatgagttctctactgttgtgtaacaaattaccacaaatttagcagcttaaaatagcacacatcatctcctagttcctgttggtcagaagtctggcacagcttagccagtcctctgcttggggttgcacaaggccccacaaggcatattcaaggactgagtccccatctggagcttgaggtccttgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctgaatgcaagtcccaggttcactgatcctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggtaagcagtcatacaaaatgctttaggctattgtagctggtcattttcagctcaaatggacgacgcgtgggaaccggcagggcaactgggagggcagtgccacagactcgcttgctttttttttttttttttttttttttttggagacggagcctcactctgtctcccaggctggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctgatgctttccctccccactcccccaaccccacaagaggccctggtgtgtgatgttccccttcctatgtccaagtgttctcattgttcagttcccacctatgagtcagaacatgcggagtttggttttttgttcttgggatactttgctgagaatgatggtttccagcttcatccatgtccctacaaaggacaggaactaatccctttttatggctgcgtagtattccatggtgtatatgtgccacattttcttaatccagtctatcattgatggacatttgggttggttccaagtctttgctattgtgaatagtgccgcaataaacatacgtgtgcatgtgcctttatagcagcatgatttataatcctttgggtatatacccagtaatgggatggctgggtcaaatggtatttctagttctagatccatgagaaatcgccacactgtcttccacaatggttgaactagttcaccttcccaccagcagtgtaaaagtgttcctatttctccacatcctctccagcacctgttgtttcctgacattttaatgatcaccattctaactggtgtgagatggtatctcattgtggttttgatttgcatttctctgatggccagtgatgatgagcattttttcatgtgtcttttggctgcataaatgtcttctattgagaagtgtctgttcatatcttttgcccacattttgatggggttgtttgatttttttcttgtaactttgtttgagttctttgtagattctggatattagcccttagtcagatgcgtaggttgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttccccatgcctatgtcctgaatggtattgcctaggttttcttctagggtttttatggttttaggtctaacatttaagtctttaatctatcttgaattaatttttgtataaggtgtaaagaaaggatccagtttcagctttctacacatggctagccagttttcccagcaccatttatgaaatagggaatcctttccccatttcttgtttttgtcaggtttgtcacagatcagatgcttgtagatgtgtggtattatttctgagggctctgttctgttccattggtctatatctgttttggtaccagtaccacgctgttttggtgactgtagccttgtagtgtagtttgaagtcaggtagtgagatgcctccagctttgttcttttggcttaggattgtcttggcaatgttcatggttccatatgaactttaaagtagtttttcccaattctgtgaagaaagccattggtagcttgatggggatggcactgaatctataaattacctatggccattttcatgatattgattctacctatccatgagcatggaatgttcttccatttgtttgtatcctcttttatttcattgagcagtggtttgtagttctccttgaagaggtccttcacaacccttgtaagttggattcctaggtattttattctctttgaagcaattgtgaatgtgagttcactcaagatttggctctctgtttgtctgttattggtgtataagaatgcttgtgatttttgcacattgattttgtgtcctgagactttgctgaagttgcttttcatcttaaggagattttgggctgagacgatggggttttctaaatatacagtcatgtcatctgcaaacaaggacaatttgattactcttttcctaattgaataccctttacatctttctcctgcctgattgccctggccagaacttccagcactgtgttgaataggagtggtgagagagggcatccctgtcttgtgccagttttcaaagggaatgcttccagtttttgcccattcagtatgatattggctgtggggttgtcataaatagctcttattattttgagctacgtcccatcaatacctaacttattgagagtttttagcatgaagggctgttgaattttgtcaaaggcctattctgcatctattgagataatcatgtagtttttgtctttggttctgtttatatgctggattatgtttattgatttgcgtatgttgaaccagccttgcatcccagggatgaagcccacttgatgatggtggataagctttttgatgtgctgctggattcagtttgccagtattttattgaggatttttgcatcgatgttcatcagggatattggtctaaaattgtcttttttggttgtgtctctgccaggctttggtatcaggatgatgctggcctcataaaatgagttagggaggattccctctttttttattgattggaatagtttcagaaggaatggtaccagctcctccttgtacctctggtagaattcggctgtgaatccatctggtcctggactttttttggttggtaggctattaattattgcctcaacttcagagcctgtttgttattggtctattcagggattcaatttcttcctggtttagtcttgggagggtgtgtgtgtccaggaatttatccatttcttctagattttctagtttatttgcatagaagtgtttatagtatgctctgatggtagtttgtatttctgtgggatcggtggtgatatcccctttatcattttttattgcatctatttgattcttctctcttttcttctttattagtcttgctagtggtctatcaattttgttgatcctttcagaaaaccaactcctggattcattgattttttgatgggttttttgtgtctctatctccttcagttcttctctgatcttagttatttcttgtcttctgctagcttttgaatgtgtttgctcttgcttctctagttcttttcattgtgatgttagggtgtcaattttagatctctcttgctttctcttgtgggcatttagtgctataaatttccctctacacactgctttaaatgtgtcccagagattctggtatgttgtgtatttgttctcattggtttcaaagaacatctttatttctgccttcgttttgttatgtacccagtagtcattcaggagcaggttcttcaatttccatgtagttgagcagttttgggtgagtttcttaatcctgagttctagtttgattgcactgtggtctgagagatagtttgttataatttctgttcttttacatttgctgaggagtgctttacttccaactatgtggtcaattttggaataagtgtgatgtggtgccgagaagaatgtatattctgttgatttggggtggagagttctgtagatgtctgttaggtccgcttggtgcagagctgaattcaattcctggatatccttgttaactttctgtctcgttgatctgtctaatgttgacagtggggtgttaaagtctcccattattattgtgtgggagtctaagtctctttgtagatctctaaggacttgctttatgaatctgggctcctgtattgggtgcatatagatttaggatagttggctcttcttgttgaattgatccctttaccattatgtaatggccttctttgtctcttttgatctttgttggtttaaagtctgttttatcagagactaggattgcaacgactgcctttttttgttttccatttgcttggtagatcttcctccatccctttattttgagcctatgtgtgtctctgcacgtgagttgggtctcctgaatacagcacactgatgggtcttgactctttatccaatttgccagtctgtgtcttttaattggagcatttagcccatttacatttaaggttaatattgttatgtgtgaatttgatcctgtcactatgatgttagctggttattttggtcgttagttgatgcagtttcttcctagcatcgatggtctttatattttggcatgtttttgcagtggctggtaccagttgttcctttcctccaggagctcttttagggcaggcatggtggtgacaaaatcctcagcatttgcttgtctgtaaaggattttatttctccttctcttatgaagcttagtttggctggatatgaaattctgggttgaaaattcttttctttaagaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggcgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgctttggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgcctatttttttaatcaggttgtgtttttagaactttctttcatttagtttccttacgtattttgggtattaaccccttatccgaggtatggtttgtaaacatttttttcctatctataggctgtctctttatattatgggaatttttaaacatatacacaaaagaataataatcagggactctctaagttcctaattcctagcttcaagagaacattttctttttttttttttttaaagagagtataaattagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcggaaggcatgtgatgtccagttgtcccttcataatgcgatcgatcaggtgccagaggtgctggggttttgtttattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtgagccgtggggcgagagcgagcattaccacctgagctccccatcctgtcagatcagcagcagcattagagtctcataggagcaggaacccaattgtgaactgcacgtggaagggatctgtgttgtgcactccttatgaaaatctaactaatgcctgatgatctgaggtggaagagtttcatcctgaaaccatcccctctgaccctctctgtggaaaaattatcttccatgaaatcagtccccggtgccaaaaagattaggggcagctgtactagggccaccccctcccctattcctggtagaaataattgcctctcagaatgctctgggtgaagacaggagcctcctgggctggatggagagtggagagtagcgcagagttaaatcatttggggatccttccacaatcccccatccaatcaccctgcctaccacctcagtccatgctgctcctcccatcagttatctctgagcttactgtactcacagcctgctcctagagcttctgctatgggagagagggttgtccagtccaggccactgtggcttctgcctttcagggattcattataatttccagtctatcagaagcattcttggttgtttcctgatggaatgaaactgttttgaaattgcccattctgtaggtcagaaatggttgaatatcagcagtttcatgtggttcaacctaataaataatggggttagactaaaatggttacatatttctcaccccaagttatgtccttataatgtatttatacctgacattatatatttgtgacctgtttccctctaagccatgtgagatcaaagtcactttctgcccagtttgcaccatatcaccaacacccacaacagttcctggcccatctttgctctgtcagtaatttttgagggcttgaacatagtcatttgaatagagagataggctggagtttgtgttttggagacatcttgatcaaaatctcaatggctgtcaacgtccatgtgtttggaggtaatagtttaagaaaatgattataatatgattgctaaatagagtggaatacaaaactccatattcaggatgatccagatgtataaagtattacagatgatactgtaaagtctgaattgggcactgagccttgggttaatctgttacttaaacagtatgactatacgctgttgcatttcccagatcttttactcacatgtcttaaatgtagatgtttcacatactggctctttcaagaaagcagttgggtcagaagatggagactagaaagaaaacaggtattgccatcagatctggtttcattctatcttagccaggtaaccttaagatcttctactatttttctgtttatgagacatatggataacctgccctcttaatgtttccttggaagttcaaagtctctaataagtgccttttgtgggatcttgcatgtgttaaccttctcagtaactgagtgccattattgagagtgtgtgcatactggctggagggtccactagttgacactactttacaacaacaggaggaaagaatctgttaaaagaaggatccctggcagggtgcagtggctcacgcctgtaatcccaacattttgggaggctgaggcaggcagatcacctgaggtcaggagttcgagaccagcctggtcaacatggtgaaaccccgtctttactaaaaatacaaaaaaaaagtagccaggtgtggtgagcacctgtaatcccagctactcggaaggctgaggcaggagaattgcttgaacccaggaggcagaggttacagtgaaccgagattgctccattgcactccagcctaggcaacaagagtgaaactccatctcaaaaaaaaagaaggatccctaagagaatataatttagcatgaaatctcaatttttacattgattacttatttggggtgataacgttttgaatatattaggttagacaagattttaaagttaattttacctgtttctcttttactttttcagtgaccactagaaattttaaaactatgtaggtggctaacatcatattgctgttggatgcatcttttaagtgctgctgcctttgattgagctgagtgggttccagttaaccaggcttgagcacatatatcattcattatgtgtttgaacatctcatagcagaagatgccttgcatatatatcattcattatgtgtttgaacatctcatagcagaagatgccttgtggttaatgccctctatgtgttttactgatagcacatttcttagtaaagtgaatcttggtgtattgagacgggcatctcctacctccacttgctgatggcatcagatacaaataggctgtgccatttttagcctggggtttcccagagtcatacccacagccccaacttgtttaacaggattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgttttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatagaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgagggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaatgagacttagagaaatgtagaagcatgactatgcatcactgggcctttgcttagtttttattcatcagccatggagaagaaaggcatgactctttcctgcctcccacacccaccggacttgtaaagctcgacttcgatgatgcattataaagtggtgcacaggattggtttttaatgagatttttgccattggagcaaagcaagactgtttccctgccagctgctttattcaagtcatgaggcattttgttgtctcctcctgtacttgtggtacatgggccctccattttctagcccagttcttgttagatacctttgcacattcatttgtatgtatggcagaactgatgatatggcctttctttcacccccaactactaactgtccatgccattaaagatacatggacaggggattccagcaatttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaattttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattatttcttcaacttattttcttggtagaactgggagaggttcgactttgcttttgtcacgcattcttactcatcaggaaagtcccgctataaacacagtgctgagggatcagttatgtcagtctgtttccttctcccagagaccagccctgccttgggcttcccctagaactttatgtcatagcataaaggcccgtgtctgggccctgaggttgggagtatgctctgatgtcaagtatttgatcattctctttctgcctcttgatgactagaaagcgttttatggtaaagagttacgcaagaagcctttgtttagctctttctctcattgctaaaaatagtaagctgtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgtttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccatacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaaattaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggactttataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaacagtccccactttgtggggtgtgatcggcaggcttattccaggcttcttgctgagttataaaacttctgatttatctgatagagaccttcagaaggaggactggtgctattaaaattatacacatttcattctggaatttcttttgagggcatcatccactcccctcagctgtgattgtaaacctcattgctcttggtcagaatttcattcagcattaacaatgacacatcctgttatgctgtgcaggtgtattgctgtttataggaatttaagtttagatcattaaatgtttcaatactgaatgtattgacagttaagttgatgacgcagaaaactacaaatagctgggcaaactataagaggtgtttctcgtctgcaccttcccttctggtatcttgatagtatagcccaaaaatggttttaagcccttgcttctcccccagggctaccctctttgcttgcaccttacaaggttgagtgttgtgaggccccatctggtgccgactccaattctgtctctagcccagacccacacttgtgagctgctatgagttatctgggcatcttggttgacttaatcttcctaacatccttgtaaataggtggatgaatactatgttttatgattggaaaatgaagaatcaaaaagatatggcaatttggtttaagtccacatagctagtagttagggagctttgttgagaaagaaaaatgcatgagaggaaattaagactgtagttaataattatcaggtgcatattaacgttgcatgaagcttaacttaaatacatgttattcttaaggttaaaaagttcaaaacaaaggcgggggttccaaggcaaatgggtggggatagacaggagatgggcagaggtagatgaaatgcgggtgttatggtgtggaagtcagttggagtatagccactggaggcttttgtggccctgttcatatcatagttataagtgggatgttgctaatgcttgactcatcaaaggctgaaacaaagccagagctgaagttgagtacgtgtcaccgttttattggttaatctttcaaaaagagaaaagcctctgtttatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggaggatggaaagatggccttaaaataaaacaaacaaaaaccttttttgctttattttgtaggaccactatgagacctcagtccttctatgatggaagtcattcttgtgccagaggagtgtgccatattccaatggctgagccgttttgccccaaaacgagagaggtgtgtagtctttctggaaggtgtaccagaataaatcatgtgggcttggggtggcatctggcatttggttaattggcagagcgagtggccccataccctcactcaagtttgctttgtattatgcaaagttttatgaagagttatttcctgttgctaataatttcctgttcctctgttactctcagtcattttaagctgaaccactcaaagttgcaacctacctttttaataagttttgattttgctatctagataaaatgatttaacatagaatatcacattactcaagagtatgcagtctggagccagattacttaggatcaaatctctgctcttcaacaaagtagctgtgtccaagaggacaaattatttgacatatgtgggtttcagttatcttacttctaaaatgaagataattatagcatgtaccttataagactgtgtgagggatgagagagttaatacttaatgaagtctctgaaccatgcctgtcagttatggaacatccaatggctggtaactgcttttgtgaattaaattactattattgatcttctaaaaatggtcagattggcagctgttgcctttgacctgagtttggccattactgcccagccttctgtctaccattatagccaaatcacagaactatggggacagccccacaagggccagtggtggtataaggggtggaatcacagttttagttcccaagcaacaaaaatggctaccatgactaagaagcctatggcttggtccacatgtgctacttctcttataatcccaggtttgaaagtcaggtgcaactcaaaagatcagaagtatcgttagagattaactgcttcataaaatctcccttatgagttaacttagagaatataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggtttttttttttttttaaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaatggagctgtatagagcacatgtaaatgtgggtctgtggtgataatttccagtaatccaagttagcctcccttgaagccaaattaattcagcttcataaagactgagagaatactgggaaaggcaatttaagaaaatggcaaaataagcattcagaaagaaatttttaaatattatccaaaaacatgaagagtaaatagtgctgccacttggtaattttcacttttaacatccacatgatctttcatgtactgatggaataggactgtcatgatgaattgtcaagtggcaagcaagatactcagtggttgtaccatattctaccatttatgttaaagtatgtatatatacaaagaagtaagtatgtaaatatttatatacaaataaaatatttttggaaagttaacaaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacactatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaacctgatggtatttccctacccaccctggtagccaaacacaaaatatttattgccctgcctattgcctgggaaaccaaaatagttaccttgggcatcttagggcaagcttagagccccctactccttctgcagctggtgctctcttgaaagtgccacctcctggctggaggccagtcaactgaggccattacagcaactcataaaacaataaccctgatcccaggacggaaaagacaacacctaatttcactgcctgcaacatcctggctaaccagagatcctgaatatgtccacatgacaacttcactgctagcataagcagcattcaagagagccagcacattaaacatatctacaaccaatgactcttgcagagtttacttcacttccctgccacatctaccagagcaggtgctagtagccacagcttggagacctgaagatggatcacatcgcagtactcattgcagacatcccccagcaacagcccagagcctggtggcctcaatgggtggctagacccagaagagcaataacagtcactgcagtccagctctcaggaagccccatccctaggggaaaggggagagcaccacatcaagggatcaccccatgagacaagaaaatctgaacagcaggccttgagtttcaacctctccactaaaatagtctaccaaaatgacaaggaaccagaaaagcaattctggtaatatgacaaaatggggttctgtaacacccccaaaagatcacaccagctccctagcaatggatccaaaccaagaggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccaacactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatgaaattgaaacaaaaaaatacaaaagataaatgaaacaaaaatatttgaaaatttaaaattgatagaccattagtgaaattaaccaagaagagaaaagatccaaataagctcaatgagaaatgaaacaggagatattacaaccaataccacagaatacaaaagactattcaaggctactatgaacacctttatgcacacaaactagaaaatctagaggagatgagtaaattcttggaaatataccaccctccccaattaaatcaggaagaaatggaaaccctaaacagaccaataacaagtaggaagattgaaacagtaattttaaaaaattgccaacaaagaaaacatccaagaccagagggattcacagctgaattctatcagacattcaaagaactggtaccaatcttactgaaactattccaaaagacagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcaatagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatcaatatactcaaatcaatagcacttttatagaccaacagcaaccaagctgagaatcaaatcaagaactcaacctgctttacaacagttgcaggaaaaaaaaagtaaaatgcctaaccaaggacatgaaagatctctacaaggagaactacagaacactgctgaaagaaattatagataatacaaaaaaatggaaacataccatgctcagggatgggcagaattaatattgttaagaattcttacaaaagcaatctgccaaaaagcaatccacaaattcaatgcagtttccttcagagtaccaccatcattcttcacagaaatataaaagtatcatatttctgccaaaagcaatccacaaattcaatgcagtttccttcagaataccaccatcattgttcacagaaatataaaaaaaaaaatcctaaaatttatgtgagaccaaaaaaagagcccatatagccaaagcaagactaagcaaaaagaacaatctggaggtatcacattacctgacatcaaactatactacaaggctatagttatcaaaacagcatggtactggtataaaagtaggcatgcagaccagtggaacagaatagagtatccagaaataaagccaaatatttacagccaactgatctttgaaaaagcaaaacaaaaacatacactgaggaaaggacaccctatttaacaaatgttgcaggataattggcaagccagatgtagaagaatgaaactggatcttcatctctcatataaaaatcaatgcaagatgcatcaaagacttaaatctaagacctgaaaccataaaaattctagaaaataacatcggaaaaacctatctaggccttggcttaggcaaagagttcatgatcaacaacccaaaagcaaatgcaacaaaaactaagacaaatagatgcagcttaattcatctaaaatgcttcagcacaacaacaaaaaataataatcagtggaataaatgaccacccgcagaaagggagaaaatattcgcaaactatgcattcaatagaggaccaatatccagaatctacagggaactgaaacaaatcagcaagaaaaaaaaaaaaggtcgctaagtacatgaatagacaattttcaaaacacatggccaacacacatgaaaaaatgctcaaaattactaatccaggaaatgcaaattaaaaccacaatgcgataccaccttactcctgcaagaatggccataatttaaacatcaaaaaataatagatattggtgtagatgtggtgtaaagggaacacttttacactgctggtgtgaatgtaaactagtacaatggaaagccatatagagattccttacagaactaaaagtagaactaccatgtgatccagcaatcccactcctatgcgtctacccagaggaaaataagtcattatatgaaaaagacacttgcacatgcatgtttatagcagcacaacttacaattgtaaaaactatggaaccaacctaaatgcccgttgaccaatgagtgaataaagaaaatatggtatatatacagcatgggtgtgatggttaatactgagtgtaaacttgattggattgaaggatacagagtattgatcctgggtgtgtctgtgagggtgttgccaaaggagattaacattgagtcagtgggctgggaaaggcagacccacccttaatgtgggtgggcacagtctaatcagctgccagcatggctagaatataagcaggcagaaaaatgtgaaaagagagactggcctagcctcccagcgtacatctttctcccgtgctggatacttcctgccctcaaacatcagactgcaagttcttcatttttggaactctgactggctctccttgctcctcagcctgcagacggcctattgtgggaccttgtgataatgtgagttaatacttaataaactcccatttatctatctgtcccattagttctgtccctctagagaaccctgactaatacagattttggtaccaggagtggttctagaggaacagaatattaaggatggagttcttttattggtatgaggtttctggagttgactgcttaatatgattagacccaaagatgctaaggactctacttctaataatatggataacaccaatagtccttgacttgaactgtttagagagttatgcaaaataaatatatttgagactcctgattcatcactcgtgagaggcaaggactctacataatacctttgaccatatgtggaatcacccttagtgactctgtacataatacctttgaccatatatggaggaccagggaacataatgaagctggttggttgctcctaagttcagtggacaaagtgatgaaagaaaataatgaactcagggattgtatctcccagctccagcagcagatactgagcctcagatctgctaagattgttctgaatgaaagacttatctcctgtagagaaagagctgaaattgtggaaaaacagacacaagctcttatcatgtgagtggctgacctgcaatgaaaggtacatgcacagcctcgccaggtgtctactgttaaagtgagagcattgattgaaaataaatgggaccctgcaacttggaactgggatgtgtgggaggaccctgatgaagctggggacactgagtttgaaaactctgatgaaccttatttaccagaagaaacagctttcccatccccagaagtggcagcatcccctccctgacctatgctgccatcagccttttcacctttgtctgaggagataaaccctgtgcggcctgaggcaacagtgatggcctcccctgaggcagttgccaggcaagataatgttgattcttctcaggagccacccctaagactcccatttgcttctagacctataactggactgaagttccagcaggcccctagaggtgaggttgagattgtgacccatgaggtggtgtgctacactcaaaaagaaccgcttgagttttctgatttatataaacagaaatctggagaacaggcatgggaatggatactaagggtgtgggataatggtggaaggaaaatggagttggatcaggctgaatttattgatttgggcccactaagtagggattctgcatttaatgttgcagctctgggagttaaaaaaggttctaattatttacttgcttggtttgctgaaatatggattaaaaggtggcccactgtgaacaagctggaaatgcctgatctcccttggtttaatttagaggaggggatccaaaggcttatggaaattcagatggtggagtagattagtcactttagacctatttatccctgctggtccagaaaatatgcccttgaccaatgccttgcaaaacagatatgtgagggcagcactgggatctttgaagagccctgtaattgctcttctctgtatgtcagatctaactgtggtaatgtcagatctaactgtgggaaccgcagtcactcaactacaaaacttaaatacagtgggaataattggattccaaggcagcaggggccatggcggcactcagctgtcaaaggcaaggtgggcatagctaccataatgggcagcagaggcaaagcggcaatcagaacagtctgactcgtgtaaagctctggcactggctaattaatcacagcattcctagaagtaaaattcataggaggcctactgcattcctacttaatttacataagcagaaacttctaggtcaaatggacaaaaaactaatttgaattataaaaacagactcacagcccctcaaccaatttccagacttgagctagtttacagacccagaaccccttgaatgaaggggaggccaggtcccgttgaggaaggaccccactatattaccaacaatttatgctgtgaatctttctcccgtccttccccaaggagacctccgaccttttaccagggtaactgtgcactggggaaagggaaataatcagacatttcagggactactggacactggctctgagctgatgttgattccagggaacccaaactgtcatgtggtcctccagttaaagtaggggcttatgaaagtcaggtaattaatggagttttagctcaggtctgacgtgcagtgggtcttatgggtgcctggactcatcctgtggtcatttccccagtgccagaatgcataactggcatagacatacttagcagctggcagaacccccacactggctccctgactggtaaagtgatggctattacagtgggaaaggccagatggaagccattcgagctgcctctacctagaaaaatagtaaagcaaaaacaataccacatccctggagggattgcagagattagtaccaccattaaagacttgaaagacgcagggatggtgattcctaccacatccccatttatctctcccatttggcccatacagaagacagatgggtcttggggagaatgacagtggattacaataagctgaaccaagtggtgactccaattgcagctgttgtaccagatgtgatttcattgcttgagcaaattaacacatctcctggtacctggtatgcagccattgacttggaaaatgcctttttctctatatctgtccataaggaccaccagaagcaatttgccttcagctggcaaggccagcagtataccttgactgtcctacctcaagggtatatcaactcttcagttttgtgtcataatcttattcagagagaacttgatcgctttttgctcccacaagatatcacaatggtccattacattgatgacagtacgctgattggatccagtgagcaagaagtggcaaacacaccagacttattggtgaggcatttgcatgccagaggatgagaaataaatctgactaaaattcagggaccttctacctcagtaaaatttctagggggtccagtggtgtggggcctgtggagatactccttctaaggtgaaggataagttgctgcatttgtcctctcctgcaaccaagaaagaggcacaatgcctagtgagcctatttggattttggaggcaacacattcttcatttgagtgtgttactctggcccatctattgagtgacccaaaagggtgccaattttgagtgggtccagaacaggagaaggctctgcaacagttccaggctgctgtgcaaactgctgtgccatttgggccatatgacccagcaaatccaatggtccttgaggtgtcagtggcagataaggatgctgtttggagcctttggcaggcccccataggtgaattacagtggagccctctaggattttggagcaaggtcctgccatcttctgcagataactattctcctttcgagagactgtccttggcctgttactggactttggtggaaagtgaacttttgactatgggtcatcaagtcaccatgcgacctgaactgcctatcatgaactgggggctttctgactcatctagccataaagtgggttgtgcacagcagcattcagttatcaaatggaaatggtatatatatgactgggctcaagcaggtcctgaaggcactttgctgtgcccgtgcatggcctccatccttgccacctggacactttgggctcctcctgcctttaagtcaacaggctaagaagggagttacagtgctggctggggtgattgacccagactatcaagatgaaatcagtctactactccacaatggaagtaaagaagagtacacatggaatacaggagatccattagggtgtctcttagtattaccatgccctgtaattaaggtcattgggaaactacaacagcccaatccaggcaggactacaaatgacccagactcttcaggaatgaagatttcagtcactccacaaggaaaaaaccacaacctactgaggtccttgataaaggcaaagggaatacagaatgggtagtagaagaaggtagtcatcgataccagctacaaccatgtgaccagctacagaaatgaggactgtaattgtcatgagtatttcctcctccttttgttaaaaacatgtttgtgcatatatacagttgtactaagaaaatatcttcattgtattttctttctcctttatcatatgacatgagatttattgacttcacatcaacatttaagtattgctaactttatgtagtagtatttgggttggtgtttggtgcatttccagttgcacaaaggatagctgtattatgttacgtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtcccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgggagctaagctatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttctattcattttaggagttaatatgaaagtcctgacattaaatctgtttaggctggtgatctaatattgctagttccttggtgagggttgtggtactttcactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaatatgtgtagaagctgccagtattaatgattgttagaagaccagcttagtgcatacagtgtttacagcgcacctggcatgcttctatgcttgtatataccttagttcatttaatcttcctcatacaattgaattatgcgatatcattattctcaatttacacttgagaaaactaaggcatacagagatgatttttcaacagtgcttcagtaagttaacagttaagttgaaaagacttttttttaattaaaagggaatattgaataagctaagaaaaaatgaaggtaattaataacttgaagattagatgtgcagtattaaataaaacactggagaaaaggatcgaacttttcaatgatgtttctaaaaatccatgcctagccttgccactaaaggaattccaagatgtttatccctgtgaacagaaaaacaatcagcacaactctgtggaaaggcaataggcaaaagagaaatcactttctaaccagcaaaagcttttacagaagtcttcagattctgtatttttaaaagtaatgagaattaacttttcagaagcctggaaatagaactcaacacacctgtttgagaagataagcgacgagaggcaccttagcttagcctgcgaggttaaaagttaagactccagtctgtattctcaaaccagcttagtctcttaaagttgttaagaagcaaatgagattaaagcatataaacaaatgcctggcgagtagaaagagctcagtgcttgcttgtgtagctattagtttctacatgcaaagggctggggaaacaggattatgtgaatgagaaagggtccaggaaacacccttctgtggtcctctaggttttttctgagagcctggcagatagtaggcatttattatagtgacaaatcatctttaagaaatcaacttggtaaacattggggggaagtgcagccttaagttgtgcatgtgctagtatgttttgaagtttctggtttttcttttctaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaagaaatagaatggtgaggtacaagggtacactaggtcaactgaatagagttgaccagaccaaatatttgaagtatgagaagccttcctgttttaagtgtgatgggcaagaagggcatgattgagtagagtggaaaggagggagactggggagaagggagagagaggagggatgcaatacagtagggccaggccatacagaccatggtaagggtttcagatggaaggacagtgaggggttcaggcagggaaggcagcaggatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatttatctcattttaagataaagggacgacaaaactgcagtcacttttgaagtaaggaaaacatttaggggtgactttctgagcacatttagggtaagtgacatctccaaagaggcctaatattgtaccaccgttttagagagtttgttttactatctaatgtgtacagtgttttgggtcatagatgaacacaggttctttgtttttcatgaattccttatgatgactcttcagtgtaataaactgtttgcttagtactaggatgccttttatgtaagagattcgcaaattattacattaagtcacaacataatatcttatttggcagctttggtaacctaaggaacaactcagcctcgtaatgtcaagaagctgcttccaattaataggaaactccagcccctgccacaccctgagagcggtttgcttcctgcctgtggctttctgctcagtctaataacatatgtctcctcctttgtagaaccagcagtgatttcctttagtagccaaatgaggttggggaaatagtcagctggagctactttattgaaaagcagagaaattaagctctgtaagtggaaaggcttgaagacagtgttaaatgctacaaggaaggcccacagaaagatggcattatttcagccaatcgtgtgttgcagcctggcatggcaaaaaggatttggagttctctaaacccatcttcagatttgagttgctccatttgcttgtcacattgggcgagttatttcacttgtttactcttctgtagaatgaagccagggctctgggtgaggagtggaggttgtttagtcattgtttagtcagttagaccttgaaagattactggaagaattaaaccaaatgagatatgtaaaaaagctagtataatgctggcttgtaagagggtggtcatcagatggtggctctgatggagtggggggcctgagaggtgggtagtatcagggaaaagcatttaaactgcaccttgaagagagggtttattttgggaaggtcagtaggaaggacattttgggtgaagcccaacagctggaacaaagagaagggaggtcagtgtctatacagaaataaccagtcacaggaaaaatatataaggaaatgagtaaatacaaggcaaatttcttggatgcttcatgtctgcattcaaagactcagcttaaaacatatcatttacatgtgcctggcagatacccagcctgtcactgctttgtgttcccatagtagtgcaaactcccctctgctacagtgttcatcattttttcctatacacatcttggtgtttgtgggtgggatctggactatgcttaaggaaatagaaagatgtaatccttgtgtccctgaatgctggatttcttcgaagcataggaaggcatgtcaagtactctatctctgatggtaattttgtgttcactttcttcaactttttcttatgaagctattttagtcatatacagaagtagctaatagcacgagcttccatgaattcagcatctagcttcaaccattatattaacttacaaccaatatgattattactcccatcaataattttatccataaacacttcaggaggtatctaacatgagcacattatcattttcattctccaataataattctttaatatacccagccagaatttaaatttctggttaaatgccttaaattattcttttggttgcaagctttttatgaaggaaccagatcatttgtcctgttgagtttcccacagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaacccattatacatctgagatattttctccgataccatattgaaatctgtattagtctgttatcacattgctatggagaaatacctaaaactgggtaatttataaagaaaagaggtttaattggcttatggttctacaggctgtacgggacgtgatgctggcatctgctcagcttctggggaggcctcaggaaacttccaatcatgttggaaggcaaaaggagcgaggcatctcacatggtgggagcaggagcaagagagagtgagaggagaggtgctgtacacttttaaacaatcagatctcacaagaactcactatcagtaaaacagcacctgaggatgctgctaaaccattcgtgagaaatccaaccccatgatccaaccgcctcccaccaggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatcaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaattttaagttctagtaacctccagtgctattgtttctctaggtttcggtggaccgggtcttaaagaccctgaaagaaaacgctaataaagccaaaagcttactgctcactaccatacctcagatagggtccacagaatggtcagaaaccctccataacctgaaggtaagtgtcagccatggacaatcaggcatgtctgtagactctctattgtcttcttttcttacttgcatttcacctttggtcctcatgtattttatgccagcctagatgttttcaacaagtttttgtgacatctactactaccataccaaccacttgtgaaactgagtagtcttattttctggctggtagtgcaagaccactgaaggctagggttgagagagttttattatctcgtgtaccagattcttcacattgccctgctctgtagtatccctaagtcttacttcagaagattgatagtgctttctctgcatatcgcttacattgttgacaaagctattttctctttggcagatccattcaaatttgtggcaatcctttaaagccaaaactctgacaatagtaccaaaatggtgccagaaaatatctgcttaaggttaatcatgcatcaaactaaacagtaattaatgataaaccaactctagtattctcagaatataatttaaactaactgataaactcggagttgcatgatttttctttgggcactttgtgactcttcttaaccacatagggaaagacttgtctcaaactgatcagatattgcattctcctactatccaaagaggaccataccccaaagtctcctagaatacacctgtacttttgggtcttctggtggtggtggagagaggatttgaaaggttgatctaagccctccttacctgaattaccacctaggagctctgtaatgagagagccacagttttagtataatgaggacattgtatggtggtaagtgactgccaatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattagaattaaaagggaaaaaatacatttgagtgcagtcaaatggcacaactggagcttgcataaaaaaacgcatgttggtttgccagaaatgtgactcctacttgtactattgttagcaaaatgtcatagaagtttgtttgtttatttgtttgtttgtttgagacggagtctcattctgtcacccaggctggagtgcagtggcacgatctcagctcactgcaacctctgcctccctggttcaagcgattctcctgcctcagtctcctgagtagctgggattacaggcatggaccaccatgcccagctagtttttatatttttagtagagactaaacctagtagatgaccaacatggtttcatcatgtcggtcaggctggtcttgaactcctgacctcgtgatccacccgctttggcctcccaaagtgctgggattacaggcatgagccactgcgcccagccaagtttattttttttaagtctcccaactaaccccactttgaccatagtctttcaaaagcttgaagttaatttctcaaataatatatttactgttttagctttatttttaagtaaaaatgcttgaagagtagaaatcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaaattacaagtctttttgtgaacatattttcacttgtgcaaatgcctatactcccaccagtaatttgtaagaattcttgacaaagcttggtattgtcagcgtttttaattttagccattctattgggtatattttgatatctcgtggttttgatttgcatttttctgattaaagatgttgaacttcttttcatgtgcttattggccattcacatatttcgtgaactatctgtacaaatatttttgtttattaaaaaattagattgttttgttttattattgaatagtaagaattgtttatatattctggatacactctttttcagatatgtgtgttgtgactattcttagtctttagcttgccttttcattttcttaattatgtctttcaaagaacaagtttttcattttgacgaagcctagtttatcaattttttttatggttggtgctttttgtgtgttccaagaaatctttgcctactcatttaattacctgtgtgcccttgtcaaaatcatttaattttgactactcacttaattaccttgcctactcatttaattacctgtgtgcccttgtcaaaatttactgtttatctgtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttcagtagtagttcttatttttattttattgcaagtgccttagggataccttgtgtacacaatcatgtcatatatgaataacaacagtttaccttttgtttcttcttgctttgtcgtaatggctaggaccttcaacctaatgttgaatagaagcggtgtgtgagttgttactcttgtcttattctcaacagcagaggatagcgtctagtttttcactattaaaatatgttagctataggttttttccgtttcatgtttttatcagattgaagatcccttttattcctattttgccaagagtgtcatgaatgcatgttgaatttcaccaagtactttttcctgcatctgttgagagaatcttgacttttctcttttattttgttaatgtagattctttaatgttaaactgatcttgcattcctgatataaaccatacttagtcatgatatgttatcccctttatataatgctggattcggtttgcaaatattttgtttgatttttgcatctatgctcatgagacagattggtctgtgattttcctttcttgtaagtcttgtcaggtgtcagggcttggttaattttgacacatttacaaacatatatttttaagataaaaataaacttcaaaaaaaaaaagatgacgacagcctgagttgtttatatacagaatttgttaaccaaaaagattgaaaaaggctggaacagcaggttacatttgatacctgaaaatattttgcagctataaatgcatcttggaactgttataggcaaaagcttgggaatggctaaaattctcagtgtcataggatgttttaaataaactaaggtacatcaattcaaataagtaatgtgcagttgtcaaaaagaatagatatctgtttatgcaccagtatggaacaatgttcatgacaaaaggggaaatcaaaaatacatagagtaaaataagtttgtggtgatgtatagataggatgtttatacttcatatttccagaaaggttctggaaagaaacttattgatggcttctgagggatgaatcaagagacttaaactgtctacttcatacctttctatagtggttgaatttttcaccacaggcaactgttcctttaattgatatattttaaggaatggatactagaggagacctagcttcatagcagtttatgtaacatgagataaaatatatgattcttggcattaacttctgataggttgtgcttggggcactatatccagttctgggcacaatgctttcaggaggatgactatctaaaaagcaccaagagaagagtgaagggactgaaaaaaccatgccacatatgtaatacttaaatgggttaagtatatctaactacttaggagaaagccttcaatgagaactttgtttaggggctgtcattctcttacagacatgtgcctccctcactgttctgtaagcttttgtaaaggcaggagttgtttttttaactcatcagtttaggagcctcttttccttgtatttagcacaaactcaacaaatatttgtgtaaataaaaatctgattacgtttctttcctacttaaaacccttcatcagctctcccaaacacctccccatgttcactttcagcaggtgactttagttccctcttcacagacagaactgaagcatcagcagaacactttcaagacccccctctgctgctctctcccaaactgttttccctcctgttaccatctgtgatagtgcttctcaaacgggagcacgcatcgtcatcacctggagggcttattaaaacaggttgcatggcaccaccccagagtttccgattcaggatatctggagcatggcctgataatttgcatttccaacaagttcccagatgatgctggtcccactttgagaactactgtcatagatgtttctccctgatcattgtcttatgcaccagaccccatacctcacacctagtaaggacatcagtctagtaactacccatttcataatcatttttctccttattattgaatcactttttcagcacacaaatatactttatttctcccattaaaattcttgaccccaattctatgtgctggctcatttttaagcttttcattggcataaaatccctcgagttattgtttctcctgcctccaattcctcttctccagtctttccttagtcctcttcatttcagattttgccagtgcaccatcttcagcaccaacaagattctcaaggtcaccgatttactgcatgtcaattttcacacttaacccttagtttcctatcagccgcatttgatacacttgaccccttcctcctctttgataagttttctttacttggcttccaaggacaccacactcttgattttcttccttcattgatggttgctgcttcttagtctcctttgctgatttcttgccttctccctgatcttttaatgttgcctgccctagagctcaatccttggatttctccatcttcacttgttccttggtggtcactcctcaacttcccctacacctgctttcccatcccagtctagcagttccatccttctagttcctcagactaaaaacttgaagtccttgactcttctcttcaaaacccacattaaaaccaggaaaaatttatttaccatccaaatatgtcaagatactgactattcctcattacagctactgcttccaacctagtctgagccactctcatctcacctggatactgtaataacccctaacaggtcctgtgtctacttttgttccctagagcaagcaacccaggaggcagaatgatctgtacaaaatgctatttcacttgtattaaaatcccacatttatgatagcctatgaatccccatgtgatttgcacttgccctcctatctctctgacttcctctcactactgtcctcttgctcactctgctccagcccttttccaagaacacaccaggccccctcctgcctttaacattagagtatttggtttgtgttccttctacctggaacactctcccagcagataaccacctggcctcactacagcagctccttcagatctttgctccaaaatcaccttagtgggtcaaccccaaacatcgtattttaacagatgataatgcccttcactccatgcccaaagtactcctaaggactcttacaagcacagcttttttgtttttcccatagctcttaacttctccctacttactctagtatttgtatatatttgtttattgttttgtaactcccaacacacacacttcctccaaaatgtacaacctctgtgacagcaggaaacttgtcatttactgatatcctaaatgaccagactagtgcttgggatttagtaggcttccagccaatactatcttgaatgtacagcttcccaatacatatggcttgcaaagccgtgtatgttctgacttactccagcctctttctcacctcccacacctcatggcactctaaatcagtgctgtctgatagaaatatgtgagccaatatgtaattttaaattttctaggagccacatttacaaagtaaaaaacagttgaaattatttataatatattttaatataatatatccaaaatgttatggagatgtaacatttaaaaattatgaaatttttattcttcaaatactaaatctttgggatcagatattttatactaacagtacatctcaattcagaggttaaatttttttttcttttttttttttttttgagatggattctctgtctcccaggctggagtgcagtggcatgatctcggctcactgcaacctctacctcccaggttcaagcaattctgcctcagcctcccaagtagctgggattacaggtgcctgccaccatgcccagctaatttttatattttcagtagagacagggtttcaccatgttggccaggctggtctcaaactcctgacctgaagtgatccaccagcctcggccttacaaagtgctaggatcacagccatcagccaccatgcctggctgtgaggctaaatttttataagaaatgttctatctgtgtttaaattttgtaaaatttactttgaaaaaatagactcacatacctaagttgttccagtgattttgaagcggctgtcaacttttaaatttaacttaattaaaactaaataaaattaatttcatttgctcagttgcactagctacattttaagtgttcagcagccacacttggctagtgatgtattagcacaactctttgaccccagctccaagcagaccaggctcctccttgtctctggccttttgtaagttgtccctccacttggaagactcttctttgctccaccatcatctctttttatctgactcactgtctgaattagccctttctctgcactttgcaaacaccctattctgttacattactagtcacactgtattataattgtctgattcattgtgtgatggttcaggaattatttctaccttgtttacttctgtgtccccagactcttcggacattacctttcatataagagatactgtgtatgtctatatatacatatatgtatttgttaaataaatttataaatctatgaaatttatgcctatagaagttttagccatccttcggtttccacctcaaatcccttcttcccaggattcttgtcagagcagtccacagcaaatatttcctgttttgtactcccaaaccacctgcagctcatattactcataggccatttgtaatacatgattttactacgtaaaattctacctccccagatagtgaaaactggaagagcaggaattctggaaaagaaaatgacttacatattaggtgttcaataaaaacttgatgacttattaaatatattgtctgatttcagtcttatgtctggtgattacttttcctgaggtaattcagtaaaaccagtgaaaatttttgtgtgttttaaccattatgctaaaaggtatctgctctctgccaggcgtggtggctcacacctgtaatcccagcactttgggaggctgaggctagatcacttgaggtcaggagttgaacaccagcctggccaacatggcaaaacctcatctctactaaaaatacaaaaattaaacaggcatgatggtaggcacctgtaatcccagctactcaggaggctgagcttagcaggaaaatagcttgaacccagaaggcgggaggttgcagtgagccaagattgcgccactgcactccagcctgggcaatagagaaaaactccatctcaaaacaaacaaccaccaaaaactgtctgctctcaatcttttgattgaatagtaaaaccaatattttttttaaaggaaggctacttcccgaatgaccttatctacctatgtgtctgtgtagttggccattaatcaaatgtcatttatatcccaaacttcattttcattcattgttgattcggttgatactcatgtccatctgtctacagatatacactgtcactcatcagtgttatatacaaaccttactcattttattatcactaatgggctcaatcctaaataagatcaaagcttatttttcccttttgcatagtatcttccaatagtcaagctaaagaagaaaaaagcaaattgcattatgaaaatgctatactacacagtctgttctgtgaggtgtagagcaagcattaatgaccctttttttctgtgccagattggaggagaaaagagagaagtagaaacaattaactgtagacagatcagacctttcaactttttcatgctttatgactgcagtcctaatgataaagaaccccagaggcaatgtgagcactccctcgggagggaatgtgagtctggtatctggtcctctctaacagttcatgcctggtaaggatcatggtgtcctggcatgacagacaccaaaagtccacattttccaagggaatgaatgtttacaaatacattggttccttgatgttactagagccctcttcctattctctcctcttttcctaattcatgcccccttattaccttaacagaggtgggagttaatcaggatgtaataaaattgaaaaagtacctaggatggaagggatttggaattctgaatattgtgttttaagttggaaaaaaaagttacataaaatgtattctattgtcttggcagttatttactttgttttttatcttatagtttgtcttcttgagactgtaggcgtctataaactgtgaactaatttagatgccactcctgagggcctggcacatgatttgcacttaatgaacagctgctttggtctgaatttctgtgtcctcctaaaatccatatattgaaatctaatctccaatgcagtagtatcaagaggtagagcctttgggggtgattaggtcatgatagtgtttccttcatgaatgagattagtttctctataaataaggcccgagggagctcttttgccccttctgccatgtgagaacacgtctagaaggtggcatctatgaagtagagtgggccctcatcagacactgaatctgttggtgccttgatcttggacttccacccccgccccccaccccaagaactgtgagaaacaactttattgtttttaagttactcagtctaagatactttgttatagccacccaaaaggactaagacagcagccactaaaaagtgttcattttacctcaatcagcaatttaaaaggaacagctatagaagttgaacaacagtcgtactaaatggttcctaaggaagttatttttgaaaaagtataaatatcaacatgaaaaggtttcagaattcagtgtataagtgaaaaaaggacatgttcttggtttaataatcattttgttgcagagcacttttttcggaataaaaaaaatttgattatttcatttagggaagattaacaggaaatagtgttatcaaactgtgccctcagttttatagatgactcagtcttaaaaactccacacatcggaatgtgatgatgtgttcattagctgctctgtttgacctcactttagtttacgaattcccaccctttaggaatcaagattacaaggctaaagcagtaagtaataggaaagtcaacttcaaatatatacagaaatacaaagatcaatataatgaacccctgtctgccacccggcttcaagaattacttcatagacaatctgtttattctataatcccactgactgttcacctccgacgttattttgaagcatttctcatgtatgatttcatctatgaatatttccatgataagaataaaaatttcttaatgtcagaaaatatttagtgactattcaaaatttcaaatgtgttataaatgccatgttttacatgttgtttatttaaatcaggatccaagtaaagtctatacattgcaattggttaatacatattttgtgtttcttttattttaggccatctcttttagtaaatgtccttgaatgtttcttaagttgctgtatgttcatggaccatttccagagactttgattggttgttttaaaataattttcacccattctgtaggttgcctgttaatgctgatggtagtttcttccgctgtgcagaaaagaactctggactcagttcccagaaaaactagtgaaaattatttttttaatcatttttctttttttttttttttaattatactttaagtgctgggatacatgtgcagaacatgcaggtttgttacggaggtatacatgtgccgtggtagtttgctgtaaccatcaacccgtcatctacattaggtatttttcctaatgctatccctcccctagcccacaccctgacaggccccggtatgtgatgttcccctccctgtgtccatgtgttcttattgttcaactcccacttatgagtgagaacatgcagtgtttggttttctattggaatgatggtttccagcttcatccatgtccctgcaaaggacatgaactcatccttttttatggctgcatggtattccatggtgtatatgtgccacattttctttatccagtctgtcattggatgggcatttgggctggttccaagtctttactcttgtgaatagtgccgcaataaacatagtgtgcatgtgtctttatagtagaatgatttataatcctttgggtatatgcccagtaatgggattgctgggtcaaatggtatttctagttctagatccttgaggaatcaccacactgtattgtttcctgactttttaatgatcgccattctaactggtgtgagatggtatctcatggtggttttgattagcatttctctaatgaccagtgatgttgagctttttttcatgtttgttgactgcataaatgtcttcttttgagaagtgtctgttcatatccttcgcccactttttgatggggtggtttgtttcttctaaatttgtttaagttccttgtagattctggatattagccctttgtcaggtgggtagattgcaaaaattggttattttctctgctcctcaccctcctcccacccttaaccctcaagttggccccagtgtcttctttgtgtctgtgagttcttatcatctagctcccacttataagtgaaaacgtgtggtatttggttttctgtttctgtgttactttactaaggataatggcatccagctccatctatgttccaacaaaagatatggtctccttcttttcagtggctgcatagtattccatggtacatatgtaccacattttctttgtccagtctgtcattggtgggcatttaggttgattccatgtctttgctgttgtgagtagtgctgtatgtgtctttatggtagattgatgtatgttcctctgggtatatacctagtaatgagattgctgggtcaaatggtagttctatttttagctctttgaggaatccccacaccgcttcccacaatggtta

SEQ ID NO: 323 - DNA, 41729 bp, Homo sapiens
ctgcccacaccagctccccttccaccatgaatggaggaggcttgaggccctcaccagatgcacatgctggcaccatgccgcttttacagcctgcagaatcgtgagccacgtaagcctcttttctttaaaattacccagtctcagattttttttttttaattatacttgaagttctagggtacatgtgtacaacgtgcaggtttgttacatatgtatacatgtgccatgttggtgtgctgcacccgttatctcatcatttacattaggcatatctcctaatgctatccctcccccctccccccatcccacaacaggccctggtgtgtgatgttccccttcctgcgtccaagtgttctcattgttcagttcctacctatgaatgagaacatgcggtgtttggttttttgtccttgtgatagtttgctgagaatgatggtttccagcttcatccatgtccctacaaaggacaggaactcatcatttttcatggctgcatagtattccatggtgtatatgtgccacattttcttaatccagtctatcattgttggacatttgagttggttccaagtctttactattgtgagtagtgctgcaataaacatacgtgtgcacgtgtctttatagcagcatgatttatattcctttgggtaaaacaccaaaagcaatggcaacaaaagccaacgttgacaaatggggtctaattaaactaaagagtctcagatatttctttatagtaacacaacaacagacgaagacaatgaatgactctaatctgattcagtcttggtaggtcatatgtttccagaaatgtgaacacttcatctaggccattcaatttgttgatgcacaatttttcacagtactctcctataagcccttttaattttgttaaattggttataatatcccctctttcactttcaattttagttacttgagtcttctctctttgtatcttagtcattctagctaaaagttttcaattttgttgatctttttgaaaaatcaactcagtttcattgacttttctctattgttttctattccctagcttatttctgatctaatctttattatttccctcttctgctagctttgagtttagtttgtttgttttctattccttcgaggtgtgagtttaggttgttcatctgagatctttcttcttttttactgtaggtatgtacagctacaaatttccttctcagcaccgttttcacagcatcccagaagttttggtaggttgttttcatttttattttgtctcaaactattttctaattttcctgtgatttcttctctgacctactgtttaacagtgtgctaatttccacatatttgcgtattttccagtgttcctttgccactgatttctagtttcattccactgtggttggaaaggatactttgtattattattttaacctttttaaatttattaagacttgttttatggccgaatgtgtggtttatcctggagaatgttccatgtggacttgagaaaactgtttatctgctgttgctgagttccatgtgtttcttaaatagaggagactgtcctatcaatgtcgttaatatatcttcacagatttatgtctttaatccatctctattttgtatgtggtcagaagaaggaatccaacttaattttttagagttagtcagttttacccacattatccaaaaaaataaatgacacttatcttcaatcattaaaatgaagtcccacctgtaacctacaccgagttccttttcatacatgtatttgcatttttcctctgtactatataatttctaaaagcacagttgtcttaaacaaacccattcattacaaagtaattgatatgtctcttaatctttgctccctcctctatctttttttctttcaaatacttgttagagtggtttctttgtactaaagatttgggtagagtttggattttgctgattgtctcctgcgatgttgtctagtatgctttcttgctccctgcatttcctgaaaatttctagttaaatcagattcaggtttgagttttaggaagaggagactacttcctagacggtggtgtgtatttgcatctagttgtctcttttgctgatgttagcagctgcactacattctcattaggtgtgttctgtccccttcctgctacatgggaagcacttgggataatacatgctgtgttcatcactttctccccatcaccgagcaccgtttctggaaaaccaagggatccaatattatctaaatttttagtgaatacaggagctcatggttcagacttatctcttctactaactctaatagatcatggacaagatgcttaatttttgtgaatcttattttcacagtctgtaaaatgaagggattggcattaccatgccccctaatgttccttgaatgattctacaacatggccatgcaaaggtcaagaagataggctgtctttttcctccagaagttgcaagaaataaagaattccatcccatgcatatatactgaccaagaaatgttttctggggggacttttttgtttttctttttgcagaaacacatttgatttgggcaataaatttatacttagaatagaacagcgtttgttggttacatatatcaaaatgaagcaatgttcaattatgttcagttccattccatgatggactagaatataacaatataatacacatattataacgtaggtatgcacatgaacacatatgaataactaatttaaattctgctgagaaaaatgccaaaaccaaagagacaggcctattgtctataaacaaatgcatatattaagtaattataaaaccaccctccatctttcttgttgttgccattgttttagaaaaacggtcttgctctccggcccaggctggagtgcagtggtgcaatcatagctcactgcagctcaaactcctgggctcaagcagtcctccgaccttagtctcctaagtagccaggactgtaggtacatctcatctttactggctaattttctgctttttaagagacagggtctcgttgtcatccaggctggtctcaaattcctggcctcaagagatccttccacctgagcctcctgggtcattgggattacaggtatgagccaccacacccagcaaccttccattcttaaccaacttttgtttaatttccaacaaataacaggaaaaacaaactgtccaccttgaaaataatgacataaaatcatattcatctttttccatatatacacatgtgtacacatataacttttattaaaacaaatatacacaagcaaagatcccattaaagttcatccttggcagtaacaaggtgcagatatgagtaaaaagtagtaaaaacatgcaagtttactacatcatgggctatgttttcaaaaatacaaaatcaagtcatcttttggaaaaacaagcttcctcaacttttattaaaatttatatccagactaaaagaaaatagttaccagtataaaacaatatcagaactcaagttaacatcttatatttaactactttgagtttcctaaacattgtctaagcaaacacttattctctagcacaatggtcagagagttaatgaagatacaatttttctaggcagaaatcagttatgttctactatgcaaaccaaacagttgaattgattcttatccttgtatcgtaagcattgaggctcatccagtatttattagaatggtgcttggtggataatcactagtccctttgtgcaccaaaactcaagagttcttagaggcttgttccacatcatcatagaaagagaaggtaccactcatttttttattctaagcaattttctctacttctccttagcaaactagacacatctgcttcacacactgcaacataacagttctatcagaaattagagcaccagattatcacaataaaaggacaaagacaagtgtctcctttctaaaagcagtggtaatcagttggttttaaaacagccacgttcatcatattctcctgtaatcggaacacagaaatgtgtcctcataatcaaggtactcttttctaggaacatagcattacttcattattactaacaacacagcacagcacctaaataatctttttatctcttcaaagctgtagaggctgttcatattgcctaagatcaacaacattacaattgaaaaaaaaaagcagctagctggctaaaacacacacaatgcacacacacgcacacagacacacaaccatacacaaacttggtctctcacattaaactctgtaacagtaaaaaacactcctaaatagttgtttctattaaactgtttctgttccagagaagaaaaatacaataatatatatgattaggggtcatgattctaaaatcattaactttattttttttttatgattgtggtcccatcaatttaaattttcctttacactttcaaacaaggtggccacacactcgactccattgttcttctggggttagacaagtgtgaggtgaccccagttagggatgccccaacaggcattaagttgacagcacaagagcttccatcgcaaccctctagacactgcaaccgccacaacagtctcttggtactcatttagtgtcttactaaacgtttaccttgtcaatgatcattacattatgtggatactaagactttggttagatatctctaccttttggcctttgtctgtattttacaaatttagtttacattcaatctttggtcttctaaaagacctttggtaaaataagtacacgcttatcagcaacataaatactggacacaactaaaatcactttcatttattccctaaattctccccctacaagttctggagatttccaaaaacttgtaatcaacatagcaaagtgggtgctaccattgcaaagattagagcacttttttttttttttttttttttgagacggagtttcgctcttgttgcccgggctggagtgtagtggttcgatctcggctcactgcaacctccacctcctgggttcaagcgattctcctgcctcagcctcctgagtagctgggattacatgtgcctgccaccactctcagctaatttttgtatttttagtagagacggggtttctccatgttggtcaagctagtctcaaactcccgacctcaggtgatctgcctgccttgacctcccaaagtgctggtattacaggcgtgagccactgcacccggcctagagcatttttatactgtacacaataactttttaaaatagagatgctttattttctagcataaaagtagaaaaaagtaaaaggaagaatggaacaagaaattttgaaaattatgttttcaaaagaaaaagctgcttatagatcatgctcacgtaattctccaatataataattcagtcctttaagatgacttaaaaacatattccaaatgtgtttgcttattcacagtgaaatatttggtgatgaatcagaggtagtccaaaaaatgatcaaaattcattacctaacattcatgttgaatgtgtttaatcactaagcaattatggatttaatatctaagattgattatccagtcaaatcgcctcccagaatatttaaaatcaagttgctctgctgctttgtcagaaaaatatgtgattgcttatgcatgtcaatgatttacacatacacacatttggtaatgagacatacaatagagcaaactgaagttattcctttccccaatctatagtatctattaactctttagttttaaacaaagaaaaaccatattttattttatttattttttattgtactttaagttctagggtacatgtgcacaacgtgcaggtctgttacatacgtatacatatattgtaccaacatacatatgttggtgtgctgcacccattaactcatcatttaacattaggtatatctcctaatgctatccctccctcctccccccaccccacaacaggccctggtgtgtgatgtttcccttcctgtgtccatgtgttctcattgttcaattcccacctatgagtgagaacatgcggtgtttggttttttgtccttgcgatagtttgctgagaatgatggaaaaaccatattttataagactatgaagcttacagaatatagtatatgtagtacgtcccaaactaatctgttccaacaggtataagaaaaatacaacaatatatgtttaaaagttacattcactaaaggcaaaaaagataatcctacatggtttagattttccataggagaatacagttgaagcaagctctgcagtgataatattcaaataatttatgtaaattagaatggtcaaatgtttctgtctatgcaatccaactggatgttagtgtaggtacttaagttatagaatgcttataattgcacagcattccagtaactgatagaagaaaagacaatgatagatgctgatccttattccacgtcaaatggccttgtatagactttgcctaaccagagtctcagatcccactgagtgcttttcaaaaggggcatttttccctgttataacacaggtactatttttggcctcacaaagccttcagcctagacagtgaaatcccagctatagacacatgcaaataatcctagaatttgcaaatatgctacagaaaatatcattctctcttttatgtcaaccctcacatcaccactagtactcccataggcaaggggagactggcaaagattctttacactggaaacaagtgattctgatagactgcagatacttacctcaatacaggttgatagctcattaacacagcttagatttcatgaaaaagtctgcttcctggccggcgcggtggctcatgcctgtaatctcagcactttgggaggccgaggtggatagatcacgaggtcaagagatcgagaccatcctggccaacatggtaaaacaccatctctactaaaaatacaaaaaaaaattagctgggcatggtggcacaaacctgtagtcccagctactcaggaggctgaggcaggagaattgcttgaacccagaaggcagagattgcagtcagccaagactgtgccactgcactccagcctggtgacagagcaagactctatttccaaaaaaaaagaaaaagtctgctttcttgactaaggagcacatgtccagtgatgctacacgatactacccaggtgcccattagcagtatgcaacagtcatttgataagtcctaatctaatggtcttgaaagagttaatcttccaaacagactacaaaatagtttgtacactgaaaatatcaagcacaactgattacatatctgagtttttcaagaggaaaaaaacacagagctaagggcgatctacttattgatatcacagtgaagaaccggagaaaacacctcgaatgattatgagacttctacatggggattctggtaggggaaacctgggtattttactttgatctttatgagtagctgtttcattggcaatattctaactatctgatggtagtggaaaatcatttcaatatttgaaagttacatacttgattttcaggtgagctactcatggcaattttttaaagggcacagttttctattcactatgtttgctgacatacaattcaaatatagtacaatacagaaataaagacataaaattccataaagaacaaaggaatcatactgtgtacacttagcaacatagtaattcataccaagcatcaagaaaagagtgtaaaataaactgcaaaaagcgctcagttgagcatggttgattttttaagtttcggttatctgaaatttggaacactggcctaaatgttatctttactatttaaatgtgattttgataagaactcagaacttttacacataaatgacttgggtaacgttttggagacaatttacacacacacacatacaccaacaatgacaaacataatttggtgttttccaaatatgcttaatgaaaagaatcattagcaaatatatccagataactttttgtcttacgtatatagttgcaaatcagcaatttattctagtatgtgacactttgctacagacttttaaaatacaagaaaacatggttatcatctgtagcaaaacacttgatacgacatacctcacagtagtctcaaataacaatttggggtaaactgctgccaaagtttatgaaaccatagttttgtgatgcattttttctctctcagactttcagtactattagggcagtgaaattctaaaatgaattactgaagaatattgttttgcagtatctataatagaaaagctatctggtttcattatttacttgcacaactgaagtgtccatctagaacacagtcagcaccgcatcaaacagtctacagcaacttgatcctttgtcatttttaactgagctcgttcgacaaattaatgaattaacagagatcaattcaaaagagctgctcagtgacacaataataacaagcccaatgtctaataaagttaaataaaattttatacataactgctgctttaaaatcccagggtaattgacacctgaataagagctctgtaatataatttagttctttttattattattattattattgtactttaagttgtagggtacatgtgcacaatgtgcaggtttgttacacatgtatacatgtgccatgttggtgtgctgcacccattaactggtcatttagcattaggtatatctcctaatgctatccctcccccctcccccctccccccaccccacaacagtccccagagtgtgatgttccccttcctgtgtccatgtgttctcattgttcaattcccacctatgagtgagaacatgcagtgtttggttttttgtcctcggaatagtttgctgagaatgatggtttccagtttcatccatgtccctacaaaggacatgaactcatcattttttatgactgcatagtattccatggtgtatatgtgccaccgtttcttaatccagtctatcgttgttggacatttgggttggttccaactctttgctattgtgaatagtgccgcaataaacatatgtgtgcatgtgtctttatagcagcatgatttataatcctttgggtatatacccagtaaggggatggctgggtcaaatggtttttttttttttttttttttttgaggcagagtctcattctgtagcctaagttggaatgtactggcgcgatctcggctcaccacaacctctgcctctggggctcaagggattctcctaactcagtctcctgagtagctgggattacaggcgtgtgccaccatgcccagataattttttgtatttttttagagatgggatttcatcatgttgcccagggtggtctcaaactcctgaactcagttgatctgcccacctcagcctcccaaagtgctgagattacaggtgtgagcgactgtgcccggcctatgatttagttctttatctggttgcatgcacaacttgtaatatagagcagcaaacatttatgaccatgagtatagctacccaatgctaactctgccagctgaaaggtttgtggtgttggttgtggttgtgattgttgatgagccattaactgatttatgttcagcctttccctctgtaataagaggcactcaccccactttcattgtttgttccatttacagaaaaaaaattgttccatttgctcatttataaataaaattctctttcatttttctgctagaagtcttcaaaaagtgaagaagaatgcaattaccccttttgtggcactcatttacaataaaagtttgcacactccttcccctgaatgcattcagcagcttactctcaccccagccctgaaccgcattcctcagttaacatgtaactctccatacattctgtacttctcttgactagtagaattggaggggtttataatgctgacagcacgttagctcagaaactatggcagcagccaggtaaaagttggaagtttcctccaccactctgctttcccagacatctgtcaagagcgaggccttgcgcagcgtgtccatctcacccggaacgtggtgcttttttaaacggagtccacctttactacattattgttggtcatcagtggagacggtttccatttaaccctatcggccacgtcgttagagctgtccacaaagaacaccctggctgtacagagcgagactataattctcctgtattccttcctgaaattttggttcagtagcccgtatataatggcattgaggcagctgttgaaatacgccatgtagtaactggccacaaacagccactctgggatcctaggcaccatgctggcggggtcagaggccacggccaggccaatgaagttcagaggagcccagcaaatggcaaaaaggacaaaaaccacaaacatggtgacaaaattcctgaagtcctgtggtttcagtttgggtttgcggtcaggtttcaccctctgtctgacctggagaaccaggatccatattctcaggtaacagaagatgactatgatcatggggacgaggaagtggaaaaccaccacggcgatggtgtaggcggagctgacggactgggcgaaggtgcacgagtagatcctcgggtcgtactggagagtccctgcacggaggttgggcaggacggccgccagcgtcaggagccatatgaggagcacgtagcagagggagttcttgctgctgtacagtttgtcgtacttgagactgtggcagatgtagcagtagcggttgatggcgatgccggtgatgttgaatatggagccgatgacgctcaggcccatcaggaacccactgacttggcagtgcagatagcccaggttccacccgttgttaaatatcgacatcagcaccaacgggtacggataaatggccaccaccaggtctgccaccgctaagctcaccacaaagatgtttcctgaaagagaatcgtttagaaaatacagtgaataccagttcacagtgggttttctgttacaattgttaaagaaggagctgcttctgcagctccgatgacctgacgtcacagcggcggccgcactgcaaatgaagtggaggccgtttcccaggagggccagtccactgccgctcctgacacatcgaatccgctgttcacacattcccacctccccagaacagggcctgttccatgttcaaaactgctgtctttcaaaccgttcggcttctcatctcttaaaaagtcctgagatcagaatgcttgcacaccatctgttgttctggagccttctacatcacctgagaaatctcatatgatgtcaagccagccacaacttccttaagttcaagtcttcattccctctgtagtgcttcagcagctctcagggggcctctagcttctgttcttgctgatcccatagagagggagttaagggcaagagggatctgtcgtcagccgtctggatgagaacatggcttcactccttactaactgtccaaccggggcaagttacttgatctccccaagcacctgcctcctcccctggatgatgggataatgagcagcttcctcttagggctgtggtgagcacgagatgagactatctgtggtgagcgccatgtaccgtgtcttacaccatagaaatgttcttattctacgactccctcaccttgaaccaaaggaaaatgcagaaattctcttagatcttataaagaacttacgttacaaaacttaaaccctaaatagtctgttaattttctcaattaatataacaacacatatttaattacagaaaaaaaaaactctagtcacttttttatttttatttttttgagacagagtcttgttctgtcacccagtctggagtgcaatggtccgaccttggctcactgcaacctccgcctgcagggctcaagcaatcctcctacctcagcctcccaagcagcagggaccacaggtgcacaccaccacacccggctcgtttttgtatttttgtagagacggggttttgccattttgtctaggctgctctcaaactcctgggctccagccatccacttgcctcggcctcccaaagtgctgggatggcaggtgtgagccattgctcccagctacattagtcaaatattatgagatgttctgcaaatatgttttttttcttttgcggctcttctgcctctgtttcttactattccttctgcctcgaatggctcctcacatcaactttctaaatcctgcccattctcccaagtctatctcaaatagaaatgccagaagcctttgctcatttgcccacctagtggtaagagcttcctcctttgaagggtcttaaagcactttatactgctttttactcagattaaattataataaattcaattcagtttacatattaaatgcatatatttggtgcagggggaaacaggaattgagagacaggaaaagtcaaaaagattacactagagtggttgggcgcagtggctcacacctgtaatcccagcactttgggaggccaaggtgggtggatcaactgaagtcaggagttcaggaccagcctggccaacatggtgacaccccgtctctactaaaaatacaaaaattcgctgggcgtggtggcgggcacctgtaatcccaactacttggaaggctgagccaggagaattgcttgaacctgggaggcagaggttgcagtgagcagagatcgcgccattgcactccagcctgggtgacaagagcaaaactccgtatcaaaaaaaaaaaagaaaaaaaagaaaaagaaaattacactagagtaagcagcagcaccagagcacgcacagaccagaagctgtgaggaaaggggtgcgctggacagggacagagggagccccaggtggacggacagaagatttcgccttctattctattgacctgtaggccaggcttccctgcgtctccagatggtggccctcgtgagtacatttcctcatatttgcgtcctagaccacacccaataaatacagtgacttttgctcatacactcaatgagttcattaaactgtcacttcccaatatttgaaatgagacagcccatagcagtcaagatgagagaaaggcaaaatttgtgccatttatttaggaatttcagataaattgtcataaaagcaaatactttaaaaattggttgtattcatccaaattaaagttacaaaggcaaatttattttcccacagatcactttcaattagcgttgaaacatttaaattcctaagaggtgtattttaataaattatttagctcaaaatgtttaatgctttaaaagcatctataatatgtgaaattctgttccaaatcaaactgtcattgtaacagcacatttgttcccagagtgtcatgatgacaaactggcctaatatggatttatttttaaaagagcttaaaaatgaaatcacaaatgatgtcataaatttctttcatggctcgaataccctgcttcatttattttatagtaattatgttgcattacaattcaagcaattacattaattagatcattgattctttgaattaatcccattttacaaatcttggtgaaaattaattaagccacagactccccacaggtgcggctgtcaggtagctcacataaagctttagcaccagtgttcatgtgtgcctggggggtgtgtggtgtctgggcggagaaggaaaaagggaatttccttttttcttttatgaacttcaccagataagagtcattaaatcatctaattataattatacacattataagttcatctattccattctcaaatctatgtaactccagacatatggacaatctacccatttttacagatatccaggactgtatgcaacaagcttaataatgcattctgaaatgtaaaataatgtctgttcatgggtaagaatttcttctctgttgaatatagttccaatccttactgtggcagaatcatagaatcataggatgttaaaattgagagatgggttaatgatctccctggataattcctactttttaaagatgagaaaacaaaaatatagagttaaattggatgaagtcgtacgactacttagtgaaagagtcaggattataccaatgctatgaactggtgagtgttgttcaatgttatttccctgagaaagctcctgtgctcctacagatacgagactcagaaactgggccctgtggctacgtcctggcttacagcctctccaggcacaattctgaagaagcgtatttgaactagaacattctaaagagaagatgggggaggaaaacacctaagtcagtatgctggcaacaagacgaacagcgatcagccttgtggtgattaaaggcaccaactataaaatgcacagtcaatatttgttcccaggaataaaaccttaaagtggaagtgaaatatggcacagatatgaataaaataaggtaacagacaactaaaatgtcagcttgctgggagtaccttcctcagaactagtcctgtgagtcccttctgggaatgacacagcagcacgacgttgcttttctgtttatcgcgattatgtctctacttctccccatctcccacagccccagctatcacctcggtgaggacactgcctgtcttagatatcttctccctccaccttgaacagtacctggccgagggttaatcgatgcacagtgggtttatattgtgtcaacttcgcgaagctgaaaagacttttccttgcaccgctccgggttagtgttccccacaagaggcaattgcgtgagattttgaaggcggaagtgcagcagtagcttgctctctgccctcagtatgtctgtgtcaagtgccagacgccaccacaagctcggcactccgagtctcatctgctgccctgcagggggtgggtgacggcagtgtgctcacagcttctccagctcctgctcacctcctcctggcttgagattcgaccatcctccagagctccagtccctcctcccaggttctagcttcccctgcgtcccctcctaacatccagctttccttcttaaatccgtggactttagacagcagcaccagacacagaagcgaaaacctcaaatacgctatttaatcagctcacacaactgctctagcaattttacttcttggattgattgaacccagactgatacagaatttggttctggaagtggaccaaggagaaccttcaggatggtttctctgtattggttttgggttacctgcagtcgattctgtaataggactagctttaaagtattagaaatcctatttccagtagttaagggacactggtagtcacggcctgcaggggcaaaagaattccttaaaagaccacctgggctgggtgtggcagctcacgcctgtaatcccagcactttgggaggccgaggcgggggatcacgaggtcacgagatcaagaccatcctggccaacatggtgaaaccccatctctactaaaaatacaaaaattagctgggcgtggtggtgcgcacctgtagtcccagctactagggaggctgaggcaggagaatcgcttgaacccagaaggcgaaggttgcagtgagctgagatcgtgccactgcactccagcctggcaacagagcaagactccattaaaaaaaaaaaaaaaaaaaaaggccacctgtattcaccttccaaggtgaaaacaatgtcattgcatcaccctccaaccactaagatgaaaaacaaaatataccaaccatacaaagggttggacgtattaaaccaacccatttcctgagtgactcaaaaagctgtcagtgttgactggagcccagaacaaggccctgaaggctgctcagccacctgatccatctgatccaatggctatggtctaaatgtgtctcccccaaaatttatgtgttgacacttaatcgccaatgtgatagtattgagaggtggggcctttaggaagccattaaatcatgagggtggagcccttacagataagattagtgcctttataaaagaggtgccagggagttgttcatctctccaccatgtgaggactcagcattcatctgctccagaagacacagcaagaaggcaccatcctggaagcagacagcagccctcaccagactccaaatctgccagtgcctagattttgggcttcccagcctccagaactgtgagaaacacatttcagttatttacaacttcccagtctacattgttataacagcaggaacagattaagacaccaatggggcttgaattgtttatagggttgtcccttggtatcagcagggactgactccaggatctccatagacacccaaattcatggatgcttgtattagtccattctcatgctgctgataaagacatactcgagactgggcaattacaaaagaaagaggcttaatggacttacagttccacgtggctggggaagcctcacaatcatggtggaaggcaaagaagagcaagtcacatcttacgtggatggcagcaggcaaagagagagcttgtgcagggaaactcccccttatagaaccatcagatcttgtgaggcttattcactatctcgagaacagcatgggaaagacctgcccctgtgattcaattacctcccaccaggtccctgacaacccatggtaattcaaaatgagatttgagtagggacacagccaaaccgcatcaatgctcaagtcccacagttggccctgcagaccctgtgaatatgtgaagttggccctctatgtctttgagttccacatccctcaaatattgtattttcaatccatgattggttgaatccctggatgtggaacccatggatatggagggaccactgcatgttaataggaaggctgtaaggaggccttagcaggcacattcagatgactcataacacagacccttagtactttgcagcaaatctgtgctctcctttgcagataccgttttttacttcctacttggccttggtagagtctgaatgctcgaacatggacccccaagtgaccatgtgatctgaaagctgtctgaaggaccaggtgctgtctatctgaaggaccaggtgctgtctgtctgaaggaccaggtgctgtctgactgactgaaggaccaggtgctgtctgtctgaaggaccaggtgctgtctgactgactgaaggaccaggtgctgtctgtctgaaggaccaggtgctgtctgactgaaggaaggaccaggtgctgtctgactgaaggaccaggtgctgtctgactgaaggaccaggtgctgtctgactgaaggaccaggtgctgtctgactgaaggaccaggtgctgtctgtctgaaggaccaggtgctgtctgacccaccaaatcaccaaatcacaaagttgcccatcacagcatcaaacagaagccgcacatccaagatctggctccggcagctcctgaaggcacagggaagatgcaagagcaagtggctcagaggccacagcctgcgttcccaccaccctgcctccattccctcagcatgctcctatggcctcatgaggacgtgcccctgaccagctgaataagaaagaaaaaaaccttcttgcctggtttccacatggcttttcatgacctactgacactacctgaaattggatggttgcagcactacagacccaattcagtacagccctgaaaaacaaggatggaggaagaccctcccaggaaacagaactttgagcaatgcttcaaactggttgttcatttttcctggaaggagagagggccacaggtttagatctgcactgattaatgggcagtggctaatggtcagctagaccaggggtccccaacctgatggggacagtagctaatggtcagctagattcatgggcagtggctaatggtcagctcgatcaggttggagacggctgatctagctgaccattagccactgatctagctgaccattagccactgctctagctgaccattagccacagactgggtccgtgacctgttaggaaccaggctgcacagcaggaggtgagcagcatatgagcaagcattaccgcctaagctccccctcctgtcagctcagctgtggtatcacattctcataggagtgcaaaccctatcgtgaactccatgtgagggatctaggctacaccctccttatgagaatctaactaatgcctgatgatttgaggtgggacagtttcatcccgaaaccattcccccaccctgtcctgtggaaaaattgtcttccatgaaaccagtccctggtgccaaaaaggttagggaccactgagctagatgggcaacgatttggaagaaacataattagaaaaccggttatggggctctggggaagacgtagcacacagacctctcagaatggacacttggtgtgaagatatttgtgtcttgatgatgcaacctgtgtatatcagttaatctgtctttggccaccagtccttgaccaatgggctcacaaagttgtcatggcagcaaggatagaagttattcatgagctcagcatcagattactcctcatgaaaactgatctggatgcagccactgctgcactgctgaatgtccagcctgccaagagtggagataacaccagcggagcaccattccctgggaaaatcagccagacgctgctggtaggtggattacataccacttccatcatcaaagggagcagtggtttgttctggctggaacagaggcatactctgaatatggatgtgcctttcctaccttttcaggcccttaaatcttccagcaacctaacacccacggacgtacaggacgccttctccaccgtgatggtattcctcatggcgttgcttttgactaaggaattcctctgacagcaaatgaagtatagcaatggggccatgtcctgggaattcactgcccttaccaggtttcccatctcaaaacagctgacctgatatgttggtggaatggcttttgaaggttcagtttcagcaccaggcgggtgagcctagggtacagatccctatcatgtggcacctgctctaaatcagtgattaacatagaatgttgttcatcccatggccaggattcatggatcagaaaatcaagggtgaaaatggcagctcatcctctcatattaccctggtgataccctagcaaaatgtttgcttcctttctgtgaaactttaggttctgttggtctaaagtcttagttcccaagggagcaatgcttccaccaggagatacccctttggtttcattaaactggaaattgaggctaggcacagatcctggcactttgggaggctggagtgagtggatcacttgagcccaggggttcaagacctgcctgagcaacatggtgaaactccatctctacaaaaaataaattagccaggcgtgcaggtgcatgtctgtattcccagttactcgggaggctaaggtgggagaatcacttgagcccaagagttcaaggctgcagggagccatgatggcaccactgaactccagctcaggcgacagagcaagatcctgtctcaaagaaaagaaaaccagaaaactggaggttgagagtgccacctgctatttggggctcctcattctagtgaatccatagacaaggaggggggttactgtgcttaccgtgtttagtcctgatcatcaaggggaaactgggttatgattgcacagtaagagcaaggaagtatagatctggcatgccagaaatccctcgcgtgtctcagtactcccatgccctgggattgaagccaatgggaaaccaaaataacccaatacaggcaggaatgccagtgtcccagagtgttaggaatgaaggcttcagccaccagaacatgcaaagagccagagggcagaggaaatgaggagggaatggtagttccaaatacccactgtggccacctggccaactgcagaagtgagggctaaaataattatgagtatttcctgcttgctttagcatgaacaatttgtgaatatagtaataactttgtgtctctttccctctgctattcccctaccatctcatataagatgtgttaatagtgaaccttgtatctcagaatgtaagttataggatatcaaatggggaatgtgactcaactagaataataaaaatgatgtaaagttgcataaagagactgtattttcttttacaaagagggttaatgtattttcaattttacacgggatagttgctttgttagatggaagcataattttgatgtttcctttatttcgaagttaaatatggttaaaagatatagctagaacccaagttgtcaaggggtggactgtgttgaattagtattgtgtcaacttagctaaattggaactatgctccctagaattctgttttctgcataattataggatagcctcacccacaaaagaattttgtataagatttggaaggtggaaatgaagcagcagctatttttttcattttttcttcttgagatggagtctggctctgtcaccaggctggaatgcagtggtgttatcttggctccctgcaacctctgccgtcccccacccccactgggttcaagcaattctcctggctcagcctcctgagtagctgggactacaggtgcacgccaccatgcccagctaatttttgtatttttagttgagatgggatttcaccatattggccaggatagtctcgatctcttgacctcatgatccacccacctcggcctcccaaagtactgggattacaggcgtgagccaccatgcccggcctgcagcagccatttgtgtaatgcttttttatgctagatatgccgttattaactagtaaaagccttaactaagtaaatctacaggatcttcctatcctgggccagactcttaccttttatcagtcatttctgctcttttttagaaatcccacactgcaatcctcaggctgatttgcatttgaatgaatacttctgcatcactttgcttttttgtgaattacacagaaatctatcaacctatctgacactgtgcaaagtgtggaccctgtgtctgaagttttcatgaacaatgaaaatgtgtatttctgaaaaacgtctgtttctacagctctagccatctttttcctcatttgataatctccaaatctgtgcaatgattaaccctgcggacactttctttccttctgcgtgtgggttagcagggcccattaccacagcaagcctgggctccaggcggcttctgctcatcctctgtctttcagaggtgttgtcgtagacgctgctggcgcatttctccccaaagtgtctgtgagttctgggagccttcatttggcaaggactggatccttccccagagactgccttcactgatcacagagccactgaatggggtacaaacgaccagtccctttgcctcaagtaatggcaactccactggatttacgcccagaggccccaacttatggatgaggccaagtctcagctttccctgagaccccatccctccctgaccctttcccctgccctgatctgctctcctctctttcttacaagctccccctgagagtgctccctcagcaaagcacgagtaccaagcctctgtctcaggttctgtttctagcaaacctgaaatagaccttcagctctatgatgaggttgggtggtttcctaaagaggtcactggcttctagatagaaaaaaagagctacttactatggtgtcttacagacacgagccaaccataccgggtaggagttacaggctgtagctgcccaccggcactgctcttccatgcttccaacctcactacgtgtgcatctgcttccaatattgaggcaacatgaaaacacacacattcgcacagccgtctgtctccctctgagactcaggtcctcactgtggacatgaaccttcacattctcacggtgagcacagagcctggcccatattaggtgctcggaaataatttgctgattgaattaacgcaccctttggcctctgaactactccctcagaaaagcagaaattacttgctcttcctgctcatatccactaagatgttggtttttcccagcaggtcaatattcactccttctttcatttcagcctggactttaaccacgtggaaagcaagattagaggccccctgaatagtactgttcacgaagactaaaaggaactgagtgtgcctgagcttaagcatcacgaagaccagtaataaagaactatttacaaacttggtttgtattttttaaaattgcacgtgcatacatgttacctgtatgataagagaaagctgagctaccgcaggtgtgtagggaatattctctggcagtacaagggaaagggaagggctttacttcgaggcatcaaagcacacagtccatgttttagattcttaaatgtaaagagactataccttagaaaagtgtcttttcagattactagaggcagtgtgcaccatgagtgtggaaacaaaagccggattcagatcccagccacgccacttgctaacgtgacctcaggtaagtcacagcttcccacagcctcagtctcttaatatgcaataaatcaagctgcttagggccgtggtgaggatttgagggcgtgtggcccatcttcctttgcaggattattcactcatgtcttatttctgttcccctgtgatggaaaccacacgtcttgcttcacggaaggttcctccctggcacacagtcctggctagggaggatcctccctgatccctgcaatggaacaggggtctctccatagccgatgagcctcctctcatcccccacccctcctgccgtcggcctcactgctcccctcccccttccacacacggctctccacagcacacatgacagtgcatcaccccgcaatgcccaggcttcaatagccctgcagtattcagtgacatacttggtgactccttctcccagcctttaactccttaaactccccaaactataataccctcttcatgtgacacgccatccacatcacaccccattaacgggatatgctgtccacaccacaccctgttcatgagacacgctgctcaccttgcaccctgttcatacaacaacacaccatccgcctcgctccctgttcatgccacccacatcacaccctgttcatgccacccacaccacacctgttcatacaacacaccatccacaccacaccctgttcatacaacacaccatccgcctcgctccctgttcatgccatccacaccacaccctgttcatgggacacaccgtccacaccacaccctgttcgtgggacacaccgtccacaccacaccctgttcgtgggacacaccgtccacaccacaccctgttcgtgggacacaccgtccacaccacaccctgttcctgggacacaccgtccacaccacaccctgttcctgggacacaccgtccacaccacaccctgttcctgggacacaccgtccacaccacaccctgttcctgggacacaccgtccacaccacaccctgttcgtgggacacaccgtccacaccacaccctgttcgtgggacacaccgtcctcacaccctgttcctgggacacaccgtcctcacaccctgttcctgggacacaccgtcctcctcacaccctgttcctgggacacaccatccacaccacaccctgttcatgggacacaccgtccacaccacaccctgttcatgggacacaccgtccacaccacaccctgttcatgggacacaccgtccacgccacaccctgttcatgggacacaccgtccacaccacaccctgttcgtgggacacaccgtcctcctcacaccctgttcgtgggacacactgtccacaccacaccctgttcgtgggacacactgtcctcacaccctgttcatgggacacactgtcctcctcacaccctgttcctgggacatgctgtacccatcacaccctgttcctgggacacaccgtcgtcccacacctggttcatggtactcgcggttgtctgaacaccctgttccatctgagcacctcagggctccgttgcctcctggattccacgtgtcctcctggctcattcctctctctctctatcccactctgtctctagttccccacctgttctctaacttgactgttgactgctgctgtagagaaaactagtagaccttggcactgctttctattatacacggtattgtacactgtacactttacattgtacactgtattgcatatacactgtatatacaatacgagagaccaaaggcacctgaggtgtctttaagaaatcatacacattcctgcttgttcccatctggatttcagtcagtgttaaaggtgtaacatcctgcaaataatcctgctcattttctatgcccagtgactgtcttctgagaagggtggtttagtgaggcatttgtaacttgtaaaacatccacagtacagcctgactggttcagcctttcacccttaaatggaagacgaattactgatactgtacctttattcgtcttagagaatttaggatgaaactttaacaaaaacaaaatcataatccttcagcgacattaacaggcaatcaaaaaaaaactatatgaactctctttagggtaggagtcttttttcccttaggcacttttccgaaccttgaaggactcagtgaaaaccccatcttaaataaacagattaactgcactaaataataactctaaattgctaaatccaaaagagagttttattaaaaatggtataatcataatagaaccctatttatatatgaaagttaaatcaatgacaggaaaatatgttaacactacaaaagtataaaataatattctcataaaagtaactttttaaaagttaaaactttgactctatttttatgtacttacagagtatttaaagacctgtaagtgtgaaatattgcattctgccttaaaaataaaaatatgtttacacatcagaactctacaccaagaatactaactaacaaaaggaatttattctgctgctgggaatgttatatttaattcataatgcactttaagtatacagcaagccatttagtccttacaatattagtattgtcccaaattaacaagtgaggaaactgagcaaattaggtcacttgccctatgtcacacgcatgagatggcaaagcccgggttttactccaggcatctggttccagaggccatgtgtttcagagggacacatcccaaaaaaaatgacctataatagcactaatcttccatagataaggaatgcttaatctataaagatatatatatatatatatatatatatatatatatatacactatatatgtaaaacaatcttttaaaaaaagtacatggtaaaagactatatgatacctacacagacatatacacaaatgagaacagttggaagtattccaaattcagagggaacaacgaaaggagctaaaaaagataagtaaataataaaaggaaaaaatggaatgaaaactaactggcaaaaaatcttaaaagtaaaaattgcaatttaaaccacatcttaaaataaaaatgagtgaaccagaattttctcttgaaacaaaatcgtgtcctaagctcctatagatggatataggaggcatccagcaagcatttaaataaaggaggagggaatgaatgcaggaaggatgaaagcacaatatcccttccaagaacatattcctaaatatgttcagaaaatcatcaaagaggaaatactaattactgattacacatttttataatccaccacttaataactatttgagaaaacaagtataaatgtaagttagcaggctagttctccagcaggcgtttcttcgaaagacctgaagccagtgtgttcttcactaatagttatgccgtgtctctaccactgatcagtttctttgaaattctctcactaattccgtctcaatctgctgctatttcacatgtgaactagttttcacatctcccagttattacattgttctctcctcgtaagataacaactttaaaaaattctcatgattgctttaagctccagctaccatctaccagccaactttcgcatttctcttgaaaaagttttctgctgtataaatatgctcctattttcatacttttgtaccccaagtcttctctttgtttgaaaataagaagaacacacatttctaaagtgcctcgatagaaagtaatctctttgaaagtcggagccgcgtttgacccacgcttagaacaggaccttgaattttgacaaacctgcaaaaatttaccaaccatttacattctgccttatactctaggaatgcagtaagtatttatccaggtaaatgttcagctcaataagcaccaaaactactcagtatcaaagcaagtgagcacgcttttaaaccgtgcaccctaacaactcaaattcacctccattaacttaaataatattcagcaccgtgcaaatgcattttctctcccgtctcttcttctgagactgattccttcaatggcattgccgaaagtgtatacagctctgtagaaagacaagtgtttgagtacttcatccagagaatccagcagtttatttcttatctgcagcattatttaactgcactaaaaatcacagagatatcacatacagcgctcaggttcctggtcaccttgattatttgagaggggcagaagtgaggctgctgatcatcttcatgaagaggcagagatggcaccaatgataccgtgcagagttctgtgcattcataaaaacgcttctttaacaacaatccactaattgcctttttggtactagaaaactctaaaggagtatgtgagtttcctttttagaagaaagggtatttctgtcagcgaggcaacttacaaatatgtagaaaaaagggaaagcttaaggcaccttgtaaagatcttaccattcatttcagttattctgttgattatttttaaaaggtgctaaggaagaatgggcagaatgagctccaaagactctgtggagatttaaagtgacttccaaggcatgatagttttcagtgtagatgctttttaaaacagaaccatcaaatggcagtaaatattaatagaaggaggtctaatctaggactattttatcctaggttaactcccaaaattgccaagagaaaaatgatgctgaaggcaagcaaaagtaagctctatcttatctgtgattaatttaacactgaaaattcctgccagaaatactttcttacgaaatgaatagctggaggaacgaaagatcagacaaattcaatcatgtatttgagagtctgaaactactgtcataagatttacaggggattctgggaattactttgacatatttgtaaaaacttagggttcataacaatgtactatacaaaccaagatagaaagtcatagaaaactgaacaacagctaagaatacaagggggaaaaatcaataaaatgtctctaaagtaaaaaattgccttgaatcagtaatttcaaatattgtggaaagcaacaggagggaaactacagcagcgccaacaagaaacctctcggcttggagatcgcatgaagtggggttagcttgaaatcattttccaagtctgtacagtacaagttacgtcgtaggtttttgaatggtagcctgcttgcccaaggaagctactgtagcttctagagctgattcacttaaaattagagaacagctgaatatcgaaataatcagtctttaaatctcaggccttcttgctgcagagagataatggttgttacaaaagggaaaactcagacaatggagattttgtgtattttgcataatgtcacaaatgggaattagattctaaaccttccatttctggttgatttcactgttttccagttcatattgtctacttgtttttttttttaaacatacacttaaaaaataaaaacaatctaaaaagaactaatcaccagatgcgtactagcattaacatcataatactattatttgtacctcataatgatagataggtgggtaggtaggtggatggatggatagatggatggatggacggacgatgggtggctggatggatgaatgggtggttggacgtataggtgggtggatgggtaggtaagtggactgataggcagaatctaagtttatccttctagtatccctgtaagaaaagtggcatcttaaacagccgtggtacatccgagacttgaaccagatctctgaggcccaaagtccacattcactccgtactctatgcatcctctctgagtggtaatgcagaatgaataaatataacattctatagagacctgaaagcaacaagtgcaagagaggcttcacacagagtcagccatccagccatagagccattctgggaaaccatttttaaaaacatatactgacaagtttaccctactgtgcacacagattaaataataataataataaactgcttttgacaggtatctttctaaaatgtatcatatccctgtcttcttaagtagaacacaccactcatgatgacatctctcgctgatgaatcaggtgatgataatacatatgttgctgcactgtgctgctttcaggagccgtgaatggtgagcagggctgttcacatcttcacaatgtaagcacaaaaggttgtgcttgttctgtttctcagatctgcatttaatgagtctatttcaacccatactgcttgctattatgtgctatttctttaaatgtgtcaatcttcctcctaatttcctgctcataatctacagggacctagacaccagtatcacagttttgtggcactctaagttagaacaaatccgctgtaggtgagagcctgtcatttttgctaatttccatttattggctgtactctacctcagttagattgccagataattgaattttgaataggcaagatagtattgtattcttgcctgatattttgtaaaataagttttatttaagtataatgtacatatagaaaaatgcacgaatcataggtctatagtgcaatgatttccagcaaacagagcacgcccttgttaggtgtacccagaaaacaaacaagccaacacagtattacgtgttttatccttttcaaagtattctcatatgcgccacttcactacagtcattgcaacactcttatgaggctaagcggttgggtattacctgcaattcaacaaatgtggaaaatgaagtttggtatttagcttcactgatttctgaaatcagaaggagcacagcaaggatctaatcctagcgttccattgcgggaatcgtcccttatgctatcaaatttactcagaagatatgatatggtagcttcacttctattatcaaattgtggacaagagtagagcgaatattctgttggcaccacagataccagtggttgtctgcagcctgcgtcggctgtggctgtccactgtccccgccatgcagattgttagccatttttaatttattccctgggaagtcaaatgtcaacacagtcccttgaggagaggaaggtggcataaatcaccacaattataccaagctttccaaaggaaagtgatggttcaaagcctagatgccttcacattgtcatttcttccattctcttcttcccaacatttcatccttaaagccaacaaaattaatttagctgaaatgagaggtctgaagatcatcaaaacttttaataagcataccaaaacttatatttgaatcagctatccttatcactgtttcaaattaccatccattccagaaatcctcaaatggcttgaaccgcacatataaacaaaaaatccctattagaaaaatatggaacttctaaagctgtgcggattaaaggtcactaagggtctcccatgcagctacaggaatatcctcttaagagcacgtcttagcaaataaaatacaaagtgagtgtaaggagttcttaagttcttcttcagaaaacacaagaagtaaaattgttcaggcgtgatcattttttactttttattttattttatttttttgagatggagtttcactcttgttgcccaggctagagtgcaatggcacaatctctgttcactgcaacttccgcctcccgggttcaagcgattctcctgcctcaggcttccaagtagttgggattacagctgtgggccaccacatccagctaattttttgtatttttagtagagacggggtttcaccatgttggccagctggtctcgaactcctgacctcaggcgatccacccacctcggcctcccaaagtgctgggattacaggcttgagccatcgcgcccagccgtgaacactttttaaaggttctgcaggattcaaacttcccaaatgctgcaggtgttgacagcaaggaagcagggcgagctctggaggccagctctgggaattcaaccgggctcacacctacagtccctgggaacaatctgcagccccagtttctcctctgtaaggcgagttgaccacggcgccacagcacaaggctgcactaggattcaattaacccagtgctcacaacctgtttggtccagagaaagtcgtttttattgctaggaaggaaagagcctcttctcgaaggcagaattcctccagtttatatcaatcacctacgaagtgagcttattcaatttactgactcaaactcaattcatattactaagtgcttaactaactaattctcaaactacaaaccgtaaaagcactactgggggcgggtgggggaggcagggcaggggtgagcctccccaaaaggagctaagcaaaattagagcttttcttaaccacctggttaaaacgaaaatattgatcttggcagacatgttaagtgcacgtttcgttccccgccccttctcccaaaagtgcctccaaataaaaaactagtttcttcagagaaccaagcatctaatcatcactcagaggtctgaacatccagcatcctaagaacaaagtgtccacaggttcccaccagaacaaaccagttcaatgcattgctcggaggaaaaagcaagttaactcaagcacacaattacctgtagttgcatattatacgtaagtgtactctttcctgctcacgcctggctacctgcctactctaacacaacaacttccgtttttaaagtgtcaacttgtttacttggaggagccgccgcctgccggacacagcacgtttgggagcctctctttccactgtaggctcgtaactgcagactactcccgaacaacaagaccacggcggctgctccatcattttgccagcttctatgtttccatattttaacaatgttgggaaaactaaatcacatgttaagaccaagcaattgatcagttcgttgcagaggctgcttgaggaactttctgcagcctggacctgaggcttctcaatctaataaacctcagacaggacaaccagacgggggtgtccccataggaaagagaacccgactctggtggagtgtcccacctcttaggggctgtgactccgcgccttatgaaaaggcactttcaacgggcaggctggagaagagtcctctctaacaggaaaaataactccaagtccgcagtgtttaggaaaaagaaccaagtgcttggggaaggctggctgcccgcggagaggcgctgcgtccggagcgctggcccaggggaggcggcgcgggccctacctgcgttcctgagcttcttgttccgatacaccgacaggatgaccaggaggttgcccaggatgtccaccacgatggtgaagatgaggacgcaggccagggcggacgccagccacgagggccgcgcgccgtccccgcggagcacgggctgggaggcgttgggcagcgcgctgccgttgccctgcatggtccctgtgcgcgtcccggccgcggggccatcgcccgcctcgtccgcccgcccgaccacttgttaaggctccgcccggcgctccccgcgcccacgccccatcccgcgcgctcctccacgccgcgcccccggacgcccacgccgcgccggacgccacggccaggtgacacctggtgtccgccgcgagcccgcttggattccccgcccgcagctcgaaccccgcaccacgggccgacagcgccccggtgcgggaagccgggcccagccgccgcgccctggggacggtgtcccagaggcctctcctcgtgggcgcacggcgaggccgttcattgtgtttcctctctgggatgggacttttcacccagcagggccaggctgcctgggatcaaatgcgaaatgggattggggcgagttcaccagctgtgtgccccaccgcccttatcttccttatctgcaaaatgggaataagatactatctcacctgttagcctcataattagtaaaatgtgaaaaaaccaaggactgtcttccgttgtgtattgcaccgcttaagatggtgctagatgtttccgataatgaaatgacattttcaaagaaaaaagtaaaactcaatatttgcagatgataaaaatgtatgtacttctgtaagtaccagtaaaaatgagaaagaaagcacacttaggtggatcggatacatggcagcaatgtaaaagtgctaggaaatggcctaaccagttgtgtgcagtgaggaaaaaactttatgaaaaccatgaaaggaaatttaaataaacggagagacaaacagtgttcctagcttcgaagcctgaaattttcattttcctcatatactttatgccagaccaagaaaaatatcaaataacctaaagtttctttgaaagagtaaaaagaaagtgtaggaaaaggatttgaataagatgaataggagagaagtatgacctaccagtatcaaaatgttcattaaaaattacaattaagtggcgcctgggattacaggcacggtggctcacgcctgcaatcccagcactttgggaggccgaggtgggcggattacctgaggtcaggagttcaagaccagcctagccaacatggtgaaaccccgtctctactaaaaatacaaaaattagccgggcgtggtggcacaggcctataatcccagctattcgggaggctgaggcaggagaattgcttgagcccgggaggcggagattgcagtgagccgagatcgtgccactgcactccagtctggcagacagagcaagactctgtctcaaaaaaaaaaaaaaaaaaattacaataagtatgccaggcacggctgctcacacctgtaaccccagcactttggaaggctgaggcaggtggatcacctgaggtcaggagtttgaggctggcctggccaacatggtgaaacctcgtctctactaaaaacacaaaaattagccaagtattgtggtgggcgcctgtaatctcaggagcctgaggcaggagaatcgcttgaacccgggaggcagagattgtagtgagctgagatcacgccactgcgctccagcctgggccaaaaagaatgagactccgtttcaaaaaaaaaaaaaaaactaaaacagtattgagctcataaacaatttgaaaaagcatataaaataaagattttataaagtgaacagttcaaatcagtagggctgggatagatcacgaaaacaaaaatgcatttaaagaaaatgtaggtaaatatacatatcacttgaggtagagaagcactctgtaagcctggaaaaaagacagacaggaaataatcctaaccatagaaaaggtagcagctgccatggacagcgtgtgtcacttcccatctctggcatcggtatcttacaaccattgtttgcacaatgtgttaacaattccagaaggtctggcactgctgcgaccattttatggacgagaaacctctggtgctgagaggttaagcaatgtaccaaagtcacacagctggtaacaagtagaggcaggattggaactcaggtctctctgactgccaagcaaggagcctcattactaagtgatagtgtttctcggtcgtgatagatttgactacggaaaagttaaaagtcctatattcaaaaaataccacacacaagtgaaagctagagaaactggggaaatgatttgtgacatagctaagagacgaagcattaatggtcttcattattgttatggtttcagcatgtccccagaatttgtgtgtggaaaatttggtccccaggggaaggcggggccttcaagaggcgatcaggtcaagagggttataccactctgtctgactgggttaattctgcaggcatgagtcagttcttgctctcctgggactggattagttacagtgagagtgggttttaaaaaattaccactccagcctgggagacagagagagactctgcttcagaaaaaaaaaaaaaaaattatccagtcccaggtattgctgtattctgtaatagtgatggaaaacagactaagacaattatataaagagctaaggaaaaaaaatagaaatatatttaaaggtcataattagacaaaaactaaaaatgtatgtgtaacctcttttagcaaaaaagttaaaaaaaagagaaagcttccattccagcgatcactttagaaaacattatattggtagtgccaagtgtggtttgaaacacgtggagaaaaagcattcctgtgcaccagatatggacgtcttcaaactgcatacatggtgctagtcgttttactaatagaaaacaattgaacagtgtccacatgtgtcaggacacaccgttatttctccctgcattgtttgtcacaggtaaaactcctatacttggggttttgatacacaaatttgtgaaatcaacagatgaaatacaaaggcatagatggctaactctcccccaaaaggggtggcatacataatgctggggtgcacataacaacattcatgatctttcttccctggggaatgagaaaggtgaagctgggaaaccacgagcactgaaaatgatggtgaaatcctggaaaacaaagacccagagagggaatgcccagactctgactgccagcatccctgaacccagcacgtgaggaatagacccaaaggaagcaactggagcaaaaggcctgaactgaggctggagctgccacacaagaaaacagttccagttccagcctagccaagaacactgcctactgagacaaagaaaactcaacagagaaaaataatagcatctagaatacccacagtgtaagattcgtatgtccatggtacattcaaaattatttaacgtatgaaaacattgtctgtctatctatctatctatctatctatctatctatctatctatctatctacctatctatctatcatctatctaaacacattctttaagatacaataagatcaatcaaatccagtccctaaatgagcaaaatgttgtaactaacaatctcagcaaagaaataggaactcccatgaaagaaataaaaacagtaaaaaagaacgaaggggaaattctagaactgaaaaatacaatttctgaaattaattctttactcaatggacttactagccaaatggacatgacagagtaagtatacttaaagataaaccaacagaaattgtccaacacagagaaaagatatattttaaaatgaacaaagcttacaattcttatagattatattaattagaatactagctgtagaaataaaatggtgcagaaaaaatattagaagacatcatgattgaaattttcctgaattttaggaaagacgtaaatttgtacatgcaaaatgaatactaagcagaataaacaaaaacaagcatactaaggcacagcatagtcaaactgctaaaagccaaagataaaaagcaattaaagtcaagttacatattacgtactggttagcaattaatccaactaacagctgatttctcatcagaaactgtgctaattttctattactgtcataacaaattaccttaattaaattaatttggagacttaaaacaacatccatgtattatgtcacagttaaacagaccagaagtccaggtacaaagtggctcagctgagccctctgcttagggtcttatgaggataaaaccacaaagaagtagagctgtttctttctggaggttctcagggtaaatccacttctgagctcattcaagttgctggcagaatccagtttcatatggttgtaaggttgaggtcattctcagcttctagaggttggctgcattccttgactcatggtcccttctctcatctttgaagccaacaatggtgggcagagtcccactcacacttcaaatttctctaactttatcttctgctttatctcctctgctgttagctggagaaagttctctattttaagggcatgtggatttagactgggcccaactagacaacccaggctaatttttctatctgaaagtccatagccttaattatatctgaaagtcccttttgccattggtcttacccctcattgtgttgctataacagaagaccacagactgggtaatttacaaagaaaaggaatgtatttcttacagctctggaggctgggcaatccaagatcaaggggctgcaccttgtgaaagccttctcgttgtgtaatcccatggtggatgaaatacccaagaccgagtaatttataaggaaaagaggttgaattggctcacggtttcacaggctgtacaggaggcatggctgcttctgctcgacttctaggtaagtcttgggagacttacaatcagggtggaaagcgaaaggaagcaggaatatcttacatggccagagcaagaggaagagagagaggagggaggtgctacacacttataaacaaccagatcttgtgacaactctatcacaataacaaaaccaaagggagaaatccacctccatgatccaatgacctccctccaagaccacctccaacactggggattacaattcgacatgaaatttgggcagcgacacaaaagccaaccatatgaaagacacataaagcaaacagtaagcacaaaaaggccagagtggctatatcagtatcagatttaaaatggatcttgatgtaaaatagattttaaatcaaaatgtattaccagagataaagagagacacatcataacgatgaaagggtcaattcaacaggaaacaacaataattttaaaaattgtatgtactcaacaacatagctttcaaatacataaagcaaagatggccagaatataaggtagaaatagacaatttcacaatcataaatggaaattataacatccctgccctagcaatgatagaaaactagacaaaaagtcagtagacatagaagatctgagcaatgctatcaacaagcgtgacttttcaattgtacatggaatatttaccaggaagaaacatatgccgggctataaaaaaaaaatgcctcaataaaaatttttaaatgggccagatatgttggttcatgcccataagcccagtactttgggaggccaatgttagaggattgcttgaggctaggagtttaagagcagcctgggcaacatgacatagtgagaccctgtctctacaaaaaataaaaataaaaaattttcaatagaaatcaggctagacacggtggatcatatctgtaattccaacaccttgagaggccaaggtgggaggattgcttgagcccaggggttcaagattagcctgggcaacatagggagacccatccccgtctctacaaaaaaaatttaaaaattagccaggcagtgtgttttgcacctgtagtcctgggtactcaggaggttgagggaggattgcttgagcccaggaggttgaggctgtgtgagctaggattgcaccactgcactccagcctgggtgacagagtgagaccctgtctgaagaaaaaagaaaagaaaagaaaagaaaagaaagaaattataatagagaatatagtctctgactacatggaattaaattagaaataataaagatgtgataaccagaaaaatccaaaccatttggaaattaaacaacacacttctaaataattgttgtgtcagagaataaatgcaacagatattagaaaatatcttgataatattctgttattgaaatgataatgatagtaatcatggaacgataatgaaaatgccgcatgtccaactgtgcaggatgcaatctctctctctctctctccctccctctccatgtttgtgcccacagtgtggctgaggggctgatgctggcagaacgagtgttaagaggtcatacagaagtggcctttaaaatttgctttagggggtaaaaataatggagagtctgttggatttttcttggtttttaaatttgcagccaaaactgtaagacaagagatcatatttaacatccccgaggaacatgatctaggaagtacattattatctgtaattaattagagatcattttgtcactgtaaggaatctataagagcatgagttaattatttcaccaaaatgttctgcttcccagggagttggtaatggttggctaacctggaacaaccctgtttatgcttcagcccaggtttcctatccccttggcctgatgtgtaatacctattatccttggttctttgcacttccaaataacttctttttaaattcagcctgtcaagtttcataaaacccccatttggaattttgattgatattgcataacacataaattaatttgacatgttcaaaataatgagttaaaatgtcaattttgaatgtagattcttaattttcttgtaattcttttggtgtttgtttcacataagacaatgttatggagtaaaaataaatttagaattattatgtcttccggtgattttaaacatatcattttgtagcatccctctttatttgtaataagactttttgtcttacagtctattttgtcagaggcataaatgtagctgcatcagtcttcctctttttttttttttttttttttttgagacagagttttgctcttgttgcccaagctggagtacagtggcgccatctcagctcactgcaacctccgcctcttgggttcaaggattctcctgccccagccttctgagtagctgggattacaagctcctgccaccacgcctggctaatttttgtatttttagtagagagtgggtttcaccatgttagccaggctggtctcgaacccctgacctcaggtgatctgcccacctcggcctcccaaagtgctgggattacaggcatgaaccaccacgcccggcctcttccttttgctttatatttgtctgattatctctccttcctactttttattcccaaatgtctgtctctaatgttttgggtgagtttcatgtaaatagcatacagcttctttatctctactttatctgaatatcttttaactagagactttagctcctttacattttttgtgactactaaggtactgaaacttatttctaacatctaattttgggctttttattgatccctttattgtgtttccctcctcctcatccttcatgtttttcttcttaattcattgtttttctgtacatttcacttttccttttacctaaagtatcatcacagtgcatctattgataataaactctttaaaaaatttctatgtgaatgaatacatattgatttcacccatgtttttgaatgacagcttagctgagtatagaattctaaattgctcggtgtggcggctcatgcctgtaataccagcactttgggaggctgaggcgggcagattacttgaggtcaggagttcgagaccagcctggccaacatggtgaaaccccgtctctactaaaaatacaaaaattagctgggcgtgatggtgggggcctgtaatcccaggtactggggaggctgaggcaggagaattgcttgaaccctggaggcggagtttgcagtaaaccaagaccttcccactgtgccccagcctgagcaacagaacgagactccatctcaaaaaaaaaaaaaaaagaattctgagttgacagttactattttctcagcacttacagaatattattggattactccctcagggattctattgctctatggaaaatcagctgacagtctgattgtcatggcttcaaaggtgatccggttttccctcttgttacttgcaagattttttttcttattctttagtgtcctattgtttcacaagcctctaagtgtacattttgtcttttatttatgtgctgcttctacaaaacactccatactatcacctagcagggattatttttatgtaaatgtcttgggttgaaggttcctcagcatgcaaataaaataaatgtggaactcttgccactcagaaattcagagaagacgtttctgagttttttatttacctccgttcaaaactgaaacaagcaaatttccttggctaggcagatttcccccactaaccaagcccccctcaccaggtccattttttcactgtgtgtggctatttgaggatgctggccttgggaacgcggcagagggcgaggacttggttccagctgtctgcatcaccgtggactgactcaccccctagttgcacacgggcactaaaactcaggtcccttgcttcctttgagggacaagctcctcaggcttatcacaggctcagctctcgtatttcaatttattctttgttttaggctcctggaaaatgttctttttattttatttttttttttgaggcggagtctcgctctgccgcccaggctggagtgcagtggcgcgatctcggctctctgcaagctccgcctcccgggttcacgccattctcctgcctcagcctcccgagtagctgggactgcaggtgcccgccaccacgcccggctaaattttttgcatttttagtagagacggggtttcaccgtgttagccaggatggtctcgatctcctgaccttgtgatccacccatctcagcctcccaaagtgctgggattacaggcgtgagccaccgcgcccggccaaaatgttcttactttcttgtgcgtgcaggtgtgcattcctcaccccagtacttccgacaatgttataggatgagaatttgcagtctataaaatccagcttttgctagagacaggattaacattttaaaaacttattataaaactctataatcgtaaatatttgctaacttactaaaatctcactaccctactgtttaagtacttttaatttttttatttttttagagacagggtctcactctatcgcctaggctggagtgcagtggtgggatcacagctcactgcagcctcggactcccaggctcaagcgattctcctgcctcagcctcgcaagtagctgtaagtacctgcttttaatcataaacttcgaaggtgtgaaggtcatactgtctcttgttgctatctttatatagtttctctatctctaaatattgatagtaaatctattaatttatttttacttttcttttcttttttattgagacggagtttctcatcacccaggctggaatgcagtggtgcgatctcagctcacagcaacctccgcctcctgggttcaagcgattctcctgcctcagcctcctgagtagctgagattacaggcgcccaccaccatgcctggctaattttcgtatttttagtagagatggggtttcaccatgttggccaggctggtcttgaactcctgacctcaggcgatccgcccacctctgcctcccaaagtgctaggattacaggcgtacgccactgtgcccggtctactttttttttttcttttcttttctatttttgagacagggtcttgctctgtcactcaggctgaagtgtggtcgtgtaatcacagctcactgcagcctcaacctcctgggctcaagtgatcctcctgcctcagcctcccaagtacctgagggtacacatatgcatcaccatccccagctaatttgtgtatttttttgcagagatagggctttgccatctt
